United States Patent 10,233,495 (METHODS AND COMPOSITIONS FOR SCREENING AND TREATING DEVELOPMENTAL DISORDERS) - sequence listing, part 197

SEQ ID NO: 1364 - DNA, 1126110 bp, Homo sapiens
gagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaaggtgctgtttttgccaccacagtcttcctgagagccactcactgaatttctcgcccttagtagcccagggtgtcctgtacctgttagaagagttgggagaccttccaaggcctcatacttagtaaccactcagtacattttggatggagggttgctttttatgttaagacagcacaacaaattgcttcaaccctcctttcaaataatgggtttcctaaataagccctcaatctttcagaaagccgtcccaataaattcaacggaggaacgttaggagactagggaaagacctctgccattggactttaaggagctgaagctcagaatacccaacccacgatcctgttcgatggtccagttaatgcttaaatgcttagttttgatagcattatcttcctgagtagttccaagtttgactacttaataataaatactaatagtatagttgcttttttttcttgagcaaataaataatgatctggtgagctacacagctcagagatattaggaataaagcagatggtgattagcgatttttatcggaagtaccagaaaaattgaataacaatgtgtggataattaggtccactatttcttgtgtaaggctttagaacttctttcctctagttatatagattaattcctactagggagacggggagggttcatgagaaaaagacatgtaactcctttattcagggaggtaagaaagagatgattatctgttcagttcttaaagataccaaggaaactccaaaatctgccaaatcttatttgtttgtccaactgtaatcctctccaggtttaattcaagatttcagaaatccagcaatgattcatttcgtgagctttgacaagccgattaacctgtcctgactcaggctcagtacacatccacactacagagagctttgaagaatttagctgaaagattaaagaaaatatgtagtattttattgggtgcaaaaacgacttttacaggaatagaaatttgaatcgcttgaaatgaatttgaaagaaatatatgggtgctttagtgtcataaatgaggttttatactgttttcgtagatgtaacaggcagtcttttccagtgatattcctctttaacaacgattttcataattcttcctaagcttatctatatccagtgcccttgctactgaatggtaaccaggcatcttgtaattttgtttgcattaaaattatttccgtgaacacatagtttaattgttaacatgagattgacacaatgaggtaactttttgcaaacatctttgtgaaataaatggtaggagtctaacataacacaactttcagcaatgaaaatcaggtttacttaatgtgcagggagatcactgagtcacacctgccaagatgtagcagtttgcaaacctgtcttacaaagactttttcaaataatcacacttatttgaactttaacacatataagcaactgtaactttttaggattttactaaccgttgtgtgaattatccaacccatttgcttttcttctttctttggttgactgactgctattttgtattttaaccaaatggtagtcaggggatacacagttaaacatttaaccagtttattttgctatattccatgctgagggaagaggtttagtcatttcaactctcagttgaaatgaagtttgaggattacttgtgaataccaattattcctgtatccctgggcactcttcacatggttaattaagagttgcctgtgtaatgttgtttgacattgtttcttaaggcaattatgatagttgccaaagtgagacttcctttggtttaaagtctttgctttcaggtaatttaattgagctatcatggtgggtaaataaaagttataatatgcacagatgaatcagaaatctgatgtcctctgcttcgcacatatactcaatcacttctaatctactgcatttggcctggatttcccttatttatcactcaacagatgctcctagtacattagacaatgagctatcaatatcgagcaagactttgaaagaagttgacttgaattctttaggaaatctcccacttttctgcttttaaatactcaattatgaagagtatgaatagactaatgtccaaaccagaaacagccaggatccatcttgtgggggacattaatgaaggtcccatgtcctttataatggtttacacactgggttcaggaaaaagagttcttaccctgcaacaccctttccctgtaatctcctagctgtaacagtgccacctatttctcttctaaggaacccagaatatcattgcttttatgttttagacttcaacaaggtgagatacaaatatacattgttcttagctattgtcagaacactaagaaattgagttatggagtatatgaatcctctctagaacccatcattagaaaaatacttgcagcattataaactataaggtgagattttagctatgtgatagatatgtaaagggtcaagtaggtatctccagaacctagaaagaaggttgattgtcttttgtgaatgaatgaatcccttattagaaatcaacacaacttgggtgaggttttcaactgtagtagtgaggaagggctgcctattaatgtatggctgcagacatttgggactgcctagttccaattggaaggccagcatgaatttgtactaagaaagctaagggttaattgactttgttgttccttgtctaaagagactttgttcaaggaatagtaaatgaatacatggaccctaggaaagtggagcttcaaggtattgtttttgttacatacctccctcaatatggacatctggctcctctagcttttgattatttcctctctctgggcattctaatactaaggatttggctttttagatggtaggtgtaagtttactggccaatgaaaaaggctccccaacccccagcagcaatttctgagagttcagtaagtttaagccagttctgtgaagctaatcagctctgaatggagtcccaaagtcaactctttctgaaactccaaaattaaggactctagaccctgaaatatgaggatcacactagactgatgcccttatctgagatactgaggactgtaattgaagtagcaagcctgtagataaatatcttaacttctaccatgctacctttaaaaaaaattattatttttttagagatgaggtattgctctgctacccaggcttgagtacagtggcatgatcatagctcactgcaacttcaaattcctgggctcgagcaatcttcccacctcagcttcctgagtagcggggactgcagatgtgcggcaccatacccagctaattttgtttgtttgtttttgtttttggtagagacgggggtctcactctgctattcagattggtctcgaactcctgtgctcaaggcatcctactgccttggcctcccaaagtgctgggattacagacatgagccactgtaccaggctgctgtcttcttaagtaacagttctatctagtctttcattgccatagtaatgttgactgataactttaattaaaattgaagttttccttattttattttattttttgagacggagtctcgctctgtctcccaggctggagtgtagtggcacgatctcggctcactgcaagctctgcctcccggattcgtgccattctgctgccccagcctcccgagtagctgggactacaggcatctgccaccacacctggctaatttttttttttttgtattttcagtagagacggggtttcactgtgttagccaggatggtctcgatctcctgacttcgtgatccatccgcctcagcctcccaaagtgctgggattacaggtgtgagccaccgcacctgtcctttcctttttttaaatttactgtatggtttttaactttttttttttttaaagctaaacattgtagttgagtaagtaaaacatttagaaaggtggatgcatagatttctttttcttttttaaaactaacattctcttagatacatgtgttaaccactttttcttctgttataaaatggtacttctctgaaatgtttgtagtattataattgttctgaaccctaaagtgtatttcttatcactggaacttaatttgtgcatgggttcttagatattagaacatacataccccgtgtatattcaaatgaaaaggatacacaacctgcatatagacagactaagaactatgttactaaatccagagtgttgatatttacttgtgtaaaagtcataggctatttggagagaaaaaaaatgtgttttgctctgtgtcctttagtcaggcgttaatgtgcatatgactcacctggggagctttaaataaatattctaattcaataagtctggcaagggggctgagattctgcattgctaagaagcttcctggtgctgcggttgctgctggtctaaggactgtaattgaagtagcaaggctgtagataaatatcttaatctctagcctttatattttcagatagaaatatcacatgtggagtccatatctttggatctcctggcttagaagttggaaagacttataccaccagctgccatgagcactgagtcttacatgctgaacaaaagttattttccagttatgaaggtagaagatatgcaacagctatgtaggacaggggtggccagtacatttccactcttgccaattctgttgaattggtagtggctccctggtataggatattaataagaattctgagtcctcatgaagactgtgtggtaaaaactgcagggagcaattggcaaaagggaatgtgaccacaagcatgccagctaccttccatttttgtctgtattattcagttaacttatttaaactggccttcctaagaaagggaccaagactatgatatttgctatttacagtatttttatttcaacttaataagtaaaatgttgatcatggaagatccaggctagattttagattgagtctgtgtacgttggctctgcagtgatggcaaggattacaaaatgatttctgtctatagtagctttgggaaatcatgtaaaatataattagctatatgtttcactccagttcttcataaagatgctgctactgctggcagtaaacactacctacaaatgcagcagtggaagagaccagtgtgtaaggtactttgctgctcacatctgaaaattattcattggtttctggctctggtccatttgcagaatgttatttgtctccccctcataccaattggcacctcaagctctgcgccattaggccaaccaaaatgtctcaccgaggtttctggcagttgtgttctctgtagtactgtgatgggcttagggctccctggcagtttcagtgtgggtgttacattttcccattttctgaaaagatcgagaatatcaggatctggtgcaggctctgctagtgcagaaactatgagatagttcacccatggtgactaaataccaggaaactaattcatgctatgaaactcacgagtgctactaaattccttccagagcaaatgcagatttgggaggaatgggagcctcagtctgtgtctaggttatgactagaaatacagaacctggcctggacttggatggtactgtgggctgtggcttcagggcagggagaaaaggggagccatggacactaccccaggcaagaacaatctagaaaacaaggcacagtattaagtgtcaagtcaaggccaagtgtgcagataggtaagaaccagatatgaggggaacagacagggcagaaaaaaattttggaactgaaattcaccagtgttcttcgaaggaatactaggcagttagagggaagggagttttgtgagggctcaaaggcagcttgacattaagaaactggatttaggccagaatgctagcttattatttcagtgaaagaataactttgcatgagaactgtgattagcttaattgtatggatgtttcctggagagtaggatcacctaagagattaaattacagatgagaaagttgctccgtgaaagtagaaccagagtgtacagagttttatcattcttgacgaattaaccttttctactctggcaagattgttatccaaaacaatgctttccaaagtttttcacatacagtactccatcacatcctacttcactctgccttttttaccgtcccaagggccaaggggattgatatctctacactgcactattctttttatgagaacccaagaatgtcatttctctcaggctttggaaccagatattcctggatatctgttgagaaactcatctgttttcattgggtcgatacagagatggtatctgattccatgtccctttttaccctggttactgggaagcttagagtcaaatctgggggttatttttgaccaatcttatgagacctatggtatctgctgcatcttaatcatatttctataatgctatttccttttctcctccaatttccacattcattaattgttacattttgtatagtgtgtgtatttgcaaactgtagcagaatcactttaggatcagtttgtgcacctgtccctactgccagctagctagccaggtaaacagatgcgtacaaacataagtgtcaaagtacatttatgtctttaataacattgtgacatttaaactgagttgcctttgggaaattttaaatataaattatattgtggatacataaaaatcaatcaaagtatgtatcttcctagtttgattgttttgtccactacctgacgtattgtcccatcagtctcttgcccttggttagatttcgttttgagtctgtagcctgtagctcttttctacttctctttcctctgggggtcttcaaattgagctatttatgtgatttgatttacctgttattaatataacacttgaaagtttttggaaaaaaataggtgagttcattacctaggatattggtaaaaaagttgtgtattcctattgtgtcactgtagaaacagtactatgtagcagcaaatttatggcatttgtatctcaggaatttatctttgtcattcacagctgtgtgatcttgggcaaatcttttaatctctgattcagtttcttcatttttaatttagagatgggtatatctgtgctgtttgacctcactgggttgtgtgagaataaatatagttttggtccatgtgaaaatacttttaagctttataaaatggtagttatgtactctcttaatcttttttgattgtgggaaagtaatacatttaggtgataaaaagccattgtctagaatatttgctgggtaggagtatgtaagtgttgattgatattttctatgcttcgaggacaaatcactttttttctactctatattgccatgtgacatcttcctcatataatcttatcagcggttggcttatttacaactttaaagtctatccagaagcttttagagtatttacttctttttgaaattattatgatgtgaacatggtgaaggatggcattgcttttctggagacatacaaatgaccgcttacaaaattactttctaggagctgtctctcagaaggggtcatgctttttcatagaaaagaggctgacttcctctagctgaaccttcggaaattttatctcattatataaaactatcagaggccgggtgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaacaaaaaaaaacaaaactatcagaaagatataaatctataactggagggaaatttaaaatgtcttttatttattcattttaacatatgggggaacagaggcatgagaaatttaaaagatttttttttccatagatactcatctctttccagagtgagaaaagaaatgacaacaaacacttgtatatcatttactataagccaggcactaatctaaatgctttacatatattgactcttaacattcttatagtatggaaggaagccagtctctaaaataaaatgacaccctgatatggtttggctctgtgtccccaccctaatctcaccttgaattgtaataatccgtatgtgtcaagggcaggaccttgtagaggtaattggatcatagggccagtttcccccatgctgctcttgtgataatgagtgagtatcgcaagatctcatggttttgtaagtgtctggcatttccactgcttgcacccattctctctttcatggtgccctgtgaagaagtgccttccgccatgattgtaagtttcctgaggtatcctcagccatgcagaactatgagtcaattaaacctcttttccttataaattacccagtcttgggtatttcttcatagcagcatgagaatgaactaatacgcatccagtgagccccacctcctaatattcatgctcttgtgtaatcctcacacactgagtagacgtgacccatgtaaccagtgggatattgaagaaatgatgtgtgacttctgatgtttggttagaaaagctattgtggcatccacattgttttcttggactgcttattctgggggtagttagcccaccatatcttgaggatgctcaagcagcctgtggagagacccacatggggaagaactgaggtcttctgggaaactagtacattgtcagtgagctgccatggaaatggatcctgttgcctcatctcagccttcagatgactctaattctcctgttattttgactatgacatgagagacccccaagtcagattctaccagataaaccactactgagcccttgacccagagaaactacaatataataaatgcttattgttcctttttcagcgttattgagttgtaattgacaacattacatatattctaggtgtacaacatattttgatttacatatacattgtgaaatgattaccacacccaagctaattaacctatttacctcatatagttaccttttcacttttatattacttgtggtgagaatatttaagatctactctctttacaaatttcaagtgacactccattattattagccatagttactgtgctatacattaggtctccataaattcttcatcttataactgaatgtttgtgcaacgttgatgaacatccccccattttccctaccctctattcattggtaactccccttctaatgtctgtttctgtagagttggaattttttttagattccacatataagtgagactatgcagtatttgtctttctgtatctaacatttcacttagcatgaccttcaggttcagtatctggagtagggtgttaaataagaagtaacagagtagctttgaaactggggattagggagatgttggaaatactttgttagtgaaagataaaatacctcgaacagattgctagtagaagccttatgatctttaaagaggctgatggcaaggaattagagagtgaggcaaatactattagaatctgttctacagtaatagataattaataaaggaggtattttactccttgtagtatttaatatggatgaattaaggttatggaatagactgcaagtatgcaactatttttttgtttaatcatttaactagctatttttgagcctaattacttttcactatgttattaggagaggcacttattcatgttttacaataaaatactgaccttttgacagatacctggtatctgaggattggtcataatggaatggggcttaagtgtccctgcaagggatagggataagacatacaggatgattacttgtgatggagcttagtagcagtaataaatttataggtttagatctctgtggaaaataattggcaaacactttatgtatttatgtagcacagaaaacccacacagaacatggagaggcaatataatatggtgaaacctaaacatctgggctcttttaggtcctagctgtggaaccttatgcctctgattcttgatttgtaaaatagagttatagttccagcctcataggcaggatgaggatgaaattagttaatacatggaaaacacttagaacagttcctgtctcctattaaatactgtgtaagtgttatctgttcttgttataagcaacagaagttgttatataccctttcagctaatgcttggtaaacaatgccagagacattttataatcagcagcaaaatgaaaactaggctaatcttatctttgattttcataaccattaccatgcattaaagtgtttaattcacacattttaaacttggcataaccgagtcagtgtaatcgaaaaaaatgtaaacctaacaataataacaacaacaacaacaagcattgctggtgtgtgctgtgatttaacataaaatattgtcttgaagttttcatatgtaattagagtaacttatagtttttgaaagtcttaaagcagttctcttagaattattttatgttagaatcatttccattgatatttaatttcttcagtatttatgaaattttgaattatgattgctatatactttatattcacttaaaaattaagttatctttcctataaagataatttaaaaatggagatacatggaaaagtaaaatttaaattttactgataaaagcattgatatgtgtttttttcttaaatattggcgtgcatttgttttgttcattcacaatactttaaaccaaataaagtcacattttattcatgtactgtgaatagttaactcaggagctctggaaaattcattgtggtttaagatgaatttgaaaaagttactgttttttcttacctgtttctaattcacgctaccttatgatattatgtatattttcacaagccttcatagaatcaagtttgaaatcattagatagatagtaaacagtcaaaagacagatagcaatgtaggttttcatggatttgagttgtgaaaaataatgaagtattttatttttaaatatctagatttataggctatatggggaagacaaattttttaaagattaaattatatatatttaccaacttcctggtgagatagttgaatccaatactatatttgaaggtcaaatcaatttttgtgcaataattttattctatattttttgagattaaaacttgacaagatattcagaggtcaccataactgaagcatctgaagatgactatgaatatgaagaggtaacatgttaattttaggtgtttattctgtaaatttattgcagtcattctcatgaaatgctcattttattttctgaaacatgtaagaaccattcttttttcttaagagataccagtttttcaactgaatttagctagtatcagctgattaagaatgagatgtgaaaattctgtttaaacatttaaattggaaaatacatctgattcttttgattttcctgttaatcgtccttcaggttcagctccttattacctgccttgtagattcctaccataaactgttatctctgttcaggaggcacttccttcctgtcatccagtctgctcttgtcaaggattcctagattcccactgctcagttgaagcggaggccttatgcatccttccagcttaacagtatttctatctaatgtggttcctatctcaaagctttcctttaattcattgttcccgagacctatcattacttcggacacttggaggataaaatcactggtagatgacagaggctgtgaatgaaactgtgtggaaataagcctggcgagcctgggtgagcaagagacaggatgaaaattggagacaggctttttattactggtaaaatggagattatgtgtaccacatgaagttcctgaatgagttaataaatgtaaaaggcctaaaccagtgatcagtacataagaagcgtgtgttaagtcttaactgtcattaatcataattgcaatccatcacgtcctttcaagattttaatgctcagtgagttttattttttaataaacgagagattttcagttgctagtagttctgaaaaagtgatggtggaaagcacttgagatggggcaagaatggtgatatttagatagccttattattttttcagcagaattgttagattacattttctattatagataaaagcagttgcccacaaactaatcctgaatttattagaagtgacgtttattgacatttacaaggaagtcagaagaaagcagttattcatttttcatggatcttcagaatgacatggtattttacataaagtatttctttgatcctttgatttgtgaagcaaaattatttctgaagtgaaataaagtattttatatttctgctcactcttcctatccttctctttctctgtgatctagataccagatgacaattttagcatcccagaaggtgaagaagatctggcaaaagcaattcagatggcccaagaacaggctacagatactgaaattttggtgagaatttgaacactagtgtagtctatagtttagtggtagtgctttttatatgaagtttggaaagtcttttaaatgtaaatactagtgtagctcagtcatctgttatatcattttcatctctgtttatttgtgatcaagccttcactttaaggtaagcagtcatatttactcttttttggattgccattctccacatcatggtcactcttgcatgactttgtatcaagtgacaccttctctctgaactctgattaatctcactggaggataaaccaataattttcaacatttatgtttagaatttagtgtcatatacaagttctacagtctgttttgtaaacattttgtgtttttttacatgaaagtattaatcttacagggaatgcttaatatggctttcttgtgaggcttatgaactaattatgttaaggaatgtggtgggggatgttttttgattataatacaatgaactaaaagtgcataaaactgatggcattcctctaaaattgaaaactcattaaaattgtgaaccatttaatatgatggcaaaaatatttttaaaaatgttttattttgtaccaacattaagaagcatgctttctttcagtgtttaacccctttactacagagaaatgtgaaggaatttgtgaaactcctttttggttgcagatttgccttcctcagtgtggaattgtatgtgagactttactgcatattataccatatcattctttccatattctgtagacttcttcaatgtagaagtccaataactccttttcaaaatgtctgtccactcaaaattggaataaaagctctagaggaagattttttcaggccagaattaattgcattctgttgtaaatggagggctgcagctcatagtaaatgacattctctaatgaatcccatggacatagcttcttcttggtagacacaaagtgaaatctattccatagacttagtctgttggatatctcaaagcaataatttgtaggaatagttttaaaatgtatgaatagcattttcagtgacatgcaactgatatgtttattcatttatcatcatcctcttgctttacatcactaaggattttgacaaattctttatgtaccactcatttgtatcggtatttggtaaagtacatgtggctaatacagtgcttggcacatagttggcactaaataaatagcagttaaataagagaatggataagtggatcattgaatgaaaaaactgaacaaaactgtaattgcttccttctgctatcatggtcgaaagtgtttgtaatgcaaagataaatcagaggaaagttgaggaagaaatacattgtagtagctgttgtatctactgagccaaatatcagtaattcttcttttatcaatttattggaagcttttctttatcataaccttacatgagttaacattcttgatttctggcatgtctgtagctgattgactctcatttagcttctttttacctcattttaaaaaattctttggaggaacagtattatgctgaaaattcacagaagttgtccttaagctgttaaatatggattcattttatcataagcatattagttatattttttaatttgctttttatttctaaagtatgttaatcttcagtaatttgaattgtgctatgggctttctcttttaaagaatacttattgcttgttaaatccattttttgttctgatcttatatatattcataaacaagatatattttcttctctgttaaaggatacagtaatctctatgcacagaactcttaaaattttcattgaagattgcaagtaaatggttatgatactattaggaaagttaagttgaaataatgtaaattatcttatttgttaaaatattaacaaaaaatgacttattgcgacttattgaatagttgacatttaaatacattcttgttcttatgatttccttttttttttttttgagacggagtctcactctgtcgcccaggctggagtccagtggcgcaatcttggctcactgcaagctctgcttcccaagtagctgggactacaggcacctgccaccacaccgagctaattttttttttttttgtatttttagtagagacggggtttcaccatgttagccaggttggtctcgatctcctgacctcgtgatccacctgcctcagcctcccaaagtgctgggattacaggtgtgagccaccacactgggccaagttcttatgatttcctttaaatgtgggtagtatagattaaatatttgagaattgattgcatggtttgctttataaattttaaattgtgtatttgatactatccgttttcttagtgggttcaatgatctgaattctgaattaaataattttcattatatttaaagttattcttgaaaaatattgagaagataggaaatgttattaatctataacagttatgtagtttgattatactatcagtagtttcttgaaatttaagtattttacaggtatgaatacaagtaaaggtaggattatatatatgttcgttagattgtgtctgtgtgtctgtatgtattacttagggatatttgtatgtaaatatatgaaaagaaaggtctacttacattgaagctgggtctccccttctaaattctgagcctttttataagtgtatttttgccatttttttggataattcttcagcctctttggttattgatagtttattctgttaattttcaaggtacaatctcagaggtcttttatactgctgtaattacgtaatgacttctaatttttataaatgtagaattttgatctttaaatatgacagtagcaagacacccaagtcatataattgttcaattccctgatgcttttcctcctcctgctaccccttttcctcctctttcttctcccttccctcctcctccttttcttcctcttcctcctgagaatttaagtagaatttatggaatttctttggaataattaactatttttggagaagactaattgatgactgacccaagcgagaatgttctttaccatatgtatcaatagttctcaaagtattgtgggagatcttttggggtccccaagaccccttttagggaatttatgttgtctttcattttccaactacacacctgctggaggattctcctcatgtagctcaactgagacaacatatcacaacaggtcaaatgcagaaaaaaatatggggatctagctgttcctctaaatactaaaaagatttgtaaaaatttgtaacagtgtcactcttctcattagttctttttctgttttggaaaatgtagttagtttttattaaaaaaattctgtctatgttatctgtgtagaagttttgctatagttattttaaagtaaataaatgaatattttaaaatttaatatccaatatataattcttgataggtataactcagataaataagtgctgtctggagtactcaataatttttaatagtataaagtgttgcgagaacataaagtttgagacattttatagaattctattctcagaaattttcaaatatgttaagaattaatataaaaaagttctcttgctattatgttaatataccaaaatatagtctaggattaataaatatgtattccttttatttagatcttaatctcacgagggattaatattaggttggtgcaaaagtaattgtggctataccattacttttaacggaaaaaaacgcaattacttttgcatcaacctataccattatgttaactctcacatcataatgctaatggattaaattcttaaacaattttcattacttttagactcaattactagtctcaagaaaaagagctgtttgtcattattgaattcccattctctccatgtacacacttaattttagttagagacccaggctccttgtactcaaagccatgtctacagattatccaagccaatatatttgacttaatgtgaattaaggagttgatgaaatgaagccccaaataaagtaacatttaagttttaagaccacttggatttcattgtttatttttttgtttctcactggtcaactaaagttgtcaaaggaactcacattaaaacagttcaaaatttgtcaagatacttaattttaatatgtggtttagcacttctttgcaattcaacatttaattagttcttaagtctggaaagttttatgtcctcaacatctttcatatccttctctttaccttcatcctcacttagtctaccttaaagctaccctctttcttttctcatctgagctacagcatgctgctggtactatgcttccttctattcccacctaaaagatgtgtctaatgcaaatttcagtttatctcccctctacgtaaattcccaatgtgtctacccttccacctgcctttgccttcttgatatgcttcctgtttagtttttccactttatctttggccctttctccgtaagaccctgagccttaatggattgaattgtcactccttgtttttgcctcagatgttttcttgccttgaatattggtttatctttctttatctgttgtatttcctcatcgtctgtaacgttcaacctaatagtctccttaacatagccttcattcacatatctaaggcaagggaaatattcttctccattgtgtatcacttcacctagcagatttctattgttgcaatcataacacaatatagaatcctgtctacttagaaaatgtcaactttagaatgttcatagacaaaatgaagctatgtgctagagctaccattgtttgtcctcaacagatttctgggtcacatgtggctagagtaatttttgatcattcagcagtctgcaaagtgagaccatgtttcgctagtttgtagattgcttgcttttttgtgcttattctgtggtgttttgttaacctcataattaagttagttaaaagccgtaatgagagttgtatataatgtataatagggataaaagtgtaacttaaatttcttaagtatacataatggttgcatgtatgatatctgtggatacctgagtaggattttgtaatcaaaatttgtaacaaaagagcttctgtattataatgttttgtttttgctaaatgaaccgttcagttcctcaagacagaactgtcttcttcatgtttaattcccagcacctttcatggtacctggtacatgggagatgttcaccaattatatgttgaataaatatcctacgtaaaggtaaaagagatattcatgatcacattagagcttggaaggggtgtgtgtgtgtgtgtgtgtgtgtgtgtgtgtgtgtgttgtgtataaatgcagaagaactataaattgaggtatatttacaagcttatacattttattgtacagtataaataagaaccaacacagtttaaggtggtcgtatttcttttctgtgggaatgcttcaaggtgtgtgcatggtgcacattcaggaagacacagaatgcaaacatttatttgaaagggcaggaatctgccaggtgtgttgcaaccgtacatacaacaaacatcctttaacctgcccataagtgtctttagaaatgagaatagatacaccctcctgctgtctgtcttccttttcctgttttccaagttccttccaacaatcagcctaaaatatcattttcaaatttattgaccaaaaaaactgaggtagcatttattgttgtataatgaatgttcacttccaactatattttgccctgaccttacaattatatataatttcctgtgctagtaaccagcacactgcaaagacttgaaggcagacatcttgtactctgctagtttggtatctcccatgacatttgaattggcatcctgtacttcttatgtaatgtctttttaataatctttggaagaatagtccagttttttttttaatttttaatttttgaggatacatactaggtacatatatttatcgggtacataagatattttgatacaggtgtacaatgtgcaataatcacagggtaaatggggttctatcaactcaagcatttatatttctttatattacaaacaatccaattatactcattaatttaaaaattactataaattattgttgaatgtagtcactctcgtgctatcaaatactagatcttactcattctgactatatttttgtacccattaaccatcccctctcccctccccagcctctggtaattattgctctagactctgccttcgtgagttcaattgttttactttctagcccccacaaataagtgagaacatgtgaagtttgtctttctgtgcctgacttattccacttacataatgatgtccaggcccatccatgttgttggaaatgacaggatctcattctttttgatggctgaatagtactttattacataaatgtagcacatttcctttctgcactcacctgttgatggatacttaggttgcctccaaatcttagttattgtgaatagtgctgagataaacacaatagtgcagatatattttcgatatactgatttcctttcttttgagtatattcctggtagtaggattgctgaatcatattaaataactcttacttttagtttttttggggaacatctaacctgttctttatagtggttgtactaatttacatttccactaatggtgtacgagggttactttttctccacatccttgccagcattcattattggctatctttcagataaaagccattttaactggggtgagatgatagctcattgtagttttgattggcatttttctgatgatcaatgatattgagcacctttttatttaactgtttgccatttgtatatcttcttttgagaaatgtctattctgatcttttgcccattttaaaattactttttttctttagagttgtttgagctccttatatattctgattattaatcccttttcagatggatagtttgcatatattttctcccattctatgggtagtcccttcacattattgattgtttcctttgctgtgcaaaactttttaactgatgtgatcccatttgtctattacttgtcttggatgcctgtgcttgtgaagtattgctcaagaaatttttgcccagaccagtgtcctgaagagtttcttttgggagttttctcttagaaggtccacggtttgagggtgtaaatttaagtctttaatccattttgatttgattttgtgtatgacaagggataggggtctagtttgattcttctggatatggatatccagttttcccatcaccattcatcgaagacactgtcttttcccctaatgtatgttcttgatacctttgtcgaaaatgagttcactgtagacgtatggatgtgtttctgtgtgctctgttctgttggtctatgtatctgtttttatactagtaccatactgttttgtttactatagctctgtagtataatttgatgtcacataatgtgattcgtgcagtttccttcttgttcaggatagctttggctaatgtgggacttttttggttccatataaattgtaggattattttttctgtttctatgaagaatgtcattggcattttattttgttggggattccactgaatttgtaaattgctttggatagtattgacattttggcagtattgattcttctaatccatgaacatggactatcttttcattttgttgtttctttttcgatttctttcatcagtattttatagctttcattgtagagagatctcacttgattggttaagttaacttctaggtatattatttgtaactatttgtaaatgtgttttctttcttgatatctttaccagattgttaactgtcagcatatagaaatactactgattttgatatgttgatttcatattctgcagctttactgactttatcagtccttttggtgaataggtttttttcgagtataacatcatagcatttgcaaacaaggataatttgacttcttcctttctgatttggatgccctttatttccttcccttgtcagattgctctacctaggacttccagtactatgttgaataatagtggtgacgatgggcatccttgttatgtttcagatcttggaggaaaggctttcaggttttccccattcagtgtgatactacctgtgggtctgtcatatatggcgtttactgtgttgaggtatgtttcttctatctccatgttttttgagggtttctatcatgaagggatgttgaattttatcaaatgcttttttcagcatgaattgaaaggataatatgatttttgatcttcattcttttgttatgatgtatcacattgatagatttgcataagttgaaccatccttgcattccaaggatgaatcccacttggtcatgatgatgacctttttaatgtgttgttgaattaaattggctaatacggtgttgaggattttgcatctatgttcatcaggaatattggccttttaacatgtctttgtctggccttgatatcagggtaatactggcctcatagaatgagttttgaagtactcccttttcttgtgatttttagaaaagtttgagtagggttggaattagttcctttttaaaatgttttatacaattcagcagtgaagccattgtgtccagagctttcctttgctgggagcctttttattatggcatcaatcttgttattggtctgtttggcttttggatttcttcatgttacaatcttggtaggttgtatgtgtccaggaatttatccatttcttctaggctttccaatttactggcacgtagttgctcattgtagcctccaatgatcctttaaaatttctttggtattggttgtgatgtcccctttttcctcttgattatatttatttgagtctactttaaaaaaatttttttttggctaatgttttgtcaattttgtttatcttttgaaaaaaccaacatttgttttattgatctattgtattgttttgttcatttgaatttcatttatttctgctctgatgttcattatttttctttcctctttactcttctctcctcaagtggaaggaaggagtctctcggggttaggggaggtgtggcacaagcactcacttggctgccctggctggtatctcactaagtcatgtgctcctaatgtccactggctctgagcccagcatagcatcataacttgccaaagaattacagtccatgtggtgtagactgcctttcaagtttatttagtaccccagaaccctttagcccgtggtggtgaggctttctggaactcaggttctgactgctgggatgggcaagtcccctcttgctagggctggttgaaatgctccctctgggtgatggctgagttctgcctggtgttgctttctgccatgatgatgcagcactattttcgaatgtaaaaaattccataattactacagtctccctcccacaggacagagattttctctccatgccacttggccactgccaggggatgggggaggtgtggtgtcagcaactcaagactgtcttttctgccttcttcagtgcctctttcagcaatatgaagttaaagcctggtattgtgattactcacttgatttttggttcttatgaagttgcctttttgtgtgaatagttcttcagtttggtgttcctgcagggttaatgatcagaggtgtctattcagccatcttgaactgcctccttccaaattattctttttgaactttacaaaagtaattttacactctacccctttgtcaggatttttctgtagccccaaaatttgcctcaactcaccactattgtgaatgtcatagcagctatcagtaataaacatcagtgttgaattttgtttttttttattttttttactttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaataatgcagcaataaacatagcagcatgatttatagtccttttggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgtcgaattttgtatagcacttttggaaagaatttttggggcagcaaagatcctctttcctcattggatttccatgtaaacattctgtgcattctgtgtaacctgttgtataaccattaacagcttgggaaagagaaggcgaaaggaaaatttgctgctgagtttctgtaggtgagaatagatctgcttattcaaatagtcagcaaacaaattagagacttcttgccaatgcgaagaaaatgacagcactcaagagacgatgattgttttatttttttaattttatttttattgagcaacacttcattccataaaatagaattagtattccctattccttggtatttttaaaaaactaccaattattttatttattttgtacactgacttacatgatataataatttttatggctgtactaatttcatttgttgcttgctgaaatgtcttcatttttctagttttaggtctgctaagatgttctgtcagaatactacatacagtttgagtatcttttatccaaaatgcttgggaccatagtatttcagattttggattttttttcagatgttggaatatttgcaaatacatatcaatgataatgatattttgaaaatatgatttagtgttattcaagtgcaaagcttgaggatagccacctgggaaacacagtctccaaaagaatgagtgagtgttccatagtggggaagttttcacttatataggcagaaacagaagttaacagggttgcaacattttccatacaaggtcattacatagtttgtaatgatttgattgattacagcttgctacattccaaggaagattgctttgacattctgcaaggaagggcagtgttctaaagtggtcttatatctggtggtattccgtgttttgtaatcatttttaggacagtaatgaagacatttaatctataattgaagaagcagaagttgcagcttcatgctatgtggctcaggccacatagtcccgttcctctcaagccttaacaaatataaagttccaaaagctataggtttggattatttagtttgacatatacactaagatctcttggggctgggacccagttataaacatgaaattcatttatgttccatatacaccttgtacacacagcctgaaggtaattttatacaatattttaaataattttgtatatgaaacaaagtttgtgttaagtacttgcatgtggaattttttacctgtggtatcatgttggtgcttcagaatttttggctattggagcatttcagattttggattttcggattagggattgctcaacttgtactttaggttttgagggccatgaggactctgtggcaactagtcaactatctcatgtagtgcaaatgcatccatacataatatgtaaacaaatgggcatgggcatgctgtgctctaacaaactttatttataagaactgttagctgacccctgatctagttgatagactgactgacttccatgtggaatactagtgtaagctcctgttgtcactaattattttctccatagtgtttctaaaagtcatggtactaaaattactgtatttctttttaaatgataattaaaagcattaaaaggtccatgcattctttttttcttttttttgattaacatgctatgtgctattgaaagggcaaacctaccttcttactatcctttagacaatccaatcacactcctgctgcagggcctttgcacttgctgatgcagatacaaaccggaacataagacactctgcctctttgtctagatttatgctcagataacagttttatcaatgacatcttcaccaccctaaatacgtagcaacccagcttcacataaatacttgtcctacacttggttctatctttagtcctctactttctccccaccccaaggtacttagtaccatctgtcatagtatatgttttttatttagttattcatattctgtctccatccacttgactaatagataggaggacagagatttgtttgctttcatctgctttatccccagtaattaaaatattaatggttcctggcatataacagtcaacaaacattgttgaaaaaaaatgaatggatgaatgaatgagtcgaaggcttatctatatcattaattaatgctttgatgttttcagaataaataaatgcacgtttaaatttcaggaacggaaaacagttcttccttcaaagcatgcagtacctgaagtaatagaagactttctctgcaatttcttgatcaaaatgggaatgaccagaactcttgattgctttcagtctgaatggtaaacaattatgtagataaatagttctcttaaaattctaacatttaacatatacacttttaagtgtcttaggagactttgaaatgactcagcctatgaaaaatgactagaaacttttcccatctccagccctgaaaccacaacacacacacacacacacacacacacacacacacacacacacacacacacacacaaatcagaatagcagttacaaagacatttttattaaacatctttcccaaatatttaagtttaagtaatttttaaaaaatcaagacacttgaatatctcctggagttataaaacacaaagatattttatgaaaacatttcctaatatttttgtataattattgagagtatttcctgtatttagacattatactaaacagtcctgctttacttccttgttttatttatagtgtaatggcttgtctttttctactcacatagctgattaattatatttctatgaatattcttcagttagaagtaagtggaattgtattttgaatatcacttaaacaaaatattttcttgttataattgaaaattttaataactagttatgaaaatcagtaggtgtacctttattcctttgttataataataatgtcaccaggcatattttcagtttcctgacattgtttaaataaatttattaaatgattagctatgaaaatgtatttgaactttaatagctattgcatattctagaaagggggattaatatgatacctaaagatgtttataattaggactaattcctaattttaaataaatttgcaatgtatggataatttgcgatttttactcatccagctgtggtataaatttttattttttgctttttttggttctcatcttctgagaacatgcacataagcgcagtcagtttcattattttaaattgcacatgtaatgttaataaattctatgaggagaattatttttcattaatacagtctaagaaaaacaaagttcagtggaagaaaaataatactgcttctcttaaatttggaaatagtgtgaattatttaaaataattttttataaaaatatccctaagaaatataataattacaaatgtactagaaaatatattttttgtaaaagtaggtagatgattaatttacagtgctaataaagtgaaagattaatatgattcacttaactttctgtgttcaacaatgtgtgttaggacatgtgatgcttatatgttaggccagtccaaagtgtaaaatgattttcttagaataatctggatccaagtatactgttaacaattcggtgactattgtcatattttccttttagatttagcaatctgaattgatgagatgaaattttaggaaactaagattactgttagtattaggatttaaagtcctcccaaactaagcatactagtcataagataaaattggtataacgcatttctttatgagtttagaatatcgtggttcaagtaattttatccttatccctagctgccagtttgcaatgagattacattgtattgaataccttatttcatatgaaacattttttattttgattagaaaactttacctattctacatagtaaaattataggaatattaaatatattattttttatcatttttaccacaggaaaaaacacttagaatatatcatttgctatgaattcacttaatctttcaaaacatgaccaaacaaggattttcctttgttagtttgttaaaataagcaaacaaacaaaacactgggcagtaaaatttgatataggttctttcactcctcaagcagaaaatgcaatagatcctttaaatcgagggttagaaaactaagatccttgggccaaatctggcctgcttcctgatttttaaaataaaatcttattggaacacagatataacctttctttaggtattgtatatggctgctttcactctgtaaaagcaaagttaattagtcacaacaggagagatatggcctgtaaatatagttttgccaattctaaaatatttattctctgaccctttacagaaaagagttgccagaacatagtaggaatttgttctatgaaccactgaaaagtttccattgcaggtttagtcgatggttcaattctatttatatgcctattttagaattctcaatgggcaatggtaatttctcaggggggaaaaattaaagaagaaattaaaatggagaaaatatgataatctaattccagtacccttacctgagcatatgtcatccatctgtcttcctacactgactgttcccctattaacattgtcagaactactcaccctaaagatacattcttactttttttgcctcttactacacttctttttaaaccatttttccctttccagccaatattttgaaaacagagtttaaattttttttctttcttcacctttttacttcgtattcaacacttagttctctccagtttggcctattcgcaccatttcactgaaggtagggtggcaatgaaaatgccatcaaaagtaatagtacaattatttataacatttaattactaatttaattttttttaataatggaagagattgtaaattaagagtatatttcattaatttgcatgaaagaaatattgcagcttttagacaataaaatttgtcataacatttaatcacttaaatgtgagcagtgcagttacaactttctggggatggttaagttttaaagccagagcctagaattaaaattacctttgatatagcccttatgttgcccaagtatgtacaggaaatatgtgtggtgttgtgtatacattaatgactcccagtgaacactacacaaatatttgttcctttgtcatttgatcttactgctgtttcttcaattaatgagaacttggcttctagttatatgtcccataagaatattttttccccattcattattaagtttaacacaggaatgtagtgactcttctacataacataaaagttagcaaaagctaatttttgctatgttacattatgatacatttgaccactataaatacatctgcacagatttatgtactatgatattaagagagcagccatttaggtgagtatttaatttaaatttttaaaacaaaattaataacatgtttattaaatatgagggatttaaaaatatttaagaaggtgaagccttaggcttatcactcagaaatttactttgtatcatttttattgatatagtatattctcatgcattatttcatttacttctcccaacaactgtatctagcaggtagccacagccatatttctattttacgggtaaggaaaggggatagggagattaggaaatctcatcagtgagtgtcaccaagtcatagccagtaagtggcagagtcaacctaggacatactgatcttaaagaccagtctcctaaccacagggctatattgtgcaattatacaagagaatctttgaaaaaattaataaaggtgccttttggcttggctggatactaaaaggacttcagaaaatattaatttagaattcaaatttgtgcctattttctatattggtttgaggaatcttggggccagtaataaacatgtcagccatgctatatttttcctgagagggactgtctggttctaagtgatagtcgcgatagtgctggggattctgacatcctcggtttgtacaggaattaaaataattttgtctgtgttggtaatgtatttccctaaatctttatgaaaacatggaggaaaagttctcattataggcttcgtataaggagattataatcaagatgacctttcccctgtcttttacatcctatgccttgggtgccaccatgagggaaaaataatccttattcttctgacaccatttctgtttttactggaattctgtcataatattcatcatttatggcagtgggtcttaaatgcttttgttatgtggacaaaattttatgaaatttctatgcactttctccctgaaattcatatatattctccatttctacataattctaagtagttgatggatctcctggtaaatattaagataattaatgcagttttattagtgataattttattggcaatttcattaagagcaaattatatttcaaatttctaatagttatggcaatcttttttcccacctgaacacttttgagtcttattttaagagtgagtgaaaaagaagaaaaaataaaaagtcaggatatttgttaaaacaaaacaaaacaacagatacatacaaactgaagcaaaccacaaaaacattatgtatgagaattcagattttattgagaagtatacttctgtagtttgtgcattaaaattcctaattacttgtattattatctaaaaatgagcctgaagtcatctttcatatttttacatggatggcagaaaatttacctgataaataatttttgaatgtcctgagatatatactatgtaataaatgttgtatttggatttgtgcttcttttatcacatactattttatttatagtatttaatttagaggaaaaactattaaatcacttttttcctcatagaaaatttctctagtggtttttcctcattaaataaagcaaggtgctgaaaaccaattttatggtcagaaaaagcctatgtcttctcttctgagataagtatatcacattcctagtacagattacttactgaatttatgattcaattgatacctatttcctgttttatgaattgtggcaaatataatggaatattgattcaattatcttaatcttcaggatattctatgggggggtcctcttgctctttttttagaaaaaatcagataaagtatataacacaaaatatgtgactttataaatatgtaacattattatgatttataatatgaaactactgataatttataattagctctaatatttagctcatctagagtaagctttgtagggatttattaataaccttattacttgaaatatttttctgtgctcaaattgttttttttaactttattgattgccatacacagggattaaaattgtaattatttacaatctgcaattgattctctgatgttgcttcttatttgactgagaaaatagaagttccatcactcccacctccctctttaccaccctgctgcctctggcctcaggtattcttctcttctccctcagactctaatgttatctgaagccaactctcatcttgtctgcttgataccagcccctctcacagacttaaggatactgcttttgtaatcgtcccgcttttacctccattgtcagttttttccctcttggctgagtcattcccataagcatacagatgcacaatatctcacattttaaaaaaggaagagaagaaccgccctagatttcatatcttcttctaagttcatcttgattccctgtgctttgctttagagcatatctccttgaaaaaagtttgttgccacttcctcatttcctagtctctcagacgtactctcagtttggcttttatctgcatgactctattgaaaacttttttttttttaatagtgactttcacagtgccaacttcagtaattgattctcagtattcttttcagactcctggcagcattcgtcactgttgttcagttcttcctttttagaacactttcttcatttggcccctgggcacagctctcagattctcccactatttcacgggcctctcttgcttcgtcttttttggtagtgttttcttttcccctcaacctggaagcagtgtagtgtttatggctcactcctaggacctcttcatttctttctttctttactttcatttcccactgcctagctggtctttttcagtctcatgactttaaatagtatctataatgttgattaccaaatttaaattgccaaccctgacttttttcctgaactctgaacatgtatactcaacgtttgtcttcacttaaatgtctgctaggcatattacatttaacacgaatggaaacaatcccttgattactccagccactctgctcctcctgcatttgtccccacttagtaaataaatggctatctgttgctcagccaaaaaccctggagtcgcacttgccttctctcatttaccaacacctgacagttgatccatcagagagtcctgctggccccaccttgacagcatttctagaaggtacttctcataatctccactgctaccaacttctttcaagccaccatgctctctctttgactactgcaatagcctgctaactggtctctctgattctatgcttgctagactaatccctttaaaacataaatctggtcagtgtcacttatctcaaaaccttcctatggtttacttctgattcagagtaaaattgctttcctcactgtgactccctgctgttttcctgactcatctttcaccattctctccttggtcacttagttggcttcagttccagacactccaggtaccctggctgtttgttctttcttgtagttgccaaacacttccttggttcagggccattgcatttacttttccatctgccccagctgcttctctcccagctatccacataacacagtccctcatttcctttagatctctgttcagatatcactttgtcagtcatgtttgtcattcatgcccaccctatgtaaaatagcacaagcactcccatcagtgtttccacctcattcttcctatatctttcagacagcttatttaacttcatagaacttatcaccctccccactagaatggaaactccatgaaatagggacgtagacatttttgtcaattttaatattgtctagaccagtgcctggaacataggagatgttcagttattatattttatacaccatgatggtattggtacctagaagtcatattttattctaaaatatattatgactgttggacattttaacttataaatgtaatactgcaactaattactataacactccctgagacttaactttttgaattgtacataaattaagccaatttggcagaaagaaatgatataaacccttttgtttgattttatcctaggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaattctctatactgttttccatacaggttgaactaatttacattcccaccaaccatgtatgagtgttctcttttctgcacgttctcaccaacatctgttatttttgactttttaataatagctgttctgactggtgtaagatgatatctcattgtggttttgacttcagtccagcagttccactactgggtatctactcagttgtataaaaattccacccacactcttacgtttattgcagtgctattgatgataacaaagtcatggaatcaacgtaagtgtccatcagcagatgatgggataaaaaatgtgacatttatatacaatggaatactattcagccataaaaatgaatgaaatcaggccttttgcagcaacatgggtggaactcgaggccctcacccttagtgaaatgactcagaaacagaaagtcaaaaaccacatattctcacttataagtaggagctaagcaataagtacatatggacatatagaatggaataatagatactggagactttaaaaggtgggagagttggaggaaagcaagtatgggtaaaatgtccactacttgggtgattggtacaccagaaacccagacttcatcactatgcaatatatccatgtaaaacaactgcacttttaccccttaatctataaaaataaaaaattttaaaaaagaaaatataaactatccataatttcaccacccagggccaaccacttaccattttgttgaatagcagccttgactttcctcaatgcatttatattaatgcatatttatgagtaacttttaaatataaactgcactaataccatattttgtaagttcctttttcattcaagagtacattattaatatattttatgaaaataaattttcttctaacttaaaagaaaattactgaaaggaaacctttgttttgtaatttcctggcataaatttattcatagaagagaagccagatctctccacacctttctttctttctgcaattaatggaagacatgcaattcctggtgaacaattttagataaacagccagtgttattctgacaaggaatgtgtgaatgcattaacttggggtgaatctgcttatctgaggcaatgttatatggaaaaatcaatgctcagatgtgaagcagagttcgtgttttatttattaattcatttttattaaatatagttaaagagggcctttctcacttaaagaatcatattaaaaccaaaattagattaatggaactaccatataggaacataatattgttaagatttttgataagtttaaagaaacatgccttttcattgagaagtagagaaaatatttaagctcttgtaaaagatggcagtaaataatttgtatgatatcatttattcaagtattatctgtacttgtagaaatgtttttgcaaggtatataaattttgtattgtctatggatgtaatgtaccatttagaattttatattttacattagaagtgtatgatgattcagaagaatatattactagaaccagtgttctctctattcttcattccatttctcaaaagtgttttgtactgtttgccctgttgctcactatgattttgtatattcatctaatggattcactgggaatttggtatagcatatttctcacagtgctgcctggcacactgtttcagttcctgatctcctttgaattattgcttgagtttgctaattttcttttaaatagatcaaagcagcctctttatgccataagtttagctccagtgacattgaatagtcattgtcaagtactggttgtttgttgaatattatgtttaatagcaataatacgaaataacatattactcatgcagattattaacttaatgttaaaagaagccaggattaaaatgtatcactcaaataaaacatcttgtcttactaacatatcagattatagttttaattttaacagtttatggctatttctcaaatctatctcattcaatagaacttaaaatctaaaaaattagacaaggaaaatttgtgtttgctttactctacttgacatggaagatttgaaaggaagctgcttgatccttagtagatgcttaatctttattttgttgagtggatattaagcatggtgtgctttcacagcacattttagtaaagtgcttccttatagcctggttctactgatacattcttagaaaatgtagaatgaagttttgtttcgttttgtcagtagttttttattgatacatcataattgtacatacatttatatatgataattgtacatgtgatattttgatacatatgtatcaaatacatttgtacatatgataattgtacatgtgttattttgattacatacatacaatgtgtagtaatcaaatcagagtatttagggtatccatcacctcaaacatttatgattttttgtgtgtgttgggaacatttcaaatctaactattttgaaatagatgataaattattgttaactgtagtcacgctactgtgatattgaacactagaagttaacccttctatctaactgtttgtatccattaaccaatttctcttcatctcccctttccacccaacgttccccacatacttcccagcctctggtaattatcattctccctgctacctccatgagatcaactattttagcttccacatgagtaaggacacgcaatatttgtctttctgtacctggcttatttctcttaacataatcatctctagtttcatctatgttcctgcaaattataggatttcattctttttttaaaaatggcttaataacattccattgtgtatatgtgccacatttgatttatttattcttctgttgatgggtacttaggttgattccacattcttggctattgtgaatagtgctgcaattaagttttgaaaaaagttttccgaactacatctgtcatgctaccagcctgccccaaatggtagtgtttaatcatctaggtttttcaatttgacttctgaggataattttcaaatagcaattagtaataaacatgagattccctatattgagcttgagctaatgtttgtatttttaggattaggatatttcttaaggcaaaataaaacaggcaaaatagaataggatatttcttaaggcaaaataaaatagatatcaaatacttttctaataataatttttaatacacaaaaaagtcaggttgcagatatgtattattcttgattatactaatagcatttagtgatgtatctaggaaaatcaaataaataatacagctataaaattaatatttatctgggggaaagttgccatggaaagagtattgatcttaaagttcaaatacctggcttctaatattctgttacttattaactcagtttattgaattactcccagttttcttattaacctgggaattattttgcatagtgttattaatttctatggaataatgtgataattaaatgagtcaagctatgttaaagagctttgtaaatcacagagtgctttgaaatgtcagctattatcaataactctaaatgctgtcatctctaagtttttattaatcacatcattaatattttttaaattcagcaacgatgaagtatgaagaaggaaatgaaaggagaaaatatttcccactaaaatatcatttgaattgccataattaaagcagggaattgtcattttctctgttgtcaacagtgtcaattttagactataggttttctctgtacctgctataaatatagattatctgtcttccaaaatataaagttgggaaaataactgttgagaacatttctgtatagatgtttttatggagaaaatgatcttattaaaaatttatagttacattggaagtaaaagtatttcccatactggatattgaagaacaatatttttctcagaaaaggagagcatacgttttctattgaaatgtagaccaattgttattttaaatgcaaaagtctaaagttgcacttaaagcaggtgaccacagttgcagagatttggtggttgacaccaacatggcacatgtatacatatgtaactaacttgcactttgtgcacatgtaccctaaaacttaaagtataataaaaataaataaataaataaataaaaaaaagtaaaaaaaaaagattataaaacaccacttagaattgtatctttcacagtttagacactatattcattcataaaccttgttttatttggtagttgtcatgccaaaagatttactttggtctgaagtttataaataactattatgagttttattaattaaaacctttttgcttgatcttcttgcctgttttcactagcattttatgtcttctttccatagtgtagacaatgcaaaaaaaaaaaaaaaaaaaaaacaaaaaactcgtttgggtgattgattcctgaaagcaccagtgtacttgaactttaacatcttgcagtctgactttcatttcactttttctcagttggccttggacacaagagaactgtttgacacccaaatttagcagtcttttttttccatttgtatatcctggtttttattcctatcttcccttagcatctgtgacatcatactgttctgcccctccttctaccttagtgacaggcttcttttccttttcttaactccaaacagttgatactctttaagtacattaggataactattgactacatgtgaatattgacaaatacaacatatattaggtagtggtaagtgctatgaagaaaaataacatgggtaaaggagacagacggggtgctgttttatgtaggattggtaaggggtggggcagggagcaggggagcacatcagaaacctgaagagactgagggaaaaagccaagtataaacttgggaaaatggaattccaggcagaggaaaaaggaagtataaagaggatgtggtgaagacaggttggcttgttagaggattagcaaggaggctatagtggctctaaccagtgggttagtggtagaggcctttgctagaaacttgctttttcccccaggtggcatgtgaagctaatagtttgagcagaagcatgtgaacaggcttctgcatggaaaaatgctcaatgttactaattgtcaaggaaatccaaatcaaaagtaaacgagaaatcacctcatacttttcaggatggctattattagaaaaacacaaacaatatgtccggcgcggtggcttacgcctgtaatcccagcactgtgggaggccgaggcgggcagatcacaaggtcaggagatcaagaccatcctggctaacatggtgaaaccccgtctcttctaaaaaatacaaaaaattagccgggcatggtggtgggtgtctgtagtcccagctactcgggaggctgaggcaggagaatggtgtgaacccaggaggcggagcttgcagtgagccgagatcatgccactgcactccagcctaggcgacagagcaagactccgtctcaaaaaaaaaatagaaaaatacaaacaataacaagtgttgatgtaaatgtggaagaattggaacccttgcacattactggtgggaatgcaagtggtgcagccaccactgaaaaccgaataaaggttcctcaaaaaattaaaattcaaactaccatatgatcaagaaatcccactcctgggtatttatttgaagtgaattgaattgaaaccaggatctgaggcagatattagcactcctgtgttcattacagcattattcacaacagccaaattatagaaacaacctaaatgttcattgacagatgaatgggtaaaaaaaatatggtacattcatgcaatgcaatactactcatcctttaaaaagagggaaattctgtaatatgtgaggacatgcatgaaccttgaggacactatggtaagtgaaataagacagtcacagagggatgattactgcatgattccccatatatgaggtatttaatatggtaaaattcatagaatcagagtagaatggtggtttccaggggatgacaggagaggaagatagggcattacaaatcaaagggcataaagttttaggtaaacaaaaatcagtgctacagatttgttatatatcattgtactacaaccaacaatagtgtattgtacacttaaaaattcgttaagagggtagatctcatgttaccttcttaccatatactcaaagaaagtaaacagtatagactaatgaacctcatagacctataggataatcaacactctacttttgtcattcttatttcacttctactcttacccattccctactgtacctcaagttattataatatataatttttacagttattttttgttatgctttatatacattgaagtatatgtcttagctatataattttggcaaacggataaactcttaaacatccacattcatctcaaggtagaacatttttatctatccagaagttttcctcatgtcccttctcagtcattctctgtcccagcaatcacttttaagaattttttcactttagattagttttgtttgagaatttcataaatggaatcacagtatattattgtgtttggcatcttatactcagcataaagtctgtacaatgtattatttttgcctgtatcagtaatttgttcctctttattgctaagtagtattctgttgtataatgtatactacaacttttttatcctttttccatttagttatttccaacagttggttattaaagataaaactgctgtgaacattgaggtacaaatatttggtgggaatatgttttcatttcttataaaaacttagtggaatttctggatcaaggggatagatggatgtttaactctgtatgaactgctcgtacatattcccacattcaagttggtccattttgctttctcagtaggaatacatgcgaattccagttgctccaaacagctactaacattgagtgttgttagtcttttcagttgtagccattttaactgttgtgttgtggcatcttgtatttttgatatgcattttctgtatacaaatgatattaaacataattttttttgctttttgaccattctaaaaagcattctacaaagcatttatcctgctttctgtatgtttatgttttttgcttgctgatcttataattgaattgtaagagttgtttgtatattctggatataagtgctttgttagaatattgtgaatattttctcccagtctgtggcttgtgtctttaatttatgaatggtgtctttgttgagcagacactataaattttaatgaagcatatcttatcttttttatggtatttattttgacattttgttgaatatatcattttctactataggtcacagagatattctgtgttttcttctaaaacgcttaaaatatagatttttatttcaacataggatctgttcttaagttttgtgcattgtgtgaggtagaagctagaagttaattttctttactataggaatacataattgttctggcaccatttcttgagaaaattatctttaagtctcatttaatttctttggcacttttattgaaaatcagttgaccctttagaataagtttgccaatttccacagacacgggtgatgtaggtgtgacataggatggggattaagttgaaaatataacttgattttggaaaaatatgtgtgtgtgtgtgtgtgtgtgtgcatatctattttttgaggggggaaggattgatactgtcacaagttttagtcctatttacatagcatatctctccatttaagttatatttaatttaatactttatatttatgaaggagcttgaaatttatgcccttcatattgaattatctaatgtttatattttgttgttgcattttcagttccatataatagagactatgttttgtgttcactatacccacggggcctatctctgtgcctggtacatagaaggagcttaagtgattgtgtgctattaaacttttggctctttagttaagcttttaataatttttagagcagttaattggtgatttttgcccctttcatggcatttatttggggtaggcattattttcttgggaatgtaaccagtcttgccgtattttgagtattgtcttcctttgccaggcttttacagtaaggaaatataatgcagaccagaaaggctttgttgagagccctgaagaaaataatactgattgggattactaacaggaagatgaaaaactgccatttaaaaaataatgacatactttattttacaatctgccagagagtataggcataaagaaaaccataattacatggcaattaatattgaggaaaaattaaggtggtttactaaggggcctttatttcactttcaaaatttacttctataaaaggtcaaagagtgcccagcttttgtgaagacccatttagttttatgactttcagaaacaaacactgtgaaaataaagataataatgaggcttataaaatttcatgctttagtgtttaggtaattgcttgttaaattaagaaggtatttttttctggacgtgaatatacccctttcttttttggttaggatataatgaaagtttttctctaatctggttgaattccattttggccatccaacagttattccaatataaaatttagtgggttaaataaattcatttataaccaattgaagataatggaatatttgctaattatgtaactactattatcagaaattactttgattcaattttttcatgtgagaaaaatatatgacaaagatagcctacttcgatgcaggtaaacaagaaaatgtttatatgctttactttgccaaattataacaagataatccaataaactcattattaaatgatcattcaaaaatacttaaaactgttcagttaataaaattattttaccatggatattcacttcaaaatatttttgagcatactattaaataatattcatatcatattgaaaatggagttttggggcaataattttatagttcgataagaatatctgtaccttaatattgcataattgaattgtagactttgatatgctggtttcctgaaatggagaagttaaataatcattgtaccattttattaagacaaagcatgtgcaaattgttttctttatgatgtacacatttaaatagaatgttccactgagtaactcttaacagcgttgtacttgaaacaatgtctgtttgctgtgtttttttttttttaacacaaagatgctctactaatgtgatgaggaaatattatatagtttaaaatattagctgcttatatgaatattttaaactttattctttagtacaacttttattttccatttattaagcagatgggcagcaggaaggtcataataggagaagcaccaccatgaaatgaatttaaattgttctactgaatagacttcattgtgcaaacagaaagaaagtccctgaaaaccaatttaatggtcagaaaaactttaaggtctaatacttcagtcaattcctatgctttgtttcctgggacgagcacaaataggcttctaatgtatatttaaaaagtgaattgatgcaatgctgcacatttatggttctgcttaagaaattttgcagcgttatttcttaaagtatttttaacatgttgtgggtttacatttcacataagataaaaataagctcatttatgtaattcaagtgactgaaattaagacaatttagtatactcaaaatagacgttcacaaaattttaaattcattttttaaaagatacacagtgttactaatattcacatatcctaatatttttggttgattagaagatatttacttactggcacactccttattgtaggaagataaatttagcgcttagaagaattgtgtgtgtctgttttactatactgaatagcagtattatgaaatgatgatgatgattatgagtacagaaacatttattgagtaatttagtatttgctatgtgcaagactatgtaagccactttactaaaatatttaattgaatacgctttgaagctcattatatgtccattttggaggtgctaaatttgatatttacagaggttatatagcttgacaaggtcacattgcaatgaagaatttcctatattgaatatgatattattatcatattagcattactccaatgaagtaaccatatctgttagctgattataaagacataatactggatttttatctatggttctaaaacaaatatagtattattttttagataaactcattcaacttgacatgctttagagctaacttgttttgatagcccgctcaggatattctgtacaacttttttttaaaaatacagggttaaaatgaatgttctaagatcttattcattattctttttgcaaattatttgaagagattcattgatcctttttcaaaacaatttatctcttctacacacagcctttctctatacttctaattgaaaatggaatcattttctaaatgagaattcaagtgaggttcttgtgctttcacaataaagtatcaactcaatcatttacttattttccattcactttacttaaattctctcctcctcttcacttagtactcagtaaggatgatgccaaacagtctgccatctcagggagatggcagagagtttctctctttttagtccatattcactagggaggtcttgtgtacctgagccttaggaatgaggacttttcctgtctctttgtccatcctctgtgttatggccaaactctgccttctatctgtagttggtctttgtaggagtttcatactgctacctcaggagtaggatacttctacttgctgtgatggaatattaaggcctaagatggttacctgttgattggtttggctgtgtccccacccaaatctcatcttgaattcccacgtgttgagggagggacctggtgggaggtaattgaatcatgggggcaggtctttccaatgctgttctcctgatagggaataataagtctcacgagatctgatggttttagaaaggggagtttccctgcacaagctctccttttttttgcctgccaccatccatgtaagatgtggcttgctctttttgtcttgcaccatgatagtgaggcctccccagccaagtggaactgtaagtccattaaacctctttttcttcccagtctcaggtatgtctttatcagcagtgtgaaaatggattaatacagtaaattggtaccagtatagtgggcattgctgaaaagataccagaaaatgtgaaagtgactttagaactgggtaacaggcagaggttggaacagtttggagggctcagaagcagacaggaaaatttgggaaagtttggacctccctagagacttgttgaatggcgttgcccaaagtgctgataatgatatggacaaagaaatccaggctgagatgatctcagatggagatgaggaacttgttgggaactggagcaaaggtgactcttgttatgttttagcaaagagactggtgatattttgcccctgtcctagagatttgtggaactttgcacttgagagagatgatttaggttattatctggtggaagaaattgctaagcatcaaagcgttcaagaggtgacttgggtgctgttaaaggcattcagtttcaaaagggaaacagagcataaaagtttggaaaatttgcagcttgatgatgtggtagagaaggaaatcccattttctggggagaaattcaagccagctgcagaaatttgcataagtaatgaggagctgaatgttaatcaccaagacaatggggaaaatgtctccagggcatgtcagagacctttgcgacaacccctgccatcacaagcccagaggcttaggaggaaaaaatagttctatgggctgggcctagggtccctctgctgtgtgcattctagggacttggtgccttgcatctcagctactccagccatgactaaaaggggccaaggtacagctcaggctgttgcttcagaggatcgaaacccaaagccttggcagcttccatgtgatgttgagcctgcaggtgcatggaagtcaagaattgaggtgtgtggcctctgcctagattttaaaagatgtatggaaacgcctggatgcccaggcagaagtttgcggcaggggtggggctctcatggagaacctctgctaaggcagtgcggaagggaaatatggggtgggagcccccacacagagtccctactggagcattgcctagtggagctgtgagaagagggccactatccgttataccccagaatgatggatccaccgacagcttgcactgtgcacctggaaaagccacagacactaaacaccagcccatgaaagcacccaggagggagggtgtaccttgtaaagccacaggggtggagcttcccaagaccacaggagcctacctcttgtatcagcgtgacctggatgtgagacatggagtcaaaggagatcattttggagctttaagatttgactaccctgctggattttgcacttgcatggggcttgtagtccctttgtttgggccaatttctcccatttggaatggctgtatttacccaatgcctgtagccccgttgtatctaggaagtaactaacttgcttttgattttacaggctcataggtggaagggacttgctttgtctcagataagactttggactgtggacttttgagttaatgctgaaaagagttaagattttgggggactgttgggaaggcattattgtgttttgcaatgtaaaacatgagatttgagaggggccaggtgtgcaatatggttggcccacccaaatctcatcttgaattcccatgtgttgtgggagggacccagtgggaggtaattgaatcatgggggcaggtctttctcgtgctgttcttgtgacagcaaataatcctcatgagatttgatggttttaaaaaggggagtttacctgcacaagctcacttttttttgcctgctgccatccatgtaagatgtgtttgctcctccttgccttcctccatgattgtgaggcctcccctgccatgtggaactgttaagtccattaaacctctttttcttcccagtctcaagtatgtctatgcacagtgtgaaaatggactaatacacctctccatctatcaggggtagagagtttttcttttacttttccttcacctgcaaagtatctttgcctgtgcctgtgtgttgccctttccccaggggcctcagaagtaggcactggtttgtgccttttctgcagcatgcctgggtcctgaggcccccattccaggcctgagctcccacataacatttctagacactttctgggctaaaagggaccccactgccttgaagggaagaacctgatcttggcaggatttaccgtcataagaatgtcattatttaatgatagagcagtcagttcagcaagaggatataacaattgtaaatatatatgcacccaacactggagcacccagatatataaagcaaatattattagagctaaagagagggagagatcgcaatacagtaatagctggagtcttcaacatcccattttcagtattggacaggtattccagacagaaaatcaacaaacatcagacttaatctgcaccatagaacaaatggacttgatagatatttccattctcaatgatagactatatgttaggttacagaacaagttttaaaacattcaaaaattgaaataatatcaaacatcttctctgaccacgatggaataaaactataaatcaacaagaagaggaattttggaaaccatatgaacatgtagaaatttaacagtatgctcctgaatgaccagtggatcagtgaaggaattaagaagaaaactgaaaaatttcttggaacaaatgatagtggaaacacaacataccataatctatgggatacagtgaaagcagtactaagaggggaatttataggcacttacataagtgcctttttcttcaaaaaagaagaaaaacttcaaataaattacctaatgattcatcttaaaaagctagcaaagcaagagcaaacctaacccaagattagtataaaaaataaataaaaaggaacagaatagaaataaatgaatttgaaatgaagaaagcaatacaaaagtcaaggaaacaaaaaatgttattcttttgaaaagataaacaaaatcaacaagtccttaggcagattaaagcacaaaaaaggaaaagacccaaataagtaaaatcagatggaaaaggaaacattacaactgggattgcagaatttcaaaggatcatcagtagctactatgaccaactacatgccaataaattggaaaatctaggggaaatggataaattcctagttagatacaagctaccagaattaaaccatgaagaaatacaaaatatgaatagaccaataacaataaacaagattgaagctgtaatatgaagtctcccagtaaagaaaataacaggacctgatggcttcactgcttaatcgtgccaagcatttaaagaactaacaccagtgttactcaaacaattccgaaaaatacaggaagagggaatcttttccaaactcatttacaagacccatattaccctgatacccaaaccaaagacacatctaaaaataaaaccacaggccagtatctctgatgttgattcaaaaatcaacaaaaataccagccagcggaattcaacaatatattaaaaagataattcatcatgaccaagtgggaattattccagggatgcaaggatgattcaacatatgcaagttaatcagtgtgatacattacatcaaaagaatgaacaacaaaaaccatatgttcatttcaattcatgctgagaaaaatttaatacaattcaacatccctttatgataaaaactctcaaaaaatttggtatggaaggaacatacctgaacacaataaacactatatttgtcatgccaccgtgtcatactgaatagggaaaacttaaaatcctttcctctaagatctgaaacatgaaaaggatgcccattgtcaccactattattcaatgtagtagtggaagtccaagcaatcagacaagagaaggaaataaatggcatataattggaaaggaaaaagtcaaattatccttgtttgcagatgatatgatcttatatttggaaaaacctaaagtatccaccaaaaaaatgatgagaactgataaattcagcaaggtttcaaggtacaacatcaacatacaaaaatcagtagcatttctgtatactaacagtgaataatctgaaaaagaaattagaaagtaatccaacttacaatagccatggataaaattagataggaagtaacaagcaaataaatgaaatatctctacaatgaaaactataaaacactgatgaaagaaattgaagaggacacagcaacatggaaagacattacatgtttatgggttctaagaatcaatattgttaaaatgtccatactaccctaagcaacctacaaattcagtgtgacccctatcaaaatacccatgagattcttcacagaaatagaaaatacaatcctaaaatttatgtagaatcacaaaagatccagaataggcaaagctatcctaagcaaagagaacaaaaccggaggaatcacattacctgacttcaaattatactacagaaatatagtaaccaaaacaacatggtactgacataaaaccaaacacatagaccaatggaacagaatagagaaccagaaacaaaaccacatacctacagtgaacacatttttgacataagtgccaagaacatacactgtggaaaaggcagtctcttcaataaatggtgctgggaaaactggatatctatatgaagaagaatcaaactggaatactatgtctcatcatgtgcaaaaatcaaatcaaaatgaaattcctaagagaaaactaaaagaaactctcaatgacattggtctaggcagaaatttcttgagtaataccctacaagcacaggcatccaaagaaaataatggacaaatggcatcacatcaagttaaaaagcttctgcatagaaaagggaataatcaacaaagtgaagagacaaacccatagaatgggagaaaatatttgcaaacgactcatctgataagattaataaccagaatatataagaaactctataggaaaaaagtctaatactccaattaaaaaaatggacaaaaaatttgaacagacttttctctaaagacatacaaatggcaaacaggtatatgagaaggtgttcaacatcattgatcatcaggcaaatatcagtcaaaactatgatgagctgtcatctcaccccagttaaaatggcttttatccaaaagacaggtaataatgctggcgaggatatggagaaaagggaacccttgtacgctgttggtgggattgtaaattagtacaaccactgtgaagaacagttcgcagttcctcaaaaatctaaaaatagatctaccatatgatccagcaatcttactgctgggtgtatatacccaaaagaaaggaaatcagtatatcaaagagatatctgcactcccatgtttgttgcagcactgttcacaatagccaggatttgaaagcaacctaagtgtctatcagcagatgaatggataaaggaaatgtagtacatatatgtaatggagaactgttcaaccgtaaaaatgaatgagattctgtcatttgcaacatggtggaactgaaggtcgttatgttaagtgaaataacccaggcatggaaagacaaatttcacatgttctcatttatctgtggaatctagaaatcaaaacaattgaactaatggagatagagagtagaaggatggttgccagagactgggaagggtagtgtgtgtgtgtgggtgagccagggatggttaatgggtacagaaaaaattagaatgaataagacctagtatttgttagcacaatagggtcactgtagtcataacttaattgtacatttaaaaataaccgaaagtaaaattcgattttttgtaacaggataaatgcttgaggggatggatgctctattttccatgattattacacatgcatgcctgtttcaaaatatctcatatactccatgaatatatacatctactatgtacccacaaaaattttaaaaagtaataattaaaaattatattttcatttagcaatatagataaatggttaaaactagaagtttgtaatattttggaagagatgaaagcatgcaaataacaagacaattcaaaaaggttgtcacaaacataatgaactgttcccaaagaatctcataatgaacttgagaaaattacatccctatctacaatctaaaaattggaagatggacatgtattcctattttaaatacaggctttattgttgttgaaatgcaaaactgtcctaaattgcactatcttttttgttaaagtgagtatatgtaactgttacactaaaaaatacactatatatatttaaaggaaaataaccattaatttttgtttttacaacagagacatcttgaccagaagcaatacaataacaaattagaaaagataaaaagcacttcattcaatatcagtatctatattatttctcaatttatgttgtcagcttatgttatttgtcaaattatattcttgatatacgcaaatgggttaaaatcagaaaagaataaattgtttatctaatcattcatatattcctcagatgatttttcaagactgaatgttcgaatcaataatttcttgcacgtataagattgttggcatgaaaatgaggttgaggtttaggtggagaaagttcaccatgagtattgtgagtcacctgaacattgtttatttacgtgtaatgaaaactacaaaattggcagtaaaataacagtagaggtcatttttaaaaaaatagggtgtgctgggaggtggggagaaagaaacttagggggtgagagtagccaagtttaccaaatagaaacagctccactctgtggctcccaccaagaaggatgaaaacagccagtgaattctgaatcttcagttgaggtaccaagcttttctcattgggactgactaggtggttggcgcaacccagggagagcaaagaagagcatcgagggcccacccaagagctgtgtgggcaaaggaagctttctcccccagccaaaggaggcggtgagggattgtgctacccctccctgaaaaccttgcttttgtcatggatccttgcaacctgcggatcaggagttccccttgcgagcccacgccaccagggccttgggtcccaagcacagaactgtaaagacatggcagctgcttgggtggctggccatttcagcaggcaccaagacacagtatttgcatactccagctctgggaactcccatgaggcaggatatctgtccactcctgtgggaagggggctgaagccagggggccaagtggcctcacttccacagaaccccacaagctaaaacacactggcttggaatccctgccagccaacgcagcaggtcagagactgcctaggaagacttaattccgagggcaggagggttggccaccatcactgcggctccagttggccattgtcccctgctgtaggtgccagtgagactgggtggtctggactaggagcaattccccacagcgcagcacagcagctgtgtcagttcatggctagactgcttccttaagtagaacactgatccattttttctcactgggtgaggcctctctgtgggaatttcagcatccctagacaggagtttatgaacagaactttgatatccctgagaggagccactaggaggggcagctacggtatcatggatcagtggtctttgtcttttctgcctgctggctctggagagtcaggggagcccagatgagggtgcagcacacccgctccaccaaggggcagccagactgcttatttaagcaggtgcctgatcccactcctgctgactaggtgagacctcccaacaggagtccacagataactcatatgggagaattccaactggcatcaggttggtgcccctctgggacacagcttccagaggaaggagctggcttccatctgtgctggtctgtagcctctgctggtgatacctccaggggtgggagggacccaggcaaatagggtctagagtggacctccagcaaactgcaacatccctgtagaagagggggcctgactgctaaaagaaaaacagaaaacaacaacaacatcaatgaaaaggaccccacaaaaacccatccaaaggtcagcaacctcaaagatcaaaggtagataaactcatgacgatgagaaagaatcaacacaaaaatcctgaaaactcaaaaagccagagtgcctcttctcctccaaatgattgcaacatgtctccagcaaaggcacagaactgggctgaggctgagatggatgaattgacagaagtaggcttcagaagatgggtaataatgaacttcactgagctaaagaattatgttctaactcattgcaaagaagctaagaaccatgataaaacattacaggagctgtttaccaacataactagtatagagaggaatataaattacctgatcaagctgagaaacacaacacgagaacttcacagtgcaataacaagcatcaatagccaaagagacgaagcagaagaaagggtatcagagcttgaagactatcttgctgaaataagacaggcagacaagaggagagaaaaaaagaatgaaaaggaatgaaaaaaacctctgagaactgtgtgattatgttaaaaaaccaaacctatgactgataggagtatctgaaagagacggagagaatggaaccaagttggaaaacacacttcaggatatcatccagaatttcctcaacctagcaagacaggccagtgttcaaattcaggaaacccagacaaccctagtaagatactacatgagaagatcaagcaaaagacacataatcatcagattctccagggctgaaataaaggaaaaaatgttaagggcagccagagagaaagtccaggtcacctataaagggaagcccatcagactaacagtggatctctgcagaaaccctacaagccagaagatagtgggggccaatattcgacactcttaaaagaatttccaacctagagtttcatatctggtcaaactcagcttcataagtgaaggagaaataaaatctttttcagacaagcaaatgctgagggaattcatcaccaccaggcctgccttgcaagcactcctgaaggaagcactaaatatggaagggaaaaaccattaccagccactacaaaaacacactgaagtacacagaccagtgacaatatgaggcaactacgcaaacaagtctacaaaataaccagctagcatcatagtgacaggatcaaattgatacataaaatattaaccttaaatgtaaatggactaaatgccccaattaaaagatgcagagtggcaagctggatagaggcaagattcattggtgtgctgtattcaagagacctatctcacatgcaaagacacacatagacttaatcccattactgggtatatacccaaaggaatataaatcattctgttacaaagacacatgcatgtgtatgttcattgcagcactatttacgatcacaaagacatggaatcaacccagatgcccatcaatgatagactggataaagaaaatgtggcacatatacaccatgaaatactatgcagccataaaaaggaatgggaccatgtcctttgtagcgacatggatggagttggaagccattatcctcagcaaactaatgcagtaacagaaaaccaaacactgcatgttctcacttataagtgggagctgaacaatcaaaacacatggacacaggaaagggaaccacacacactggcgcctgtcagggggtggagtatgtggttgggggaggtggagcattaggaaaaatagcgaacgtatgctgcgcttaatagctaggtgatgggttgataggtgcagtaaaccaccgtggcacatgtttacctatgtaacaaaccttcacaacttgcacctgtgccccagaacttaaaaaaaaaaaaaagaaaagaagaaagaaacttggaagaatggatcagagaccttgcaccatatgcctcatgtaatttgatcttcatcaagaagtcgttaatcaacatatgcttcattgagagccttactttatctcataaacatctttggtagcatcccatacgctgatcctcagtgattgacttctgacaccgcttaaagcagaaatctgttcgtgtgcatttattttatgtgaatcaaaattttgaaataattgtgacccagagaagtagatttcttctgtttcaatcctaatatgaggtatcagtccatttttcagaatggaaatgtgacagtgtcaatgctgtagcactttgtcagttatctgaggctgagaactactttttcattataaattatatttcacattattgtattgaaactaatatattatggaggtaagtgaaacattctcattaaatgttcacatagaacctgggattagaaagaatcctttagcttgctttatgccagaggtttgcagaagatatatcaagttgaaaaatttttctgtattacagcactgatattgaagaccattctcatcaagctatgaattatgtagtaatcagatccactgatgatatatatttattttataccatgaaatcttggttttctagaatttatatgctttcttttcccaattatcagaactgaataatctagtatattctctttaactttacattctaggaagttcagagttaaattccataaagtctttatttttaataattttgaattgtcatgtttcatatatttcaattttccaagccaaaaaggttctctttggaaatagatggtttatactttggacatgttctggcagcatacctttaattttcatttacttagatgaaatgtagatgaatcatatttttggaactacaggttttgccctttcatccttcacccccatacctaatatgaccttatacaaattatgtttgatgagaatcttcgatgagaattatagcaaaatatttgttttcctattatcttttgaatggcacaatactggatttgaactcaagactaaataatttttcgaaaaagaattagcagtgatttataaagttactatttttttttcagcaaagctagagaagatttgctgaaaattcagaaagaacgtgattttcatcgaatgcatcataagcgaatagtccaggaaaaaaacaaattaattaatgacctcaaagggtaagcttatacttgttggcatatttattaaagagttatttaatacatgttaagtaatttgattatgacaaagttttagacaaagttattaattccacggttattgagcataagatgagtaagttgcgacccttgctgtcaagggtctcagaaaatacttgtgtgtgtgaagtgggaggagttaagcagaaatatactgaaatacactgcattgttgctatgccacccaagagggccatcatcccaatacgactggagtgtgagagggctcaaggatttatttccacaggaattaaattctcaagtatgagtaagagtagacagtgaggaagtggggtccgcacagtgctctttgcagatagtacatcctctgcaaatgcaccaagacatgaaaaaacatgttacgttcatcaaattgtgtacatagagagtaaagtgcagctgtggtattgcagggataggggacatatctctaaatgactatgaatttgtaagtcttttagaaattattttgaaggcattattgagatttactttctctccttctttaccttcctcccctacaaaaacaagaaaataaatttacaatccttaaataaaattatattttgcttgctctaaggcagtgctatccaacagaactttttgtgatgatataaatactctgtatctgtactgtccaatacaatagcccctaaccatttatatttaaaaatataccatacttgttcaaattcctaatatgtttaaagaatacttttcacataaaattcatcattttagattacatgtttttttcgtatttcattatttcaggcaccctggtaaagaagcacacattactttgtaatacagctacacttggtgtatactcagatagcctttatttcttcatttaatcattaagaaaaacatctccatttaacaatctggatgaatcactaaagctcattttataaagacctaaaacaaaacttcaatgatgccatcaagtcacaaaactgggtatcaagttaatcagtcaaacacagtgaatactttgcccgatagctgcgcgattgcataataaatcagctataggacagagtgttttgatgccaggcaaagttggggtctgaaatctcttatgtcacattttacccaaatacattaatagtgtatccatatttcctttcattgtaaaccattaaatgtttaccttatttttctgtaaatttttcaactagtttgataataaattttacagtatttctttgtttgttgttttgttttgctttttagagtcagactctcattctgtcgcccattttagaatgcagtggtgagattaaggcatcctgtagccccaactcctgggttcaagcagtccttccgcctcagccttctgagtagctgggtctacaggtgcatgccaccatacccagctaaatttttttgttttaatttttttgtagtgatgggggtctcactttgttgatcaggttggttttgaactcctgggcaccagtgatcctctcagatcggcctcccaaagtgttggaattacaggcatgagtgaccaagcctggccagtatttcccatttaacacaagtatcttattatgaacgtgcttattttcagaattatctatagctaatattagaacttgcaaacagatgaattatgaagtacttatggactttataaaatagacacaccctttaaaatagattaaacagagtttttctagatgttgtttccttgttatattccagtgaaattctatgtgttgttaattcttttaacagaagatagtcaagccatatctcatgaatgagttaaattccaaagttagtaaaaaaagggaaattttgccatcaatattttctttaaaattcttcaaccatccacagattacagtatatatagttttgtgtatacaattctatatctgtgtgttgtatgtatttatgaatatgtaatgtttatggagattatagtatgcagcaaagtgtatatatattacatacatatgtatatatatatgacatatgtgtatatatatgttacatatatgtgtatatatatattacatatatgtatatatatattacatatatatgtattatatatatatataaacacacactaagctaatcagaaaggaggatagaactgtacatactacctaaatttttatttttgttactttttctgagtgtcatattaatacacattaaatgtatatataatgcaactgcactttaatacttaatttctattgctatcatcaatgaggtataatgtgatatccaaattaatgacgtttataaatactgctatgaaaatatagaaaataaaaagctctgttttaattattaatggaataaaatattattcttttggaggacttttggggaatttctgctttgggctatgtcattgtaaatagtatagaattagctctccaactggtactggactagctccccaaatgtaaggaactacatgactggacaaaatacatgaggcagttttttttttaagatggtggaaaattggcaaagcaggaccgtgatgcctaagagaagacaaacacaaaatgagcaggatgatcaacccacatatcttcctgaaggtacttttcagcccacagtttgaccagatataacccaagcagagcatggtggctttcagagctgaggaggcagagatcagagttcagggctgcagaggtagctggaacttgcagcatggtgtacacagaaggaaggaggtacatgaaatgtagcttaagaaatatctgtaatggttctcttcagtctttggccacgtaactaacttgtggaagtataggatgagagaacatgaagcctggcaggaaacagcacctgggaaactctgagcaaaatagagattccagaggttgcacagtgctgggagatgcaggagttctgaccagccataagggaagtaacctcactgaatactctgagcatttacttaatatcctccacaagccatgccacagaagcagacctagttggtcctagacaaagtgttgctttagaatttttctccaaaaagcttaaaggtaagctttgaaaaactcgagctgattcactgggaaattaactgtctgtcagaaaataactctttaaaggaagaaaacaaaattcagacaagtgtatgtccaacatacaataaataaataaagtttatacgtattgatttatctatagatatatctagaagcaggaagacatgtcctataatcaggaaaaagcagaaccagacacagagaaaagaaaattacagaattagcaggcagggactttacaacagttattatgaaatgcttagagttttaaagaaaatggtgactgtaaggagtgataaacagaattaaactgaaatttgagaactgaaaaaaacataatatgcaaatgaaaaatttactaataggtcttagaagattggacattgccaatggaaagatcaatgaacatgaagacaggaagatggaaaatgatccaactggtgcacaaagagaaaaaagctgaaaagaaatgagcagggactcaaagaaaaaagactgaaaaaacataaatagaacctctggagcaatattaaatagtccatcataggtgtgtatttgaaatccaagaagaggctgggcataaccttccctattctgctagcttattccaattgttaagtatacaaattcaaattatttactcaggaagactggagttgatcactgggtgcttacatgaaccaaatatgctgtgagcagactttagccaggactgtacttattttctgttcccctgtagactcccattctaacagaggggtcatgattctgctttaggtttctgaatttgaatgaccacttcttaaaatatctttccccagtacatagtcactcaattaaatagccaggggtaatttgcagaaaaattgaggctatttataacagtatataattgctatggtgttacggagtgcttcctctactgtctgccagggtagctccagcatttccacttcacagcgttggctatctttttccaagttttgaaggaccaccctagaagtgaatcaaccttattcactggagtttttttcttttttttttgtattttaagttttagggtacatgtgcacagcgtgcaggtttgttacatatgtatacatgtgccatgttggtgtgctgcacccattaactcatcagttaacattaggtatatctcctaatgctatccctctccacttcccacaccccacaacaggccccggtatgtgatgttccccttcctgtgtccatgtgttctcattgttcagttcccacctatgagtgagaacatgcggtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacataacgtgtgcatgtgtatttatagcagcatgatttataatcctttgggtatatacccagtaatgggatcgctgggtcaaatggtatttctagttcaagatccctgaggaatcaccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgtgatgagcattttttcatgtgtctgttggctgcataaatgtcttcttttgagaagtgtctgttcatatccttcgcccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccgtgctgttttggttactgtagccttgtagtgtagtttgaagtcaggtagcgtgatgcttccagctttgttctttttgcttaggattgacttagcaatgcaggctcttttttggatccatatgaactttaaagtagttttttccagttctgtgaagaaagtcatgggtagcctgatagggatggcattgaatctataaattaccttgggcagtatggccattttcacgatattgattcttcctacccatgagcatggaatgttcttccatttgtttgtatcctcttttatttccttgagcagtggtttttagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagaccttgctgaagttgcctatcagcttaaggagattttgggctgagacagtggggttttctagatatacaatcatgtcatctgcaagcagggacaatttgacttcctcttttcctaattgaatacgctttatttccttctcctgcctgattgccctggccagaacttccaacaccgtgctgaataggagtgatgaggcaggacatccctgtcttgtgccagttttcaaagggaatgcttccagtttttgcccattcagtatgatattggctgtgggtttgtcatagatagctcttattattttgagatacgtcccatcaatacctcatttattgagagtttttagcatgaaggttgttcaattttgtcaaaggccttttctgctctaatgagataatcctatgttttttgtcattggctctgtttatatgctggattatgtttattgatttgcatatgttgaaccagccttgcatcccagggatgaagcccacttgatcatgatggataagctttttgatgtgctgctggattcggtttgccagtattttattgaggatttttgcatcgatgttcatcagggatattggtctaaaattctctttttttttttgttgtgtctctgccaggctttggtatcaggatgatgctggcctcataaaatgagttaggaaggtattccttctttttctattgattggaatagttttagaaggaatggtaccagctcctccttgtacctctggtagaattcggctgtgaatccttctggtcctggactttttttggttggtaagctattaattattgcctcaatttcagagcctgcaattggtctattcagagattcaacttcttcctggtttagtcttgggagggtgtatatgtcgaggaatttatccatttcttctagattttctagtttatttgcatagaggtgtttatagtattctctgatggtagtttgtatttctgtgggatcggtggtgatatcccctttatcattttttattgtgtctatttgattcttctctcttttcttctttattagtcttgctagtggtctctcaattttgttgatcttttcaaaaaatcagctcctggattcattgatattttgaagggttttttgtgtctctatttccttcagttctgctctgatcttagttatttcttgccttctgccagcttttgaatgtgtttgctcttgcttctcttgttcttttaattgtgatgttagggtgtcaattttagatctttcctgctttctcttgtgggcatttagtgctataaattttcctctacacactgctttaaatgtgtcccagagattctggtatgttgtatctttgttctcattggtttcaaagaacatctttatttctgccttcatttcgttatgtacccagtagtcattcaggagcaggttgttcagtttccatgtagttgagcggttttcagtgagtttcttaatcctgagttctagtttgactgcactgtggtctgagagatagtttgttataatttctgttcttttacatttgatgaggagtgctttacttccaactgtgtggtcagttttggaataagtacggtgtggtgctgaaaagattgtatattctgttgatttggggtggagagttctgtagatgtctattaggtctgcttggtgtggagctgagttcaattcctggatatccttgttaactttctgtctcgttgatctgtctaatgttgacagtggggtgttaaaatctcccattatgattgtgtgggagtctaagtctttttgtaggtctctaaggacttgctttaagaatctgggtgctcctgtattaggtgcacatatatttaggatagttagctcttgtcaaattgatccctttaccattatgtaatggccttctttgtctcttctgatctttgttggtttaaagtctgttttatcagagactaggattgcaacccctgcttttttttgttttgcttggtagatcttcctccatcccttgattttgagcctatgtgtgtctctgcatgtgagatgggtttcctgaatgcaacacaatgatgggtcttgactccttatccagtttgccagtctgtgtcttttaacgggagcatttagcccatttacatttaaggttaatattcttatgtgtgaatttgatcctgtcattgtgatgttagctggttattttgctcattagttgatgcagtttcttcctagcctcgatggtctttacaagttggcatgtttttgcagtggctgttaccggttgttcctttccatgtttagtgcttccttcaggagctcttttagggcaggcctggtggtgacaaaatctctcagcatttgcttgtctgtaaaggattttatttctccttcacttatgaaggttagtttggctggatatgaaattctgggttgaaaattcttttctttcagaatgttgaatattggcccccactctcttctggctggtagagtttctgccaggagatcagctgttagtctgatgggcttccctttgtgactaacccgacctttctctctggctgcccttaacattttttccttcatttcaactttggtgaatctgacaattatgtgtcctggagttgctcttcttgaggagtatctttgtggcattctctgtatttccttctactttgctctttccagtgcacatggaattgtcactaaaatagatcgtatactgagccataaaacaagtctctatacatttcaaaggatggatgtcatacatagaatattttctgaccacaaccaaattaaattagaaatcaatttttaaaaatctcaggggatttctcaaatatttggaaattaagtagtatactttaaataatccatgaggcaaagaagaaaattacagaatattttgcgctgaatgattaaaaatgcagcatattgaaatgcagccaatgcggcttaaattgaaattgatggctttaaatgcttattttagaaaataaagttttaaaaccaatgatgtcatcttagaagcttaaaaagagcaaattacaaccaagaaacatgaagaaatgaaaaataagagctgaaatcaataaaatagcaaatggacaaacaaaaaatcaacaaagtcagatgttggttaatggaaaatgtaataaaactgacaaatttgataataagatggataaactcttaatagactgatatcaccagaggctggcaataatgtagggtacccaggactgtcatatagggttgttggaagtataaattataacccagcaattaaactcctgggtgtttatctaaaataaatgaagatatatgaccaaaaatattacatgacttatataaaaatgtttaaagaggccttattcatgatagcccaaactaaaatccactcaagttttcatcagcaaaatattggataaccacattgtggaatatacatacatacaagggaatactactcacagtaaaaaggagtgaagtattgctatgtaaagtaatgtggaataatctaaagaaacattacactgagtgaaataaactagttaaaaaagagaacatgttatatgataccaaataaatgaagttctagaattttctggggtgttagacatgcttcatattttgataatgtatactacttgggtgtgcatttctcaaaactctgaactgtaacgcttaagagctgtatgttttatccatgtaaattacacttcaataaaaagattttgaggtcattttcaaataaaacagattttttaaaggtatattatatactaggctgaattattccttctgtttagatatcaaaatgtttttatacttaatttttaaaatacaagattagccaaacttgttttaaagactatcctttagtttattttgatgtgaatgacactccatgtttaatcatctattgtttgtggcccttgtctttctgatagttatttccaaattgacaaaaggaattgcattttaaaaaatttcatgggtagcagcaatcttctgagtacatacttggacacagcaaaaggtgctagtaggaaatagagaactagttaagacgtgatttgctccctcactgcaccctccaccctcaagttgcagtgaagttgtatgctttttgtgcttcttggctgtagtgtgttaacctttatatgattattcatttttatttcacagcaaaaaagaaaaagaaaaaaaggttttgatgttagatggaaattactgatttaactcaataaccccttaagatgctattgactttattttttataggttgaagttacattatgcatcttatgaaccgactataagggtgttacatgagaaacaccacactttactgaaggagaaaatgctgacctccttggaaagagacaaagtagttgggcaggtaaagatatagtcaaagctaacttaaaatgatcttttaatcatttttttaataatacaagtagaaatactgattttgtttctgagattaattttaaaacattttcaaccaactttcatgtaaaagagatccatttggaaacattcagaaaaagtatttctccatttaactacctataaagattattataaaattaggccaggggcagtggctcatgcctgtaatcccagcactttgggagaccaaggtaggtggatcatttgcggccaggagtttgagaccagcctggccaatatggtgaaaacctgtctctactaaaaatacaaaaaaaaaaaaacaaaaaacaaatagccgggtgtggtggcacaggcctgtaatccctgctacgtgggaggctgaggcatgagaatcatttgaacccgggagtggaggttgcagtgagccgagatggccccataccactgcactctagcctaggcaacagagtgagacagtgtctcaaaaaaattaaattaaatatcatttaattgagacataaatttatagcagattattaaattatagttagaagaaaaaacttagccattgtggtcaaacttgggtttaaatgccagctttgacagctataaacattaaccttaggagagtcatttaaacaaattggagctcagatttctcatatataaaatgtagctgcaaagaccaaagacataccatttaagattgctgtgaaacttatatgagatattttaataaataaaaactccctcataggtactgactcaagtttttggttatttttgctaatgcttgacatccttttagggtttttgtgtaggcttaggcctagggtagtgggtgagatacctttggcataaaaatttaagaaaaagaaacaaaatgtttatatgccactttaaaaccatttatcagtttttttagaatatataaaactgcaactatgcttaacattctattattgttttctggagattttcatttttggccaaactttgagaagctacaaaagcttacatgatgataatactcttttgaataattttatttgtcaagacatgctttaatcaagtttattttgtcttttgagtgaaattcttagcttcgaaaatgcaaaacatcattgtcttgatgccccttgtgcttgaatttaattttgtgttttgaatgtttgaattttaagtaatattggatacaatgataatatgatttggctgtgtccccatccaaatctcaccttgaattgtaatcatccccacgtgtcaagggcgggaccaggtggaggtaactgaatcatgggggtggtttctcccatgctattctcatgataattgagtgagtctcaagagatctggtggttgtataagcgtctggcatttcttttgcttgcactcactctctttcctgccaccctctgaagaggtttctaccatggttgtaaatttcatgaggactccccagccatgtggaacttgagccaattaaacctctagtctttttttttttttaatatatttttaccctaaaacctctattctttataaaatacccagtctcgggtatttcctcatagtggtgtgagaatgaactaatacaaatgagtttaacaataatttaaattttatggcattataatcaaaccttcagaatttcatacccttgcttcttttcatctaatctgtcttccccagtctcctaacaaaaggctttctttattctatatcctgaggtattaggagctagattcagatctcttcctatttcctattccagatgggccaagcttaagcttttgctacccatcttactctctttagtcctcctggtctcatgcttatctcccatataccatgtacaatatttgtgtttcaagttgctccttgatggtttagtggaaagagctaagaactgggaatggctggtatgaattccagttgtgttgtaaaacacccaagtgaggattcaggttatttaaatatttctttttactcacttattaaatagggataaattatttgccttatgattgatatgtgtacaagattaaaacatgtttaaaaagttaaaatcatttgatctatgagttagagttgaattttgcacactactgttcagatgtgcaaagaaatatatctttattatctgcaactggttttgtctttgaactcctactcctgctgaagacaaaagaaaagataacctgcatattaaagactatcccaatctttgtgagttaaaccagtctctttgggtttaacacagggtgtttgaatattatattaactgaatgtttagctaaaacatagttattagtgctcattttcttccttcaaatggcatgccctttttattcttccccagatggttcctagtaaaaaagttacttgtctatccgtatagcttaaagtctacaggctatattcactctccagtgtactgtgacttgtttgattaggttggtgtccaggtacatgaaacctggatagttctggatagctcctggatagttcctgggtagttcttttgtatgtgaacccaacacaccttgctaaatccatggcctctgccacaatatctgtgaactcctttatatctgtggcctcattatcctaaccctagctttttttctgctccagtacatcaaatattaacatttccatgtaccccactgaggtggttgaggcttctgatttctctatattggaaatacaagccatgagcaatttgaaaaccagttagggtccatctacacagatatacctttttcagtccattttcaacatgacctggagagtagtgtgtttttctagcacaatgtaaaatatgaaggactctttaaggggttgtcaattttcctaggctattgcctgaaaagctaacagcaagtatacttatattcctggagtatccctagagtatctggctttatttgcccttcatttccaactggccccacttgcatttttcacttggtagataaagtaggactcatgtctgacctgttgttacctcgtccctcaggcatctcgtccctcaggcacagaactcttttcacttctttgttctattggatggaatatcttcctatcttctttcatgttacaggatgctctatgtcctcatttgttacagcaatcctgatttacacctatttgcacaggggaatttttaataaattccactttcaccctaaaaatatcccaatttagaaaatctttattaatgggaaaattctatttttttatactttaagttctagggtacatgtgcacaacgtacaggtttgttacataggtttacaagtgccatgttggtttgctacacccatcgtcatttacattaggtatttctcttaatgctatccctgtcccagccccacaccccatgataggccctggtgtgtgacgctccctgccctgtgtccatgtgttctcattgttcgtttcccacctatgagtgagaacatgcggtgtttggttttctgtacctgtgatagtttgctgagaatgatggtttccagcttcatccatgttcatgtcaaaggacatgaactcatccttttttatggcagcatagtattccatgatgtatatgtgccacactttcttaatccagtctatcattgatggacatttgggttggttccaagtccttgctattgtgaacggtgccgcaataaacatacatgtgcatgtatctttatcgtagcatcatttataataatttgggtatataccccgtaatgggattgctgggtcaaatggtatttctggttctagatccttgaggaatcaccacactgtcttccacagtggttgaactaatttacactcccaccaacagtgtaaaatcattcctatttctccacatcctctccagcatctgttgtttcctgactttttaatgatcgccattgcaactggtatgagatggtatctcattgtggtttttatttgcatttctctgatgaccaatgatgatgagcattttttcacgtttctgttggctgcataaatgtcttcttttgagaagtatctgttcatatactttgtttttttcttgtaaatttgttgaagttatttgtagattctgaatattagctctttgtcagatgggtagatggcaaaaattttctcccattgtgtaggttacctgttcactctgatggtagtttcttttgctgtgcagaagctctttagtttagttagatcccatttgtcaatttttgcttttgttgccattgcttttggtgttttagtcacaaagtctttgcccatgcctatgtcctaaatggtattgcctaggttctgttctagggtttttatggttttaggccttacatttaagtatttaatccatcgtgaattaatttttgtataaggtgtaaagaagggatccagtttcagttttctgcatatggctagccagttttcccagcaccatttatcaaatagggaatcctttccccatttcttgtttttgtcaggtttgtcaaagatcagatggttgtagatgtgtggtgttatttctgaggcctctgttctgttccactggtctatatatctgttttggtactggtaccatgctattttggttattgtagccttgtagtatagtttgaagtcaggtagcctgatgcttccagctttgttctttttgcttaggattgtcttggctatgcaggctcttttttggttccatatgaactttaaagtagttttctctaactctgtgaagaaagtcattggtagcttgatggggaaggcattgaatctataaattaccttgggcagtatggccattttcaagatattgattgttcctatccgtgagcatggaatgttcttccatttgtttgtgtcctcttttatttcattgagcagtggtttttagttctccttgaagacgtcctttacatcccttgtaagttggattcctaggtattttattctctttgaagcaattgtgaatgggatttcactcatgatttggccctctgtttgtctgttattggtgtataggaatgcttgtgattgttgcacattgattttgtatcctgagattttgctgaagttgcttatcagcttaaggagattttgggctgagatgatggggttttctaaacatacaatcatgtcatctgcacgcagggacaatttgactccctctttttctaatcgaatcccctttatttctttctcttgcctgattgccctggccagaactgccaacttccaactatgttgaattggagtggtgagagagggcatcgttgtcttgtgccagttttcaaagggaatgcttccagtttttgcccattcagtatgatattggctgtgggtttgtcataaatagctcttattattttgaggtattttcgatcaatacctagtttattgagagattttagcatgaagtgatgttgaattttgtcaaaggccttttctggtggataagctttttgatgtgctgctggattcggtttgccagtattttaatgaggattttcatcgatgttcatcagggatattggtctaaaattctctttttttgttgtgtctctgccaggctttggtatcaggatgatgctggcctcataaaatgagttagggaggattccctctttctctattgattggaatagtttcagaaggaatggtaccagctcctctttgtacctctggcagaatttggctgtgaatctgtctgatcttggactttatttggttggtaggttattaattattgccgcaatttcagagcctgtgattggtcaattcagagattcaacttcttcctagtttattcttgtgagagagtgtgtgtccaggaatttatccatttattctaaattttctagtttatttgcatagaggtgtttatagtattctctgatggtagtttgtatttctatgggatcggtggggatatcccctttatcatttttttattgcatctatttgattcttctctcctttcttctttattagtcttgttagtggtctgtcaatattgttgatctttcaaaaagccagctcctggctactttgattttttgaagggtgtttttgtgtccctgtctccttcagttctgttctgatcttagttatttcttgccttctgctagcttttgaatgtgtttgttcttgcttctctagttctttttattgtgatgttagggtgttgattttagatctttcctgctttctcttgcgggtatttagtgctctaaattttcctctacacactgctttaaatgtgtcccagagattctggtatgttgtgtctttgttctcattgatttcaaagaacgtctttatttctgccttaatttcgttatgtacccagtagtcattcaggagcaggttcttcagtttccatgtagttgtgtggttttgagtgagtttcttaatcctgagttccaatttgattgcactgtggtctgtggtctgagagacagtttgttgtgatttgtattcttttacatttgctgaggagtgctttacttccaattatatggtcaattttagaataagcgcgatatggtgccaagcagaatgtatattcttttgatttggggtagagagttctgtagatgtctgttaggtctgcttggtgaagagctgagttgaagtcctggatatccttgttaaccttctgtctcgttgatctgtctaatattgacagtagggtgttaaagtctcccattattattgtgtgggagtctaagtctctttataggtctctaaggacttcctttatgaatatgggttctcttgctttgggtgcatatatatttaggatagttggctcttcttgttgaattgatccctttaccattatgtaatggccttctttgtctcttttgatatttgttggttttaaagtcgttttatcagagactaggattgcaacccctgcttttttttgctttccatttgcttggtagctcttccttcatccctttattttgagcctatgtgtgtctctgcacatgagatgggtctcctgaatacagcacactgatgggtcttgactgttaatccagtttgccagtctgtgtcttttaattggggcatttagcccatttacatttaaggttaatattgttatgtgtgaattcaatcctgtcattatgatgttcgctggttattttgcccattaattgatgcagtttcttcatagcattgatggtctttacaatttggcatgtttttgcagtggctggtactggttgttcctttccatgtttagtgcttccttcaggagctcttgtaaggcaggcctggtagtaacaaaaccccttagcatttgcttgtctgtgaaggattttatttctccttcacttatgaaacttagtttggctagatatgaaattctgggttgaaaattctttcctttaagagtgtcgaatattggcccccactctcttctggcttgtagggtttctgccgagagatctgctgttagtctgatgagcttccccttttatgtaacctgccctctctctctggcggcccttaacattttttccttcatttcaaccttggtgaatctgacgattatgtgtcttagggttactcttcttggggagtacctttatggtgttctctgtatttcctgaatttgaatgttggcctgccttgctaggttggggaagttctcctggataatatcctgaagagtgttttctaacttggttccattctccccatcactttcaggtacaccaatcaaatgtagatttggtcttttcacatagtgccatatttcttggaggctttgttcatttctttttactctttttctctaatcttgtcttctcactttatttcattaagtcgatcttcaatcactgatatcctttcttccacttgattgaattggttactgaagcttgtgcatgcatcacaacgttttcgtgctgtggttttcagctccatcaggtcatttaaggtcttctctgtactgtttattatagttagccattcatctaaccttttttcaaggtttttagcttccttgcgatgggttagaccacgctcctttagcttggagaagtttgttattaccgaccttctgaagcctacttttgtcaactcatcaaagtcattctccatccagttttgttccattgctggtgaggagttgtgatcctttggaggagaagaggcactctggtttttagaattttccacttttctgctcttgtttctctccatctttgtggttttatctacctttggtgtttgatgttagtgaccttcagatggggttttgatgtgggtgtcctttttttgaagtttatgctatttctgtttgttagttttccttctaacagtcaggccccttagctgcaggtctgttggggtttgctggaggtccactccagaccctgtttgcctcgctatcaccagcagaggctgtagaacagcaaatattgcagagcagcaaatattgctgcctgatccttcttctagaagctttgtcccagaggggcacctgcctatatgaggtatcagtcggcccctactgggaggtgtctcccagtcaggctgcatggggatcagggacccacttgaggaggcagtccatccattctcagagctcgaatgccatgctgggagaaccactgctttcttcagagctgtcagacatggggtttaagtctgcagaagtttctgctgccttttgttcagctatgccctgcccacagagatggagtctatagaggcagtaggccttgctgagctgcggtgggctcctccagtttgagcttcccagctgctttgtttacctactgaagcctcagcaatggcagacgcccctcctcccaccaggctgcagcctcgcaggtcaatctcagactacagtgctagcagtgagcaaggctctgtgggcgtcggacctgctgagccaggcacgggagaaaatctcctggtctgccagttgctaagaccatgggaaaagtgcagtatttggacagaagtgcctcgtttttccaggtacagtctgttatggcttcccttggctaggaaaggcaaatcccccaaccccttgcactcctgggtgaggcaacgccctgccctgcttcagcttgccctccgtgggctgcacccactgtccaaccactcccaatgggatgaaccagcacctcagttggaaatgcagaaatctgtcttctgtgttgatcacactgggagctgcagacgggagctgttcctattcagccatcttggaaacgaccttaatttgaaaattctaaagagctaatttcttgatatctaatatggaacagttagtcccactcttaagataacattgaaaaaaataaataaaatggagaagttaggatttataaatagcttttctctctcaaccaaatctgctgttgaaggtggtagattcactacaatttgagaaagtcaaatttaaataggaggtgctattgctgccactgagctgtcaccacaggttttaccatggacaatgctaatactgaatacttgatactctttcagaattttgttatacttgtcaatggaaactggatgtggcagccaccattctcaggataaattccaaattctacattgttccttatatcactaaattttgttcagaatccaaaatgggtacacaggattgatggagccaatgcaagtcctagttataggacaagctgtgtaaatatctgatatctattgcaaaaggtggaagacacatgattctctaaacccaaactgctaagtggccaaagcgactgtcaaatatccattatacaagtctaaaccaaggctcaattaacctactctccaaattagggcacagaatatagtcctagtcctgtcagctctccaggtgtgtccttgtggaacaagtcaaggttaccacttaaagaatggaaactgtttgtgtacccttcttacaaagaatgatttattgccaaccaatcctttctttctgttgtagcatactaatcaggtatatcctgggtgtacaggcatagattagcctttgaaattgaacatattagtagtgtgtcatggagctatagaatgaatttattcaaagtatgtgtacagagaaaatatcttaaaatatgtgaaatgtttctctataatgtaaaatagaagataggttacttttgtgcttatattttgaatatttctttatttcaacgtttgatgcagttacgctttgagaattcatttccaaccaaactttaggatgtgagttaagagcagtaagacatcttatgttttctagctggattcctgattgttacttccttaaaaactttatcttaatgagcatttagcttactgtgtttctccttaaacctataccttgcataaagaaggattgtataataatttaaaatttttgattattatctagtttgcatatgaaagagtgaaaacacactgtgggatgacaaaaatccgataggaaatacatgttttcaaatttctttagtagatactagacagtgaatcaacatttatttaaaatgtaatgaaaaacctataactttgtttttggttttaagaaattattgaaaatagtgttcagaattttgaattagagctccatgacccaagaaaaggtgaaatagaattgatttgtaggtatctatgtatactaaattatattttatcttttttagatcatgggattctaactcagaatatgtatgtatgtgtgtgtgtgtgtatatatatatatatgtatactaaaaactaaatctaaatatatatatatattttaggtctgtctgcttggagagtctagaagtagtgacactccaccagtaatgaacatatccagtgttaggatcttgatttctaatatcactctgtaataaaaggaaaggaaacagggttctttggagaagtgtctgattctagagctgggcagataaaatactagataggcctggagcacttgggacattttcttgtgctagaaaggaaggaaatgctcaaaaagtagaacagaaaagaaaaaaaaactcaacataataatgggatatgtcaagttatgacaaaggaactgtagtgggcacctgcagaggttggtggatccccaactaaatttgatttggatattcagactgataatgccacacacacacacacacacacacacacacacacacacacagaggctgtgaataaattcactacttgtggaactgaatttgctgaggagagctgcacattacctcccaagcatttctgaaatggcttgagagagcaagtaagggagactggcttggggtttttattgcggttgggggttagggccagggtgagaattctcatatgtgaggtgaggcttgagtcatttgaatctcccatcagtaccagacaagggagtacccaggcattcttgtccagttgcccagatgttgggcacaagggaagaaggaggaggtaaaacttaaaggctgttgacactcaaacatcaaacaataaagtcaggttcctcattataggaatccaacctgaaagagcttccagtgatcaaaccttctgaaacaatttgagcaacaaaataatgtagtgtttgattataacccaaaatataaaataaatatctttgattccttaatggtataaatataaatgattagtaaggacatgtgagagagtagacaaatctcccatacagaagaatctcgagtaatatatgttgataatccttccctcaagtaggtggagcttaacaactcagctgttgagtgttggctgcactttgtaaataatgacttgcatccagaaatgcaagggaaatagggaagaaagtaactttacagtggggaaacctgtcaaccttctcatcatgtaaccaaaggatcaaggtgaacatcatcagttttaagtactgttggtagcatgaacctatgatgtaatatgctaataatggcactcccctgtgatcttcttgcaaatccataactttagtctaaccatggggaaaatatcagacaacctcaaatctagggctattctgtaaaatactgtcagactaatgctccccaaaattgtcaaggacattaaaatcagggaaaatctgtgtattagtccatcttgtgttgctataaaggaatacccgagactgggtaatttataaggaaaagaggtttatttggcgcatggttctgcaggctgtagaagaagtatagcaccagcatctgcagagagatctgcctccatgacccaaacacttccccctaggccccacctccaacactggggatcacttttcaacaagagatttggagaggacaaatatccaaactatatcagtctgagaaactgtctcagtccagaggaggcttaggagacctaaaaactagttgtaaggtgatattctggatgcgattttgaaacataaaaaggatattatggaaaaattaataaaactaaaaatatggcctgtagttcataataatatatcaatattggttcattatttgtgaaaaatgtatcattacaatgtatgatgttaatgggggaaaaagggtatgggataaaacaggaattctcagtactacattagcaactctcctgttaatcttatgctattctaaataaaaagtttatttttgaaatttataattcttttggcttctaggaatagatagtaatcttttacttttttttaacctaggcatttcatgagcactcatctataggttataattaataaattatgttattttctattaataaagaaatattactattcagtgatagtagaaaaaagtgtgtatctgtatgtaattgaacagatggtattttgtgttggtataatcatatacaatgcaagatgaaatagcttttcaaggtcaaattttaaattaagtatttttcaggaatacaggtaaatcatgacaccaaagctaacaaaagttcttagttataagacatgtttaataaaatagagaatatatgtgggtggaaaatgagctaagagttgggggaataaaaacaacctcttcatattttacattccaagtgataattaccttgtattttataaatataaagatgatagttattgtgaaacaatttgaacagaggaaaaacctctctcaaaatagagaattgaataattattaaagtgtacaatgagtattcttaattcaggaaactatgccgtgaaataaatgtttcagatgcttacctaaaataagtaattaataattagctggtggaattatattttaacttaaaattctgtttttcttttgttaaaatttatgttttattaaaaaaggtataaatttaaaagagattaatattttttatattttacaatggatatttaaatattgtgttttatgtaacctttttaaaagtcatttagtgtataatttcatttctttgaattttactttttagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaggtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatggatccaccctaacgaagcataaaattaagcctaggattttagggtcatcagccaaaaatggaactgccttctagaacaaaaaatgacatccttttgaggaagacagtcatccagagtctttacaatcttttacccacattgcctagtacataattaaacatttctagatatgaataggaacaggaaaatgtgacccataatcaagacaacaagcaataaatggaaacctacccttaagtagctaaactgttgcatttagcagatagaaagtgctaaagtagatactttgattatgttcaaggacttaatggaaaatactaataagtgaacagatggggaatttaagcaaagaaatgagaacaagcatacattccaaagcaaattgaagttctacagctgaaaagtagaataactaaaatgaattttttttttttttgagacagagtcttgctgtgtcacccaggctggagtgcagtggcatgatctcagctcactgcagcctccacctcccaggttcaagtgattctggtgcctcagcctctccagtagctgggactacaggcatgtgccaccatgactggctaatttttgtatttttagtagagctggggcttcaccatgttggccaggctggtcttgaactcctgtcttgaagtgatccgcctgcctcagcctcccaacatgctgggattacaggcatgagccactgcgcccaatcaaaaattttatttaatgtacttcataacaaattagagatgacagaagtgtcagtaaatttcaagagagatccataaaggcatctagtctaaagaagaaagataggccgggcacggtggctcacgcctgtaatcccagcactttgggaggctgaggcgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaagaagaaagataaaagattaaaggaaaacttgcctatttaacatatataaaattaaagtcccaaagaagagaatgaaaatggagcataaaaatacttaaacaaatgatggccccaaatttccccaaattcatgtaaagtataaacttaaacacctaagaaaagaactaatcatacacataaagagaaccactcctgaacacaatgtgttgaaattgttgaaaattgaagtgagaaaatcttttttttttaatttataaagaaaaagaaaaagaggtataatggactcacagttccacatagctggggaggcctcacaataatggtggaaggcaaaggaggagcaaaggcacctcttagatggcagcaggcaagagagagtttgcagaggaactgccctttataaaaccatcagatcttgtgagatttattcactatcatgagaacagcatgggaaaacccgcctccatgattcaaatacctcccacctggtccctcccttgacacatggggattatgggagctacaattcaagatgagatttgggtggggacacagcccaaaccatatcaccaagtgtccattgatagatgaatggataagcaaaatgtggtttttacatgcaatagaatcttttttttttaattatactttaagttctaggatacaggtgcacaacatacaggtttgttacatacgtatacatgtgccatattggtgtgctgcacccattaactcatcatttacattagatatatctcctaatggtatccctccccattccccctaccccatgacaggccccggtgtgtgatgttccccttcctgtgtccaagtgttctcattgttcaattcccacctgtgagtgagaacatgcagtgtttggttgtctgtccttgagatagttggctgagaacgatggtttccagtttcatccatgtccctacaaaggacatgaactcatccttttttatggttgcatagtattccatggtgtatatgtcccacattttcttaatccagtctatcattgatggacatttgggttggttccaagtctttgctattgtgaatagtgccgcaataaacataatgtgtgcatgtgtctttacagcagcatgatttataatcctttgggtatatacccagtaatgggatcgctgggtcaaatggtatttctagttcaagatctttgaggaattgccacactgtctttcataatggctgaactagtttacagtcccaccagcagtgtaaaagtgttcctatttctccacatcctctccagcacctgttgtttcctgactttttaatgatcgccattctaactggtgtgagatggtatctcattgtggtttgatttgcatttctctgatggccagtgtgatgagcattttttcatgtgtctgttggctgcataaatgtcttcttttgagaagtgtctgttcatatccttcacccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccatgctgttttggttactgtagccttgtagtatagtttgaagtcaggtagtgtgatgcctccagctttgttctttttgcttaggattgtcttggctatgtaggctcttttttggatccatatgaactttaaagtagttttttccagttctgtgaagaatgtcattggtagcttgatggcgatggcattgaatctatacacttcatgctaaaaactctcaaaaattcgttattgatgggacttatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaattagtcaggaaaaagaaataaagggtattcagttaggaaaagaagaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagtattcttatacaccaataacacaaacagagagccaaatcatgagtcaaatcccattcacagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatcttgaaagcaataatacaaatacaggctgatttctcataggaaatactggaggctagaaacaataaaatggtatttttaaagtgtggaaacaattttaattcagaattgtgtatccaataaaaatatcctttaaaatttagataaaatgtagacattttaagatgcaggcaagctcggagattttttgcaagcctatctgtacagcaggaaatactaaagaagtttctttggtcaaaaaagtatatttgccagaaggaaattaatatctaccacaattgaatacagagaattaaaaatgttaaattctggttaaaatgagaaatatgttttccttttctaatttcctcagaagaaaagtgactgattaaaataaaattatggtgtcataaggtaatgtttataaggtatgtaaaataaaggaaaataaattgaggtgtggtggaaatgttttatatcttaattttggtggtagttacatgcctgtttatatttgtcaaaacacacctatctgtacaattacagtgcataatttacctacaataaaatgcataaatttaagtatacctgtgtttacttttaggcaaagaggatttttttttttggctcagatagctagaaggcacagacagtattctcagacatgactagatccagaaggatgatgtccttaggacctggtcactgcctctgtcttgtgagctgaattcattttttaaaaaggataaactttattttttagagcagttttaggtttatagcaaaattgagtggaaggtacagtgattttccatataccacctgcccccacccatataccacctgcccccagacatagcttcccctattatcagcatcccctaccagattgatacagttgtaaaaactgatgagtgtccatgacattaatatcaccgaagtccatagtttacattagggttcacttttgatgttgtacgttctgtggaattcaacacatttatgacgtgtatccaacattatagtgtcatacagagtagtatcactgccctaaaaaccttttgtgctttgcgtattcatcccttcctccttcctacttttctaatattttatgttaaagtagtatcagttatgcacagtgattcctaagggactatgcacaaggatgtttattgcagtcataaaagtaacacaacaatacaagcaatctcactttttaaccaccagtgaatgtttatagtggatcctacaataataaaaagtctaaaactcatgcataagaaatacttatgttttaatgttaagaagtaaaaacatttatatggtacaaatgtatgcctgttgaatatatgcaaagaaaaaatatcagaaggtgtataccaggattttaacataattttctctgtgttatgtgactacttcctacccttttctttattgcatattttacaaagagtgtacatttctgtcaacttcaaaaattgttttcatattaagataagaagaatgtaatcagatataaatattaaatgatggtttgaaattatcataatttcatgaactgtaactccaaaaatgactaaatagtctgaaaaagaatatatgtaagaaagcttaaaggttgagggactttgtgaattgggttgatgtttgcaccaattaatctctaacgattcattctactctaatggtttaaattttatatatttatccttgacatatcaattaaaataaactgatgcctgacagataactcccttatgaaattatctcctggtgtttagtctaattcatacaagaacatattgcatgtttttcttgagtgatgtttacaatgtactttggagattaaacttgtatttgatctgtgatattttgaaatggcttttagtcaaaagaaattctgacccaacatggggaaatagtttcttttagttatgtatcccaactatctaatcaaaagtagttatttaaatcctgtactgaataattttatgctctttgtaaacatacactctagttttagatacagaacttgaagcacttttccctaagcttctgatctcagcatttgtctgtggtcccttagactctgtcacgtctccagttgctaaaacttggtatcctacttagggactgtaatttgaaaagaggctgtgcgtggtggctcacgcctgtaatcccggctctttgggaagccgacgcaggcggatcacgaggtcaggaaatcaagaccatcctggccaacatggtaaaaccccgtctactaaaaatacaaaaattagctaggcatgatggtgcgtgcctgtaatcccagctacttgggaggctgagacaagagaatcacttgaaccaggaggttgcagtgagccgagatcgcaccactgcattccagcctggcaacacagcaagaccgtgtctcaaaaaaaaaaaaaaaaaaaaaagaaaagaaaagacgatttattggttaagtggttgttcttcataattcctgtcattcttcatattttcatgttacttcctcccgctttacttgctcatttaagtttagttttaaaaatacttccctctctctctcatttacccattcatccacccatccatctatccatttattttcggcagaagttggcatgtcaatagagattcttcaaattaaacattatttactttgaagttagaaaacaacaaattgattgtcatttactctaaactttgggaagaagacacattaattgttatttaatctaaatttagggaataagatgcaaattggaatgatttggagcaaagttagcaaagtattttaaacatacttttttgactaccaaagtgacgtttattatagaaaattcagacaatgataaaatatattttaaagaatcaccccgtaattgctgccatacaaagataatattaatgctttattacctaatctgatctgaaaagagttttcaattttacatttattctttatggtaggtcaaaagtagaaaaatttctgggagaaactatgaaataattattattgagtagatatttaaactgaaaattacagattatgtttttatttttatcaagggtcatatgtatcgaatatttacatgacactatacagaaagcactttttagtattacatattatgagataaatttttttttcaaattaatttcaaaaagcttatgaaatctactggttttgattgtcatccttttattagttgtttttgtttgctaaggttgcaatttcagtgcagtaatgcctatttttaaaccagatcataatgatacatataattgcattttagtatatcttataatgtataggaaattattaattccggatgaccttctagaaattgtaaatgcttggtgaagtgaaaaattgtgaaagctgacttcagagctttaaagaggaaataaatgtcatatatagtaaagcaaagtagctcttaagttagtacttcaaaattaatagtagagcaagtactcattatttcttatagtttaattaattgctgctttttaagttcgtgttttgttgctgctcagaattgcattatgagatgccaaattcatgtaattattagactatatggtctaattaatacttttttcaaatataacatcttcttatttaactctatttctttttctgaattctaattacatagatctaaccaatctcctcattttagtttacatgtgtcctaatctcttagacattttctgtttctctagggtaaattatagacaatttcttcaaaacctttttcagttaaaaaattctcttttcagttttgtttggtctataaggaagttagggagtggcatgaagttagggagtggcacaaagtaagtgctcaataaatatttgttaaattatggtatttatgtctttctgatatttatccaagagcctgaacatgttaacattgattaaatgtgtacacacatgaaggaacaattgagtgggtaaaatttagcactggaaggtacaataaatagaatttctataaatgaaagtgtgtttgtttatttgctgtttgttttatctcaagaaagtatgcatgccttaaaatgttgactttacctaagtaaaatttggaaaactgcacagtacctgttggtaccatagcctttgtcattaataagcattagatgacagccatgagaagctatgatagagacaaagactttgctgggatattactcaacattgagaagtgctatatggaatctgagaattacatgcatttaacactgaatgtgatacagactttattgtctgtgcctttcatttgttctgtaaatttttgtgtaagtaaaagtgatgcttatttgctggagagtggaaatcatatttattctcgctacattgagaaatacttgaaaaacatttttttttctgccagtaccctgtacattctgcaatgtttattcctaagttttggttttaaatgttgaatactgtcctaaaattttattaaagtgtgtattttccattttgtttgtagagcaacaatgtatacacataaaccatgcccttttggattttccacttttgtaattactaccatatttgtttgtttacttgctttttaattttatttctttgatgaagtggcctttagcaatgtcttgcatgctacatgagatctgcttatattcctggaattatctgttggattcttgagtttctctccctactgatttctcttttctttcctctgatattactatatgcattccccttctcatatacaatgggaacaaaaggtagtgtgaccttcacaagattatttacataattgcataaaattgtacctatgagttgtttagaatagtggacattataatagtaaaagatcaatgaggcatgaatgttagttattgtttttaattattatcaggttgacacccctggaatttgaaggggaaaatataataaaagagaagcagaagtaaatattttcccttaatctcaacaagctgtaattgttgcctttcctctagacttcagtatcctagatgctgtgggactctagcttagcaccttcggggaggacaggcagtttggacacccaggtctctcaagtactttcatgtaacgtggggttatggaacattttttaacgttattgtgggagttattttgaggattttctcctttgtctagaactggtatcgaatagaaaaaattagtcagaaaataaaataaaataaatgccagccattttcttccctgcctttataatctcaggatttcttaagagagccttgtcattgaaatcatccagacatttctttgttcatcatcttttctctattataaatctggtgttataatttgtaacgtttagttgtttatttgtgttagtgattataaccttagttttttgcaatcaacttactgtttagaaatacaagtggaaatatgtgtacttatatatgtgtatgtattatatgtagaaaaatgtgagagactttttctgtcaattccccactctcaaatgattccattaagactgctcattatgtccatgagaagtaggagaccaatgttacaactattttgaatattaccctgtgtttttcctttttgtccttaacatagtgaagcatagacaataatattttattaatacaatattctttttataataaaaatatttattatctagtttcatgtgggaagttttgtcatttcttgtcattctctcctccaccatctttaactctgtttataaacacacaaagccttgtgataacaggaatttggatatgtcataactgtgctctgtaactggctcaccatgtatttaattaaccttgtagtaatgcatctctgcatttttgggaactgaattttgagaccacacataaagcatttggtatggtttgggtatcaataatttaatgaattttttaaaaatacatgcatcattgaggttttggttttcatatttttggttgcaatcattttataccgataaacagtgcaaatattaagaataaattatattatcttgtagttgatcatagtcgtgaaaaagaaaatgcaccagaaggtcctactcagaaaggtcttcgtgaagccagggaacaaaacaaatgtaaaacaaagatgaaaggcaatacaaaggtatgatatttgtttttgtttgcattaagtcatacttaactctcagatctttagatccattcactcatatggtatcattattttaccggaaaaggaatttagaggttatatattccgggctgcttggtttatacatggacagtggaggtatccaaatgttactagtaagtagttaattcagggacacaggcttattagtagcagagacagctcagtggatcactctgccacctatcccaacataatcatgatcatgtctgctcacctgctaacttttctgcttgaaactacctctgtctaaaagaaatcactcccaggtcatatcttgttatatcttttctcaaaatgtaacgtcagactttacttagtctctttaaaggtagaatgaaatagcattatgctccgtttaacaatctctttatatcttgagtaccttcactttgtaatcagactggtagtttaaatctttgccagtgattaaagaaaatggtattaaaaatggttggtcaaagagatcaaaaatgaagaaaattacataaaacctgtgaagagtttagtttattgttttgaaaattacataaaagtctagctcaggtaatggattttcttgtaaggcagttgttaccttagagttctaaaatatctggcacttattttaaaataaaaatatttacaattataatagcttcttagtaattctagaagaagaatagatttgtatgaattcaaataatagcatttacttaggtaatgccaataattttttttctctctaaaacatgcattggattctggtattgtataaaatatttatacaatgaatttttataaatttgtataaatataaaatataaaatttataaatttgtataaatataaaatatttatacaataccagaatccaatgtataaaatatttatacaataaaataaaaactaatcacttttttgttataataagctttttattataatcttgtgctttttcagattagtgttttgttgtttttctatcataattatagattatcgtatgtgaggtagactcacatcagatttaaggatttttggaatgatggaggtgattgtcatcagaaacattttcatcttctaacggtataagtattgtctttcaggtagtaagtcatacttagaagtgatttgttgattcattcactcagtgcttactgcttataagagtttagattaataatgcaaggttgactttttatgggacaaaaagatactaaaatataggaaaagtacattgcatatttatgcatagtatattattttatggtgttgcattctgatatttaacgtaatacctacagcatggtagaaaacataggtcatattaaagggctaaagtgtaaaataaggtgaatccttctcaccttcactgagtaatcatttttactagtatttctcttaattttcttgttgttattattataacaaatgactgagttctgtttctatttttttaataattcacttcacatgatatctattgactccgccgtaacaaagaggcatttagagcactttactgacttgatttgaattatattattatgtatgttgtcataattgataacatttacatttgttctatagtcttaattctattttctatgctatgtctgtaaattaatactaacatttaatcccataaacagcctttaaatggattatgtttaagtaaatgtaatttattgcagacattgcaaatttaactagaactgtagaggaggaaggagaatacctgaagtgcataggactgtatttaaagatttctcttttataaacagtcgctctcttctacttcattggcttacactcagctgcccctgttatgtattctcatattttccttcatagattgctttttctgttttcctagattatctccttgagtaattttcaaaaagggccaatggagataaatgatctaagttcatacatctgaaatattcttgttctaccttacactgagttgatattttgctggaattagagttctagttttaaattaatttttcaccagaattttacaggcattgttttaatgtcttagaggatagcaataattgctgttggtctgattcttgttattttgttgggaagtaaaaaataccatatacaatacaatgtaccagtaaactagtattttgaacaactagaacagtgaggtgtaatcataataacaactttatttatgtgacctactgactcttaaagctgctcagtggaggtaattcaacccttaccctagggtgataattcattcaggcttcatgaaattattagtcaagtgtgtgtttactctggttgcaaaacacaatctcaaatcagtaattaaatatgtccagctttatgtaacacaaatgctccacatttaacatgaagttaaattttcacctaaccctcagctgaggacttctttgggctagacatttgcagtgtggaaggggttgtaatggtggtggtgtgtggccgttcgtaaatcttttcctcttactttttccctcttactttttcctcttactttttcccttactttttccctagtttgctaactggcaaggttgaaggtgcaaggagggagaaattaaagacgaatggaagagttgttactggacttgagataccttatgatagcttagagttctttgaacttggcaaaatcagaaagcttttatcctgatgagcactgtattagtcagagctctccagagggatagaactaataggatgtgtatatatatatatatatatatatttttttttttttttctttagaaggatagaactaataagatatatatggggagtttattaagtattaactcacacgatcacaaggtcccacaataggctgtctgcaaactaaggagcacggagagccagtccgagtcccaaaactgaagaacttggagtctgatgttagagggcaggaagcatccagcatggagaaagatgtaggctgggaggctaggccagtctggtcttttcacatttttctgcctgctttatatcctagctacactaggagctgattagatgttgcccacccagattaagggtgggtctgtctttcccagcccactgactcaaatgttaatctcctttggcaacaccttcacagacacacccaggatcaatactttgcatccttcaattcagtcaagttgacagtattaaccatcacaagtccccgccttgtcaacttgaacccatacatatctgctgagatcatacataatcttcaaataaagacaataataaggtcataattatgcctaacataaaacaactatccttcgtacaaccagaaatgcatcagtccccaactcaaatactattacataaagttaacaatacttaaatgttgatgtgaagtcagtaaatccttatatcacatgataagggaaaaaggaaataaaacgaaggtatattcttagtacagtgtatacatgtacaaccatggttttaacaaaagaaggagggaatacccatgacaattacagtcctcgtttctgcagctggtcatgtggttgtagctggtattgattactaccttgttctatctattctgtagtccctttgccttcagcaagtacctcagcaggttgtggattttttcctggtggagtgacccaaaccttcattcctgaagggtctgggccatatgcagtcctgcccagactgtgatgttgtaatttcccaatgaccttaatcacagggcatggcaatactaagagacatcctagtggatctcctgtagtcatgcatactctttgctacctccattgtggagtagtagactgatttcatcttgatagtctgggccaatcaccccagccaagactgtaactcccttcttagcctgttgacttaaaggtaggaggagcccaaagtgtccaagtggcaatcttaactttcagtttaatggaatcattgttgtgtctcttgatggcagcgttcctccctctggaactaagacctctaggccagcaggatcaatgttgtgggaacaggaagcaagaattttgctggtggatcactaggggtgatggtgagtggtgccacttccacttccaccccttggttcctggaaccatgaatcctggctatgggagaaacagtaccatatattgaatgctgattcagagcatacacaccttctggagaactttgcctcagcctagtaaagtattgtcacctagttcgtgttgtaattgtgacttcaaaaggcaattctacggttttatcaatccagctgcttcaggatgatggggaaacatggtaagaccagtagattccaggagcatgagccccatgctgcacttctttagccataaagtgagtgctttggtcagaggcaatgctgtgtggaacaacatgatggtggataaggcattccgtgagtccacagatgatgtcttggcagaagcattgcttttaggataggcaaacccatatccagagtaagtgtctattccagtaaggacaaacctctgccctttccatgatggaagaggtccagtataatcaatctgccatcaggtagctggctgatcaccccaaggaatggtgccatattgagggctcagtgttggtctctgctgctggcaaattgggcactcagcagtagccataaccaggtcagccatggtcagtggaagtccatgttcctgggcccatgcgtaacctccatccctgccaccatggccactttattcatgggcccattggtgatgacaggggtggctggggaaagaggctgagtggtgtccacagaacggggcatcctttccacttgattattaaaatcctcctcagctgaggtcatcagttggtgagcactcacacggaatacaaatgtcttcacagtttttgaccactcagaggtgtccatccacgtacctctttcctgaatttccttgtcaccaattttccaatcgtgcttcttttaagtccctgaccatccagccaaaccattggctgcagccgtaagtcagcatataatcacacatctgaccatttctccttccatgcaaagtgcacaaccagttgcactgctctaagttctgcccactgggaagatttcccttcatcactgtctttcagggatgtcctagaaaggggctgtggtgctgtagctgtcaactttcggatggtgcctgcatattgtgcagatccatctatgaatcaggccctagtcttctcttcctctgtcacctgatcataggtaactccccatgatgccatcagtgcaagctgggagacagaaggcagggtgacaggaatggagaccatggacatttgagccacttcctcatgtaacttacttgtgccttcgggacctgcttgagcccgatcacacatacaccactttcatatgatgaaggactgctgctatgcatgacccagtttatggctagatgtgtcagaaagcatccagttcacgacaggcagttcaggttgcatggtgacttgatgacccatagtcaaacattcagtttccacgaagcccagtaacaggccaagagctgtctctcaaaaggagagtagttatctgcagaagatggcagggccttgctccataatccaagaggcctccgctgtgattcacctatggaggcagcattggatctgctgggttatatggccccagtggtagagcagcttgcacagcagcctggacctgtttcagagcgttctcctgttctggacctcactcaaaactggcagcccttcgggtcactcgataaatgggccagagttacctaccccaatgaagaatgtggttgcctgcaaaatcaaaataggcccactaggcattgtgcctctttcctggttgtaagattttactaattgactaatatatctatttcaagaatacaatcagaagccagggaaacaatgaaggaatgggtccataaatccactgggcttaccgtaaaatagacttataccacaacactgttgatcagaaggctatgataagcccctaatttagctgttagatggtgttttggggtctctaggaaagggcatttattcagagccaatttctaattatatctgaaaggtatgaagcaaaagagtactccatgtaaatgactgctgttcctttagggaaggcttggaggaagacttacaatcagatttctgtagtgaacccaacatgatacaatgaacacatattttgtccagtgaaaataaaaaaacactgacccttctaaaatggtccaacataataagtatgccagtaggtggctggcaggtttttcatggtacggtgccataacaacggttccatgttggtttgtgctgttggtaagctggacattcagcactggatggtagctgaataaactttgcttaggagaagcctttgttaatgattccatacgtagtcttcatctttaacacaaggctacatgatcctattgagcatacagagggagagccaaggaaaatagccagtattcacaagataaggcatgtgatccacccgattattgaaaacctgttttgcagtggattttttaaaataagtatacccatgggacaccaatatttccacacttttgcctattgtgagagatgtagccactaaccatttccttagatcttatctcagaatttccaaccttattcttttataaacccctaaccagtcagccagactgatagccactgccaataaataggtatagatgtatccgctgtaccatttatgtttttaggcaacataggtgatcagatatactgccaagatttctgttcacctgaaggcttttcattcatcactgtctttcagcgctcccattggaagacttgtaatccagtgactgtccacttatagctgaatttgggtggcacattgtacaaacctgtatggaaatcaggctagttttttttttttaatccattctctgatagctggtcatggtgagtatctcacaaagccgtaggtatagttgagggacatgtgacattgaaacaagagtggaagtttggaagtttacctgctcatgcaacttacttgtgcttttctgatgttctctagcacaatttaaattataattcttccttttttaagatgaattgcttttacatgtccagactcatgtctttgaggacctcctggtttatgatgagcaattcagtttacttagttgcttggtgttataagtcctcagtatctgtcagagctcatgaacatagtaggagctaacccttaatagagaatatgtaaaagtagttatcaacaaggtgaacatgccttttctccagaagtctggaggtcagtactgtggccctctgttggggcttgttataggcttcctatagtatcttcattttctacagatagtttgagcaccattgggtctgctgggccataaggcccaaggagaattgtcttatatcctggacatgttgtaaactttttggggtccaaacatcatttatactatgttctttattcagcatggaggacaaaagatacagtaactttgccttttatttagaagcattatcttaccatgttccaggcttcagaatttctttggtgtttgtttcttctctggcacaagcatattgctaagacatctagggtacttgccacttcctgctcatcagatccatttagggggattttagcaatatagtggaatataaagatggtcaaggttactttagtttgacagagaataggggagtttatatggccccgaggcaaaggagtagaaagttttctgctgcctttgtcatgtaaaggcaatttggattaactaccatcacagatgggaggagagaataaaacattcaccaaatcagtagcctcataacaagtagtagagggtatttttatctgcttcagtaaagataacacatatggcacagcccatatgttccagatctttacatgattctctcaatcttgtaccccattattttctgattgaattcttgagcaatgtttggacagtaagattctactcctgtctctcttttgttggatctggcaacctccttttataaaagtaagtgacatattggataatatatgtataaacactttatacattataaaagcattatgtaaatacaaagatattattgttgctgatattattcctattattatagaaatatatcccccaacatgatgctaagattgcagagtatttagtatcttgctgacccctcttgacttatcttctagctctacttgttcctgttcttctcataatgaagtgcaaaaataagctaaggttcttatgggttgtcttggatgtctaaataagttgttcatttgttttgaatgttctaggtcttaatcagtgtatattaagattatatgaatcctcttgaatgatgatatacactccaatagagtgtgtgccacttgagtgtataccatatggtggatacactcagaggcagcagtgggttcctattacaagtttgtaggaccttattctcctggcattccaaactgtgtcttctcttgagtacatctgtagatagtcaaaacatataagacatgaactactgtcctgtttgcaccaactagctccttttgcctataatcataacacacaaagcttattattagtaaacatcatgtttatccattctgattaacataatacaataaatagtgatgttctataatatttctagagagtacagttcccttcagactattttatgactagagtggaatgttaaccttggcaagaacataaacatgtactgttgtctgcccaactgaatgcacattgcttctaatctcactttatgagaagacacatttgccggatcaatgactacacacgatgtgcctgagtacatgttaatctgctgttgcaaagataccatatcaggtagaacagttgcaatttaggctgttacttggttgagtttgcagtagtctcctgtcatcctccaggatctttgtttattatagaaactagactagggaattatatggaaatatgatgagaacatccacatctacatcctttgtttaaatctgtgccattttccaccaccctccccaatatgcagtattattttttatgaacttgacagggaaaggagcagttttcaagtctcctacttggcatttcccaccatagtatcatatatcccacaggtcaagaattaatgtggaagttctgcaaaataccaagtatgttctttcaacttgtttggaatctgttaaatgaccatcagatgggttcatggattccatcttactgtgagccagacctgggcaagctatatttattacttagtccctatatgcctcagcctcaaatctaagatggtggagggtgagagttataaaactatgagtccctgagtatcaacgccatgctagaccctgtgtcaacagtttcacaatgtctgggtctttctttttctgtagtgtattgttacctaagcctctggggaaggaatggaggaatcattgtatgtacttgctatggtgtaggaggatcctttttcatagggactgaacttctttcgtcaggaagttctgtgtgtgaaaactggctaagatctggaaaccaggcaagagatagtgactttttacaaggttgctgctctcagtatcctgatcatccatcctgtttcttctggtcgtacagattgaacattaccactgttggcttcccatctttcagccctttaaagattctatgttctattgactatcttcctagcgttctatggttcaggatatcctgatagcccttaccaccttgctgttcttttccataattgtgcccatcttgcttttgacatttacgtgcttctggctggcctctgctttctcaggagtctataatctaaattgctttcagggagtgtagttctctaataacatactctctactatcatcttagagaaccacaactgagcttctcaatgatgttgctgctcctctcaccttactgctttcctagtggacgtattctctggtcatccggtggacatggttatctcatgggatttttggccttttatggtgtatccactctcacaggctcacttctctgagtatttagatcctcctttgttgtggaatgtagcattggcttttctagttcacttagtttggtaatcactttttcccctaagcttcaaagagccatcctagcttcacataaataccagtttcctttctagggtgttaagttctgtgttatagaagagtactctcatattgataaactctgccttgtccaactttatattctacctctcttacctcaatgacctcaggacccaattcttcatgtactgtcgtggaacccataggtacatgttggctagttcctgcagttccttggaagtagttcttttcatctttataacagagtcattacttacctgaataggttttatttttatttaaatgaattttggtctgttggccagtaaggagggtggggaatatattgtaagaatggcatgtattgtctcataagacagaagactctgaattgcccttggtgaagagaggtgtgctcgtctctaaaagggagaagcaggccatttttgcagggccagagagttcagggaaatatgaagatttaagatttttaagtacgttgtctcagatttcttcatctctgtccacacacacacacacacacacacacgtatgacttcttgtaactcagaataaatttatttttccataaaattcatgtactaaaatactgttggttttcctaaaatgactttcctataatatgttttcaaatttcacttctttgctgatatctttaaatttttatattattatactataactttataacaatatttggagtcatctacagcaatttatgttttgagataaaaataacatgacaattcacaaataactatcatatttcacaaacattaatttcttcatctttgaaatgtcttctaatagtatctacattttactagtttattcagttcagaattgtggccttgtcttaaatcgtattcttcccaatgtcttccaaactcccattgatgccttttttccatattatttaataagttgtgaatttctcctaggagtggggcatgggttcagatcctactggaaagggcctaagagtcttgtcttgaaatttcatttgcaaaacaaacttagattaaatatatatatattttggttggatttaggagggcatctagcagagattttgagaggtctcctgaaactatccctaacctcctattgcagtttccccattttcctttaattctcactcccatccttctaaatctggtctccatgggctacattcacaaccttgcaggctgtctttcaatagttcattctatgtttcatggattgataactttccctaaaacatgcctctataagctcgtctaatcttccttagacaattgtatatctttacttctcaagccagttgggtatctagcttgttgatattccatgataattcttatatatcttttataacattataaatcacattttacttatatattttacaaagttggttacattttaaagtcaattcttatggtttaaactattttctcttgaattaggggaacaatttttgtgaacattagggaagccattttcttctgaaagttttttagccaatcagtggattactaaaatagtcagtggattagtctttgtaaagataactaaatattacaacataatttcattttacctgtggaatatattttatcctaaaggaaataagagccattatgcaattaattggatggtttttgcaatctcataagtcaaaattaagagaaaaaagttactgctttattgagactaagaatgatgattatacatgtgaaactttcagtgtgtcaacatattattttaaggaacagcagaatggaagagtgccatacagatttgaatagttttaaaaggtaatatttatacatagaatttccttttttgttgtagaagggaaaaaaaggatcaaatggtatccactgtagtccaaattcattactttaatgactccttgtagagttaaattggagctagattataatatttgtaatatattaaaaatctacctttcaccttgtattttgacctatatattcaatgacagtgcaggaaaggtgaaaaagcactattattaaaagtattttaagaaaatagaaaggaaattagaaaagataaggggctgctaacttgtttcttccatcctttttttgcccaaattcttagtcttttttgggttggaatgaaatgcatgctctttttttttttttttttttttttttttttgagacagagtctcgctctgtcgcccaggctggagtgcagtgtggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccattttggccgggatggtctcgatctcctgacctcgtgatccgcccgcctcggcctcccaaagtgctgggattacaggcgtgagccaccgcgcccggccatgcatgctcttttaaaagaaaattcttccctagtgaaaaaatatttagattgttttgtttctatctgtaaacatatttatatccctaataccccttctgggtttctgctggaaatggtgttttaaaatattataaagatctagtaagaaaacatagaagggaggattatgggaaggtggcagagtgggaagcaccagggatgcctcctcatctagataacaatggcactagcaaaatctgtctgatataatgatttggaaagtctagagtctgttgaagtctttcaatgtccacaggaaggattggacagtaaattatagttaagttgggtcaatttcaactcttagtatatcagcacctaccttcagccaccctagctctgtggcaggcagctgcacacaaattccaggagtaccttgcaggagcctgggtgggcaaaaagcatcctgtcctgcaaatatcagggatctgtgctcttatctctaactactgctttttatcatagaggtgcagacaaagagggttatagcaattgttgttttatcttactccattattcacccttgtctccctctctagctgaagtgatttccagggacttaaagggccaagtctccttttcccaccttcgtttttctcattccccactttggggagccaaacattaaagtctatgacattcagaagcaactgcatatatggggaaaattagaaagtgaccacacaagcctggggataggtggaggctcagaaaagtcctgagaaaacagtaaggttactgatccttgaccagagacagtccataacaataaatttttttaaaaaataaataaacacaaacaatagtaaaaaacccagcaaaccctggggaaggaggagaatctgatttccagactccaaattacaacacaaaatcatttgtatttctatacactaacaataaacaatcagaacaggaaattatcaaagcatttttatttaaagtagtgtcaaaagaataaagtacttaggaatttgtcaaagagatgaaagacttgtacaatgaaagctaaaaaacattgctgagggaaattaaagaagacataaataaatgtaaacatatcctatgttcacaatttctatcaaaatcccaaagaccttttttttgcaaaaacataaaaacccatcctaagtttcgtatagtctcaagggacactgattagcccaaacaatcttgcaaaagaagaacaaacttggaagactcatactttcttatttctaaactactgcaaagctacagtaatcaaaacagtatggtactggcataaagacagacatatagaccaatggaatagactaaacagcccagaaataaaccctcacatatatgatcaaatgattttgacaatagtaccaagaccaatcaatggggaaagacagtctttttaccaaattgtgctgggaatactgggtatctacatgcaaaataataaagttggacccttactaataccatatacaaaaattaactcaaaataatcaaagacctaaatataagacacaaaactataaaactctcagaagaaaatataggacaaaagtatcatggcattgattttaacaatgatttcttagatatgacacaaaaggcacaggcaacaatagaaaaactggactttataaacattttaaaatttggggcatcgaaagactgtcatcagagtaaaaaggcaaccaatagaatgggagaaaatatctgtaatcatatatctggcaaggaattaatatacagaatatatagagaattcctaaaactcaacaacaacaaaaagtccaatccaaaaaaggactttaataacacatttctagattgaagatatataaatggtaaagtacatgaaaagatgcttaacatcattaatcattaaggaaatacaaatcaaaactgcagtagggtatcacttcagactaataagggtggtttccattaaaaacaaaaagaaagctggtgaggacataagttaattggaaccattgttcactattggcagaatgtaaagtggtatagtcactatgggaaaacagtatgacagttcctcaaaaaataaaaaatagaattaccatatgatctcacagtttgcacttctgcctatatacacaaaagaattgaaagcagcatgttaaaaagatattttacacccatgttcatagcagtgttactcacagtagctgaaacatggagacaattcagtgttcattggcagctgaaggaataagcaaaatgtggtatatacatacaatggaatattattcagccttaaaaaggaaggaatttctagcaaattccacaacattgatgaagcttgaggacattatgctaagtgaaataaaccaataacagaaagacaaatactatatgattccgtgtatatgaggtactttgagtggtgaaaattataaatacagaagtagaatgatgtttgttagggctgggggagagggaatgaggagttactgtttaatgagtatagagtttcagttttacaatgaaaagaattctaggagatgggtgaggataattgttgcagaaagttatataaatgcatttaagaccattgaactgtatcctaaaattggttttatgttatgccattaataacttatgatgcatttttattacaataaaaacattattaaagaaagatcatttccatatggctaggaacagaaggcatgttaggaaggatacataaacattgcagtatgtacaacaaatatgttaaaacattttatatcttaattcaaatgtcaaaggttaaaagaaaaaataacttatgttttgggaaatattcacatcaacttcatatttaaagaagattttaaaaacgtttaaagcagcaatttaaaagcctacagtaaaattattagattatttgctcaggcagcagctggtttagcaacatttattcagagcttattataagaaaaatatcttttgctgaagtttttaaaaaatagcttctaattgccattaataacttatgatgcattattttttaatcatttaattttatgtttattaatcaataatacatgttatatacaaatggcttttcaaagcttggtttatactaccaatatagctattaaaataacagctttctcataaggtatgaatgagttttcaaaagctatagctgagttttcatttttgcccatttattttaattccttttgatctttagaaattatatggccaggcgcggtgactcatgcctgtaatcccagcactttgggaggccaaggtgggtggatcacgaaatcaggagttcaagaccagcctgaccaatatggtgaaaccccgtctctactaaaaatacaaaaattagctgggcatggtggcacgtgcctgtaattccagctacttgggaggctgaggcaggagaataacttgaacccaggaggtggaggttgcagtgagctgagatggcgccactgcactccaacctgggcgatggagcgagactccgtttcaaaaaaataaataaataaatgatacataatattttgttaagggaaaaaaatattttagcttataacttatccttgtgtaaattaactatcataatcaattttttgtttaccttagcatctgttagcaaattgtattatgtactttggcaaatattcttttagagtatgaattagtttgaagcctaatatgtattttagatccaggtctaccacttattacctgtacaaacatgggcacattacctaatttctatgtttccatctctataaactgggaagaataccatgtttatcaaagggttttttgttagtattcaatgaaataatatatgtaagatatctaacactgtgcttataacaggatttagactcaagtaattttgtttcgatagaaaaggttatttactaagggaagataaaagatctctaatttttaatactatttttctcttttaagtgtgacataagttacactgaatatgtctgctaaagacttccagattcattactttttaactactttagccattttattatgcaatggcatgaacaatttaccagtagttttccctgattgtgagtatagtttccctgtttcagattatatacaaatagaaacatggagattagagaattacggtggctaattctgatgttccaatgtttgcatgtcccctgttacatatttaaaagtgcttctgtgctcataaaacctgtacacaactctcagtttctttagggctattctatattttgatttctttaatgaaaaaatggaatgttatttaatatctttatcataacacctgccagttattatataaaataggtggtaatttaaacgtaaccatatgcaaatgtgaaaaggagagaaaggtttcctctactctgatacaatggtatatgccattgtgttgtgttatgtcaccctggcatgataatggcacacttcaactaatccacttaagtgctgatactttgcatttattgtagagtttagttgcatttagtacagtattcttgaatgtttctttgcagctattattattactttttgcctaaagtgtcattgcataatgcagagtgactctggcatcaaccaaggatctgggtgctattttgcaggatttgtaaatattacaccaaaatgttaaataattttatttatcacacatggagtttctaaaaaagaatttagttttacattttttcagtttgaaaatatggaagttggtaagaaatctataaccatatgcaaatgggaattttaatactaataatatgaaaatagtgttgaggctgggcacggtggctcacacctgtaatcccagcactttgggaggccgaggtgggtggatcacaaggtcaggagttcaagaatagcctggccaacatgatgaaaccctgtctctactaaaaatacaaaaacattagccaggcgtggtggcgggtgcctgtaatctcagctactcgggaggctgaagcagagaattgcttgaacccgggaggcagaggctgcagtgagccgagattgcactactgcactccatcctgggtgatggagcgagactctgtctcttaaaaaaaaaaaaacagtgttgaatatcttcagcagttgaaataattcatttaaacatctctgaggaaatatatttaccaaaatatttatttataatatcatgccatgttaaatagataagaattaagccaacatatttataattctgtgctaagtagaaaatcaaataaacagaaatacttacattattacactaaatatattctgcttacataaagagaagcaaatgtgaatcagaataaaagtaattaagagatactaattattcttaggttttaaactctgctccctatttttggattatgcatgtatagccctggatcatttgaaaatgcataactgagactgcagtaaaaaaaaaatgctgaggatttacaacattttgaaaactttggtcattataaatacttacattagctatatttcaactgttgatttatgaaaaataagaatttgtagattaaatatagcataatgaaaaaataatattcaattaatgttttagttaaaatatatcacatatatttgaatataatatataaattaaaatatatttttaaaatgaaaattacaaaatacatatgtagtcttcaacttgcttttttgattcgatttttgtttctaagagtctttagtgttgctgtaggtggctctaggtcatttcacaatatttacttttttgtattattgttacaatgttcagttggtttccaatgtcttggaaataaacagtgctgccaagaatattcttgtatgtctccaagtgcattagtggaagattttctgtaggacacaaacctaggggtggaattggggatgagggttttatgaaatagtgtcatttttttttcaaaccagttgaatatatttataaacccacacagagagctcctactactctatatctttctctgtattcattattgccagggttttttatttttcccaagcaaatgaaatatgtcgcctcactaggtcttaatttctatttttctgattactaattaaattgaacgtgttctttttcatatgttagcttctgtgaaataacagttcatatcttttgcaatttttttccattagattgttggcccttgaagtatacttgaaatgtataattgacattaattttgtgatcaattctattaatgcggatatcttgctccacatggtgacttatattttctgtttctttattattttttcagtgaatataagttcttcattataatgtagtaaaactaatcagtactttcttttatgatagcacttactgtcatttgattaagaaacccttttttatctcaagatcagagtactatgttcatatcttttttagcatttttcttgtttattttttcctttaccaaccaattcagacataaaaacagatattatctttcataaacccaatataattatctaaatcaagaaattaacattgataaaatacttttattttaatctatagaaattatttaaattttactgtgttgtactgtctctgtaatttcttaaaactaatatttttactttgagatagctttagattcacatacatatgtaagatataaatcagagagatcccatacagtctttacccagtttcccctaacggttacatcttggaaaactataatatagtatcaagattaggatgttgacattgatataatcaaggtatggaatagttctgcctgccagaggatccctggtgttgcccttttatagccacactgatttccctttagctctgtccatgcctaaccccaggaaaccactaatcttttcttcatttctgtaatttttttaattttaagattgttatttaaatggaattatataatatttaacttttgggggttgactgttacacttggcataattccactgagtcatccaagatgttgtgtggatcagtagctgatcatgttattaaattgctgagtagttgttgattctctttaaaatatttgggagaattcaccagtgaaaccatatggacttgggattttttggatgggagctttttaattattaatacaaatttaatttctttaatgcctatatgactattcagattatctcactttacttgagttttggtagtctgtggttttttaggaattgttccatttcatccaagttgttaaatttatgggcataaagttgtttatagtgttctcttattattcttttaataactgcaagatctatagtgataccactgttttattcttgatatttgtgatttgtttcttctcccatttatttttgtcagtcttgctatatagcaatttatcagttttatggactttttttcaaacaaccagcttttttgtaaacttttgtattaatttcctattttcaatttcattgatttttgcttttatctttatttcctgtcttcttctagctttgggtttattatgttcttccttttagacttttttgaggtaacaacttaaattattgatttgactttttaatcttgtaatgtaagaatatagtgctataaattttcctctcagcattgtttttgctgaatcccacatattttgttatattgtatttttgtttttattcagttttgaatatactttacttccatcaagtcttcctctttgacgtatagattatttagaagtgtgctgtttaatttccaggtgtttagagattttccggtttgatttctagtttgattccattatggttagagatcacattgccttttgttgctagattgggagtcagggctggctcaccttcttctgttgggtggtgaatgataaaatgccctatcattatgctcttcctccagtcctggaatctctgatcattttacctccctgtttccacctttcagagttccccttagattgtctcttgcatcatttccagggtttatagtttagttaccagggaagaatgggggacagttgagtctacaccactttggctggatagaacatcacttcaattttgctttacaattttaaatatttaatttccttgaaattgatttttcatgtagagtatagtaggaatccagtttcactttgttttattcagataattgctgtttcaacacaattatatggttcttcagtggtctgaagtatcagctctaactgttatttaactagtttccatgcatacatgagtttgcttctggactttcttttatgtttcactggtgagtttgtttattcctgtggcagtagcatacctctagattattttagtttttaacatatttggatatatcctaaggtaattatcttcaccttactattattcttcttcagaagtgttttagctagtcttatacctttatttatccctataaatttaatagtaggcttgctaaattcctaaaaaaattctcataacatttattgaaatattttatatttttatacattaatatggagattctagcatcttttcgatattgaatctttcaatgcgtgaatgaacatagtttatctccccacatatttggacattctttaacatctttcaataacaattttataattttccccatgcagatcttgtacatgtttttgttaaatataattctaagtaccttatagttttgctcttgtatatgatatctttttaaataaataagcttgttcctttgttggctttgaggcctccttcaacagaaatcaagagaaagcttatgagctcagtgcgagaacagccctctgtctaactccatgcctccatcagcagcagtggacagggaactctcaaacttggaataagaccgtacctctgcaggacactattggcaggagacaagagaacaacagtgcacaccagcacatcgactaagactgcccatcttcaggacatttgtcagcaggagccaaatgggaaattctgagcaacaggtgttcctggcttgttctcctccaatcctccctttcgtcaacacccataccctttatctgtgttctttacagtcttcataaaaggagtccaggacttccagttaatcatttatcccagaactctaatcctccgtaaggatcctttttttttgacccaatatttccctcttctgactccccaaaccctttctttgtactctattgaattcaaggtcagtcaacaaaaaagtcctttatattttaatattttactatgagtgttcccttcaccttctgtgctaatgaaaatctagattttccttcatgatagtttcccctgcatccattgaggttctggtaaatgttttaacaatcaactctttggaagaagaaaacaaaagccttgatttgtatagtgttttccagtttctgtgctgttaaacactcacaccatagccatttaagctatcttctcacttcactgaataaggagcctgggacttgatgtccacactcagctctcctaagccagtatgagagagcaacaacacatcacatcttacagtacctttaagggtaactgttctctctactccactcaaatgtagcataggtcctgaaagtcagataagtgtcccctttgcttctcattgctgctttcagtttgttctccctccttcatgaacatacccttccgtgaatctcatgtcatcagatttgcccactcattgtacctttttgttatgggcacctcttctcacctcatctttttgtcaattaaaaaaattaatccccgtgatattgtcactttcttaaaagtgattcctccataatgcttcatgattgaaatgttgatatggatgatccttctaactctctgaagtttcagttccttgacagcctctcctccagtgatccacttaactcactttcatagtcatttcctaggccttgttattgcaagtaactgctataatttttcattgcctctattgtttgctccctaccccccgaatctctgcatactgaggtgtttcaaggctcagttcttgaccctctgttggttgtcttcactccctaggtgatctcatccagtcttatggctttaaattctgcctatatattaattatcccttaatttacatcttcaactgagatctcttctctgaactctagtttcatatatccaactgcttactgaacacctccagttaaatgtcatttcttcatttcaattatctccccttccatgttctccttcttaattaatggaaactccacactttagttacttagccaaaaaactctagagtcatccctgagacgtctctctctctcacatctcacatctgataagaaaaagaaattattttggctctatctttgaaaaaatatctacattttcattttttcttaccactagcacttttgctctctgtttttttttttttgccaccgtctgtagtttgtattattgcaaaagcctcctaactgatctctgcttttgtctttacttttcttcagtctcttttgaacacagcagccacagtcatcttcttaaaacataagtctgtccatgacatttctctgctgaaaattttccagtaacctcccatcttactgagttacaggtaaggtcattataacctctgaggccctacattacctagatcccttttacctctctgacattatctcctgctaccctcccatcttttgctcaattgcaggcacactagcctcctacaaattctacttatttatagaacactgtaggtatgccccaccttgaggctcttgcacttgagtttttatcttctgtctgtgttattttccttcagataattcagatggctcatctctcactttatttaaagctttactcaaatgttcccttttcagagagacttttcatagccatccaatctaaattttaatgctgcctctaattcactggcacttctttggcctctatcctactttaatttttctttttgcctatcttacatatctctcatatgctatgttgtacttattaactcattgtatcacttcccactagaatgtaagtcccatgaaagcaggaatatttattaattgtattcactgctatattctcagtgccagaaaaatgcctggcaaatagtaattatcccataaatatgtaaatttgaaggaatgcataaattaaaaaatgtgttttgttagttgctattgtatagatatgcattgattactacaagttgatcagaaatagagtgtttctgctaaaccccctgtttctataatttgtctataggctttttgggaattttctttgtaagtagtatcatctgtgaaaaataatagttgtgactttcatttttcaattctaaaaatttttatttgtatttcttatatttgtgctttgtctaggtcctccagaaagttaaatagaagtggttaaatagtggtggttatactatttgtgattttaaaggtgatgcatctgatgtttcaacacaaggaatgatatttattgtctttggtggttattctttatcaagttgaaaaaatttgttttcctttgatatttaaagtttgtgttttaccatgagtatattaatttttttgaccataagtgattggtaattttatcatgtttaagttttaagattttattttatcatgaataagtattgtattttctgcttctgagactgttttctccattaatattttaatgtggtaaatgttgccatggattttaaaatgtaaacattctctttcattcctggaataaaactaatgtattcatcatgtgttatttgagttacataacactggacctagttaatcattttttcataggatgcttacttctagtttatgaataaaattgatctttaattttcctgttcagtcactgtctttttataattttagtatcattgaataagttgtggaatagttcctttcttctattctttgaaagatttttataccctggaagacctattccttaaatgtatggtagaagtcttctgtaaaactaattggaactgttatatatttataggaagattttatactgtggattcagatttctttgtaatgtaatagaagttatttcttccttaatcaatttttataaattctgaagtaatatgcttacatgaatatgaccatttcatctgagttttaaatttactggcttaaaatatttatcatattttttattatcttttaaatctcaaatggatccataattatattctctttaatttgtgaattctatttcttgccctcccttccaacagttttcccctcccttcccatctcacatcattcttcctgtaaatatataaattttgttggtacttttaaagatccaagctttggattttataatcattatgtttagcttttttcttgtataactttgtagtttcattgttatgatcttcttctgcctatagtctttgagtttatgctttgtttctttttccagcttcttaagttgatacataactcattaatggttggcttttctactattttaagtacttaatactattaattttccccaaatactgtttcaactgcatcccacagatgtttatatgtagcattttaatttttgtttagttttaagtattttaaggtttccattatggtttgttctttgtcctgtggcttatgtagaggacattttcaaatttacatatgcatgggttttgggttatttttttatttgggttattatgtatttgtagttgaaataaatcatggtcagaatgcatggtttgtatgaaaccaattcttgaaatttcttgggagttgctatggcagagatttctagttttctaccaaaaaatgttttctttattcctgtagttttcatgatatagctgggcatatagttaggtacctgtatttttcagtatcctgtacacctagatgttaccatgaaactaaatgttgccagtggaatttgcacttaatagttgtgtgtttgtggaattacctttcagaaatatttactccctcccatcattttaaagaaaggattctacttccctgatttttttagtctttgtttttttcttttttttgagacagggtgtcactctgtcacccaggctagagctcagtggcatgatcgcggctcacagtagcctcgacctcccagggctcagctgatcctcccacctcagccttccaagtagctgggactacaggcctgcaccaccacacctggctaatttttatatttttttgtcaagatagagttttgtcatgttgctcaggctggtcacaaactcctggactcaagagatctgtctgtcttggcctcccaaagtgctgagattacaggtgtgagccactgcacccagctgtttcctgattattgatgtagagcttggccttggccatgtaacttattttggtcaatgataatttgagaaacctgactctacagaagcttgatatatgcttgcacatttaggtttgctctgtctgccatgggcatgaaaagaatgcggccatttcccttgataatatatgttcttcagaaacattagataatgtcataatgcattattacttggatatttcacaatgtattttatgttcccatgtctactcattttgtttatttccgttgttttgctgtttcaaataattctatgaggcaattcttatacattaaattctgttcatatcttattgtttctttggtataaaactcaagaactggtgatcttggattaaaggatataaacaagtgtttgttctattcttcatttttacagtgaaatacaaaaaatctcctttaaaaagctactccttgcatttcatgttagtatttgcctggtacatcttttttcatccctttattttcaacatttctgtaatatgtttagttgatgtttctaggaattagtatatagtgggcagtctctttcatttatctggtgattttgtccacttatatttatttaagtgttttccacttattttgattattcatgtttttggacgtgtttctaccatcttattttttgctttatgttaatttatctttttatgcttgcatttatctttccttgctttataatacattgatttgttttcactatgtatttttctctttcagtgtttgctctgaaaaaatttagcatgcacatgtaatacaatctaaaattaattacttggataatagaaaaacttcaaacgttttaaataagatcaaaacacttcctatttacatatatttttgtctggtcatatattttttaatataatgaaacattattatttaagaaaggtaatttataaagacaatgcttatttcaatttatctacaaatttactaattttatttttctaactggttttaggatctcatattatctttttttgcccaagtttcgtcataataggtataattttttaaaaatttatttcatggactgtattatgtttcctgtatttaggtggcatgtcttttatcatttctcagaattcacactcatgattgcagtaaatatttcctttcctccattaataaaaattcattcctttcagagatgcaattagatatgttatactatctaattctatctgccatattatttaaactctcttttacattgtttatattcttatctccttatgctcaattcccaaaaatttatttatagttttttttaaattttattattattatactttaagttttagggtacatgtgcacaacgtgcaggtttgttacatatgtatacatgtgccatgttggtgtgctgcacccattaacttgtcatttagcattaggtatatctcctaatgctatccctcccccctccccacaccccacaacagtccctggagtgtgatgttctccttcctgtgtccatgtgttctcattgttcaattcccacttatgagtgagaacatgcggtgtttggttttctgtccttgcgatagtttacagagaatgatggtttccagtttcatccatgtccctacagaggacatgaactcatcattttttatggctgcatagtattccatggtgtatatgtcccacattttcttaatccagtctatcgttgttggacatttaggttggttccaagtctttgctattgtgaatagtgccgcaataaacataatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgatcgccattctaactggtgtgagatggtatctcattgtggttttgatttgcatttctctgatggccagtgatgatgagcatttttcatgtgttttttggctgcataaatgtcttcttttgagaagtgtctgttcatatccttcgcccactttttgatggggttgtttgtttttttcttgtaaatttgtttgagttcattgtagattctggatactagccctttgtcagatgagtaggttgcaaaaattttctcccattctgtcggttgcctgttcactctgatggtagtttcttttgttgtgcagaaaatgttatccagcatataaacagaaccaaagacaaaaaccacctgattatctcaatagatgcagaaaaggcctttgacaaaattcagcaaccttcatgctaaaaactctcaataaattaggtattgatgggtcgtatctcaaaataataagagctatctatgacaaacccacagccaatatcatactgaatgggcaaaaactggaagcattccctttgaaaatgggcacaagacagggatgccccctctcatcattcctattcaacatagtgttggaagttctggccagggcaatcaggcaggagaaggaaataaagcgtattcaattaggaaaagaggaagtcaaattgtccctgtttgcagatgacatgattgtatatctagaaaacctcgtcgtctcagcccaaaatctcctcaagctgataagcaacttcagcaaagtctcaggatacaaaatcaatgtacaaaaatcacaagcattcttatacaccaataagagacaaacagagagccaaatcatgagtgaactcccattcacagttgcttcaaagagaataaaatacctaggaatccaacttacaagggatgtgaaggacctcttcaaggagaactaaaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagtacacatggaaccaaacaagagcccgcattgccaagtcaatcctaagccaaaagaacaaagctggaggcatcactctacctgacttcaaactatactacaagcctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaataaatggtgctgggaaaactggctagccatatgtagaaagctgaaactggatcccttcctcacaccttataaaaaaattaattcaagatggattaaagacttaaatgttagacctaaaaccataaaaaccctagaagaaaacctaggcaataccattcaggacataggcatgggcaaagacttcatgtctaaaacaccaaaagcaatggcaacaaaagccaaaattgacaagtgggatctaattaaatttatttattcttaattgtccagttctctttctatatgttaaatctttttacaaatgctttgtatttttctaatgagtaattgtatgttttacttctaaaggtcatatttgattctttaaaatttttttttaattattggtagctcctttttacttgaacttatttgtgtgtatactttttgtttaaccatttctaggattatgcttccaaagcttatggctgacctaaagcttactctccaaattgcagttctggttttggcatttggcaacataccccaacagtaagcatgtgcttatggttgctagctcctatacagttattttactttattttgtccataagctagtaatcgtaaacacatgctttactttttcactactgtcgagtgtaacaatgcaacaagatgaacctaaggtttacttaagtgccagttgtttttgtagtgggagaatccttcaaagtatgtagtcttacatattgctggaattaaacatcctacagttaattttagctattaagatttccattttttatgttttttggaagaatataagtaaatgattgtcctaatttaatccatggaggaaaattataacaatttttaaaattttatactatcatggatacataatagttacacatatatatggggtacatgtgatattttgatataaacatacaatgtgtaatgatcaaatctgggtaaatgacatatccatcacctcaaacatttatcattcctttctgttgggaacattccaaatattcttttctggttattttgaaatatacaataaattatcacaaactatagttgccctatggtgctctcaaacactagaacttattccttctatataactgtatttttgtacacattaaccaacctctctgccttttctctcccaccttcttttcccagtctctggtaaccaccattctattcattacctccatgaggccaacttttttagctctaatatatgagtgagaataagcgatatttgtccttttgtgcctggtttgtttcacttaatgtaatgtcctccaattccatccctgttgctgctaataacaggatttcattcttatttaagttctttattcagaattaaagtattttatagtcaatggataaatccaactcttgattagtttatatgttctagggaggataagagaaagcaaaataagggttttcaaagttctttaatctggttagcacaaaggctacaggagttgaagtatgccaaaaaagaggtttacatttggataataagaagaggcataaagtaaaataaaattatagtcaaaagtgaggttgccttaggttcagcatctttaagctgatagtggcaaaggcaatggtcaattactgtaaatgtcattttctcacccttttcaatagtttcctgttttccagaattttgtttttttgatgtatcatgaattggatagtggagctttgtagtagaagaaatggcttattaactatgtgcagttactttattcattcatttctttactcatcagaaatttgcatacagtttgggaggcagtgggtaggaatgggagataccaaggaagatggaaaagccctgcttttcaggatttcacacgccagatcaaatggatttcataatcaaaacaaaaattatttcacttgattctaaattgctaactttggaatagttgtgtatatatactaattgagagccaaggtgatgtcattattttatttaaccatacattaagttgtaatttttatttatgtgatttatgaaataatgttatgaaccaaaataagtcaaagcattgtattttaattaatcaaatattaacaattttaattccctctattaggataaaggatgttaccatattatacagaaaaaagttcagtttagaaataagacctaagcggtgtgctcaccattgttccatctgtatgggcgcacccttctatgtagaagtaacttgccttgctgagaattaaaaagaaaattttatatgcgagtgcaatttcttttgtggcaccaaaactttatatataacaatttggggtctctcccgggattacattctcctccaggacggtctctcctctctcgtgaggaggcgcacccagccctagtgtggtggcctcaggggtgagaaatcaagacccaccccagtgcaaggaataacccgagctctcagcgacgcggatttaaaaaaaaaaaaaaaaaaaaagggaaaagaaactggccagcaacctagcttaaaggactctcacatactgcggcgaccactctgtgcacagaccaaggaaggagaagccgcgggagcgggtagagtaccttggtggtcaaattctggagggctaaatgtgtgtgtgcgtgaatgatcacaaacaaccctgcttgcagtgttgttcgtgtggatggtgacaagtcctactgctggacagtgtgagtgggtcctctttgcagttctaccttggcggagcggccagagaggacagcacaagtgggaagtgtgcaaaggaccttcagagggggaaagggagaaataggtcaatcttccaggacaggcaagacaccccctggtttgaggggttgagccttccagggcaagcaaggcaagacgccccctggtttgagggcttgagccttccaggacaggcaaggtgagacaccccctggtttacggggttgagccttccgggacaggcaaggtgagacatccctagtgttgaggggttgagccttccgctaatttcaagggttgaacttgacacaacccccccgttcaacccctttcctttcttctcgggagaagaaagagtagttgcactcccgcaggtccctaccctaggagagagagagacaggagagagagagagagagagagagagagagagagagagagagagacagacagacaggagagagagagggggagagagacagagaggagagagacagaagagagagagagagacagaggaaagagagacaggagagagagagacaggagagaggcagagagagacaggagagaggcagagagagacagagaggaagagagacaggagaggcagagagagagagaggagagaggcagagagagagagacaggagagaggcagagagagagacaggagagaggagagaggcagagagagagagacaggagagaggcagagagagagacaggagagagaggagagaggcagagagagacaggagagaggcagagagagagacaggagagagagaggagagaggcagagagagacaggagagaggcagagagagacaggagagaggcagagagagacaggcagagagagggagaggcaggagagagagaaagagaaaaatagaagtagtaaaaaaacaaaaacaaagaaaaaaaaacaaaaaaaccagtgtaccctattcctttaaaagctagggtaaatttaaaacctataattgataattgaaggtcttctccgtgaccctgcaacactccaataccaccttgttgtaagtgtaaacaagggcatagccagaaagcactgaggccactgacaacctgtagccttcctataaaaaatccttaacctagtaatctgcggatggccaaatgcattcaatctgtagcagcaactgctttgctaacagaagaaagtagaaaaataacttttagaggaaacctcattctgagcacaactcaccagtttagttcaggactatcctaagtcaaaaaaagcaaaaaggtagcttactaactcaaaaatcttaaagtatggggctattctgttagaaaaagatgatttaacattaaccactgaaaatccccctaacccagcaggtttcctaacaggggatttaaatcttaattaccgtacaaaggtccgaccagacccaggaggaattcccttcaggacaggaccatagatgtttcttcccgggtgaatgagggaaaaagacacaatggttattcagtaattgatagggaaactcttgtagaagcagagttaggaaaattgcctaataattggtctgctcaaacatgcaagctgtttgcactcagccaagccttaaacagaaccaggaaggaaccatctataccaattctaagttaatttggactaaacaaggtcttattaatagtaaagaataattaaaatcccaaacttagaaggttttcaagaaacgtagcttgctaaaagttagcagtgtaacacgtattatcctaacttttaatcttgtggccttagacagtctagtccacagacatgaaggaagttcgctttgaaaaagaatggttatcttcaagagggaaaaaaaaaagtggggtgggagaatttacataaaaaggaatgttccatggtaaattattgtcctgaaataaattaactgttttttttttttaaaggggatgtttgtgacaagtcagaaagttgaggcatgtcgaaaaaatatctctgaaagttgtgggaaaaaaaggttataaaagggaatttatgcaagaaatgttgtataatttaaaagtaactaggcctcctgaatgtaaaactatttattctataaacagtttatgtgcaaggtgtgtaagaaaagtaaaatatacttttggtaaaaagattgtagggaggcataagaatgtggatttttacctacattaacaggttaaaaaatatatattttgttttaaaggtttaagcaagttgtaaaacgttaattgtaaagaaaattgtgtgtgtaaacatactcgctaaagttaaagaggtatcatccagtttttctgtgaactggacagtaaaagcataacaggtttttcttaacgcactaacctgctctttaacaaaaattataaaaggttaaaaagagtctataaaatcttaccttagggccagacattaaaaattgaataaatatatctacaaagttttattaaaactaagtttaacattaataacacactaatataaaggtgaaatttagctcatcgggtataaaaatcatacaagaagcattatcaaatataaaatggtatttggctttctttggtctaaaaactaataaaaataggtgctaaaggaaatttctcagtaagaaggcaccaaggactataaagtcctctgcagatgtccccacacttaaaaggtcaatttcttagaaattatatacttggtttatcttccactttccttttcctcaaaactaaaagtcttttagcacaggtaccatccctagaatttccggtaaacgggaaccagcctgaagatcacgttcttatctagggtggaaagaaagaaaactttagcgatcctgggaaggaccctaccttgtgctgctaaccaccgagactgctgttcgtacagcaaaaaggggatggaatcatcacacccgagtcaagaatgtgccaccccctccagagtcgtgggccatagtcccaggggaaaaccctaccgaactaaagctaagaaaaatttaactctctttcatctattctattactctttattctttcctctatctgttgctgaccatctagttattaacataagcaagtcaattttgcctcaaactactgcatttaatgcttgcgttgttataccctgaaggaacttaccaggtcaaagacagttttctatttcagaaaaggaaaagtacctgtgtccctcctgactcttctcagactgggcattagtaaattgggaccatttaatccaaggagatttcgataaagacctaaatgtcaaccaggagtcttgcccccgatgtagagcttttatgctgtagttggtccaacgttctgtggcccactgaagagcaaagatggactgcaaagatggactacaaaaaccaactggtttttgtaatttcctaaaaccctacattcattttactagagaatcatagaagttaaagacttaaactttggcaattaagacaggataccaagatgcaaatgcctagttggaatggatcaaatattccgtccacacattaaacaaaagcaattgttacacttgtgcgcacggcaagccagaggcccagattgtcccctttccactaaggtggtcctccagtcgaccaggcatgggctgcatggtagctcttttccaggattctacaccctggagtaataagtcgtaccaagctctctctctctgctatatcctgaagtccggcaccctgcgggtcagcccccgagggccatccagcttccgtctcccaacagtaagttaactttgtgtctctcatgacagggaggaaacctagtgttccttagagacctgaagggatgcagtgagcttaaaaattttcaagagcttatcaatcagttagcccttgttcatccccaagcagatgtgtggtggtattgtggtggacctttactggacactctgccaaataactggagtggcacttgcgctttagtccaattggctatccctttcaccctggcatttcaacaaccagaggaaggaaaaataagacattgtaaagcaagagaagccccttataggtctttcgactctcaagtctatttaaacgcaactggagtcccacagggaatatcagatcagtttaaagcctaaaatcaaatagctgcagaatttgagtcaatattttggtgggcgaccattaataaaaatgtagattggataaactatatctactacaaccaacagcgatttattaactacactaaagatgctgttaaaggaatagctgagcaattagggccactagccagatggcttaggaaaatagaatagccttagacatgatattagcagaaagaggagtttgcgtcatgattaaaactcaatgttgtatcttcatcccaaacaacactgcccccaatagaagtataacaaaggcattgcaaggtctgactgctctatcaaatgagttagccggtaactcaggggtaaatgacccctttacaagatggctaaaacagtagttcagtaaatggaaaggaataatagcctcgattcttatttccctcgcagccgtaataggtgtacttattcttgtcaagtgctgtgtcataccatacatccgtaagtagatgcagaggctcataaaaacggcacttactaaaacctcccttaactatcctccaccttatccagagaaacttcttttgaaaaatcaagcaaaacagctaagccatgttaaaaaaaaaagaaaaaaaggtttgaaaagaaaactataaagaatacaaggggaaggattgttagatatgggttctaaatttcttttcaaagaattaatatgtcagtatgttcaattctttgccttttacttgtaaacttcctcgtgaagcaacctttttcgtttccctgactcatctgattacctactccaccctgactcattctgatcacctactccaccctaactcattccgatcacctgctccaccctaacacattctgatcacctgctccaccctaactcattccaattacctgctatctgctctgccctgactcccaacaaagcactcaccctgtcattctctttaaattagccaatcggaattagtttaacctgtgtggtctaaccctagccaataggggaacaacacagcagcaggggccacatgtgtcagggataagaaccccttcccctcccttgtccaagtgtgtgctcaccattgttccatctgtaagtgcgcacctttctatatagaagtaacttgccttgctgagaattgaaaagaaaattaaaaaaaataataattagacatgggcattgttactctaaagagcacctcgtttaacttttatgaatcaaagttttatcctatgttggtcctcaataaatcctatcatacttcccatattaatttctgtaagttaattagagtgacatcttgtgccactctcagtgttttgtttgtttatttttttttgtttgtttggcttttcacttctcactagtttcctaccctccagaatttcccatttttggagaagcgctaaaggcttagttctaggactgattctatgtcacaggggcaatgaagaaaataaatgaaaccagcatggcataaaatatagaagagtaagaggagaatataatgataagagatagatcctaggagtagaggcaaataatagtgtcataaaggaaagatttaaaaaatgaaaattaaaaatatgaattgtctcatccaaaatgggttagaaaattaatttaaaacattattattaaattgataattttaaaatctgcaatgttagatttatagcactggatctacatactatgtataatgtgaggatctttataatatcaggtagtcttgagttatattgggtaatgctgttaattagtatgttgatactataaatggtgttttatagttggtactataaatgatactataaatgagactataaatggttttactgaagcataaatgaataggataattgcattaccattcttgttgcattttctgaatgtatgttttctagagaaaatgctatgctatttcatagaagttcatgtgtgtcataaaaactaatcctaagtgttcattcatttctaatagtatccataagattaagtattatttaaatttttttgaagtatcaggttgctgaaatattagtctgaggataacaaaatccagtaatagtttttcttcctacaaaggtcatagttttatatgtgtgcatatgtgtctatgtgtgtgtatatctacaaattaattaaaattgttgagcatctcatcatgtgctagacattgtataggttatactttacatatgtttccaatttaaaactgtcatatgaaatttaagaactttcttataactattgagaggactacatatattattcaaatattatttatattttaaatatgtttttaaaagatattacgagccaagcacttgtagcacagactagtgcataattaaggtttctgatagatttggtgaattaacaaaaaattgttaagttggtagtgagctaaaaagatggcagggtaaattaacaaaaatggaaatacgtgatactccatatctcatcccttggaattatggatctgactacatcatcattatgtctggccatgacagcacaaaccaacaatttaacttcttttcgatctaatagtgtttggtacatgccataatcatattgttagttttttgggatatttcacagtgcaaacaaagttatgacagattgatcagaagccctgggtctggtaaaatagaatagccctggtctgtttttatccaggtgtcactaatcttcatgtttaactttgtacctgaaaatataaaataatagctaattgtgctttcccatttcatttatgtttcttcaaagaaccacaggatttttatgtttaataattcattttaaccactcttttccaatgtagacagtaggaaacactaaatgcaaaaatatgtgcagtaggtagtctccaaacatagacccctcaattaactacacctcctgctattcagttcctagtgtagttcctgctacagtgggtctgagctaatggatctatgagctttcttttagcattaattacttggaaacaattttcagtttcttaaaaattcagtttatttaagcatgttaatctgaaaatttctttattattttaagattagttccttaattaattagacattttttactgtagaatatttataaatctctgttctttattaaaaaacctgaaaattttaaattttagtttaatttatagcttgaatctagatttcaatttgtttattcttattttagattatgacttttgagttttcaaattctcattttcaaacaggaaaatgaatataaaaatgtagtgttgagggactgtttttccctctaagtctggactgtcacatgattaatgtaacataaaagtgattttatatcacaaaagtgataaattcccattcttgtgacatactgctaatgcaaaactttaatcactgtgccttcaataggaagccaaaatagtctgacttaaatttaatgtaaaataagtaataaccgctgataaactatttgacctagagtcttataaatgataaatgaggacttaaagctctaatttgtcccttcttaatggactatatatgtatataagtaactgatgtcattgcttcattcttggtagaatgtgctgtctgttctttgtgacatagtcacatggatggcagcaggcaaagagagaatgaggaagatgccaaaatggaaacccatgataaaaccatcccatgtcatgagacttattcactaccagaagaacaatatgggaaaaccgcccccatgattcaattatctcccaccaggtccctcccacaacacgtgggaattacgggagtacaattcaagatgagatttgactgggaacacagagccaaaccatatcaggcagccaagctaaagcttgatgggtaggcaggaggaagctaggtaagagaacaaggagaggctgtgccagcacatgcaaagatctagaggtcagccccaagcttttcagaggggccagggaagcatgcaaggagcatgcagtgttgacagctgacctgggccaggccatggagttcctttgaagccatgcttaggaatttaggtcattatctgaaggtacttcctcaaattccaactctctgaagcggcttagaaactttgtgcctggaaatatcattttttcagcacatgaaaaaacaattgaagtggaacaaaactggactcaatgatgccaagttgggaataaatgcagcaatctatctgggtgagagatgggcacaggttggctaagaaagtagcagtgtaggtattgggaagaatagacagatttggtacttatggggcaaatcttcatggttgattacgtttgtagtgtgtgtatgagaaacaggaatcttcagatgtttttggctgggttgacagtgttatcattcattggaattgaagaaaagatgaggggaaggttttggaggagaggatattattaattggtttatgacgtgagggaatttggatgtctttgggacatctgagtaaagctgcttggttaactgtcgtacacagaacactggagtttaggagaaacttgggaaaatgaaaagccccaggttgctgcaagggaatagggtctaaggggagggaacttggttgcaattaaggcaggaagctgcagttagttctttgtgaagatgttgaggatgtagaggagttggttaatcataaaataaggataatataaacatgtaatgagaaagattgaacacaaacatggaagattgtgaagatgagatgatgggaatcagtagaaggccagaagggacacacattgtgagtgataacctgatgagcaggatgtcacatacagtgagtttgctggcccatggctgtaagaaggaatcaatgccagaagctcttggctgaatgggggctgggaaagacttgacattctctcaggagtctgaatagatcatacttccaaagtcctagcctgtggtacatgcagaggctttaaatgcaaccaactctgccacacacatatgcattgtctgtgagctacaggctgctgtttacacaggcactcagaatgtatcagggaccagatctttgtatgatgagactcggggtagggtcccagcagtcataaacctacttttaggagccaaaactaggtcatagcctatattggttactggaaaattagatcagcttcgtgtgtaaacactatttcagggaatgtggtcctactcttggtggtgtgaatacagcatgctatataacacttgatgttttaggcagcattacttgacttgttttttctttttttgttacaccacagcacttgggtaaaatatttatatgattcactgagataaatgaacaaggcatttcattgaggagaccagccattgggctctggcagtcgtaggtctttcctggctatcccggggtgggggctaaagaggagcgttttgtattcttatatgagatggtcagttggatccagccacaagaggagacagaagagaggatcaggaaaacaaagttcattatactcatgatcttaaagacagggggcacagtaaaccatgctaactgggaaaaacaccaatgtggtcaggaggcaaaacataggagcaagggaaaaggattaggccagagcctttactgaggtttccacaggaagggcaaggcaggacagacttaacagtttagaattggctagtttgaataatttcagcaggctctaagctgtaagtgtggctgctggttgcctggtacctaactctgggatgattaaagcagaggcacattgactcgtggggtgtatgggcctgttaaaggaggtaaagctctggattggttagtttgcttatcaaaggcatgatcttggctagactttcctgtctttaagaattggctagcctcaggaggtcagaggtcaagcatcatactatatagaaaagtacagacacacacacacacacaatacaaggaacaatattttgggtatagccataacctatttgaggcaaataaactggaaaactttgctttagggggatacatgaatgttatcagggcttttgcaaatgccaggacttctgacaactgtttagtgtttttgctttcacagcttcacaatatcttatatagagaaaatggtgtcatacttctaagaaattacttttgtacaacatgcagggaactagacctgtttttctcctttttcactatagagtactcagtggcacatggatttatgtaaatattaaatggctataacttgctttgttaaaaactgttatagaactattcctgctgatttcagtgtaaattaattttggtaaaccttaacagtttctctttgtaacttaaattttttaaatagaaaatactatattcacatggcaaaacattcagaaagtatattaaggcataacgaagaaactaaaaatctataatcctacattctgaaatggtaattatgcataatttagaaacttacctttttacttatctataaaaatatatttttatatgagtaaatgtatatgtaatcatgtcaatcaaaaatattttcctcctatttttcctccttttataaacaaagatcaaatttagaaatttattgtgtttcaattttttttttttttgagacagttttgctcttgttgcccaggttggagtgtgcagtggcacgatctcggctcgctgcaacatctgcttcccaggttcaagcaattctcctgcctcagccttccaagtagtggaaattacaggcatgctccatcacacccagctaattttgtatttttagtagacacgatgtttcaccatattggtcaggctggtcttgaactcctgaccttaggtgatccacctgcctcagcctcccaaagtgctgggattacaggcatgagccatgtgcccggcctacagcatatatactattaaacatgtatacacatatatgcatacatggtatttatagatatacatggatatttatatccatctacacacacacacatatatatatatgcacacatgtacacttctacccacaaacatacacacattactataacaagagcatccttctctgttaccaggatctggagctcctaaaggatgttcccaggtcattctaggagatttccagggcatggtctggaggatttccaggaagaggtttcacttataccttctatcatattttacattctcatttatactaaaaattttggtttgataatatgtttgattcaaagagctgtttgttattctctaattttttcatgacttcctatttttctctactggatcttgatgaatgcagtatattcttcaagggtaataattagatttattttgtatggtcttttgatcctggcactactcttttatgtggaatcttgcttttgttttttaaaatgtgttttattgtctcctgtaatgcttcaggattactgtaaaaggcttctggttattgattttatgtttacttttatgaatggctcaatgtaaaatctgagttgaatccctacatagattacatggatatgtcctctggaaagctttgtatagatgagtggataggcagctgatcattgctctgggtcttttaaaagccagaattctgggagcattgcttaggggcaccatcaactatacaaattactgattgatttatttcttactcttacccagtatttgatcaatttctttagaaaggaaccattttctcccaaggtctaaaagcctgtttcctaatgctgctatgctacaggagtagtatggtaggaatagagagagtgatgaggactgggaataaaaggggtaaactgtcctgtgtagatcaatgaatcctctactcttagctcctcttctcactgctgtgagaagcttacctgtttttttcctagtgctattttctgtgtggatatgcagatcaagtgagttgtctctgaacaataactccttcctgaaaattctagtctatggttcccccttgtattctcagtcaatatttttcaataactttcatttctcaggaccttatgttgttttctttgtatttgtacacattttaatttttctttacattaaatattttagccgttgccctttccacgctcctcattatgctgccttttttactccctaatatgctcatacagaaggtcatcttagtagcactaactgtggtcaaatgaataagggatgaagaagaaattatttatagaaaaggatcacatgctgagatttgtagtactcgtgtagcacttaacaccaggcaatacatatatgacatgaatgtctggcaggcattcaagatataatgatgtccaataacattgaaaaagaacacctttttaaaaaattaagattgtttttctcttgaaaataattttgcattaaaagcatgtgctacttttttttctttgaaaagaattcacattacatgtgtgctacttattgatatatggactacattgtggtttgccatattagattataggttttgaaccaaaagtatgatttaaaaggacatgttaaaaataaataatgaagagagtttaataatgtaagagatccgtatgaacaagtagtgctaagtatgtatctcacttcagctcctgcagtgggactttcacatgcaaatagatgcattatgggtaccagttatatgtagttatctcccttttcctcaagtagatgaacgtatgacaggttgcatttacaataatccctatggataatatttttttctaagtatatacaagatatttttttatacctttattttatcaaacattaagcaataactaaagcaataaacattggtttacaattttcatttatactgtatctcagttgcaatgttgcctagcatgtgacatatcttccactgacatttgtaatgcatgtcaaaataaaaatgatgtttattgctttcttggaacttactcttcacggagaataaaccctggataaatgatgcatttgatctgatgatgaaatataagaacagtgatatgtattgtttggaataatccatcaaaagacactgtcagtgtatccctaaagagtgtgcttatactttatatgttgcatttttcttcagaaactgactgatagtacctgtttttgagatgacaaaaagagaacagaagaaaatgggttgctacatgaagcaaaagttagtgcattattactcacaagtagtgttattgtaaactggaaggcacatatacacactttcactctgaaagtcaaaggccaagaaaatattttagaatttgcacagcagtgaaggacgtgaatatgtatggaaacatgcaagttgccttaatactcttgaaggaattaaataattgtcttaaggccatatattgtttaaccatggtttattctgtgttatgtaaaattcttatagttcttttaataacctaataccactatggagtttctagaagcaatacatatttgctatagaatggcttatgggttagttttagtaactttttgttagttttttaaattctttttaaaaaattaatcactcttttgcattccaaaaaaagaaagcaatacccatcatgcatgttcacatatacacatacagaatcactagtctgcttgtttggtatgtggatgggaaaaacagaaattatactgatggcagcagtggcccatctggagtggctgctgtgaagacaatggctgcagcaggggaggtgtggccagggctgcaggagagtcacagctggggctgcatcctcccagagccagcaggcctgaaacaggcgggagccttgcctcctaccaagtggtggagcaggagccccatgctctgggcacagctgcagccacccagctgcagctctggacctgggcatccatatactctcggggtcccaggaagccaccctgcccccacaggcttggaagtgcctgttcccactgtctggcctttccctgctcctggcacccactttggggcagagcaaagttgtggctgagcccaggtgctgttgcaacccagccaggtgtgcgtgtgcttggggtggtgccgactcaccagtcccccgccatttggccccctccagacattgggcaccaacaaacacaagagagaggccaaaggggtactgagggtggctcagctcaggtctgcaggtgccccttggcatgaacagcctgggtgctgtggatgacatgtagatggtggcaggaggcagacaggctcctgggcagaaaaatgtgggtccctggtgaagccccaccttcaagccaggcatggcctaaagcctgggggccaggctcccaattcccagtggagtccacaactgggagtgaggacttgtggtgatttttctgggcccacctatggccacccaaggaccaatcagcacgtatttcccctcttctgagcccataaaagccccagatggacccagccagactcacacagacattaaaactaccagctgtgggaaggagctacccaatttgggtctcctcaactcattcagacaacctgcctgcagataggagctacccactccagatctctgctgagagctggacactcatcaggacgacctgcccgcagaaaggagctacccactctgggtctcctctctgtggagggctggaaacgcattgggctgacgtgcctgcagaaatgagctacccactttgggtctcctgagagctgttctctgttctgtcacccagtaaagttcctctctgccttgcccatccacctaccagtttttcatgtacctcattcttcctggatgtggaatgaactcgggacccactaactggtaggggactaaaagagctgtaacccaaacagggctgaaatgaccccctgcttgccactttgcaggtgatgagaaggagagaagagctgtggcccttcagggagcccagacctagaagctccacgagccagtgctgtgacaccctctttggggctgtgcagtttcagatgtttccaagcatccagacgccactgaattctcatccagatttgggtgcccacagcagaagttgcttggagtgcatctgatccagctccaggcttacacagatccagtgcctgtgccagtgcctggagctgcctgccccactgcagcagctggcatgcctggctgtgcacagtggctggacctggttctcacttgctcacacacccctcacctctctgctcctggcttgcctttggctggtgtggaatctgggctgtagcaagagctgagcacagcctaccaggccgagtgggcagaatgagcccagcaggcccaagcaaaacttgggcaaaggtaccaccagccacagaggtttctggctggaaaagtgacaccctagggatcctgtgacagtatcagagttccttccccttactctccttccctcccaccctctgtacacacaagaatgcaattctctaatttctgacccaagatggatgattcttgtaggctgtgtaatttactcctttgctgacatggaattaatggttcctctagatgaaggattagccctgttgctaccatttttcccatctttgtgtaacctgagaactagcatttgacatccaagccttagcctcaagatacagatataactcaactaacagcatccttagtctatgatgacagcttagacttctaagtacttttctcttccctgccctagcagggatttccatgacagcaaggctgtcttctctagtcttcctttccttaggctgttacttcaaacactagaagcttgtcttttattgacttattttctcacaagtcagacagaagtgtaagggtttggctactgttgatataaacttttatctcatttagggagatgaatcattcttctctctggattgtgttaaccaggaccaaatgatctcttattttatgatagattttgatccagtacattcttgctatctaaaacctgaatgttcatctacccttaacttctattttttcatcaagggtagaatataatatgaagaaggaaattcctattcctagactgaaacttgcttcactttctttgtgtgtagctcctaacattagatataaacaaatatgtaattaagaaatatttttaaatagggttaggttaccttaaaattaatgatacaggatagcagtgtgttgaaaattagaccctggagagagggatggtgcctgtactcagatgctaggttggtcacatactagctgtgtggccttattcagttacatagattctctgtgccttagtgtcttcatttgtaaaagggggataaaaattaaatctgctgcctttggttgttgtgaatcttactgtttcagacaattctgtttcaactattagctgttattaatcatgatgacaatactaacactattaacgaaagacagtttgtatatgtcatttcattttggttctttcaacaatgctgaaataagatatgttattctcattttttaggtaaaaatactaaagcccaggaagttttattaatttttgccaggtcattcagtccgtctgtgtctaaactaagctcaaatttaagattctccctcaaaagccttttttctcgtctgcaatagatagtctccctttatttactgacttttgttataatgaggatcctgggtgaaaactagtattatcagagatatcttatttttacagagcatttcagcagagtacatttcctacattcatagttggctgtacaggttattgaactttatgatatgatgcaggaactcaaagagcactttccatgacaaacttaatttcctcatatacttattctagtgatacagagagaaaggaagatgaaggaagggattctttcagggggaaataagtgtagtcaggatgttatagtgaacactttgatcctcaaagggtcagcatgagaaagaaagttgtgagaaggaatcaaatgttaggcagatatatgaggagggaaattttcaaagacactcagttccttcataaagtagtttagtcaaaataattgttattagaaggattagaagattaaatgactttaaaaaatgagttaatttatgtgcaagaatatgtctttttaccattatagagatttgaatatatatttaatcacatttattttttaaacccgactttatgaactaatatgaaaagatggacacattgttcttttcttagcagagtcatattaagatatattattaaaacactctcaattagtaaaaatgagatctttttatggctaatttactggagttatctttttcttagatatcagagcttattttaaagtgtacttcttaataatttaataacccatctttaactttgaacatgttaattttctgctaccttaatgactctaatggcataaaaaataaatagtacatttatgcaccattaagatctggctgttgttctgtttcatactgctgggaactcatgctagagatgctatagtccttacattttttaaagatacccttttacaatttgagctttgagaatccagaattttaggggtctttttcaggagtcttgttcttctcctaggctctgggcttaggaataaaacctctactgagctgggaacccagccactgagttatattcatttctttgccatggcctttggggagaccttatagtttggagagcctttgaaaagaagcaagatttgttgtattcactgtcaggagtgtgtctagtgtttttgtcaggaataagggatatactcaaagtaagagtatatatgaatgtgtggcaatatagccaggcacggtggctcatgcctgtaatcccagcactttaggaggctgaggtgggcggatcacgaggtcaggagattgagaccatcctggctaacatggtgaaacctcgtctctactaaaaatacaaaaaattagccaggcatggtggtgggcgcctgtagtcccagctactcgggaggctgaggcagaatggtgtgaacctgggaagcagagcttgcagtgagccaagatcacaccactgcactccaatctgggtgagagagtgagactccgtctccaaaaaaagaatgtgtggcaatactacattagtgcatataaatgtgtaggctgggtatggtggctcatgcctgtaatcccagcactttgggaggctgaggtgggtggattgcctgaggtcaggagtttgagatcagtatagccaacaaagtgaaaccccatctctactaaaaatacaaaaaaattaactgggtgtggtggcatgtgcctgtaatcccagctactcaagaggctgaggcaggggaattgcttgaaccaggaaggtagaggttgcagtgagccgagatggcgccactgcattccagcctgggtgacagagcaagactccatctcaaaaaaaaaaaaaaaaaaaggtgtgcaaattgttgcaggaaaagtcgtgtatttccatttctactatactatcagcattatatgaatattctattaacattttatgagatttctcagtatactaaatcatgccttttaacaattaaaaattttatttcacatgctgacatgacattttactgtgttaaaagtggtggcattcatgctccaataatagaaaacagggctccatggagtaatagctgatactaagcttgggccaggaaacatacaggttgagcctggagcatgttgtagtgccaggaagcattttctcattccatattcttaccaatatgtgttatcatatttgccaataggataggtgaaaaatatttgctattattattttaactagtatttcttcaattattaattaaacatttaaatatatttattggccactggcagttttcattttatgaaatgtctgcacaatattctgtacttattttcagcctatatgatttataaatgatctttattgaagaaggacactaattcttgtcttgtacattgcaaatatttttggcagttttctattattttaaatttgtttatgataatgttaaccatagaaactttttatttagccaaatttaccactcttcttactttttggatttttttgtatttttataagaaaacgattctcatttgagattattgaaatgagcacccaaattttcttctagtacttttatagttttatattttatatttatatctctaatttatctggaatttattattgcatatttggtgtgagcttgcaatctaatgattcttttttcctatggctaataaatggttcatttttcaacaatccaagtagattttagaaaatctacaacctacacagaccaaaaatattcttgatatttgtattatgtattatcactgctaactagtttttataatgatgatgttttaattcttatttttgcttctctggctagaaggtagatactataaccttctcttctcctatactaccatcatctctttaaaacctcattaactgttcttaaaagggtgaactgttctctaaaagcataaatctggtgtgtgtgtgtgtgtgtgtgtgtgtgtgtgtatgtttatatttaaaaggatgaactttttcaaaagattattctgatacatacacacacacacacacacacacacacacacacacacacacacacacagggctacactctataggatcctttatttgatattttgctccatgaataaataaccaaagtttttttcttatgtgaatggagttaactattaaatttcaaattatttttctttccttttaagattataggtttatttcgccttttgcctaaaaacaaaactagtgaaaattaaagtataaaaataaatacagtttacattaatggacattccattcaaagtaaaaataatgataataatacatcaaaagctcacagcattgtctggcacctgtatgagaaaaagttgtgaacataaaataatatgcaaaatacataggcttttacttttaaattatatcacactcaagttgctcatccttaatctaaagctaactttaactttctccaaaacatactatttgttttagataatttgcattagtatacccaaaacttttagcatctttcttactggacagacgcacagtgatatgagtaagctgaatccttagttttttgtttatcacatttagaagataatttcatatactttgcctgtaaatttaaaaattagtaactgggatttttttgactggcttctaatttgatacaccttgcctgtaaattttaaaatggtaacttggactgttttgactggcttctaattttctggttcactcattctatatgcaatacatctcaataagaaagtcgagtttacatgcagggtaaattatcattttctgtctataggtggatgtgaaagttaaattttaggtggaacagaaaaatcagagaaaatgatctttatctacatattctcatcctgaaagcaaagacagcaaggaccaagttgctattcttcagaaagagttgatatattaaattataaggatattttccatcatatctcaagtctggttgtcaaaactgagcatcttatctgctttataatgactttttaagaaagattgtttttctggaaagtggctatcagtaaaatattcagtgtagatttaattttctttgatggatatataattaatctaaaaattagtacattgtatttcctaattgtgatattgagggaaatagtactaaatagagaatctagccctggtctcttatgtagttaaacacatcatcaacagctaatatagaagatggcagagtagagggttttctagagtgcctcaccaactctgaagaagcaaaatagtgtgtagaattcacaatgtgaaactttatccaagaaggcacacaggaattcaacataaagtgaataagaactttagatattggggaagagaaggtaagtgggcagcctgtgtggtggtgtctgactgagagctgtgagtgaagtcccaatataggagagggagaaaaagtactcctctgcaatccacatttccactggggagccgtacaatccaggctgtgagagaataccttgcccttcccaagccctgaatctaaattggagagaggctaaaacactatgagaagggacatcactaggaagcaccccaagcattttccagtacttgggacctgatagaaaaatgtgattctcaatcctagctcatacaaagccaggtgggattctgtgatctagcagcagtggcagacttgggcattaaaggagcttggacaggggattgtaatgctgggtttggggcaacagaggggctcccacagccaaaactgagagatgagtgtggcatttgctccagctgtgggcattttaatagggctctctcccttcgtgggtggagcagaaggagatttgccagagaggcatggttttgtcccggtttcaagttatacagctcagtgtgactttgcagactaaaggtatactgcacatgactttactgagtgtctcaacttgctccctttattgggttggggagtgaaccctgccaggtctaaagaatgagaggagaaggctgggcatggtggctcatgcctgtaatcccagcactttgggaggctgaggtgggcaggtcacgaggtcagtagtttgagaccagcctggccaacatagtgaagccctgtctctactaaaaatacaaaaaaattagctgagcatggtggcaggctcctgtaatcccagctactcaggaggctaaggcaggagaattgcttgaacctgggaggcaggggttgcagtgagccaagatcacaacactgtatgccagcctgggtgacagtgtgagactccatctcaaaaaaaaaaaaaaagagtaaggagagaggtgggtcctatattcgtttgcctagattaaggactgggctgcctctgccttcctgtgccaacttgatacagcaataattgctctgtctcaggaataattgcttctccctcaggaatatctccaaggtgcctgcccgttgctcctgaattcccaccagagatggtgcttttacacaccattgcagggcctgagtgcagaatttccctgttgccctttccagttccacccaacttgacccccaccaccttcccacaatgctggaccacaggacccagatcattaagttgctccctggcctagctaattgcctgggacaatggattacttttctgattgaaaaagatcaagtataaaccctattgctatcaccacagagagatcttacctgcaagcaagaactattggcctgaagttcggcctacacaatccaatacaaaatttactggcagaagtgcatagcatttggaaacaagataagtttcacataacatttgctaccaccatcttccatgacacctcagcttctcaggaggacatgagtctgctcacccacctggtacaccactactacaaccaacatttgagaaagctaccaccctaaggctatttataaccaaggaaattccacagattctttgccgttgaacacacctagaagcaaagccaaatggctctactcagtatacatcatagacacattctcaagaaaaaaataaaagtcctgcccccaagaaaataaattcaaaaataagaagtgactgtttctccaaatgcaaataaattagtgtaataacataggaatatgaaaaagtaatgtgtaatgatacacataaagaaacacagtaattctctagcgacatgtcctaactaaaaagaaatactcaatattccagataaagagttcaaaatattgatttttaaagaagatcaatgagttgcaagagaaatctgaaaaccaatacaaagaaatcggagaatcaattcaggatataaatgagaaatttaccaaggagacagatatcttaaaaacaaacacacagaacttctggaaatgaaaagttcattgaaaggattacaaaatacaatggaaagtttcaacaatagatgagaccaaaaagaaaagagcattttggaacgtgaagacaggtcttttgaattaatcgagtcagacaaaagtgaaaaagaagaaaaagaaatgaagaaggcctttgagaagtacaggattacttctcaggttagcaagcttttctaacctgtggcccatgggctgcatgcggcccaggacagctttgaatgtggcccaacacaaattcgtaaactttctgaaaacattatgagattttttttcaattttttaaaactcatcagctattgttattgttaatgtattttatttatagctcctgacaattattcttcttccaatgtggcccagggaagccaaaagattggacacctctgacataaagtgactgaacttacatatcattggtattcacaagagagaagaaaaagcaaaaagtttagaaaacctatttaaggaagtaattgatgaaaacttcactaggctagcaatatatttagaaatctagatacaagaggaccaacaaacaccagaaaatatgcagcaagatggacttccaaactacatatactcattggaatgtctaaagtcaacacaaaggaaaaaaattctaaaatcagcaagagaaaagcatctagacacctataaaggaaactctatcagaccaagagcaactttccagcagaaaccttataaatcaaaaaagattggatcctattttcaaagtgcttaaagaaaaaactgccaaccccaaattttatatcttgccagaataagcttcataaatgaaaaagaaatagtttttctcagacaagcaaacactgaggaatttatcaccagctctactagaaatgctcaaatgagttctaaacatgggaaagaaaggttgatatttgccatcattaaaacacattaaaggataagattatcaggttttataacacaattacccaaaggaagaagagaaagaaatcaaatggtagcataacaggactccaccaaaccagaaagacaaacggaggggaaaaaaaagaatctacaaaacaactagataacaattaatattttgacagtcagaaaacctcacatacaaataataaccttgaatgtaaatggattaaattctccacttaaaagatatagattggcagaattgatattaataaaaccccaaaaccaactacatgctgcttactggtaaaaaaaaaagatattccatgcaaacagagagcagaggcaagcaggagtagctatacttatatcagataacacatacattaaatcagaaactgtaaaaaaaaagaaaaagtcattatataatgataaagggattaattcaataagagtatatatcagtcctaaatatatatgcaccaaacaccagaggacacagattcataaaacaaatattactagacctaaagaaagagatagcaacacaataagtgcaggatttcaacaccctacggacacactataaagattatagagacagaaaaacaacaaagaaacactggacttcaatgaaactttagaccaaatggacctaacatacatttatagaacattttactcaacaacctcaaaatatacatttttctcatcagcgcatgcagcattctccaagatagaccatatgttaggccacaaaacaagtctcaacaaattaaaaaaaatagtaactttatcaagtgtcttctctaactatagtaaaatgaaactagaagttaataccaagcagaactcttgaaactatagaaatacatagcaatttaaaaacatgctgctaaatgatctttgagtcaatgataaaattaaattaataatttttttgaaatgaaggaatatgaaaacacaacatatcaaaacctttgggatacagcaaaagcagtgctcagaggcaagttgatagggttaaatggctgcattaaaagaagaaagatcacaaaataacaacctcacatcacatttgaaggaactagaaaatcaagatcaaaccaaatccaaaggtggcagaagaaaggacaaagatcagatcagaaccaaatgcaattgagaccaagttaaaaaataacagaagatcaacaaaatggaaaatttgttttttgaaaagataaacaaaattgataaaccactagctagattaaccaagaaaagaagtgagaagatccaaataaatgtaatcagaaatgaaaacgaagacattacaactgttaccacagaaataaaaaagatcaccggagacaaccatgaacaaccacatgttcatgaattagaaaatctagagtaaatggctaaattcctgggaacatacaaatttccaagattgaactaggaataaataaaaatcctaaacagaccaataatgagtaatgagattgaatcagtaataaaaaataatctcccaacaaataaaagcccaggagaagatagtttgaaattctggttgctgaattttaccagttgtacaaagaaaaactgaaacccatcctccagaaactctttcaaaaaattgaggtggtgggaatctttcataattcattctattaggccagtatctccctgataccaaagaccagagaggacagcactaaaatagaaaagtatagacaaatatcccgagtgaacaaagatacaaaaatcctcaacaaaataatagctaatcatatccaagagcactccaaaaagataatacaccatgatcaagtggttcccccactgccagggataccaggattgttcagcatttgcaaatcaataaatatggttcatcacacaaacaaaattaaggacaaaaccatatgataatcttaataaatgcagaaagaagcatttgataatttccagcatcatttcgctataaacaccctcacaaactagtcatagaaggaacatatcttctataataataaagggcatatatgacaaatccatgaccaacatcgtactgatctgggaagagtttgaagcaatccctctaagaactagaacaagacaagaatgtgcactttggccaatcctattcaacttagaatggaagtcctagccagaacaatcagacgagaaagaattaaaaggcatccatgttggaaaaaaggaagtcaaattgtttctattcattgatgatcttatacttgattagaaaattctaaagattcctccaaaaactcttagaattgataaatgtatttagtaaagttttattatacaaaatcaatttacaaaaatctgtagcatttctctgcaccagtaatggttgagctaaaaatgaaatcaagaatgtaatctcatttacaatagctacagaagaaaaaatagttagtaatatatttaaccaaggagatgaaatatccctacaagggaaattacaaaatactgatgaaagaaattgtggatgacacaaacaaatggaaaaacatcccatgctcatggagtggaaaaattaatggtattaaaatgaccatatacccaaagcaatctacaggtttaatacaattcctatcaaaataccaatgtcattataaagaattataaagtataatcttaaaatttatatggaatcataaaagagcccaaatagctaaataaattctaagcaaaaagaataaaactggaggtactgcattacctaacctcacattttaccacaaggctatggcaacccaaacagcattgggaaaggacactcttcttttttcctttttctttgtcttttttttttttttttttttttgagacattgtctcgttcttgtcaccccggctagagtgcaatggccctattttggctcactgcaacctctgcttcccaggttcaagtgattctcctgccctagcctcctgagtagctgggattacaggcacccgccatgaccggttaatttttttgtatttttagtacagacaggatttcaccatgttggtcaggctggtctcgaactcctgacctcaggtgatccacctgcctcggcctcccaaagtgctgggattacagacatgagccacctcacccagccaggacactgttttcaataaatggtgctgggaaaattggatagccggatgcagaaggataaaactagactcctatctctcagcatatagaaaaatcaactcaagttggattaaagtcttaaatataagacctgatactattaaaatactagaaaaagacctaggaaaaatacttctggacattgatttacgcaaggaatttatgactaagacctcaatagcacaagtaataaaaacaaaaatagataagtgggacttaattaaactaaatagcttctgcccagcaaaggaaataattaacagagttaacagacaacttgcagaataggagaaagtatttgcaaactatgcatctgataggggactgatatccagaatttatagggaactcaaacaacaatcaaaagaaaaccattaaaaagtaggcaaataaatagatatttttcaaaagaagatatataaatggctaacaagcatagaaaagatgctcaacattactaatcatcagggaactgcaaattaaaaccacaatgatatgtcatctgacgtaagtcagaatatggccagttataaaatggaaaaaatataatagactttgtgaggatgcagagaatagtgaagaaacatttagacactgtttatgggaatgtaaattaatacaaccactatgaaaagctgtatggagacatctcaaagaactagaaatagaactaccattcaatccagcaatcccactactaggtatctacccaaaagaaaagaaattatcatataaaaaagacacctacacttgtatggttattgcagcactattcataataggacagatatgtaatcaacctaagtgtccatcagtgatgaataaataaagaaaataatgtacatattttctttatccaatggaatgctatggaatactattcagccataaagaatgaaattgtgtctcttgtagcaacatggatatgtaatactgtatacttatgataccatatcattaaaaggatatgatgtcattgtcttaagtgaattgcaggtcattatcttaggtgaaacaatgcagaaacagaaagtcaaatgctgtatggtctcacttataagtgagtgctaaaaaatgtatgcacacgtacatagtgtggaataatagacattggagcctgggaaaggtgggtgagtggaagcaggggtgagggacaagaaattacttaatgggtacaatgtacattattcaattactggttacgctgaaaggcccgacttcacctttacatgatatatccatgtaacaaaactgcacgtgtaactctttaatttatacaaataagaagagaaaatattgtaatcctgttagaaaaaaatgtaagaagttaatatttaaaaagcaaagggataaaagaatttaaagataccaattattctctttagttattgaacatttttcatccatatggagctcaatataatttagtttaatatttattaaatctaaaatgactgataaaagacacattgttcaggacagaaaacaatctgaactcactttactatagcaaattatcagttttaatgtgttccattaaataacgtagacataaaatatgtattaagggtcaacgttaatcatcttaatatatatgccaaggctgtctttataatcccggtactacttgctatctatataattttggacagttaacttaagcctggtctttggaactagttcatgtttcatttagttacaccatattccccagatattccttttattcttcatattacttagatgtcttttaattcctatatactcattaacttagatgactgagaactacactaagtaatgctcaaatttctagtcagatgtagccaaaagtacattgggcttgcagtcagaagccctgagtttcagtccaagctgttatttattaggtgtttaatgttaaatcatttaatcacatttttctacagcttcttcatccgtggtgtgtaggatgtaagtaggaataaattgggcaattaaaaacaatttctagcggttttcacatttaagagtgaggagaaatatgtgtggctaacggattgggtagagtgggatgatgcaaaagattagtcttgttttcctctgaaagcagttaaatttatttgttccccatatggcaagcaatggggatttgggggcagttagaaaaatgtgtaatactgtagacttatgatagcatgtcattatatctacacaattaacacaaataaaacttctgttaatataattgtatcattggattattttactcttatcattccattaaatttgtttcaatgtattgtccagtcaagtagctcatgagtttatttgagggttggaaatactgattttattgtattatattttatacttcatattacccacaccttataattgtatatatttaataaatcttgagaaattaaattatatgaattcactttctttaaaaatatgtagcttattaatagcaaatctttatcttaaataatgtttctttccaaataccatttaatttattttcaaataattctaaatttcttctcttttatgggaacatttgcattgggtgtcactagtggcactcctgtaataaatcttttagatatttttaatttccagtgttttaattctcagtatatgacatgtaatactacgcaaaaatgataaactcttttttttttttctttgagatggagtctcgctctgtcacccaggctggagtgcagtggcatgatctcggttcactgcaagctccgcctcctgggttcacgccattctcctgcctcagcctcccaagtagctgggattacaggcacccaccaccgcgcccggctaatgttttgtatttttagcagagacagggtttcaccgtggtctcgatttcctgacctcgtgatctgcccgtctcagccttccaaagtgctggcattacaggcatgagccactgtgcctggccaaaaatgagaaactcttagtctttaagcattgttatgaaaggtaagagatttagaatcacattgcccatgccttatctcttactaactttgggaccctgggaaaattaatttatctgaccttcaaggctcttatttataaaatcagcattataatatcccatttttgaaaataacttttaacgggttaaataatgaaacggcttcaaagcatttagtcaggtgcttagcacatggtaaacctttatgttgttactactaataaaatcctcctgcattttaaagtagtttcctaaaaaaatcttttgcctctaaattttgtaagctttttgttctcacttatttcaacacaaattcagccattataggggtgacttcaatgccctcacaaatgattcattaatacctcagtcttacagatgtttgacttattctgctacagtgacctttactttttaccccaatcccacaatcattcctcaatattatacttttttaaaaacatactcagagaaacatggatgtttgagctaaaaacaaaatgcaataaacttaatttactttggtatcaaagtgctctccctgcgtatttatattattcttcctgctctttctttcaatgagtaagcagaaagtataggtagttttcattagttaatacagtaaatagctctgtcgctcttaaactaggttcttttggttgcaagtggcagaaacccatctcaaaccaagtcaaaactcatttcagagtagcttagttttagctaaaagatggaaaattattgattaatgttacagagaggcccagtgctggttttggatttagggatggttgcatctgagaggttcaggcagtgttgcttactttgtctctctttagctctttatgtctccttttctgtctttgcctttcaatctaccttaacgttttggcttttttgcctgttatcttttatttttagacaagtactagaaggaagactcctggctatcttagccctatatttatagataccagaaaaagtggtaacctattattaatagctctgccaaatagtctagtaaaaactttgattggctctgcttaggtcatgtgccaatttttgaaatagacaacaatggccaggagtggggagtattctgataggccatgcctggttcatgtgttcaattcaaggcgtgaggatgtgagatttatttaaacctgtgatggcaagctagggcccactgcttatttttatataacaagttttatttgaacatagatatagccatttatttacatattgcctatggctgctttcacactaaaatggttacagtactgacaatgttacccacaaagcttaaaatatttgctgtctggttctttacagaagatgtttactactgttctaggtagagttcaaagatgatccccaataactcacgtccttatactgtgagcaaaaccttccccttgattgtgggcaaaacctgtaagtatgacgagatggtactcctgggattatgttactttatatgtaaaaggggatttttacagatgtaattagtacccccaatcaactgagttaatgaaaagaggctatcttgcataggtctaacctaatcagatgcatttttaaaaagagagtgtagaaattagaaatggaggcagtcagagagactgtctcctaatggcctgtaagaaggtaaacatttatattgttaactttctgtggcgccatgtgacaagggactgtgggtaactacagggagctgattgttccctggatgatagctggcaagaaaactggaacctcagtcatcacagctgcaagaaaattaatttggctaaccttggatgaagactcggagactcagatgagaattgcaacctggttaacaccttgatttcagcctggggagatcatgaatagagaatccagtcaattcctactcacactcctgacccatggtaactgtgagatgataaatttgtgttattttaaaccaataattttgtgataatttgttactcagtaacataaaattgacatagactgttgtacctgaagttggaatgcttctgtaaatatcttaaaaaggggagcggctttggaaccaggcagtctgtggaggctttggatttttaagaagtatgataaagaatatctaaattgccttaaacagaccattagtagagataaggatgttgagaatactcatggtcaggacttagaaagaagtaaggaaattgttatttaaaactggaagaaggggaactatcattatgttgtggcagaaagcttaatggaattatgtcctgcagttaagtggaaagcagaacttgtaaatgatgaacctggatgaaaggaaatttctaagtatactgttcaaggtgtggtctgttttcttcttcctgcttatggtaaaaatgaaagaggagtaagataattaagggaagaactgttcaacaaaaaggaatgaagtctgcatggttttgaaaatcctaagcctctccagatgatgaaagatgctaaaagttagaaatggctatgaaaattatgacattggttaaagaaattgtagataaactcagaattaataagtgaatttagcaaagttactggatactaaataaataaacaaaatccaattatacacttagatttatgccacagaaattaggaaacttgaaaaacaaaatgccatttacaattacaaaaaactctatgataatttatctaataaaaagtatacaatacctctttagaaaagtgtatacatttttgtttagaggacataaaattttataaataaatggagaaatccaccataatcaggagttggaaactctgatactgcgtagctgtcaattttgctaggctaatccatatatctatataatctgaactgaaattcctgcagttttgtgtgtgtgtgtgttgttagcaagcttgccctacaatttaattccatgggccatgaataagcaatatcaactcaaagaagcacaagttgggaggcattttctctatccgatatcacttattttaagaccagaataatacaggaaaatagacaatgtaggctgggtgcagtggctcatgcctgtaatcccagcactttgggaggctgaggcaggcagatcacgaggtcaggagattgagaccatcctggctaacacagtgaaacctagtctctactaaaaaaaaaatacaaaaaatttagctgggcgtggcggcgggcgcctgtagtcccagctactctggaggctgaggcaggagaatggtgtgaacccaggaggctgaacttgcagtgagccaagattgcgccactgtgctccagcttgggtgacagagcgagactccatctcaaaacaacaacaacaacaacaacaacaacaaatagtcaatgtaacagaataagaagatgagaaagagatccatgcatacatggtttattcatgagaagtgtggtactactgagtagtgataaaataacagtacttttaataaatgatttaaataaatatgcaatcatttggttatatgtaaaaaatgaaactttatccttaccttacaccatatacaaagaataattacaggtttattgcatatctaaacatgaaaggtatattaatatattcttgaataagaaaggatttcctaagcagataatcaaaagcattaaccaaagagcaaaggtaaatgaattaggttgcattataacttagaaattaattccatcaaatgacacaactaagagaaggaaaagttaagccccagcataggagaagctatttgcaacacatctaactggagctaaatttttatagaattttcatgtattataggtggatgaataaattggcataattagtttggaaaactgccttacctactaaatttggaaatatgcatacattataatacagcaattccacttctggatacctgcatacaagaaatatgggcccatgagtagcaaaaataaaacaaaactaagccatacatataagcacattcaacataagcaactttatttgaaatagatacacattggtaacaccccagatgtcctatcagtggtagaataatctattaatttacaatgatatgttatccatctatgaaaatgtagaaagcactgtaatatggagcaaaatgaatgtcttctatacgcatagtatggaatgaaggcagctagaaacaacatatctacatatgcagatctatatatttcaaaaatggaaaacaaaatctatggtttcgtatttaggattcccaaagacaagaggtaaaggggtagtgacaaaatggaatcaggagttggacttacaaagtatcagtaatgttctattttttgacctgggtggtaattaaacagatgtatttatttttgtaaaaatgaattgagctgcacacatagatttgtgcacttttttctgtttgttagaattcaataaaatgttgaatttacaaagcaaaagacattgggaagaaataaaattacttttgtttgaagacgacatgattacttatgtagaagatccaaaataatttgccaaaaacctcctggaattagtaagccattatagcaagttacagtacaaagttaatatacaaaagtcaaccactttcctatattccagcagtgaacaagtggaatttgaaattaaaaacacggccggggtggtggctctcatctgtaatcccagcactttgggaggctgagacaggtggatcacttcaagtcaagagctcaagaccagcctggccaacatggcaaaaccccatctctactaaaaatatttttaaaaagttagccgtagtggcacatgcctataatcccagctactcgggaggttgaggcaggagaatctcttgaacctgggaggcggatgttgcagtgagccgagatcgccccactgcactccagcttgggcgacaaagtgagactccgtctcaaaaaacaaacaaaccgaaaccactatatcatttagattggcacccccaaacatgaaatacttaggtctaaatctaataaaatatgcaccagatctgtatgagaaactctgatgaaagaaatcaaagaactaaataaatggagatttatttcgtgttcataattagcaagactcaatattgtcaagatgttagttctttccaacttgaccagtagattgattgcattgccaatcaaaatcccagcaagttattttgtggatatcaacaaactgattataaagtttatatgggtattcaaaagacagaacagccaacacagtatgaaggagaacaaagttgcaagactgtgacactacctgacttcaagacttactataaaattacagtaattaagacagtgtggtactggcaaaagaatagacaaatagatcactggaacagaatagagtggccaacaaatacagccacacaaatatagtcaattgatatttgacaaaggagaaaaagcaatagaaagtagaaaagatagtattttcaagaaaggctgctggaacaattggacactcgtaaaaaaataaatctagacacaaggcttatatctttataaaaatgagctcaaaatggatcacagacttaaatgaaattactaaactatgaaactcctagaatataacagaaaatctagattaccttggatttggtggatatagcaccaaagacaggatccatgaacgaaagaatcgataattaattttaattgattaaaattaaaatattcttctctgccaaagacattgtcaaaagaatgaaaagataagccaaagactgagataaaacatttgcaggagacatatctgataaaggaccattatacaaaaatatacaaatgacttcagaagttgtatatatttaaggtgtaaaacatactgttttgatatatattatgcatagtaaaatgattactacagtaaagaattttaatctgtccagcaccttccatagttacctttatattttgtggtgagagtacctaatatctactttcttagcaaatttttagtatgcaatattattgattatagtccttatgatttacattagatctgtagattaattcatcctatatgtttgagccctttgacctacttctgtccattttctttccctccttgtcactagtaaccaccattgtattctctgtttctgttttcaacttttctttagattctacatataagtgatatcatacttatgtatgatgttgtaattctgtgtctggcttatttcagttagtgtagtgtccttcaaattcatccatgttgtcataaatgactgatctttttttagggctgaataatattccattgtatatgtattccacaatttctttattcattaatctgtcagtagacacctatgttgtttccatatctttgttattgtgaataatgctgaaatgaatatgggagcacagatatctttatgaggtgctgatttcattacctttgggcatatacccagcagaaggattgctgggtcatatggtttgttctacttcacttgttttagtttatttatttttagataatagctatcatgagaagtgtgaagcaatgtctcagtgctttaggtgggagcatgaaagttgtggtgcttgatgcatgcacaagtgtttccagggagattttgcagacctggatttaccactggagcaagctggaggagaggtgtgggaagtactctcactccaattcaggctcctgtaggtcgattgtttatctgcctttttctattaggctatttaaaagcctaatagaaaaagtgtgcagatttccaaggagaaactgggaactggacacttcagcctattctctgcactgattgttggaggaggagtgtgaatagatccccctggaagtacacgtgcatccatttaaaatcacctctttgttctgtagcctagggagacacaaacgctgaatcattttctgttttcagagtcaggtgaattaagggctcaactctgtgggaggaactgtaaaccttggggctctgtaagtgtatttcacaaccttttcttgtcaaagagaagttgagagttagaggttctctcctgattataaaaaactggtcctggggtggagtttgtggcatatgtgtgtctcagcttttccttccttttttgatgcagatattttatcagtttcccagtttttaggggtttatcaactagttttgagatttgtcctagagggaattgacctataaataactgtttacttagtacatccataagaggagggaaagtcaagaatttcctattctgccatcttgctgatatttcaagaacatctttctgaagttcttaaaatacaacaataagaaaacaaacttttatattttgatagggattgcattaaattttgggtagtatgggcattttaacaatgttgattcatctaatccatggacatgagatatctttccattttttgttccctcttttatttctttcatcaatatgttagagtttttattgtagcaattttttaaaaaatagagaatatttttcataggaaaagaaaaaaaattctaaaatttatatgaaaccacaaaatacccagaatagacagaataatgctgatcaaaaagaacaaagctgtagtcatcatactacctggcttcaaaatatactacaacactatagtaacccaaacagtatggtactggcataaaaatagacatatagactaatattagaaacaaaagacaaaattcagaaataaatccactcatttacagtcaactcctttttgataaaggcaccaagaacatatattggagaagggaaatccttgtcaataaatgatgctgggaaaactgaatatccatatgcagaagaatgaaaccggacccctgtctctcaccatatataaaaatcaaattaaggacaggcacagtaatatcactaaaacacaggtgaccaaagcaaaaatggacaaatggaatcacaccaaactaaaaatcttctgcgcaacaatgagaacaaccaaacaaaatgaagagacaacctacagaacggaagaaaatacttgcaaacgattcaactgacaagagattaataaccagagtatataaggaattcaaaaagttcaatagaaaaaacctcaagtaatctgattagaaaatggacaaagatcaaaagaagacatatcaatgaccaacagatatagctgggcgtggcggctcatgcctgtgatcccagcactttgggatgctgaggcaagtggatcacctgaggtcaggagatcgagaccagcctggccaacatggtgaaactctctctactaaaaatacaaaaaaattagctgggcgtagtggtgggctcctgtaatcccagctactttggaggctgaggcaggagggagaatagcttgaacccgagaggtggaggttgcggtgagccaaaaacatgccattgcactccagcctgggcgacaagagtgaaactccgtctcaaaaaaaatgaccaacagatatgtgaaaaaatgctcaacatcactaatcatcagatgaatgcaaatctaaactacaataagataccatctcacctcagctaaaatggcttttatattatcaaaaagacaaaaataagtgctggcaaggaggcagagaaactggaatgcttgtacactgttggtggaatgtaaattaacacagctactatgtgaaacagtatagaggttcctcaaaaaaccctgagggaccagagaaccaagctgcagacctggttccagccccttagggttagaacacacagcccaggagtgctcagctgaggcttggaccgctgaaaccatccagaaatgaagccaatcaactaaatccaacttacaacatagtcaaaccctaaagagcatcaaagaatataaaagcagaaaggccgattccaaagacagagactccaaaggttaaaggaacatcagcccacacagatacataagaaacagtgcaagaactctggcaactcttaaagccagagtatattcttaccttgaaataactgcactagctcctcagcgatggttcataaccagactgaaatggctgaaatgacagacattggttcagaatctggttggcaaggaagctcatcaagataaagaagaaggttgaaacccaatccaagcaaaatagtaaaatgattgaagagtttaaagatggcatagccattttaagaaagagccaaactgaacttcaggaaatgaaaaagtcactacaggaattttggaatgcagttcaagcattaataacagaatagacaaagctgagaaagaatctcagagctctaatacggctcctttgaataaacataggcagacaaaataaagtaaaaagaattttaaaaatgaacaataggttttatttaataattctcctccttatactttctgtctcaccagtttcccctcaaactgatttacctactacacaaaattattcttatcgggcttatgtgccttttcctccacttatttgacctctcacctggatggatgctcctgcggaaatctatactaacgatagtgtgtggatgcctggagctacagatgactgttgccccgctcaaccaggagaggaaggcactgcatttaatgttactatgggttataaataccctctgtgcctcagacatgcacctggttgtatccatctagaaactcaagtctgggctgcttgccttccagagagatcagccacaggggaatggggacatttggtctccggcctctccctttctcctttaagacaaatgaaagggggagtaatgagagataccccatactttcaatataaacctgtaggaaaatcatgtcctaaaaattttgagggcccatctaaaactttaatttgggaagattgtgttaactcacatgtagtagtattaaaaaatgcctcatatggtttagtaatagactgggcaccaaagggctattttaaaaaacaattgctcctctggtggaagggaatgcctggaggctacttattttatttctcattgggaggacaaggatcatcatcctactttgcataggaggttcagctcattttttcccttaaaatgggaagataagggcattacccccacaaggcctcatatgatattccccattctgagcccagaacacccagaacttcggaaactggctatcgccatgtccagactgcaagtatgggaaggggaaacttttctgtctgttatccccagtactgcccctcacatccatgattctgaaccccatgataaatcccctttgagcccttttcctctttttgatgcctatcctcctttatgggactccaattggcattatgataattcttctcaatccaggtatgccccctacctcttcagcatccctaggcccctcggattgcttctttatggtggagaacatcgggcgttcccaccgccactcctctccctcagtatcaatgtagattcaaacattctgctttgtttacctccagcctgactattcctatacagagttgtgttaagcctcctttgtgctgttagtaggaaatagcaaactttggacgaataatcaaactgtccaatgcattaattgccatttatacacttgtgttaactcctgttttgcttcaggaaaagtataatgttggttcgagctcaagaaggaatctggataccagtaactttacccagaccttgggaatcttccccctcagtacatttaattaatgaagtgttaaaacaaattctcaaaagatctaagagatttgttgttactttaattgctgtgatcatgggcctaattacagtcacggcactggccaccactgccggagtggcattacaccaatctgttcaaatggcttattttgttaatgattgccaggccaattccacccaaatgtggaattctcaacagggaatttatcaaaaattagctaatcaaattaatgatttaagacagtctgttatttggcttggagatcggctaatgagtctcgaacatcgcatgcaaatgcagtgcaattggaatacttctgatttctctatcacaccatattcctacaacgagactaatcattcatgagaaatggtcaaaggacacttgctgggaagggaagataatttatccttggagataactaaattaaagaaacaaatttttgaagcctctcaagctcatttatccattgtgcctggagctgatgcattagatcaggtggaagaaagtctttctggactaaaccccacgatttggattaagtctattgggggccccactgtagtaaattttggaatcatgtttctctgtttaatcagcttgtttttagtgtgccgtaccagttaaagaatcctgcatcaaaactgagagaatgaacaagccttcatccccatggcatatttatataaaaagaaagggagaaatgttgcaggaagtcagggacccaaatggagggacgggctggagccatggcagaggaacataaattgtgaagatttcattttaatatggacatttatcagttcccaaataatacctttataatttcttatgcatgcctttaatttttaatcatgttatcttcataagctgaggatgtacatcacctcaggaccactgtaataattatgttaactgtacaaattgattgtaaaacatgtgagtttgaacaatatgaaatcagtgcaccttgaaaaagaacagaataacagagatttttatggaacaagggaagacaaccataaggtctgactgccagtggggtcgggcaaaaagggccatatttttcttcttgcagagagcctataaacagttgtgcaagtaggagagatatcatcaaattcttttcctagcaaggaataataatattaataccctgggaaacgaatgtgttcctggggggaggtctataaatggccgctctgggaatgtgtgtcttgtgcagttgagataaggactgaaatactccctggtctcctgcagaaccctcaggcttactagggtggggaaaaactctgccctggtaaatttgtggtcagaccggttctctgctcttgaaccctgttttctgttgtttaagatgtttatcaagacaatacatgcaccactgaatatagacccttatcaatggctctgctttttccctttgtcctgttccctcagaagcatgtgatctttgttagacccttattggtagttctgctttttgctctttgaagcatgtgatctttgtacctaccctctgttcttacaccccctccccttttgaaacccttaataaaaacttgctggtctgagactcaggcaggcatcatggtcctaccgatatgtgatgtcacccctcgcggcccagatgtaaaattcctctctttatactgtctctctttatttctcagctggctgacacttatggaaaatagaaagaacctaccttgaaatatcaggggtgagttcccccaatagataggagggtgaagattgaaaaactacctattaggtactaggtgcaatatctaggtaatgacatcatttgtacaccaaaccttagcaatgcacagtttactcatgggagatacctgcacatacaccctgtgaacctaaaataaggttgaaaaataaaaataaaatagataaaataaaatgtaaattaaaataaaatttgaatacagttttatttttagtagaatttctacatgtagtttccagagttaataatttataatgaatgtctacccatgtgattattttattttccaccaacatatatttttaaatatattctcttttatagccctttccatacttagtctttttatgattaaaaagaaactgtcaggccagacatggtggctcacacctgtaatcccagcactttggtaggccaaggcaggtggatcaccaggggtcaggagtttgagaccagcctgggcaacatggtgaaacactgtctgtactaaaaatacaaaattaggcaggcatggtggtgcatgcctgtaatcccagctacttggaaggctgaggcaggagaattgcttgaagctgggaggcagaggttgcagtgagccaagattgtgccactgcactccagcctgggcgacagagccagactctgtctcaaaacaacaaaaacgaaaaaaagaacaagaaaagaaactgtttattgacatttgcttctgttactcaattctagttgtaatcaatgcctaagctttgattatatcttcgtttaacttggctatattgcgtatcatttattttgggagacagtagcctcctatcttagctctttaggtgtgcacatattcatctttacatataaagggatttgagatatttctgtgatttcataaagtttttatgaagttatcttctttaaatttacttttactttacactaattgaatgtgcattattttggctgatctattttttggaagtataataaattgctttatgtatacttcagtggctttagattttttatttatgatttttagcattatgtgtttgccttagagtttatgtgcacaaaactattatatatttgttcacattaaatacaatttatgtatgttttaatcaatattcacctgcatgtagcttgctctgaaagaactagaatgctttcattttccatacatataatttttttctatatctctggagaataatgttctgcatatttttgaaatatataggtaggactatgctttgtgaaagagtctattaaagtttaccacatttgatgagttttgttttggaattaattaaaacctgaagcaaaattgatctgacatataattatgtgtataattattatggttactgtgtcatatagtaattaggcataatatgaattttatttggttttactgcttttatgtaacatatccatcattgttttagtcagctgggaaagaactataggtaaacaattatccacattgtgaagcactttcatgagtattatctcattatgtatataaataggttatgatatttatttcatttcaggatagtaaaggggcatttcaaaaacaaaaaacaacatttttttaaatgagaaaaagatcctttaattccaatagggttagaaacaagtacgttatcctcttttcctaggtaatttatcccatgcccacaggttcagttaccatctctatattaattctcaaatattcagaacagatctttcttttgaaatccaggtatgttcagccaacttcttaattgaacctccaccttggatgtctcaaaggcatctcagattcaacatattcatacatgaactcatagtatctcccatctctactaaaaggcctcattgcctggggtaaatgcccaggttttggtctcatggccaaggaaatcaaagactcagacgcacacacgcatagtgaaattggagcaaaagtttaataggcaaaagaaaagaacagctctctgtcacagagaggggtcccaaatgggttgctgagtggtagtaaaaatgtcagggtttatataaatgggctagtgaggagggtgtgtcttatctccgtggggcctgaagaactggttaggaccgggtgtgccgtatgttgagggcagagcctctagtagtccccaccccttgtgcaggccgactcttagtttgtgctgctctgcgctgcttatctgagcatgctaaaagggagggagagtttctgtgcctgttccaggcactttcttgcagctgcaggtgtccctgactcgccccataccccgacccccaccccatctcaccccactccctccctccactcccgcgcttccagctcagcttccctatctttgtgtgcttaaagaaagggagatgaatgtgcttattatggcacactgtttttactggggcctattgtttgtatgtgaagtttggtgattacccaggacacttccagctctgtgcccaagttgcttgtctgtgtttttcagcctgatcttccaggctgctctttgttagaagagaggtgatttctttgaactgcgtgaggttagaatgggagcaatttctgagctgctttttgttagaaagaaagttttctgccagggactctctttaccctaactacctaaatgatttctttctatctcctgtaacactaccttggtacgtatttcagtgattgtcatcatcacccatcctgttaggcaaaccagaaaactcaaagccatccttgttgctcctctacatccctcactctatatccaatttatcatcagattctttatttttcttttctcaactctctaatatattatatccatgctttgccatttctactgctggaactaaccctagtcaaatcacattcctcctttgttgggagtattacaataatattctctacaaggtatacccactcaggaaacagagtgatctaattaaaatataactatttttatgtcagatcttttagtgacttcccattgttgttgagatgaggacaataattattaacaaggtgaacagggactgggatgttctggcccctgccattgcttactgaatcttgcaacaaacccccttgtctctttttttcaggtgctgaaatgcatcatggcctctcctgaggctgggcctttgcatatgccctaacacaacttaaaatcacctgtctttgaaagatgggctattgtatcagctagactaataaaaattattctccacataatcatgtttcttattattaattaacaaacatgaaaaagataccatgtaaaatattagaattcagttttcttttgaagagatctttttgaattaacagcttttaaggctattagttcctatgcattcttcagatatcagttcaagcctcattttcttagggaagtttttcctctgttcactctaggccaggttatgttttattccctatctcatagaacctagactcttgtttccttttttcttagaacattgcctcagtttatggttcttgtattgtaataatacacttatcaatatcattcttgatcaatatttatttcttccatttcaagctctgagaggtctgatactctgtctctttttgtccattgttttttctctaacctctcatagtgtctggttcataatgataaataattttcaagtcaatgaatataaagtggtagtaagtgagagagctgggatttgaaatcagagctgactctaaaactactattctgcagtgacagtatatttttaacatgtgcattataacaataaattacactggatgttcagcacttgtcttggatatattcaaaagcaaaacatgagtcttagcttttccagtttaagcagtttaattatattttcataatttataacattaataaaatggggaattgtggtaaaagagattctgaggtgcatataaaaatgtttgcaggatgaaccacttaagtaagggagacccagtggacatctgccagtgggagctggctgtgaaaggcaacaaggtagaatgaagcccagtttctgtacttgagggacccaggcaccaggcagtgagtgtggcactgatggcccaccttggtctctcctggcccagcctcaaaatagagtagaaaaagggagtcgatgacaatgaattggttctatggaagaagacagcatatgaagggaaacttcattggaatcacataggtagatttttttatgttgttggctgttgtgtccaaaaacattgcagaggaaagattcaatattaaaaagcaaattggttcattgctgagagaatgtaaaatttattctcattctctttccatctattcctcttttcttcccttcctttatctattactctctttcttcctccccttctccatgactcgctataacctctgattcttcagtatgaaagtagtgtacatggacagaaatccctaatatacttgtttttaatagcaaacggggaacatgtaaccacaactctccagcgaaattgagatcatggccacataatctacagctttttctctcttctctatgtagattataatagttttatttaatagaaaacaaaaaaattatgtattaatttcaatttaaaaattttcttgatgttagcaaactatggatcatatcttaagaaagcagtgtatatttcttacccaaattctaacactaaaatattttaaaatattatttatttcctttggtttttaatccatatatttgtgtgttagtctataggataataacaagattatattttctctatatctctcttgccatttgtaactttgtgatttttacatatttaaaagacagttaataggattgaagttgaaactgtatttctattccagatgttgatgtcttcagaattgctttggaaattgtcagatttccaaattaatatcatagattgacttcttcatctctattcttaatcaaaattttccaagaagtaaagatatttggtcaccgggaagaaaattataatgcttagcagtgactttctaagcagcctgaggtgtcttattaaccagagtctgctcaggcctcaagatctgttgctgcccacatgtagggcagtttttctcataagcctaactaagggctgagctcttcttttacagtcattctataatgcacacccaaagctaaaaaaggagtggtcagtttacgttattgtcttattagaatgcatgaaattttgtaatacaagcacaaatgtatgtattctttccatctgttagacacacaccccttttagagttttaaactgtatctttttatattctatatcctatagttttgtttgattctgtgttataaacttccagagtcattctaaagatcttgaaataatctagagttcattctaatatagtggaaaaattattttaatgtcttatcttttgaaatacagatttcaaaactacctagttagcaaatgctggataatgaaatttgttcagagtttgactttttattcattttcttatcccactaacaagagcaccttgaagttctctcatcattaatgagatttcttaaaatatgtgattctgaagttttacctgaggaaaaagaaaaattcacatgtacttttgtgatggagtagcttaacttcaaaattcattttgaaacaatttttcctttcttggttttagccttgaaacatactttacaactctgtttacctccctccccaccaaacatccccttgtactggtagcttatctagttatatccttacttagaagttccaggggctaatcttgaaacaagccaggcatggacacccgaaattccagagattacctcaaggcggtttgtcaacaatctggctattgttgagatgatgtcagcctatgctccaggtcagcagtccccagacttttcggcaccagggactggtttcatggaagacaattttttcatggatgagggcaggggtttagtttggggccaaaactgttccacctcagatcatcaggcattagaatcttataaggagcttgcaacctagatccctcacatgcacagttcacaatagggtttgcgctcctgtgataatataatgcccctgctaatttgacaggagtcaaagctcaagtggtaatgctcccctgcccatggctcacctcctgttgtgtggcctggttccagtctgccactggagggttggcgacccctgctccaggtggaccatgactcaagatagtcaccagaacaggacacacagaccttgtatccagcaccactcctgcatgccttccattccaggttgcccttttaaaacccttctccccagtctaaagttttgaatggttttttaagggaataagcttgtccattccccaactgctagaatttgagtgaagttgcctgcctttcgccacaccttgcctctcatgttttctggctctcagcagtgagcagccagacttggcgtgtggttacacttttgtgcgtaaggtattttaaaatgttctatattatgttattatttatcatattgttattaagttttttcatgtctcccattgctagctgtgcttttagaagaatttgtatgctgtaattacatactttcttaattatgcttttcttgcatattcaaatgctcccaaaagtctttatctttcacttcatttttgatttacaaactgaggaatgcaaatacttccttgtatgtactttaatcccaaactctattaagaaaggcttattcagtgtgtgtggctagggaaacagtttcaatggctaacaagtgaatatagcagaaggaagaagcatatgtatgtctgacataattttttgatgttttgaaaagttatcattcccttggttgtttccccaccattcttcaatgttccttaatagattttcatttgagtttattttctcttaggtattttgtaatttattttttatttcttaaataattttgtcttttgctttcattttttttcctgagttgtcggctctttttatttcttttctctttcctcctcttctgcctttaatgttcaatttatcagtcaaggatctgtttctccaaattcttctttgagtgtatgtaactcagttttgaattgtgacttacagttttcttctgcttcatgaatattttgtgagggaatttttgtcagttcagatgtaattaattgttttattttaatttttggaacaactctctatggattaatattttttcttctgcttattttggttgatttggtattgtttctaacattcctaattaattaatgccttcttgtatcttataacaaagctggtttttttagtggatttttttgagttatgtgtccttcatttttttttttaaatgttgtgtaggatcctaaatgttcgcattgcattttttccctttcattattcatctgccaaagagcatagctacttttcttttggccttttctcccagaaatcatgccttatgaagtcctccacttaacgttgcatgtttttctaatttccttccctgcaatcctgtctaccaggaaattgtttccctatttgactatttaggatggacttactctttctgttgatggttatgctttgctagcattcctcttttccaagcatttttttctcaggttgctcttcctctatgaaggtttagagtagggtggagacatgagagattgtttactggaatttggcaatttctgtctatgtacttcagttacttgtaaatttgagcagactgttctgaagttctaattttcgtggtttcttgtacttcacactttgttcggtattatttttaaaggacatatattgagatgccattataggcatacttgttcttttaaacgtttgaggtttatagtttgaggcaacatgcaaaaacttttgaattgttatatctaccctgtggcttttaacatcatgggtgtcccttttcttttttttaaaacccttgtattaaaatctttgtgtattattcaagccagaccagatttatttttggtgtctgcatggcatatacttttcttcactttgctttcactatttttaatctacatattttacttttgtattttgaacacagcatatgcttaaattttacttttaatttctgtctgacagcatacttattttgattagaacatttagtatacttacattcaatgtaattagatgacatattgggataaattttactacatactttctttttattattccctcttcttttattttttttttccttccttggcctttttgactaatttattactttcttattctatttttcctctagttttaataataacttgttaatatttagtggacatattacagatgactgcttgagttttttactcatcacattctaatataaactagtacttttacttcttcccaggatctttgaactttatttattccctttccttttttgctattctactattgccacattttcatttgtatagattttttattctgtaagactccattattattgttaacacaattaattttcttttagatatactcacatatttacctatgccatttatcatcattacttcatatatccctgagcttgcatctgagatcatttgccttctaaatgatgaagattaaaaaaaaatccttggctgggtgcagtggctcatgcctgtagtcacaggactttggtaggtcgaggcaggcagatcaagaggtcaggagtttgagaccagcctggccaacatagtgaaaccccatctctactaaaaattaaaaaaaaaaaagtagctgggcgtggtggtgactgcctataatcccagctactagggaggctgaggcaggagaatcgcttgaatccaggaggcggacgtggcagtgagctgagatcgcgccgctgcactccagcgtgggcaacagagtaagactcagtctaaaaaaataaataaataaaaattcctaaatgtaagcctattcacaacacattatttcattttgtttaaaaatgcccttatcttcatttttgaaatatattttcactgtgtacacagttgtatattggtaaatattttctttcagcactttgaagatactgttccatcatcttctggctctccttattctattgagaagttgtctgtcatttttactgttctccctttgaatacaatatatctatatttccctctggctacatttaaaatttcccctttatctgtaataatcagtaattacgttttaatatacataaatatgtttttctttttatttatattacatgtagtttaccatgttttttgaatttatgtgttgatgtcatttatcagttgggaaaattctcagccattatctcctaaaatattgcttgcttcttcgtcattttctctcttttccaacctgggagtccaatttacatttttgaagaatttctcccctttttttactttgtaccttatattcttttctatatcttttagcttcttcctatgccagccagttgctttctttggattagtcttccagttcacaaattaaaggttgtgactgagttcttcattttctgcattcttgttggtgagtttctaatgtccatcatttctcctgggtttggtcatacagtcttacgtttcatatgcctattgttgttgttgttgtttggttttatttttttctttttgggtgcaagacattattttcctaagaaatagagggctaacttaaggctcaagagtgattttatcttcttccaaagaaatcttttactgacatcttgcaggcaactgtgctagaagcactattaattccatgtcaccttaatccaatgggtgattgagatgattcaaagtttcactttagtacctgtaggtcaagtctatttctaggaatgaggatcattcttattccttgtatgtagccctcagagtctcaatccaaaccatggggtgatcactggaacccatttcttggaaggtcttcagcttcagttgtagtccttgtttcaatttctttgctttctccatcagaattgtctggcagcagccaaagattcagaagaaaatgaactctaagtgcaaggctcatctgcatgcatgtcgctattctcttggattgtgaatctattattcttcattacattgttacattatccaatgctttcaaacacatttatttttgttcatattttgaccatatttgctacttgcttttaaatggagtgttattccacataaccttgttcatcattactgaaaatctccacagctttaaggaaaaatatttataagtttacatttctgtaattgtgtgtagattttacccccactgaataatttcaaacagtatattattgttgaaaaatcgaatatatgttctagaatcatattcttggccagagatttcagtccctccactgtatgtgaaagtcaagttgttttatctggtcttcctgtttcttcatggtcttctgccactcacctttgcagactttccattcctgtctacatctactatctgtttatttattttcacttgcatttacattttttttcttccatactctgtctgtaaagatacctgcagtaccaggatttgattttccccgagtccaaattattttttagattattgcatgttgtttgttaccatcttctccaaatataataccattctctgtgtgcaacactgtgaaccccttgagcttgtaattagttgatctatatccatagaacaagtgtaatgccactgtatcaagatatatccataccagggcctctacccctttctagttgtttccctctgctgaaaattacatggctgtaaataaatgtgctttacttcttttcatgtgcttgctaatgttgcagggaacctcaatcaggaataaaacagaatcacgtggcaaagagattaagctaattttgaccataagaaaaatgtttgcaataatttaaacaaggttatcttgaattgtcactctttaatctttgattttgttatgaatgcatagtaaatttgatatacatgtgcatggctagaagtcaaaagatagaacttaaatcagactctttgaaaggtattactaaaatataaatgtgttatggcttaaagtcatagttacataatgctacggttggtcatagtaaatcagtaaatgtattttttagagccactaaatctttcacactcattatcattctatagtgcaaaaatgaataatgttttcagcaagtctcttatagtacataccacctagtgactgaattagggaaataacattcctaagtaagttcctgtataaacatgaatatacatatttatacatgaatataaaaaatataaattataattttactttcatgccatttctacctcagaagaataggttgaatctgttccacgaatgaaacataaacaggacattcacttgtggtagagccatttgttcactaaatacacatttatacagtgactattatggataaggtattatgctagagagagaaaaatgaataatatgccatccttgtttgctagtagctcataggtgaatggaaggactatgcaatgacacaattgcaatgttctgtaataaatgcagttctacattattaacagaggcaacaaaaaggaagaggtaatatggcatggcttagtatagggtgttatatttattggagcagtataagataatgttagagagataggcttgagttatccctatggatgatcttatagagtaatcttaggaatttaaactttatccagtggatagcggagtgccattcgatggtaatacatagatgaatgatgtgcaagtatgtatgtcttttagtaatgttattttgtctgagaaatttgttaagcagggagacatattagaggctgcagcaacatcttgtgaaaacaatgaaacttataataagaaagaagtaagtgaatagagaatgagcaatggatttttaatatgtgatttgagaaagcttaaaataattagaataatggcacatttcaggttggcaagtgccattaatcaaaatcatgaaagcaagaagaggaactgacttaagtgaaagttaaaaaaaatgtttagtgttaggcagtggaacatccaggtagaattagatgaagccagcaaagatataataggataagccctaggcatggacaaaaatgctataggaatagatgaggaatgagaaaagatacagatggttatggactcaggagaagctcaatgtttcagggacatggatgtatgtgtatgtgtatgtgtgtgtgtatgtgtatgtgtatgtatgtgtagtattctgcttactaaactaaatacagtgacaatgcctggacaggccagggaaattgttggttaacattagattatcagtcataaatgagatgttgaaaaaaatgttaaaaacattgtattctgattatgacttaaagtgttgatggtgacacattaacagcaaataaataagaggcaaggcattgtgtagtacaatttttaagagattgacttgttatcttaccccatgctgtcaaagaccacttctacagaattgcttgacttttggagtgaaaatagggaattcctacagtcaaaggcaatattttacattaaacagagcccacataactatgcagacagtatatggagttaatttcagctggacactattatattcagtctttacaaattgatgcctcagccataaaagcacctcagtgcaatctctagaaattggatggcttcccattgtaagcctttttgaggtgttggacacaaaataagtttttgattgtatttggaggagatcacatgttagttgggggtttgatatgactagactgtgtccctacccaaatctcatcccgaattataaaccccataatccccacattttgagggtggatcaggtggagataattgaatagtgggggtggttttccccatgctgttctcttaatagtgagtctcacgagatctgatggtttaataagcatctgacatttcccctgcatgcattcagtgtgtcctgctgccctgtgaagaaggtgcctgtttctcctttgccttctgccatgattgtaagtttcctgaggcctgcctagtgatgtgaaactgtgagtcaattaaacctctttcctttataaataacccagtctcgggtatttcttcatagcaatgtgagaatggactaatggactaatacagtaaatcggtaccacagagagtgggtgctgctatcaagataccccaaaatgtggaagctactttggaactgggtaataggcaaaggttgaaacagtttggagggctcagaagaagacacaaagatttgggaaagtttggaacttgctagagatttattgaatggctttgaccaaaatgctgatagtaatgaagtccaggctgaggttgtctgagatggaaatgaggaacttgttgggaactggagtgaaggtcactcttgctatgctttagcaaagagactggcagtgttttgctcctgccctagagatctgtggaactttgaacttgagagagatgatttaggacatctggtggaagaagtttgtaagcatcgaagcattaaagaggaagtagaacacaaaagtttggaaagtttgcagcctggcagtgtgatagaaaagaaaaacctattttctggggagaaattcaagccagctgcagaaatttgcttaagtaacaaggagctgaatgttaatcaccaagacaatggagaaaacatcctcagggcatgtcagagacagtcttggcagcccctcccattacaggccaggagctctagaaggaaacatggtttcattgaccgggcccagggccccttgctgtgtgcagcctaggtcttggtgccctgcatccaagctactccagctgtggctaaaaggggcctaggtacagctcaggctgtggcctcagacagtgcaagccccaagccttggcagctttcacatggtgtggagcctgcaggtgaacagaagtcaagaattgtagtttgtgaacctctgcctagatttcagaggatgtatggaaatgcctggatgtccaggcagaagtttgctgcaggggcggagccctcatggagaaactctgctaggggagtgcagaagggaaatgtggggttggagcccccatacagaggccccactggtgttgcagtttttttgcttctgtagttcagcaagtgcgagggagtggctcccagcagcttcttcactcccatagctcagtgaccatctgttccacagtggaatctatttcagtgaccttcactgccaaaggagtaaaaagaagtacagcgtatgatccctcccaatctgggcctagagagggagaaagaaaaggaagagtccttactagtactaagtcccctggttgaataaaggtggccttggttcatgggtttgggcctttgacatttgtttccgttcctgcaggaaatgggccaaagaacttacatggttaatcaaatcaaaggttacatggttaatcaaatcagaggtttcttggtctagaaggaaatcattggtgagaaaaggctgtccttacgtcatttcaaagggaattaaactcagcttcaaaggggtgtttctaaaacagtagtgccatgggcatgagagtaatccaggggagatgagtctcttaagaaagttttctgaagtgccttttgataatatcatgtttcttttctgcctttcccaaggaatgtggtctccaagcaccatgaagatggtactgtatacctagtgcctttgagtccccctgggtgacagcaaccttgaatgagaggctgttattgcctgaaggtacttagggagcccaaagtgaggaattatctaattaattagtacttctatcacctcagagactttctctgtcagacatgaaaatgcttctatccagttaatgaaggtatatacccataccaggaggtactggatgccccttatctttggaatatggatgaaatccatttgccagtcttctcccaggtagcctcccattctttgggctccagcggggagacaccattgactggggggattatttttaaggcaagcctcacaagcattaatgacctgtttgaccatttttacctgacaacaacctttgagccagttggtaggttttatcctttcctacgtggaaggcttggtgaaagattttaagaactttccattggctggaatttggtagatgaagtttgccatcctccagttgtagctgaaaggtatatccttgagaggaggcccattctatttctgcaggagagtactgagtttttgtttcttttatggagccctcccagattagaggggcctcaagtggatcagaaatctggggtactctaactgccaatttagctgcttgatctaccagtttatttccctcagcaatttcatctatctccttttggtggcctttacaatgtattatgccacttcccgtggaaggaaaaccaaggataatagtctgttaatttcccgatggtacttaatgagagacctattagctgtgaggaagtctgtctcttccagatcatggcatgggcatcgaggattgcaaaagcatacttagaatcagtataaatgttaactgctttccctttgcttaaatgcccccatgagggcatttaactcagctagttgagcacttgcacccgagaaaacaggtgcactcacaatagtgtcattcaggatgactactgtgtattctcctttatcccttgttctacaaaagaaattctgtctgtaaagagagtccattctgcatcctctaaggggtttttttgaggtcctctctggctgcataggtttgcactactatctgttcacagtcatgttcaggcttcccaagtttctctgggagggaggtggctgggtttaggagagccagattcttaactgaactgtagattcctccaatagcagagcttgatatttgaggaggcaattgtttgttagccagagactccccttagaagacagcagtcctgccaggttttgtggggtataaatggctaagttcttccccatgattaacttagtagcctctggcaccagctaagctaccgctgcaactgcccagaggcaggccagtcatcctttagccactaaatcaagttccttgctcaagtagcccatgggctgttggggtgggcctcagactgaggatagaactctgtgatgattaatattgagtgtcaacttgattgggttgaagtatgcaaagtattgttcctgggtgtgtgtttgatggtgttgctaaaggatattaacatttgagtcaatggactgggaaaggcagacccaccctcaatctgggtgggcacaatctaataagctgccagcatggctagaataaaagcagacagaagaatggaaaagactgactggcttagtctcacagcctaaatctttctcctgtgctggatgcttcctacccttgaacattggactccaagttcttcaactctgggactcagggactcagactggcttcctttcttctcagcttgcagacagcctactgtgggacctcactttgtgattgtgtgagccaatactccttaataaagtcccctttatatatacatctatcctattagttctgtccctctagagaaccctgactaatacaccttcctcactgatacataaagatttaacatcttccctatgggaagactaagggcttgtgcctcaagcaaggcttgtttcaattggtgaaaggcccttttaatatttggttccccaattatggagtgagtcttagctgcctgagtttctttcattaggtgatataagggatgagctatctcactgtgcccaggtgtccataatctgcagaatcatgtaatgcccaagaaccccctcagttgtttgagggtttgaggaggggaaagtaggagatgggcttaatcctttattcacctgttgccctggtctcctctgacaagagtagacctagatacttcactgaagtctgacagagctgagtcttagattttgagatcttatgtcctctgttaccctgaaagttaagaagaggcttactgccttcctgagtgatttcctcagttagggcacaacagataatgtcatctacatattgtaaaattttaacctgaggataaaggaactcagagagaccccttgacaacactttaccaaacaggtgggggctgtctcagaatccctgaagtacaccatccaggttagctgggtggtctggttggagggatcctcaaatgcaaacaaatattgagaggcagggtatagtggtatgtagaaaaaggcattctttagttccaggactgtgagccctttagttccctcaggtatttgagttagcaaagtatagggattgagaaccaccagatatatcggaaccacagcctcatttatgaggtggaggtcctggagcagtctgcattcccatttggatttctgtgctcccaatattggggtattacaagggctgttgcagggtttgaggaggcctgcctcttcaagttatcaatgatggcttctagccctttcctagcttctggttttagggctcactaaactagcttctggttagtgaagcaggtgggatcctaaaggtggagttggaccagtatggtggttgtggcttgatcaattttcccttgagctgccaaaacttctggattagtattagtctgcaccagtgggagacaaagagcctgccttggagccataaggatggtagttcccttatgaggtaaaatatccctatgtagcagaggagttggcctcctggcatgatttaaaaggcacgagtaagcaagaggtttccccaactgcaagtgagtggttgggaaaaatatcaggttaaagtttttcttgagatgcccctcataggcatgctaagggaggaggggaggcctggactggagaggagaacagaaatggctgtgctggtatccaagaggaggttcactttcctctcttcaactttcagagtcacttggggctcctgaatggcaatgacattttgagttattggagccagggagagaagcccaaggactcctcagtcctgctggaccatttgtgagtctggctctggactcagtgacctgcatctctggggacagtccaccctccaatggttccctccagagattggacagggtcaaggtggcttcctcatgctgcctgggcagttgttaaggtgccctggcttgccacatttgtaggagttatcaggtgcatctcagggattctgggtttttaagcctgcaaggcagctattagagactgtaccttttttcttgtgtctcctctctctctcttcagtctcctcctgatccctgttgtaaaagaccaaagtagccactttcaggaggttctctaaagtgctatcttgtcccatggcctgcttctgcagcttcctcctgataccaggggctgcctcctaaacttactctttaggattagttgtccctcaaatgaattaggggatagagaggtgtaccaaggcttctcttagcctctccagaaaggaaatgggtcatctgatccctggtctatcatggatagtttggagtaattgagaggcttagttttagtccttcataagcaaccaatatgcacatctgaaagtgtttcctcctctattctcccatgttgtattagtcagggctctctagagggacagaactaataggagatatatatatatatctctctctatatatatagatatatatatatatatctatgtatttatgtacagatatatatatatctatgtatttatatatagatatatatatctctatgtatttatatatagatatatatatgtatttatatatagatatatatatatctatgtatttatatatagatatatatatatgtatttatatatagagatatatatatctatgtatttatatatagagatatatatatctatgtatttatatatagagatatatataaaataatatctcctatatctcctattgtgtgtgtgtgtgtatatatatgtgtgtgtatatgtgtgtatatatatatctgtgtatatatatgtgtatatatatatctcctacatatatatcatatatatatatgggaatttattaagtattaacttacaaaatcacaaggtctcacaacaggccatctgcaagctgtggagcaaggagagccagttcaagtcccaaaactgaaaaatttggagtctgatgttccagagcaggaagcattcagcataggagaaagatgtaggctgggaggctaggccatctggtcttttcacaattttctgtctgctttatattatagccacactggcagctgattagattgtgcccacccagatcaagggtggatctgtcttttccagcccactgattcaaatgttaatgttctttggcaacaccctcacagacacacccaggatcaatactttgcatccctcaatccaatcaagttgacagtcattattaaccatcacaagtcaaccccttgtcaacttgaacccatacacatgtcctgagattatacataatcaaataaagacaacaataaggtaataattacacctaacataataaaactatcctttgtacatcaggaaacgcaccaatccccaacccaaatactattacataaagttaataatacttaaatgctgaggtgaagtcaataaatcttatgtcacatgatagaggggaaaggaaataaaatgaagatgttttcttagtacaggtgtatacatgcacaaacatgtttttaatgaaagaaggaggaaatacttatgacaattacagtcctcatttctgcagctggtcatgtggtcatagctggtattgatgactaccttcttcaactacccattctgtattccctttgccttcagcaagcacctcagcaggttttttttttttttttttttttttttcctggtggaatgacccaagccttcattcctgaagggtctgggtcatttgtagtcccacctgggttggggtgttgcagtttcccattgacattaatcacagggcatggtaatactgtgagatgccctaatggatctcctatattccacgtatactgttccttacctttgttgtggagtagtagactgatttcatcttgatagtccaggtcaatcacatcagccaacgctgtaactcccttcttaacctgttgtcttaaaggtaggaggagcccaaagtgtccaggtggcaatcttaacatccagtttaatgaatcattgttgtgtctcctggtggaagcattcccctctctagaactaagacttctagactagtagaatgtaatgccatgggaacaggaagcaagaattttgctagtgtatcactagaagtgatggtgagtggtgccacttccacttccaccccttgattcctggacctgtgaatcctgtctatgggagaaacagtaccatatattggatgctgattcagaacatgcatggccttctggagaactttgcctcatccaagcgaagtattatcacctagttggcattgtaattgtgacttcaaaaggccattgcacagtttttatcagtccagctgcttcaggatgatggggaacatgataagaccagtgaattccataagcatgatcccactgccccacttttttagctgtaaagtgagtgccttggtcagaggcaatgctgtgtggaataacatgatgatggataaggcattctgtgagtccatggatggtagtcttggcaggagcattgtgggcaggatacacaaacccatatccggagtaagtgtgtattccactgggcacaaatctctgccccttccttgatggaagaggttcagtataatcaacctgctaccaggtagctggttgatcaccctgaggaatggtgccatattgtgggctcagtgttggtctctgctgctggcaaattgggcactcagcagtgcccatagccaggtcagccttggtgagtgaaaatccatgttgctgagcccatgcataacctccaatcctcccatcatggccacttttctcatgggcccattgggccatgacaggcttggctggggaaagaggctgagtggtgtccacagaacgggtcatcctatccacttgattattaaaatcctcctgtgctgaggttacccataggtgagcactcacatgggatacaaatatcttcacagttttgaccacttagagaggtccatccacatatctctgccccaaatttctttgtcaccaattttccaatcatgctgcttccacatccctgatcatcaagccaaaccattggctacagttcacgaatcagcatataatcacacatctggccatttctctatccatgcaaagtgcacaaccaggtgcactgctcaaagttctgcctactgggaagaattccctttaccactgtccttcagggatgtcctaaaaaggggctgtactgctgcagctgtctacttttgggtggtacctgtatattgtgcagaaccatctgtgaaccaggacttaatcttctcttcctctttcaactgatcataggtaactccccatgaagccatcagtgcaggctggggaagagaaggtacggaggcaggaggggagcatttgagccacttcctcaagtaacttacttttgccttcagaacctgcttgagcccaatcacgtatataccacttccatttgatgatggaatgctgctgtgcgtgccccactttatgactagatgggtcagaaagcacccagttcatgataggcagttcaggtcacatggtgacttgatgacccatagtcaaacgttcagtttccaccaaagcccagtaacagaccaacatctgtctctcaaaaggagagtagttatctgcagaagatggcagggcctgctccaaaattttagaggcctctgctgtgattcacctatgggggcctgccagaggctctgatcagcatccctatctgccgctgtcacctcaagcactattgaatttgctgggtcatatggcccaagtggcagagcagcttgcacagcatccttgatctgttgcagagccttctcctgttctggagcccactcaaaactggcagccttttgggtaactcgatgaataggccacagtaacacacccatatgaggaatgtcttgcctgcaaaatccaaataggcccactaggcattgtgcctctttcttggttgtaggtggggtcaaattcagcaacttatccttcaccttagaaggaatgtcttgaaagatcccacacaactggacccctagaaagtttactgaggcagaagttccctaaattttagtcagatttattttccatcttctggcatgcaaatatatcaccaataagccctgtgtgtttgctacttcttgctcactggatttcatcagtataagacatgaatgtaatgaacgagtgtgacatcttgtagaagtaaaaagcgatcaaggtgtctccgaaaaagattatgacacaaagctggagagttgatatacccctgaggtaggacagtaaaggtatattgctggccttgccagttgaaagcaaattgcttctagtgggccttatggacaggaatggagaaaaaggcatttgccaactcaatggctgcataccagataccaggagatgtgttaattttctcaagcaataaaaccacatgtggtacagcagctgcaaatggagtcaccacttggttaagcttttgataatcgacgatcattctccaagatctatctgtcttctgcataggccttatgggagagttgaacaggaatgtggtgggaatcaccacccctgtgtcttttgagtccttgatggtggcactaatctccgcagtccctccagggatatggtattgttttcaatttactatttttctaggtagaggcagctctaatgacttccatttggcctttcccaccataatagccctcaccttacctgtcagagagccaatgtgagagttctgccagcctgctaagtatgtctatgccaattatgtgttctagcactggaggaataatcacaggatgcaccacaattcagacctgagctaaaactccattagttacctgacctccataaccccctactttaactggaggaccacagtgacattttgggtccctaagaatcaatgtcagctcagaggcagtgaccattagtccccgaattatctgatcttttcccttcctccaatgcacagttaccctagtaaaatgctggaggtttccttggggaagaatgggagaaagattaacagcataaattgtcagtagtgtagtggtgtccttcctcaagaggtcttggctcccccttcattcaaagggttctgtgtctgtaaactggctcaagtctggaatttcactgaggggccatgattctctgtttttataattcaaattcatcttttgtcccttctacgtagaagttttctgcttatataaattaagtagaaatacagtaggcttcctatcaatttcacttccaggaactccgtgattaattagccaatgctagagctctacttgagtcagactattctgattgcttctttgtctctgctatccattacggtacctatgctcaccttgcttttgatggttgagtgtcgccacttggtccctgccatctcaggatccaattattccaattgtgtttaaattttgtagatgagaactgcggttcctactattagatctgacatacagagaagagcaattacagggctcttcaaagatgcgggtgctatcctcacaaatctattttgcaaggcattggtcaagttatatcttctggaccctctcagctaggatgattaggtctgaagtgactaatccactccagcatcccaatctccctaagcctttggatcctttcctctatattaaaccaagggagatcaggcacagtaggccatcttttaatccatatttcagctaaccaagcaaataaactactagaaccttttttactccccaagctgcaatattaaattcagagtccctacttagtgggcccaaatcaataaatttagcctgatccaactctatgtttcttccactattatcccacacccttaatatccattcccatgcctgttctccagatttctgtttatataaattagaaaactcaagcagttattttcgagtgtagtacacctcctcgtggtcacactctcaacctcatctctaggggcctgccgggactttagtctagttatagatctagaagcaaacaggtgttgggtgtggctcctgagaagaatcaacattatctttcctggcaactgcctcaggggaagtcatcactgttgcttcaggcagcacagggtttatctcctcagacaaaggtggaaaggctgatggcagcatgggttggggaggggctgttgccactactgggcatggggatgcttttccttctggcaaaaaagtttcatcagagtttacaaactcagtgtccccatcttcatcagcatccttccacatgttcccattccaagttgcagggtcccattcttttccaatcaatgccctcactttaatggtagacacctggaaaggctgcacatgcactttttgttgtaggttagccactcacatgataagagcttctgtctttttttccacaatttcagctcgttctctacaggagataggtctctcagggaaaccttggcagatttgaggctcagtatctgcttctgaagttgggagatagaatccctgggttcctcattttctttcatcactttgtctactgaacttaggagcaaccaaccagctttattacattccccacatatggtcaaaggtattatatatatagtcacttaactccttgcctctcatgtttggtgactcaggagtgtcaaatgcatttattttgtgtatctctataagcagttcacaccaaggactgtcagtgttctccatactattagaagtagagtccttagcatttttgagtctaatcatattaagcagccaactccagaaaccctaaaaccaatgaaagaactctatccttaatattctgttcctctagaaccactcctggtaccaaaatctgtattagccagggttctctagagggacagaactaataggagatatactggcagctgattagttggtgcccacccagattaagagttggtctgattttcccagcccactgactcaaatgttaatctcctttggcaataccctcacagacacaccccagattaatactttgcctccttcaattcactgaagttgacactcagtattaaccatcacacatgtcatcattggggtcccatttagggtcctccaatggtactgctgtttttccaattgtataaagctcttccccttgcttggcactatatgaggtacaaagctcatccccaaatttctctgccacttgcagggctgtctgcttctcagcggtagtcaggattcgattccaaagtaacattacatccttccaggagagttcaaatacttgggttaaattctggaaagcctctatataactgtccgggtcatctgaaaacctgccaagatccccctaaatttgtcttaagtcctgtagagttcaggagacctgtatcttaatgggttatattcacaaggcattttctataggggcatgagcaaggcttggacctgcctaaaatgatttttaggatgggggcaaaataatataagaagttttttcttcaaagtctgaggggtcacaggagtcccagtgattcaggatacacttgaggggagtgcaggctgcaggtggtttgttacccacctgaaaagagagaggggagaaaaggcatgccttagtctctcccttgctaatcttgaatttgaagcatccctcaaatctcagtaactggtactggcaccatggatgggctcttgctgcttatgccatggttgtgagtatgaccttcccccatgaagcagaaaggactagttggcagggatagtcatgcttacctgcactctgtcctagccttctgttgttgacttcctctggttcctcagatctagttttctttttagggctccaaactgaagcatgaaaaatacactggagtaatggtaaggtgaagctatggaaatagatccttctcaaacaaaggaaagaaaaggaaccctgagaactggggacctggcctaataagatgtcttccaaaaggaaaaaatcagtccttcacatagaaaagctccttgtattttcaggattatgttgattcctgacatggtgggaaaagaaacaacttaaatgcagaggagggaaggtccctgggggaagtggtctcttgcactatgctaatgggtttcttcaacaggggaaagaaaactctcttaatttttacatccccctgtttctaagaatagacagaaacaacatggttcaggtttacactcccgataactaagccaagtattcattctacccactaatattatctttttggcttgcaaaaacacttgtaacattgtatataaagaagggatagaagccacaagagtcttgaaagaaagaaaatgtgataggaaagactggaagttttggtgcaacacctgaacaggctgtcgggaattggagccaatccaggagtcttccagtaatgtcgaggcatggccttggccagataccttcaattgccccaggaccttattctgatcccacatgacagctagaattctggaagagaagctggattggaataaagtgaacatttccaacacccgagggtgaagggggattgacaaaatcctcccctgcaagcctgttctctgaatcttatagaccagcagctgcactatccactcttaactggctgacaaaggcccagtgttctatctgtttttgtaaaaaatctgaggacaagaagcctcggaatgaaagtaaagagtcataggtccactcttactcaaactttaattgatcctggatgaacccccagaaatgttgtggcatttttgctcgcatagtttggtgagtgggaaggagtggcacccagtggcttcttcactcccatagctcagtgagcaggagggagcggggcccagtggcattttctctctcttagctcaggtagtggaaggggatgttacagctcttttactctcgctgcccacagcttggtgagcaggagtgttacagctctttcattcaagcagttcagagatttctacattcttgtcctgtgaccaaaaggaataaggtatgtggacactggagagtgagtaaggcagagtagaattttattgagcaacagaaagaaagctctcagaagcaagaggggacccaaaagcttgttgccatctgtgaagctgagtcgggtttttatgggcttagaatgggggaatgaatgctgattggtccatgggtgggctcgaaaaaggcatcatttgatgggttaaaaggcatcattcagaagaaatcaactgagagagagtagataagatggggatggcagttttcactctggtcctagactctatctggaactggaagctcagttttcaggctttaggctatccttggcttgaaggtcaagtttcaccagggacccatccctgtccacctatgaatttgtctgtctcctgtatctatcaatggggcactgcctaataaagctgtgagaagagggccaccatcctccagacctcagaatggtagatccactgacagcttgcaccatgcacctgaaaaagccacagacacttaacaccaagctatggaagcagctgggaggggagttataccctgcaaagccagaggaatggagctgcccaaggccatgggagcccatctcatgcatcagcatgacctggatgtgagacatggagacaaaggagatgattttggaactttaaggtttaatgactgccctgttggagatcagacttgcatggggcctgtagcccctttgttttcacgatttctcccatttggaatgggagcatttattcaatgtctgtactcccattgtacctaggaaataactaacttgcttttgattttacaggatcataggtggaagggacttgccttgtctcagatgagactttggacttggactcttgagttaatgctgaaatgaattaagactttgggggactgtgggaaggtatcattggttttgaaatataagaacatgagatttgggaggggccaggggcagaatgatatggttagtttctgtggccccaccaaaatctcatcttgaattgtaatccccataattcccacattttgagggtaaaagaggtggagataattgactcataggagtggtttcccccatgctgtgcttgtgatagtgagtgggtctcacaagatctgatggttttagaagtgtctggcatttccccttcttgcactcactctgtcctgctgccctgtgaagaaggtgcctatttctccttttctgtctgccatgatagtaagttttctgaggtctccccagcgatctggagctgagtcaattaaagctcttttctttataaattgcccagtcttgggtatttcttcatagcagtgtgagaatggactaatacagggttgtatatcagaagtcatataaagatagaagaatattaaacaggtacatttaaattttgtcatgaggttatgacaagttactctgacttcactaagcaaaccacctgagctgtttagatatcttaagtctagctagcaaaataaaacactgtctatatcaatgtagcagtatatgtgaaagggatttgtaaattctgtaatgtcataaataggagtactatttttgtactaatagaaaatttttaagtgtggcttgttcttgtggcctgttaacatgaatgtgatggtagctactattacaaaattaccacctcttctctactctcgaggatggtgattcactagcaacagtttctctttaggaactttgatatcagggaatgcctttcatagttccgtatcccaggcatttagcctgctatttgcacattaatacattaatacattaattcatttttttgaatgaattaataaaaactatgtgactgttctggaagattctgccatattcctactctgtgagtggtgggagggggaagctaaaatcaaggaggcttcacttaattattcttatccattcatcttctgaatactcttaagaatcttcaatttaaccaatagtcttaaataatcttactaagggtttttaatacatttaatgagttataaatcaaggataaggatagaaaattggcagtccatagatgcattttgtttggtcctcccaatgttgacatttctcagggttaaataattataataaaaatttactgtcagcattaaaaatttattctagttcacctaaacatgtattcttttctctttttcttctccaggcacactggcttccttttttttttttttttttttttttgtaaaatgccacatttactcttaaattctggactttgaactggctttttcctatgccaggaatgttcttcttctaaatatcatcatggtcaactctatcactgtcttagtctttaatcgaatgtcaccttctccatgaggcctcgccagattgccgcatgtataatttcatacatcatgccccaaaaaattctccccatgtacttccagtctctcttacactgctttttctttctactgcatttttaatctaacattttatgtgatatacttgtatatgtttattatttattttctgtctcctcaatatattataagctacatgaggattgagatctttttgtttgtgtgtgtgtgtgtgtttactagtgtatttcaggcaattggaataatgcttgataaattaggactatcaataaatatttgttgaatgattcaacgaaaaccccaaatatatggctccttttgaaaaaaaagcactatctgttaacattgggcttacattcctacatcctccaccatttgttggaactgagaggcaacaggtgctttaggcaagacatgcatgcattcctcggtcctctacagccatcaccaccacacttgtcttcccagtgctgagccttatctgcattggcatttatcttcatatttattcttttttttacaataaagaggaaaactatgtctagtactcatatctatatcaaaagggggtaacatgggataaagaaagatcaagaaagttatatgtttattgaaacaagggggacagcatgtttccatgttgaggtgatctacgtgttaaacatgtagaatatatctcttcatatgtccacctagttcattcatttgaattatttttctgatgcctggcttttgaatttctgacctctgctctaaatagacataactgcaactttacttaaaattcaaagataagaagtatggaagcatgcattatcagaaagaagataaaattatggaagcttacaataagatcaagtatcttgagtagctaatagtagaagttagttattttactgtggaattttattacattttaagttgccaacccacacaaagataatccttgtggacatctatagagaattaaattttcagttagctaagatgctataactttgggcataaacttgcatttatagctgggcatgtaaagcaaacagatgccaattggttgggacagtactattaggcatatccccttagccaataatgcaaataagttagccttgctacagcaaagttttgccttgcctttgaggaatggaagcagattaaagcagggaagagatgtcaatatcatccatactttctatccacaaaactaatcagaaaatctttgacatttactcagagtaataccatacctgaaataggtgaatctatgaattcttaatttagtaaatctgttagaaacaggtcaccattttcaaaagctgttacattaattcactttggtgtaaagcattgtctagcactatttcagcacccagtattgacagaagtgatcacttgtgtcatcatatggcacacacttttccgaacctccatatgcttttggctacctgtctttctattttgtacactttccctttgaatatttttaggtttgcaacacttttatgtgattatcatagtgttaaacagaagttataatttactgtccaggattattttacatataacatgtaactgaccctttcagatgttttttattattacataacaagcttatcaaaaagaaaaattgaataacttagaaataatatttattaaattgtaattattaacctgttagcattaaagtcaggataagatagctgagctgtattgcaatttcaattacaaaaatgcgtgcttattcttcattttggaagcccgccaactaaagaatatattaggcagtgaacgcaacatgacaagccattcaattcagcaatttctagttggtcagatacatcttcaggcaaatttaacctttataaggcttattcttggtctctgttttgtagagattacagaattgtttattttaaataaaaattatgttgagagaggtataatctaaaagtcattgaaatttccacttctatcaattttaggttacatgctgctaggtaagaggaattaataaaagtttagaaagtcttcattcattttcaaagtaaactgctagtagagaaactgccttactttctaaaccttaatagaatacgtttttattgataaatgtccaattcattgacttttgtcatctttcaattaattgcttacattttttgtttttaataaggttttaaaagttgttataaccatttatcacaactgtgaactgacttgacttgaaaccattagcaaaataaacacctgtattttagtagctacccataagcaataactacatactatgtaagtgccccctgacctcctgaatcctgcttcaattttgtttagcctctgtttaagctcctggggattatgggggcaaccagtatggcttccaaagaaacagagggataagtaacccaggtgtgtcctctttgtgccagtagtaggaactatgccagctggctgccctctggcactgtgcatagtgaacagaatatttcttgcattccccaaagggaaattttagtaaaaggaacacaaatgaattggatcattattcccatttctcagaaaaggtctgtgcaagagaagggcacagacttcattctttgctttatgacacaagtttattaaggttgccattgcagtgatttttgtaaatgaaggaagcatcagaacatcactgaaatacatactataattgggaattacagacagtaataggatatcctgacttggtaatgagaagagaaaatgagacttccctaaactttttctcagtatgtatgatcttatctaaaacttgaaattttggtgtctgcacaaaaacccaactcaaatatctcagtggattaaaacagcaaaatatatctctcttgtactacattgtgcaagggagcttcgctcatcataatcactgaggaccacaggctggatgggagttcctgccccatactttcatattatcaaatgaagggcacaaaggggtggccaaacacatgctggcacttcaggcttgcccccatgttgcttttgctcacatttcattcatcaggtaaatcacatggccacacctaggtacaagagggcacagaactgacatttgtaaataactctaaaactactaaacatcccgatgctgaatttgtctcagtttaaggaaatgtcagcagcaaaaattagtgccatgtgctgggttttgacagtagtaagattataagcattttcttatttagtaggaaggaggaggtttataaaatcaaatggtataatgattcttctaattttttatttagaatttttattttatttatttatttaaaaatgttcatttttattaactaataaactgagatttaggtttaggtataattatgttcttcttaggtaattataaaccatcagtggaacatgcaatttgaaatatctgattactccctgacacagagtctggtaatagatgagaaaaaggctttgtgaatcacggttctgattagagtgtagaattatgtatctaggaaccagattgttaataaggtggcaaagcccatttatgctagaggaaaaagaatattaaatagataagccattaagttaatttgcttatattcttttaaatatggtatttatagattacatacatatttaattccatgattttctgtgttaaaagtaacattaattccttatagaaaaatttgaatatgcagaaatgaatgaatacaaaatattataaagtaaaaagcatatgaagttagttgctattaatatttggacacactttattttagttgcacacatatatgtgtaaatatacatatatcatttatattaagtggacactttcctatgtccgtattcttcatgaatattattattaataactaaataatgtttcatcatctggatgcatggcattctatggttcaatcaaattaaacaccctttatttgaaatttaggtgtttctagtccttcactataataaataacgatgcatagaaaactttatatgtagatcttagcaaattggtctgaatattttctcagagtacgtttttagaaatggacttaattatggaaggtgtttggtcattatttaacataattgatacatattgccaaatttctttctagaaagtttgcattattaccagcagtgtatgagagcacctgtacaaatttacatggtatatatattgaacctgttatattaatgcttacagataggctttataaatcttttaactgtttgctaaatttcgaaagatgggttgttgagcagatggattctcaaacttaagcaagcctcagaatcacctagaaagctcactgaaaacagattgttgggccccattcacagagactctgatttagtaagtttgggaaggggtttgagaatttgctttgcaagtaagtccccagataatgttgatgcccttgtcagaggcttgcttttgggagaactgttgaaattgactaacgggagtttgttttaaagtaatagtcattattcttcaacatagtaaaaataggcacttacttaactttagaagctaaatattttctaagcatatcaatttttgtgggttagcctttaattgtattctaaaagtgtttcttaaaataattccttctatgcaaaatactgtgcatactaagaaaacataaatctaaccatttcctatgtttttaaatcaagcagatcttttatctctgttcgttagtttatgacacaaataagaagtttagtcaagaaatataatgttaaaataatgatgctgtgaagtttctaagtgaatgtttatggttgtacatcttttttttcattttatggcttcagccttatcttatatgagtcaaagttaaaaaagtttcagggataaatttaaaatacaataaaactattttgttttatataaacatctagaatagaaactttaaagactaattagatacttgaggagtactaaattaaaaatatttaagtacatttgggaaacatcattttgcaaatatcatccttctccctacagtctaaagcccaagaaatgaagacaaacataaaggtcaagtaattgaatagatatatgagtaagaaagacttttcctgacccattcgtattttcatacttagattgtgaatgtcaattagctcaatcaagccttgctgataatgtcagctgtcagtcactcctaggtagtgatgtgtgaagtttgtcagcgggtaatgggccatttgagtgatgaatgaaataatgagggcacagaagcctaagcaaaacgtctccatttttggtaaattcctctccacatgggaaattaagacaaggaaagaaaagccatataaaatctcttttaatacggtgtttattttaaaaatatatatcttaaaatatcttttaactttttatttttaaaaattaatttaaatggtcagtgattaattatcatttcccaatagtattgatcagtgtaagcaacattaggtactgcaagagataagcttgctcccagattcacgttgatattttgacttgaattgaatatttaaatcgaacttcttcagaagtttatcagcagactttctgagtccatggactatctatactaataagaccttgctttatatctctgaataaagtgtagtttctttctttaggcttaacacatttcttgttagtgttctagtaggtatttttatctgattgctgttagagttagagttagtggaatatttttcttttcttttttttttttgagacagcgtctcattctgtccattcaggctggagtgcagtggcacaatcctggctcactgcaaccttcgcctcctgggctcaagcgatcctcctgcctcagccccccaagtagctgggagtacaggtgggagccaccatgcctggctaatttttgtattttttgtagagatgggtttcactacattgcccaggctggtctcgaactcctgagctcaagcgatccacctgctttggcctaccaaaatgttaggattacaggcataagccactgcacccagacaatatttttcttttatatcttctgttaattcattgcatactagcgaaacttactaattttataatttgtcagatgtaatcagccatcataatatggtccctttagtttctttttccttttggcttatctatctaaacatctatcagtgtaatcatatctgtaattaatgatcattttatctcctcttttccaatagttttattgcttctttatttgcttattatcttttgcatatttctactctagctttttccagtgatgcatttttttttttcatttatgctgtgtccttcacaggactgtgaatccttggagtggaagcaatgtattctacttatatttgtgacctagtaattaacatagtgcctgaaatagagtagatactcaaatgttgacagaatgcctgattgaataatttttcacttccacttaaaaattgtttggggcaattcctgtgaatgttagttcaatgaacagcaaataacaagatagggaagcagacctctgttgagtggcacagatctagggtctgggggaaacctgggtactcaagggactcatggggaaagaggcctaatagatagcttggcttcccgtgggatgcctaactgatgtattactcaagttaagaaagaggtacccattgggtctttgaaattgaaaatattttattatttttaattgttttcagggtacatgtgaaaactcatataatttgtaaagttcacatcagtataattgaggtacccatcaccttaaatgtttgtctttatgttataaatgtttgaattattctcttctagctattttgaaatgtacaatagattattgtaaactagagtcaccctactgatctacagaacactaggtcttatttcttctatgaaactatgtatttgtacccattattcaacctctccatccttccttctccactgatcttttcagccttcagtaaccaccaatcaattctctgtcttcttagatccacttttttagcttccacatatgagtgagaacatgcagtatttttatttctgtgcttggcgtatttcacttaatataatgaagagatggctgcattctcatgtttattgcagcactattcataatagctgaaatatggaatcaacctaagtgcccatgaaggggtgagtgaaaaaagaaaatgtggtatatatacaatggaatattattcggccataaaaaagaatgaaatcctgtcatttgcagcaacatggatggaactgaaagttattatgttaagtgaaacaggccaagcacaggttttccattttttaaaatgtaagactatatttaattccaactggcccataaagcaataacttcttttattattggtactgagacatatatagatagccagctattaactggttatgaaactgggattcagtaagattatgtcaaaatcaagtctgcttcaatcaatatcccaggagaatattaaacttataatttgattaatatagaattatttcataataaataagtggagtatgaaacaattcatgatgaatttgctatccagctgaaattaacatgccactagttgcagaaataataaaaatagcaatataaatagataatgtttattaagaatttaatgaacatgttaggtgactaacgtgatgaatgctttgcagagattatctcatcttcatgcagcgtttaagacaggtatgattggggttgcattttacagagagaaatatatatatatattttgaaagcttgttaaatagcttgcctaagttcacacttatatgtggtggagctgagttgctaaggaaagccattattttaaccctgacttttatttcacatagaaagctttaaaataaacatgagtgccagagccttactctcaaattattatttaatttatttggggtgtgactcagtgatactggtatttttttaaaaagctgcctagtgagttcaatgtgcactttgagttaagaccagtgaactattaaagcacactgctgagagcttagctttgccttccaattgtatcttgtcaatacaaaaaaaggttatgttttttttgcttggaagaataattttaagatttattttacctcttctatcctgcacacattgtccttatttatgtatctcacatttacctcactgatcctgcctacccatgtattggccattgtctcctgaaatatttcagcacataggctgggtgatataagaaatctaatgtttacctctgcaagtgaatctatgcttagattggattgtttttactagggttttgccgctctcgatgtaaatctttttttaaatagttgttcagttatcattatattttactattttattagctctactaagtaggcagcaggacctagttgattaggtcgtattaaatacctctttctatgattattggtttaacaatgcttataaaaattgctgtgtttatggtttcagatattttcatgaagttcaaacaactatataagactggatttggatccatcttgctatattttctaacatagtaatttacccttcccctatttccaacccaagcatcatcattaaaataaaataccagcaaaacaatagaaaaataggcaatcagcataaatatgcaattcagaaaaaatgaagtaaagcaaataaataacaaatataaaaatgtttaacttaattatatatgaattggcaataattttttccataggctttttattttacagatataaaatagtatatatgttcattatttatattgacctaggtgttacttcttttagaatgtaagctccataagggagagaattttgtctattttgtttagtgatatattaaaagaactgaaactggtgcctgtcataaaattgacactcaataataaatattattcaaaggaaataactattgaaagaatggatttttttaagtgcatgtgtgtatgcacgtgtgtgtatacgccattaacaaagatatggtaaattgcacacagtactacatgactggcagcagtataattggtacagcttttctaaaaagcagtctgtgaaaaggtatcatgtttttctcaaatatttattctatttgaattatttacacttctagtactatgctttaaggaaatacttagtgaagtgcagatttatagaccaaaaactctgttcataacattgataaccataagagagacaaaaatcactgaataagtaaaatgtggcattcatcattccttcaaaacagactaaatgatgtgaaaatgcagcaatgataaatgaaaaacgagagaagacaatagagcgtgcttccaattttgtaaaaattgagagagaaagatggaaaaaaattaagtaattaaaccacagtgttaatagtatttatatctgggtggtgagactaagcgagcttttaagtttttgcagaattatgaaatgcagaaaatttctatacgaatatgtactactttgttaattagaaatatattatttcacgccagaggcggtgctcacgtctgtaatcccaccactttgggaggccaaggcgggaggatcacctgaggtagggagtttgagaccagcctggccaatatggtgaaaaccgtctactaaaaatacaaaaaattacccgggcgtggtggcacgcgcctgtagtcccagctacgcaggaggctgaggcacgggaatcgcctgaatccggaaggcggaggttgcagtgagccaagatcccgccactgcaatccatcctgggcaacaaagcgagactccatctcaaaaacgaaaaaaaaaaaaaaaagatttttcatgcctaaaataatgtttgagataaataatttttgaataagtaaatgggtgcaaaaattcatgatatgagccttctctcagagcaattttaaagaattagctgtaaggggattcataacttctttttttgagtacagttaagcaattactctatccttcattatgtgttgagtgcttatttgtagcatgtcttttttccactgaggaaggactactttctcatggactgaaaatgctctttgatctgtagctatggtttgcttggtggagcgggcggtgaccaagaaatgacagatgtggattctaatatgtgtgatttgacaggattaatagaaatggtttactttcagtaagtgtttttaaattagtactgtgtccttagatttaaaaagaaaatcataatcaatcaattagcaaatgttaactttgttacccaatgaaagtgtttttagtcggccatttataggggacaaaaggggcataagaattgtagactttcgactgctgacactacggttgggcctggaaagcttatttaaaaaaagacaattaaccaataatatatgacaatgctatattgtgcttcattggaattcaaatagggagtattttcaagtaatttttaacatgtaacatgaggcttagaattgaaattggttatataaattgatatttgccttatttaaaattttatctttttaaatattttctcaaaactaaaattggaaatgaaggacttcatgtaaattctgggcaaatataatgtttatgttgtaatttaatattaaatcagagtatcaacctgtgcagtgattttgatatttaacacagagctcttgtttaatttttttctctaggattcagaatttcccatagatatgcaaccaaatccaaacctgaatgtttctaaagaaagtctttctccagcaaaatttgactacaagctgaaaaacatttttagactccatgaacttccagtgagctggtaggatttttgatgttttattaatacttttgagattttattttcatgtcaaaattttaatgctcttacagccattcatggttgaaatggtttgcttttagcctttcaaaattgctactcatagcatgaaagaatctgcttatagtagctgtaagaatcttaaaagtaattggtttaagcacttggtggcagtacagactaagtgcactattgtgtattttattgtagaggttggagtaaaaatgcacaaatcatttttagagaagtttctaggattactttaaagataggatctcagcaactatacatttcatttgtttattttactcaccaattttaccaatgtactttttccctgttaataagttctttttacttgtttgttatgaggactgtaattttgtgaactataattacataggtttaaagatgagacttagtattactcaacatttattgaaataaattgttttatgaatctgcgtatttatattcatacacatttattttaaatcttataaaatggagagtatttttattcaaaattcaaaaaatctgtagaaaatatgcatatataaaccttataattccatggtacatttacatttcattaagtggccagcttttgttgataatcatggatacatcattttaattatggtttagtttatataagtaacattattttcttgcatttggtcatagagtcccaaatttatgtaattgttcttcaagaaatctaagacttatacaaaaatatatggcatttgttttgtaattgctcctattatacttaaggaggactaatgactcagaagagacattaaccactctttaacacatatattttacctatagtgagtatttttttttcatttgcaaagcttcctctgctcttgatgaccatatggcatgtgcaatctacttcctaaaccccatttgtttgattatttcctcatagcaagaatattgtctatggtatatgtcgtgagaacatagcacatatgaatacttctgtcataaccaaaagcagtaggtgaatgaattgaaaaggtctgttagtaaagggaaccataaaaatgatacatttataccttagtgttctatttcaatgtaaaacaagtgcctgtacattcatatgctagtcttttgatgtaaggtcgtgactttttcttatatgtctatcgtttggaattctacacaatatttcttacctaagccatgccaataatgcatcttctacaatttcaatttgtcatttcttttatctaaaataagaacttcagacaacttcagatgatctccccacctttttgtaacattaattttcattgacagtaattctgtttatccttctcatatttcatcaccataactaatgtttatactacaataacaaacacaactggcttataaacaggtttaggaccaaactcttgggactctttacaatcatgaaccttggctgatgggagtggccaatgctggtctacttgtgtgattagagagctctgagcagttggggttcagtgagtgcagcttgtgtgttttgtggagataatggaacgtgttagtcaatacagcaattaagtggaggttaagggaaaagcttctattaaatgaaaatgtggagaagaaacagagggaaacatttagctctcagtcaaaggcaaaatatggatttcagcttaatttatttccagcctttggaaagacagctgtcctgattactactactgcaactcaaggaataatggttttgtaacaatcttcactagttagcctattaggagggaaggctgtcacattattagtttattagtagaaaaataaatcggtaaaggaaaaataatcactagtctcttagagtaacataccgcagtggaagattaagttgtgactttgggacaacttacttacatgggacactttttgcctgtctacttcatttccaattggtctcattttctgcttccttatactactatttctttttttgctgtgtgtgtttgtcagtctcccaaacacatggcaaaagtagtagtttattctgcgacttctttctctgtactctcattctatactaccagtccttaactagacataatataaaactcaatttaaaattgttagtgtttctcaaatagtttcataatctgtgttcttaattttaaaaccagtggccgggtgtggtggctcacgcctgtaatcccagcactttgggaggctgaggtgggcagatcactaggtcagattgagaccatcctggctaacacagtgaaaccctctctctactaaaaatacaaaaaattagctgggtgtggtggtgggcgcctgtagtcccagctactcgggaggctgaggcaggagaatggcatgaacccgggaggtggagcttgcagtgagccaagatcgtgccactgccctccagcctaggcgacagagcgagactctgtctcaaaaaacaaaaaaaaacaaccaaaagaaaacagataccaccccctctacagacatacacatacagaatcttagtaagtctacaatacagtgtttattgacccaattatatacttttttaaggaaaaaagaaagttgttttttttttttttgtgcttggggactatgtatttttaaaatttatttttgtttttcatttgccatcagtggaaggaaagttcttcagctatggtgtgtaggtttcttaacttcaaaaatatagcagtaaaagtaatgacaatgataatggaaataatatcaataacaatgctttgctaagcctctataagtgccaggattcagctgctgtatacacacactatgtctgacctttgtatttctataaggcagttattatttttctctctctctctcgtttctccttctctgtcacatacatatacgagactcagacaccttgcgaatcacaaagaaagaatttgtgtcagatctggttaacccaaaggcaaactacaaaatagtgaataagccatgcattattttaaataaacaaaatgaaaaaaatctctgcttttatagttgggcatacaattttgccagtaatacacaactatatgacctatgatttgggcaaaatgcatgacaagcacgacctaggataattgctataaacttaaatattaaaataagtagttagattgtgtttaagtgcagaataattatgtttttttcccctctggagaaacagatttatcaaaatgtgtttttataatgtttttctaacaaggtcataataaaataaatgcatattaaaatccaggtaatttaaaaatcattgatgtattactagtttgcattttcatagagtatggtttcataggccaaagaaccagacagattttaaattaaattagtttagagagtttttgagctctgatttaggtagatgtctttcttctactcttacacgatgcttcccatcagcctagaacatgtctttcagtgactgccactagttgtttgtttgtttgtttgttttgttttttgagatggagtctcgctctcttgcccagactggagcgcagtggtgtgatctcggctcactgcagactccgattcccaggttcaagggattctcctgcctcagcctcctgagtagctgggaccacaggtgcctgccaccacacttggctaatttttgtatttttagaagagacagggtttcaccattgtggccaagttgtttaaaaatttttttttcttatccggagaactccccatcaaacctatgctgtttcctcatatcctgctcattgtctctaaggaggctgacaaaagtgcggactgaattaatagcctccacttgtccttgccattctcctctgccatcgggttctcttcctttcctctcctgaaactgctcttgccggtcattagccactccccgtgtccaccaccagtcatcactcactcattctcattttcttcacctctgaccactcctgcttttcctctcctgactcctattatttgcatgattctagttttcctgctgactcccaggctcatatccttctcagcatcttcagtgagctgctcctctctggccagatttctggttgataggttggccctagactcaactttatagcttcatcttttcactctcatttgcaggtggcctcttccattctctggctttaaatactttccatatggtggtgtctccaccatgatgtctctcctgagcttgaatatctaataggtttctccaaattttcatctgtccaaaaaataactttggttttcccccaaaagacctaatcttctccttatctccctcatttttgcaaacgtaccaaatctgtgtgaacttactcaagctaaaagcctaggagtcattttaattcctcattccctcaccctgcaattcccaccattaaatctaccagaaagtctgataggtctttcctccagaatatattaattttttccccacttctttctacctgtattactgtggtcatttctcatactcttgcaaaagcctcctaatttaccctgtcttaccccacaataattcactggtgtcacaatagccaaacatattttgaaaatgtaaatcagatcatcagatttcctgctttaaatacaatgatgtcttccccttgttgaaaaaataaaacccaaacttactactgtgtggcctttgcaagatgagactcttgcctacctccttggctgcatgctctcccactctcccttgccctatctcctcaatgacaccagtcttctcactattctgcaaacatgccacacttattcctactccaaggtctttccactaccttctccacagactcccagtattacttctccagtttttacatgtctagctcattctaacctctcttagctcaaatgttacctcctcagagaggcagtgcctgaaaaatgtagctaatatttttattcctcactcccttagtcactttcagtcctttcattctactttatttcattcatggttctcagtaggcatgcagtgttttcctagtttatgtgtggcagagatgggtagatgctcaccaatccagtttcctcttctctgagcccattgggagattatatcttcagtttggaattgaacttgggaatttggccatgtgcctaaaaatgaccaaaggcagtgcatatcacttccagacctaacccctaagacttccagtgggattcactgttgactttgaaagttctaagccatgtgatagaagaagcacggttccctgaaacatttgttggttgtagagttctccaaactttatcaagctttaatcttccagactaatgagctatctctttgtgaaattagatgttaggccacatatgataaatgaattttaaaaataaaaatattgaagagattttcacattcactcattcacacaaaaaaatgttattgaacacgtgtcaggcactactctgggcagttaactaactagacagaaatctgttctgagggagattacattgattgaaggaagaggtaataagccaatagtgaacacatgctgtatttgatggccataaatgctgtagaaaaacataaagtgagacagagggaaactgagtgtaggatgaattcagttttaaagagagtgaccgggacttttcttgagaaagtgatatgtaagggaaacctgaagcaggtgatgaagtgagacatgtggagcactaggaagaaaattagagtcagagagaacagcaaatgcaaagcccttgaggtgggagcatatccaaaatattgtgggaacagcaaggggtccggcatggacagaataagtgaccctggagaataggagggggaatataaagttatgtacttggggatcaaagagcctgtgacttagggccttataaatcatggtaaagaggactttgaattttaatctgagaatgtcaggaaggtattagaggattttgaacagaagaattacacagttttacatacataaaaacaaggtgtctgtaactgctgtgaggaaattatactgttataggggtcaagaatagaagctggtagactagttagcaactatttcagtaatccaagaaaagtataaggtttcctggagtaagttgacagtgatatagaggctaatgaatagtcagattttcattatttttttgataggagagtcgacaggattttctgttgggctggttgtggagtgaaagaaagaatttaagaatgattccaaggtttttggcctgagaacaggaagaatagagtgaccattaatttatatggggaagactgagggaggaacaggtttgaacaggtttgacatgttaaatgattgatggtaattaaacttctaagtgaacttagatatacataggacaccttggactgtgctgtgaacaaagttcataactgtgtatgctgcctagcgaacaggttcatgtcagtactattccttgtattttaattgaaacagacaccagaaataaagttactaagtagcttttactgtgaaaatatgggcattatagaaatgtaacttttggaaaacatataatttaattattatatatggatatgtataatataagctttaagtataaagcttaagtacttaattatacatatccatatatacatatccatatatataatgcttaagtacttaattatatatatccatatataaactatattaattaaattatatgttttcaagagagtatgttatattttaaaatgtgagttttgaaattaaatattttgaaaataattatagatatgtatttttccaatggatatttagaataagcttaaattatgttgtaatttttatgtttacatcccatcaaaacaaacaaacaatatattagagccaagtctatatttaaattttgcatttctaagagaaagaacttatactccatttagcttcaagaaaattccccttaggaaggtgataattacatacaattgaaacacttgtgatcattacttataagtattttacagaataatttaaaatattttctataatataaagatacagtctgctagttttacagtttattatcaaagtactaaggtattcagctatcttctattaaataataatatttatgccattaaattttaagaagaaaggtgtacaatatgcagcaaatataaacattcattttaatgagctatttatctttttggggtgtgttctatgaataaatacattatctaattagtagattcaattttcgatttatttcagattgtctttagagccattgcatgtgtttgtcttcaactttaaagtaagtttgtttagacattgggttttaaaacctgagcaactatcatcttccagaaggtgttctaccttgtttttttttttttttatggtcaactcacagccaaaattatggaaaggctttatcgttggtcacagatgatgcacagagcattttcaattccagtgtttcatagactcggtgatagaccgacagttgccctcctgggactgtaaacatttttcattctcttttaattatctagatctatattaataaccacagtgacctataagaaggcattgttggccatactataattatatatagcaattatgtgtagtgccaacaatacataaaaatcccaccctttaactacggttggtaagaaatgaaactatgcttttctgccttaggatatagtttcagtttttgaaaaattaagacattccatttttacataaaactttttctggagtatattattatggtaaggcaggtctatttccatggactgacaatacattaagaatattccaataaatatagaaagcatctctcactccagcttcctccttagctacatactggtatttcctattacatactgtataacagaaagggaaatgcaagttcaaagcaaaggttaatctttgtaatgcagaatgtcagagaagatggtttagaacaagtaccaatatatctcttgttctctttgaaaatttatttagtatttcaaactatattatattcacacatgtattcattattctgtttaaataattaaaggtggcaagacatggtgaagtatgagcaatcagtagttttgatttaggtgaagcacccatcaagtaatggcagtagtaattgccatttgccaatgtcttggcaagttgaggtgaaaccaatgtctttagtccgtgttaaagtcaatgcatgtggaatggtatcccataattgacttacttattttttttatgatgaatgggttgtaaacatcagtgcctgtgtcatagatctaaatcttaaaccaattttggcaatttcttatagggccatgactagagaatgatattgtcatattggtttatatcattaaatttttcatattaaaagtgcttttatagtctaatagaaagtaataaaacttttattagatttatacaccaaacatataaaacaatattgatgctctgatttcaatttttaaactcctgacattatcccaagctgcaatgactgttaattcagagtacctcatgaaataggacatttcaacttgcatgtcttgtgagcacctcaaatttagcaggtctcaataccagctctcctttttcatcattttcctcatcttcatgctcaccaactttctcccattttatttaatgttattatcatccatatggtcatctaagatgacctgtgagtctttttaacatcctctttaccacttatttgtcacatgcaatccatcacttaagcctgtgtattttatgtccaaaatgagttgttcagtcattcacgtctgtcaaagaccatcatctgtcacttaggcttccccagcagtttcccatggtctgcctccagtcactcctccaacttgaatttatccttcctactgccatcatagtagtctttctaaaatagagatccaatatcttatttgtgctttaaaatctttatttttcaagcccttaagacacatttggctcttccctatgtagctctaaccaatttttttttctagttctattgtgtcctttgcttctgcaccccttatgctctatattcaatgaaatcccttcatgtgttcatgcattggctcatgttcctttgaccattatgtctgttacctcctttttccacttgcaaatattcaagcaacctaaagtatgtttctatactatactagagctcctttctgttctcttgatactaggtacataacatagaaaatgcataatacaggggtgcatagaacagatcctatggattctaatgatttatttttgtgtctgtgtctcccaacaccacagtaaggactcttgagagcacagatcatatcttgtcactatgaatagtccctgacagataggaagtgacttaatatgtgttgaaagaatgaatgcatgacttaagttattatgagtgcctatagttctatagccaggtttttcaacatactgtgtattatctacttataacctggctatcaccagctgtcaccctctcttttaaaatttatttagcttgaatgtcaagaaatttatatgaatgcctgtggtataattttcctactcattatcataaccataactggcattctctgtgcatatagggtagctataaacactactctcgtaataattagagttacttctgtcatatgctcatgaccaaattctcttgcccttttcagaaagcacaaaagaggatccctttttttcagcctgccttattctctcagaattctaggtttcttactcttgcttgtctgttttctcaacagtcatcccccaattctcatacggactttcttgtccctgtttccagacactggtttctttagtattcctaagactttcactggattcttgaatcttctgctttttcctcatctatttggccttctcgattctaaattttgacagccagttaacctttaaacttgagcttgctaaactgacacctgggttttcactccataatctcccagttctattctttaactgtccaatcagattcttttggcacctgtatttcatatcattctccatttggggaatgaggatacacctgacaaacccacagaatgctttcatggggaaactcagtaacaaatataaatttagagtatattgtgtattctggattgaatccatgggcttaggacttttcaattgatgaagagtatatgaaaggaaaactaggcatttcaggtacatttgatatatgaatgtcacagatatggagtaaaatgtagtcaaaatctcctccctttttcaataagaccaccaataggaggaagataattgatttggtcaaggccaagaatataattgggtcatatcgctaaaacttgcaactttatgtgagaggagaaaagtggtcttgaatcgagaaaaacccagttatttccccttggttttcttcacgcattcaatggttgtatactcaattcctaccttgtgttctaaacattaggaattaaatggtaagtgagagagagagacagagatttatttctgtgcttctttttatcattacactagtacaacctagagatccaattattgactatgggcctagaagaaaaggacagagaacgaccaatgttattttaggccttagagtggggtggtaggtaataggttgaaggagtccagctgtcatatttgagagcggagataaactagtttgcatttacccagagttctttttgcatattttcttcagaaggaattaaaaggtgcccgagcaaggacttgggcctcctagtgtccaaacagctctagcccctaatcacggcaaagcaatatcaggaaagggataagaaagttgaaactgtgtaggtcatgagtaatgagataatatgttttatggtatacaaacacatgggtaattcttggtgagggtagagaccgttcccagaggggaaaaagtacctgtatatttctaatctcctatccaagtactcaccaggtctaaccctggttagcttccaagttttgacaagttagggcatgttgagtgtggaatggccatggactgcacattcctgatctcaatagggaattctagactaaatcttttaaggtaacttgtttctgcaataattcttgcagatgccattgacaagttttataactttcattttgttatgttaaattgggctaataacaacttctcaagaagcctaacaaattgttgatattaggtatcattttccttgctttagtaataatattgaacatttattaagctgataatattaactgcctgagaaattgtgatctaggaatagaaagaatttacctgcatttgttttacatttatgcttaaggaaactgaaataacagcacttggtgaaaaaaatatacgtctatgtccaaattttctagcttttcttcctaatattttcttatgcaaaacactatcagggaactgacatgataatgccagaaattctcttcagaggaagctgaattagtatgtcttaagacctgctctgtgtatttaaacagaatgattgggaaataactaccgtaatttcttagtgataattttgagactttttctccttttgtgcaaaatgttgtagtacatttaagtctagttgtttattacatgacaatagagtatacttttcctttttgtgcttggcagagaatgtacatttatttgtgatgtttatgtagatattaaaaatagatattggacttactatatactaaagcttagttgttctagaaaagtaattttatcgattttaatctttactgctagtcatattgctatttacttatttttctttttaaaaaacaagccaacaaaaaattcctgaaaattgttaattaacagatttagatactgaattagcccaatcaaatgatgtcttaggctattaaccaaagtggtttaagaattacatacatttatttttatttagctatttccaaagtgattttttaatttaaatagtggcttttattctggaataggacatagtaagtaaaacctttaaaaaaaattcaaacgttgtatctttgttgttgttgctgttcttttttgagacagaatctcatcctgtcactcaggctggagagcagtggcatgaagagggctcagtgcagcctggacccccagggatcaagcagtcctcctgtctcagcctcccccgtagctgagaccactggcatgcaccagctatttaaaaaattttttttttctgtagagatggggtcttgccatgtttcccaggctgatcttaaattcctgggctcaagcgattcttctgcctcagcctcccaaattgctaggattacaggcatgagccactgcacctgtctcaaaatttcctttttatacaaggaaccacatttataaataaaaatattttattttttatttgttcaccctactataaagtcatttagatgaaagtagaaactttgaaataataggctaaataaaaatgtgatttatgaattagtttatgaatttctattaagagatcagcaaacagttatgcttaaatcttggatgatgttaccacaatgatgatcacaatgaacattttttgaaaagttgaaccaatcacgttaaaggcttttcacataatttctcatttaatcctatgaacagttctttaatatggtactattattcatccattttacagaggagtatatagcagttgcccactttcccatctgaatatctgaatctcctactggctatcaacttctttgggaaagaactggctcttctttacatattctagcatagtagagcttatgacaacatagttggcacttaaaacacagtgacttgatgaatgaatgagttcctagaaaacagtgagtctgaattttctagtcaagtcatatgtacaacagaagggtcaaatataggtgagttttaaagactcttcttaataagtatgagttagccagtttctcaaccttagacatttacccttgattcccatctatatatcatgaaaatttaatagtaccgattactatgtatctgtttatgtatcttggacttttggaagtccacaaaacattctaatatctaatattgtttcacctcccccatgaatcaattttttgcctctgttggggcagctttgctctgattgagaatatatgagttaagcaatgggtgaagacattgaaatgttgatttcctcagaaaggagggatgtagggttttgctctttgcctaccttctttatgtgcctcaccatcttgttttcacagtgcttccttttagatatctttatgacattgccataaaaggtcatgttggcatattaccttaaaatactgaaaaggtaccattttagaagaacatttgatgatgaagtgaagcaacagccccattgctcctcaccacccctcatgcccttcaggtctgatttaacctgtaatgtgacttcaatattttaaggtgagatcaaccttttctttttggagaggtattcataaaaaggctaatgacccacttgtgctcataaggaatgacacagggaaacctgggggacaaagctaccaacttttcttctttggaggaaattttcccttagcttagcactatccttaaaaataaatcattaaacaagaacaattttgtgacaaggaataaagggaaattggtaaatgaaagtgaaatggtaaaatacagaggtttaagagtttaaaattaaataaattaaaatgtggaaatgtaaccggacccaggttcagctcctcaccacttgaaagccaaacacagaaggtgagggttagtgggaggaaaagcaggttttaattggaaagccagcaaactgagaacatagtgaactagtactctaaaataccatcttaaattttacagtttaccataggattttttaaggggaactttgtatggcagacatgtgggagtggtgcagggtgcagggtctgcgtgtcttgttctcgtggctatcttgtgagttattgctggtctggaagtctgattggcattatcttcactctccccaatagtggtggaatgattgtttgtgactcttgctaagcggaaggactatgcaggggctccatgcctggtttgtagcaagattagattttggaatttcttaagcaagaacataattagattagcatgcattgccagagggcagtgtgtagagagggaaggaatgaagaagtgaaagtggagggaaggaagaaaaagaaagagggtgatatttaaaacctgggtccctggttatggtaataaaacaaaacatctttaaattttaatcagggacacactttaagaaataaagattaaaggtattaaaataaaagaaattgagaggttaaaaacctgaaagtagaaggcagcaaataaaaaagttgaacttgagggcaaaaaaattatttttagtttaaaaataaagacaactagggatttctttatatgcctagtaaacaaaaatatattagaagataaagaaggcttgttggaaatagggagactaaagataaaagaagtaaggatccacttgaagtttgaaaagggggcaatttaaaacaactagcaagaattaaagcaattggaaaccataaaataatggcaagctgctaggctataaaactgtatgttctatgaagatgtaagaaagaaaatatggtggaaaatggggaaaaaaggggaagtttataaaagctccaagctataatcaagtgaggttgaattctggctaaatgtccctgtggagatgtgcaaaatgcatacatttataggagcccatttactttcacctgatcttaggccctgcctgtcagtgtgccacagacttgcccagattggcaaaaaattcatgcccttcggaattttccaaggcaatgtgctctgtgtctcacagtctttccccctcagacttgctccacagcatagataaacacttattttggttcgaggaagagcatttaagtactggcattcattcaaaatatcatttgtatcagtgacattttggtatttattatcatttataacagcaactgttttgtataaatataagtagacctttctacttgacaactgtgacctttaatttcacctggactgcacatattatatataatggagatttaaagagtattatagaaatggatagggggtatcaatttcaaatgtacaatgtcaaaactactagctgcagttgaaatgaaatttatatgtggacacaatttttttttaccttttttggttttgtttttcttttttaaattatttggagataatgagtaaaattctactatattctggtagcatcactctgcaagatttactctaccatacaaatgtatgttttttggtattctattttgaaaggttgtgttgttataatattggtattgaaaatattgatgagttaatattttaaaacataagttagtatttatttggttaggatgaagcagttgatgataatgacaacttttaactgcaggtaaaattgctaaataatacataattacgtacaacttgtggcagctttgtatttagagataatgatgtttaattgggtgtttttcttttaaaatgaaaatgagtttattctttttttaatagagtaatgcatgctcccctttacttcacttttcaaataccaaaacagataaaccctattaacaatttggataaccattatccttttagaaatccctacaagccccatccctccacacccagtcaggatcatataaagactattctgaaacttgctttatgcagttaagaccttgtgactatccttctgtgttagccattccatccttgtttatatatctgattaatattaataaatcatatataataatatatcatcatttttataaataacagctctgattatattttaatatagctctttatgtacttgtctgcttcatttggatttctttgtaatttatgagatttttgtacttttcctatttgtattagatatttatggatacaatatatttctggggttaagttaccttctagaattaaactacgtctatctaagttaccttctagaattaaactaagtctattaaactaaatctatttaagtgcttaatttaaggaaataaggacaatagatgagaagatagttcttgatgcaataatatttttatttctatgtattatatagaaacatgttaattattttagctattgacttgtagtgaatttattttcttctactagagtatatgtgagggtaaacaggaatattccattaatcattgtaaaaatgtatatacattataaatttcataatgccaggatataatgtgataggtataaatgctttcacttaataaattttatcccaagtgtgtcaagttatattttttttacattaaagtaaaaagaatttctgtctgcctaatttccttctacacctttttcatttatggaccactttaactcatggtgattagaaatccttcctcatcttatctcgaaccctcatctcagctcctcgtggactgaggtttattaaatgatttcctgacggccattttgaagactatttatcacctgaaccatgctgccatcccatctgctaccaatataaattgggatgccttatgttgcgagtgactgaaaatgcaacaaaatttgatttaaagatgaaatgaaattattggattaattaattaaaaagatcagaagtaggaatagctgcaggttaagcttgatttgctgccttaaagatattaccaaatacctgatcttaactgttttctgtcttttgtatcagcattatcctcagttcttctttcatggtagcaaaatggctgaagcaattttagacatcatatgctttcacaatgctctctaggaaaagagactctctttccattatctttcaaagaaacaaaatgtaagttctctttcctgcaagcttaggcaaatgcctccctgtgttgcattgactaatcaaattaagtgctaccccagagttgaaaactgttaccagggagaatgaccactgtatcaagaaagctatcaaaacttaccctaaaggtggggataagtttgaactgataatgaaaggagagggttgggggaagattcctttaaaaaatgcctgggtattattaccagaaagaaagggaatgatgctaaataattatacattgtactgctcaagtttccatcactggtgtctctgagttttggcaccgttgttttaaagaccctgttcttgtactatttagtattgcatagtacaaataaaattaccactgatatcaggcattcagccttttatttggcaatattcatcaaatatactcagaacgttgttctatgtcctggacagaccaaacaaaagaaaacacatctcatgatagtttaagtattagattaaatgacctacataatagtaggtgatacgatttctggagcatggtatgtcctcagtagatgatagtctttcattttgcctatttagaataggcagccctccttttcagcaatgtagtgacctgagacagggccttatcaactatgaatatatctttaagacattctttacctactcacctggacctctaagtgttacttatacctattgaaactcacctttgatttctggtgctgtttgacttgagatggggctaatttgttgacaggatgattcgatctccccactgaatctctgctgccatctcttttctgtcttcttaggtgctcacctgtgtgattctagaaggcgggtctgcttcagctctgatcactctctattatcccttcattttcctctaagtaaacaatcattaatcaatagtgtatggtaagagacagcagttttatgtagagaagtagattactcatttgactggggcaagagcttcaggtaaaataaatgattgatactttaagctcactaaattgaaacaatagccatcacattgtatgctttgctgtggtgattcctcagggatctagaactagaaataccatttgacccagccatcccatcactgggtatatacccaaaggattataaatcatgctgctataaatacacatgcacacgtatgtttattgcagcactattcacaatagcaaagacttggatccaagccaaatgtccaacaatgatagactggattaagaaaatgtggcacatatacaccatggaataccatgcagccataaaaaatgatgagttcggctgggcgcggtggctcacgcctgtaatcccagcactttgggaggccgaggcgggtggatcatgaggtcaggagatcgagaccatcctgactaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtctgcagtccggcctgggcgacagagtgagactccgtctcaaaagaaaaaaaaaaatgatgagttcatgtcctttgtagggacatggatgaagctggaaaccatcattcacagcaaactgtcgcaaggacaaaaaaccgaacaccacgtgttctcactcataggtgggaattgaacaatgagaacacatggacacaggaaggggaacatcacataccggggcctgttgtggggttgggggagtggggagggatagcatttggagatatacctaatgttaaatgacgagttactgggtgcagcgcaccaacatggcacatgtatacatatgtaactaacctgcacattgtgcacatgtaccctaaaacttaaagtataattaaaaaaaaaaaagtcccacagcctttaactccttttactgactgtgttgttattttctatacaatattttcttttcttttcttttcttttttttttgagatggagtctcactctttcacccaggctggagtgcagtgatgcaatctcggctcactgcagtctccgccttccaagttcaagtgattcttctgcctcagcctcccgagtagctgggattaaaggcacctgccaccacacccagctaattttttatatttttagaagagacggggtttcaccatcttggtcaggctggtcttgaattcctgatctcgtgatccacccgcctcggcctccaaaagtgctgggatttctatacaatattttctatattttctatttccagatagagtagaccaaagtaattgatgacctcataagcatgtttcataaatgtctctgagagattcactatgtcttattaaacctttgcctgaaatcttcttgcattattagagagaattaaggtcaaaaacaaggaaggaaaagaaataagcagttttatttatctacccatccattcacccttctacactttcatccatctgtccatctaacctctatttactcatctattgatagactagaaagataaataccaaaatgtacgggatataatctcctggtatgccgttggaataaagatgttctttgaaaccaacgagaacaaagacacaacataccagaatctctgggacacattcaaagcagtgtgtagagggaaatttatagcactaaatgcccacaagagaaagcatgaaagatctaaaattgacaccctaacatcacaattaaaagaactagaaaagcaagagcgaacacattcaaaaactagcagaaggcaagaaataactaaaatcagagcagaactgaaggaaattgagacacaaaaaacccttcaaaaattaatgaatccagcagctggttttttgaaaggatcaacaaaattgatagactgctagcaagactaataaagaagaaaagagagaagaatcaaatagacgcaatacaaaatgataaaggggatatcaccaccgatcctacagaaatacaaactaccatcagagaataccataaacacctctacacaaataaactagaaaatctagaagaaatggataaattccttgagatttatcctggataaatgatttttactaggccctggaaaatttagacatccctcatatagcactttttgaaatctgaaatcctagttattttcatatcacttcaaacccttcctggagatattgggtccatccataataggacaaagtttctagtgtagtttatgggttttagtcctcaaccatagcaaaaggacatagctgcagtttggtatgattttaatataagtacttggatagattgggatacatttaataaatttagtgagataactaatcacattctttaactatttaacattttttttattattttatttttttacagatgatagtcatgtacattagtataacatgctgtcaccattggtgaggcattcaatgaactttcaattgtgaatctttaatgtccttgcaagatataaattcatattaaatttcaacgtaatatggaatatatttgactcggatatatgtaactggaaacaactttaacttggatatttgttaaagctcagggaccagcaatgtgggttttcgcgttacactgcctacactatcacttgttgactgtgcaacctttgtattgataactggacttagtacaggcataattttttaatctgacaagtgtacttgaccatgaaacatcaactttactgaactgtgagtggattaagtgagaaacatgtgtcatatagtaaatacttaatggaatatacctatgtttacctagttataattaatatgttacttgtatttctaaatatatttccaatcctggaaccaatttatagttcatcttattgaaaccaaagtttaaaacacttgctttttcattttgtgatgtttaaactgccatataagtaattctggtttataaaagcatctcagttatgataataatagcattttaattttgaaagccctttggaaaagttattttgaatattaaaatattaaaaatgctaaatggcatttgggtatatgaatatgtaagtaaaatattaatataaagttcttgacttatttttaataattatctctttcatacaacgctatcctgttggtattcagattttacacattgactgacattcagactgacttggcagaatatttttatatgacgttattagctttttatgacaactaagcaaagagagcaccagtaagtaactagattctttgagctaggatgattctcaaatcccatcacttttaaaatatcagtgaaaaaactaacatgatttgaaggctagtttaaaataaaataccatcgtttcgagatttggaaaaaatgtatagttaaataaatcacttagtgtcttcttgaactataattctgcatttttgttaggggtaattttaaataaattggttctaaaggcaaaattcaatttaagaaaataaatgttagatttttctatagcataattattatttcctttttttaaaaaaatcttatttcaccctcaagcacatcaaaaagaatagttgccacctagaaagggcctttgtgctttgtatgtgtatcatgctttgtttttctctggtatttcttatcttcatataacaatagcttttagcattgtattttaaattaaaaatgttctactatcaaacttattctagtgagatttcttgcctttcaaaattacagtattttatttcctttaagtgtctcatattcattctgttttcacccttgatagatgtaaagtcatattatagagctatataaaacagggtggccaatctactaaaaataaaatacaaaagcatattttttttcaaaatctcattttttagtaaaacatttgcactcacaatactttagttttgagctttgttttctttatgaagtccagaaaaacattatagatgtctaatttttctcctctggagaaaaataaaataaaatatattacaccccttttatagagaagcacagattatattttagcttaattagctaaaatcacaacagtcatggttatcaatgaataacagtcatacttacagtatgttattgcaatggtgaaacaaattttcagtggcactgaaaaggcaataagaggtagaattcagttaaaattcaatgatgagggaaagaagcatataaaggggaaagaagataaacaaactagacttttgaacaaggtggagtatacatttactgatttttctgtagtatgataaagttagagagacagacaaaatggacttgaaacaaggtatacatcagttgtcatatcgtattgcaagaaaaaattattttttgcactcaagctacagagccctaaacctatcaggccatgtaagggaagtgcttcctgtattaattactaaagaccatgtgagggaactgcttcctatataattactggaaaaaatgatgaaagattgagaactattgattcacatcacatagcataaactttgtgtgaactggcactttaatttatagccctaaaaattcggctaggagactggagctgtcactggacctttgtacaagagaagggtgtggctgctaaaccaagagattaagagcccagcactgtgcaggtcagattgactccatctggcccctagcagtttcaccaaacactgccaggattttccaaaataagtatcccccatcacatatcattactttctgctgaacagattataaagtactatctccaggcatttcctgcgtttattgggaactggaagttttgaatcctcattgacttgaaagagactgccaacaatcaaacctagtcattatggcactcccaccaagactggaaatagccccaaactgctgctggtaattcctgatatcctcagctttcttatcttccatacatattaattttgtcagcagggtagttctttagggccctcagagtgcttctggaacctgtggagattcattaatggagtctggttgtaatgcattcagctaactccttttaaagctatacctgatgtcatgctgtctgttctatgatcctcttttccactgtcacgtgtgtatgtatgttttgttttgtctgtttcttgttttatcacctaattgcttgtctttttatccttgacttgctgttttgtaaagaacttagcatttatatcttctatgcttctctatgccctatattttcaaaggctcattccaaacctaacgtggtcatacactgtggctgaaccatattctaccttcaatgaatgcaccactttgaggatggggacctacaatttttgaagtctcttctgtatctgtgcttccaatattccatttctatgcatgttctcaggcaatttggggttcacacagttataaaataagtttatttctcattcaaacctgggcaatggagatgttcctatttcgatagcttttctgagcatcttttttttttgcaagtggtgacccatggaatctcagggatttaggatctttctaattttgtaatactggtgtcttcgacacatgaccttcaagattttgagaagggtgaaaacagaatgggatgggagttttatggccagccctgggagtgttatacattttcagagctagatgcaaggaagactggacaatgtgtgctaaagttaaagcacatagcggaatctctgtcacatcgtctttctgctttatacttaagctggtccccttcatatttatgaggtggctgcttgctgtataattttatacttaagctggtccccttcatatttatgagttggctgcttcctgtgtaattactaacaggccatttgcagcagcaaatgttatatccagtgggagagaggaagaaaacttctctctcaatcatagattgcaaatcttttcttatagctttggtcagaaagtatggaggaggattgagcaaccagacaaaattaggattttgtaaggagaggaaggagcggtaaatagataccagacagttaatctatcgtgagtatgacaaagaatcaagacagaatggtatcacagaacaaagagagtagagagttttgaaaagatggagtgcccaaacaggattataatgatgctaattttagaaattagatggtccttggaagctccgtataaatagtcccaaagaagtcatgagattatttctcacattatggtttatggagaagtgcatgaaagctgaggaaatgggcccttggtatttattcataatgctgtgctccatgcagttgactttacttcctaaataaatgttgcattcttgatgaaagtttaggctaaatacagtgagccctcaactttgaagataatataagaatattatcataattagagtttacatcatttaaaaatataatttgcttcattaaaaattactattagaaatttataattttgtcggcatatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtatatttttaacttttaaaattctcagaaatctaaagtaaattataattttaacactgaaattatttgctagtgaagatacaaatctatgctaattgctctaataacctagataattaattattatgcattcctaaaatggaatcctattaagttattttactatgatggatgtaatcattttgataataagtaacctacacatttttctagattaatcacagatgctcttctaaagttgtcttaatgtgatgaattataattgttcacttataagcatcaagggtttttaaactctcttgataaccatattcaaattttatcacctagaggtagatttatatttttattcaaaataacatgtcaggtgttatgcgtcttattttctgcaaaatagctaacttgtatgtaattctgaaataaactaaataaatattcaaactattagataagtagtacgtatgtatatatatatataaacccattctatctgaatcaatttaaaggttacttaaattaggtctttcttggactcagtagcccctactgatatcttcaaactgcactttatcctccaaagtcactcaattctttcaaaacaagaaagcccattatttaacagcctcacattgttagatgcgaggaagtcacattgatgacttccttttacctaaggataaaaaccaaagtcctctatacttcatcctctacctccctagctagtctattgccctgttgctctcaactggagtatttcctaagccatatttgtacacctgctgtgtccctgatgcgagcataaagtatgtgagtaaaaaatgtttttgaaatattatctgctttttaaaatgatgtaattcctttttttccatttcctttatcccatttgaaacagtttggttctatacttatgcctgggggaaaaatatgacagaaaaaggagatgggggagtttaaaaatatctttcttaccttggcgctttaaagtgcttaggagcagaaaaggctcactgcatagctacagcacatcagaacaaatataatgagttaagactcatccaccccttttccctttaccttcagataattttatgggagccaggaatgcaagagatctgttcttcatttcctgacaagaccccagaaaagaaattgttgcattgtgtgtctagacagataccatcacagagtttcagccctccggtgtgaagtaggaattgctcaatgattcctgtactcccaagaatgaaaatgaagtggcagaaagagagctattgaaacaaaataggccatagggagaggagggaaccagaagtttccactgagacttgtgtgatatattgataaattatttaagtgatgcctataaagccggatgatatttaggcttttatggtgttacccccagtgttggcataaaatgggaaaccctaagaaattatgctcaaaggaaaaattcagctaatgcagagaaagattaagaacctacatttcttgcattcttgaaattacactctagaattcacatcagctgtggaaatttatacttacttctttgtgtgtatttaagtaatggcataataaaaataatcaattcaccactgaggtccaatcatttcttcccttcaataagtgcccatacgttactaacatctgataacaaaatgaagcccaagttcttttgtaacattttatctttttcttaaaaaaatgaacttatcttagtgcttctttatttttaaagagaataatctacatttcttacttcctctggaaggtctgactccagagaaaggttaaaggttgcgctatatacccctaagtcttttcttatttttattttctccttcattccagaatatctatttagctattgatatgtgccaggcactattttaggtggtagaattccagaagtaaagacagtctctgtcctcaaagaactcaaaatctaactgtatggcatacttagaaaaataatgcaataaccacataagggggcctcctaaagcaaactgtgatgtggaaatgaatgtcaaaaaatctccctatcataggtagcctttgagtatagcattgagaaatgtgtatatttgatgagaaatacttttttggaaaaataattatgttgtttttcattaaatggaaaaaatagaaaaaagtttcaagatgataattgattttcatattaatgaatttatttaattcactgtgatctaccatcaccgtttgcattaaaacatttctgaggaagtcctagccaatgcaatcaagtaagagaaaaaaaatgaaaggcattgaaataggaaaataagtcaaactgtctcttcactgatgatatgattctatatctagaaaattctagagtctcttctaaatggctgataaaactgataagtaattttaggaagatttcaggacccaaaatcatacaaaaattggtagtatttctatataccagtaatgcccacgctgagagtcaaatcaagagcatgataacatttacaacagcggcaaagaaaacaaaatacttaggaatacagctaaccaaagaggtgaaagatctctaccaggagaattgcaaaacactgctgaaataaattagagatgacacaaataaagagaaaatcattccatgttcatggcttggaagaatcagcattgttaaaatgaccatactgcccaaagcaatttacagattcagcactactcttatcaaactaccaatgtcatttttcacagaagtagaaaaagctatcctaaaattcatatggaaccaaagaagagcctgaatattcaaagcaatcctgagcaaaaggagcaaagctgaacacttcatactacccaatttcaaactatattataaggctacaggaaccaaaacatcattgcacttgtataaaaacagacacatagaccagtggaacagaatagaatagaaaactcagaaataaagccacacacatctgatctttggcaaggatgacaaaaacaaatggagaaagggctccctgttcaataaatagtgctgggacaatcggcccgttatatggagaataatgaaactggacccttaccttttaccatatacaaaaattaactcaagatggattaaagatttaaatgtaagacctaaaactatgaaaattctagaagaaaaccctaggaagttcccttcttgagatgggccttggcaaagatttttggactaaggcaccaaaaggaacttcaacaaaaacaaaaattgacaagtaggacctaattaaatagaagagtttctgtacaacaaaagaaattatcaataaactagatagacaccctacagaatgggagcaaatattcacaaactatgcatctggcaaaggcctagtatctagaatctgtaagaaacttaacaagcaaaaaacaaataaccccactgataaatgggcaaaggacctgaatagacacttttcaaaacaacacatacaagtggccaacagacatatgaaaacatgctcatcatctgccatcatcagagaattgcagatcaaaaccatgatgcaaaaccatcgtacaccaggcagaatggctattattatttgaggcatgttctcactctgttacccatgctggagtgcaggtagcatgatcatcgcttactgcaaccgcaaagtcctgggctcaagggatcctcttgcctcagcctcctacaggaagctgggactacatgctgaggcaggtttttttttcctgtagagacaaggttttgctttgttgcctaatctggccctgaacttctgggctaaagcattcctcccacctcaacctcctgaagtgctgggattacaggcatgagctaccatggctggcctgattggctattattaaaaagtcaaaaaacaacagatgctggtgaggctatggagaaaagggagcatgtacagtggtggtgggaatgtaaattagttcagccactgtggaaaacagtttggagatttctgaaagaacttaaaacgagctatcatttaacccaacaatcctgttactaggtatatactcaaaggaaaaccaaaaagacacatgcatttgcatgttaattgctgcactattcacaatagcaaagacatagaatagacataggtggctatccatggtggactggataaagcaaatattatacatatacactgtggaatactatgcagccataaaaagaacgaaatcatgtcctttgtggcaacatggttggagctggaggctataatcctaagcaaattaatgcaggaatttaaaagcaaatagcacatgttcttacttataaatgagaactaaacattgagcacacatagacgtaaacttgggaataacagacactgtggactaccggtggggggttaggtcaaaaaactgcctattgcatactatgctcactacccgagtgcaatatacccaagtaacaaacttgtacttgtgccctctgtatctaaaaaaaggtagctataaaaccaaaaaatcatttctgaaatgctgaatagaaaccttaaaattttctactgattcatacccttacttttaaaaaagttagctttaacattttatccttcacctgttgatatgatttggcttggtgtccccacccaaatctcatcttgaattgtactcccataattcctatgtgttgtgggagggatgcagtgggagataattgaatcatgggggcaggtctttcctttgctgttctcatgataatgaataagtctcatgagatctaatggttttataaggaggagttttcctgcaaaagctctttgcctgccgccatccacataagatgtgacttgcttcttcttgccttctgccatgattgtgagtcttccccagccatatggaactgtaagtcaaattaaagctctgtcttttgtaaattgccagtctcaggtatgtctttatcagtagcatgaaaatgaactaatatgcctttgattaaaattatgcctaagaatgttaacatttactcctagaaacaaactctcttcagcaatatatagtgcctttgtatgtaattcttctgtagcaatcatacaaaaaaaaaatgaaagcacacatgttttcatagtatactctttgttttgagttgaattgtgtctcccaaaacaatatgttgaagttctaatcccctgtacctgtgaatgtgattacatttggaaataacatttttgtaggtgtaaacaagttgaggacattttggattagcatgagccctaatgcagtatgactgatgtccttattagaaaagaagagacacaaacatacgcacaaacacatacacatatgcatgtgcgtgcacacacacacacacgagagagagagagaaatagagaggagagagagagagcaagagcaagagagagagagagagagagagaatgctaagtgatgacagaggcagagattggagttatgctaccacaagccaaggaatgaccaggactattggcaaccaccagaagttaggagaaagtcatgggatggtttctctttcacagcctccagaaggaatatgctgtgctcgtaccttgatttcagacttatggcctccagaactgtaaaagataaatcttggccaagcgtggtggctcacgcctgtaatcccagcactttgggaggctgaggcgggaagatcacgaggtcaggagattgagaccatcctggctaacacggtgaaaccccgtctctactaaaaatacaaaaaaaaaaaaaattcgctgggcgtggtggtgggcacctgtagtcccagctactctggaggctgaggcaggagaatggtgtgaacctgggaggcggagcttgcagtgagccgagatcacaccactgcactccagcctgagtgacagagcaagactccatctcaaaaaagacaagataaatctctggtgttttaatccatccaacttgtattactctgttacaacagccctaggagactactactgtgttctaattgctctgttcataaacttggaaacaaaatctttccaaaaaatacaaagcattccacaagttttgcttttattgttcacttaagtaacttgtaattatttcatgtaattacctaagtgaattattgtcacataattcttgggatcagtcactcagttggagattcaggtatatctattaaagatcaacagtcagtactgcccttagacttggacaaatcctgctcttgatcctcagaggtcctaccatttggagtgacttccttgacatttttgggtctttctttggtgccaggggatgtctggggctgggagtgccatctgccagatgctttgattggcaggttaccgtatctcaatttatcatttttggagtcctctctgatcctcttatgtgtgtgtggattcaacccaatgccctgtggagctcatgaacttgtgttgatggcatcttttcaggactttaatgtctgggttctggttccaggaaggtggcctggttggtggatgttttctgcttactggtatgataattcttttacacgatcatggaagattgagctactggaaccatgctgatttggggtgacttctcattcacattggacatatgacaattcaaagatccaggtgtgggctcttgccaatttttgcctaggttctcacctgttttcattctgacttgcagtgctgattctagtctgtagcacccaaggacaatcaccacaccttctcttcaggcttgtcagcatatttcaggaagacttccaggatgttagagcctatctcccctgagagcttttgctttttattctcttgctccacaatgccagtggaccctctggttcatgttttttcttgtgtccaatccatgtttgtatgtcgtgcacttctaggtcagtgttaagccatgcctgatgcaggacagatattcttgcatgaatggaactactgatgtgttcctaacctaatctccctgctggtgttggtctgcagaaggccaatgtcaatatcaaaaaaactcttattttagaaatgtactcattgtggtctgaagagttcacaatagtcatgtttggaaatgtgtcattttacatttatagtactcccatgctgtaatgtgttgtttaaaatttatgtgttaccattacaaatggtaaagttagcatgactacaaagtaaattattgtttatgcttttctgcgtgccctgggaagacttgcatttgtggtcaacatcaatgaagcatagcaatatcttttgggagtatcattggaaaccaatattcatgatggatgatgcagccttataagcaatagtgtgagcatcaaataaatggaattagggaactgcagagccaagaacatctatattgttcaatataaagaggttctaaagatctatagcattgctatctttttcctgtggctggctgtaagaaattagccaggaatggcatatttgacagaaaagaacaaagaaattgttccaggtcctgaataggaggagatgggggcctggccactataaggaatctttaagtttgttgattggataataaacacagatgtaaacacttttcactctccattattcgaaagctttattgacaaatcaaggtatttcacatgagacaatatattttaagtaaaattgttcatgtagacaggaacctaacaaaaaatatttgcttgggctacctaatttctagaggcaatcctgtcaacagctatttaaaaaggggggtgggaagagagaactgggcagagggaaaagtggacaaagcctcaggcaatccagtggggttatgccccacatctgactgaaatggtttggcctttacacccctgcctctctcagttactggtccctggaggaatatgaccttatacaagttggctctctgtggctgagacagagaaggtgaagaagctgacagctggagaccatctgctgtttgcacaccccaacactgggcagcaaatcctttcttgaaatgggggtctgggcagcacatctttgtgtctaccacaaatataatttcaggacttagtttgagagagatctgtaaatgaaatttaaatatattctaaaatgcccaaaacttacatgccaaatatatatatatatataacaaacttatatatatataacaaacatatatataaaaaaactaatatatatatgttttaggcattttagaatatatttaaattacatatataaatgtatgtatttatatttgttcaaaattatggagaggcagaggcaactaattattgttaatttaataactattaatagcccttgtcttattaaatttaaaacactttgtctaaaatacttgatttcccaattactaattgatatggtttggctgtgtcacctcccagatctcatcttgaattgtagttcccataatcctcacatgtcatgggagggacccagtgggaggtaattgaatcatggaggcagtaaccctgatgctgctgttctcgtgatagtgagggatttcttacaggatctgattgtttataaagggcttttcccccttttgcttggcaatcctcctttctgccgccatgtgaagaaggatgtgtttgcttccgcttccaccatgattgtaagtttcctgaggccttcccagcgatgtggaactgtgagttaatcaaacctcattcttttataaattacccggactcaggtatgtcttcattagaagcatgagaatagactaatacagtaaattggtaccagtagagtggggtactgctataaagatacccaaaaatgtggaagtgactctgaagctgggtaacaggcagaagttggaacagtttggagggctcagaagaagatagaaaaatgtaggaaagtttggaacttcttagagacttggagggcttagaaaactggaagatgtgggaaagtttggaacttcctagagacttgttgaatggctttgaccaaaatgctgatagtgatacaaacaatgaagtccaggctgaggtggtctcaggtagagataaggaacttgggaactgaagcaaaggtgattcttgttatgctttagcaaagagactggcagtatattgcccctgccctaaagatctgtggaactttgaacttgagatagatgacttacagtgtctagcagaagaaatttcaaagtggcaaagtgttcaaaggaagcagagcataaaaatttggaaaatttgcagcctgacaatgcaatagaaaagaaaaccccattttctggggagaaatttgcataagtagcaagagactgaatgttaatctccaagataatgggaatgtctccagggcatgtcagagactttcttagcagcccctctcatctcaggcccagagacttaggatgaaaaaattgttttgtgggctgggaccagggcccccttgctgtgtgcagcctagggacttggtgccttgtgtcccagctgctctagccatggctacaagaacccaaggtaaagctcaggctgtggcttcagaggattcaagcccaagccttggcagcttccatgtagtgttgagcctgcagatgtacagaagacaaaaattgaggtttggagacctctaactggatttcagagtatgtatggaaatgcctggatgtccaggcagaagtttgctgcaggggtggagccctcatgtagaacctctgccagagtagtgtggaagagaaatgtggggttggtgctgcctagtggagctgtgagaagagggccaccatcctctagactgcagaatggtaggtccactgacagttttccctgtgtgcctggaaaagccacagacaatgccagttgtgaaggcagctgggaaggaggttgtaccatgcaaagccacaggggtggagctgcccaaggccatgggagcccacctcctgcatcagtgtgacctggatgcgagacatggagtcaaaggagatcattttgaagctttaagatttgacttcctgactggatttcggacttgcatggggcatgtagccccttcattttggtcaatttctcccattttgaatgggtgtatttacctaatgcctgtactcccattgtatctaaaaagtaactatcttgctttcaattttacaggctcatggttggaagagacttgccttgtctaagaagagactttggacttggaattttgagttaatgttggaattagttaagacttttggggactgttggaggggcatgattgtgttttgaaatgtgggacctgtgatttgggaagggtcaggggcagaatgatatggtttggctgtttccccacccaaatctcatcttgaattgcagttcccataatccccacatttcttgggaggtagcttgtgggaggtaattgaatcatgagagcagctacctccatgctgctgttctcatgatagtgagtgtgttcttacaacatctgatgtttgtataaggggcttttcctccttttgcttggcacttctccttgctgttgccatgtgaaaaaggacatatttgctttccttttgaccaggtatgtaagtttcctgaggcctccccagccctgtggaactgtaaatcaattaaacctcttttccttttcttttttttttttttttttttttgagacagagtctcgcttgttcacccaggctggagtgcagtggcgcgatcttggctcactgcaacctctgcctcccaggttcaagctattcttctgcctcagcctcccaagtagctgggactacaggtgcccaccaccatgcccagctaatttttgtatttttagtagagatggggtttcaccatattagcaaggctggtctcaaactcctgaccttgtgatctacccgcctcggcctcccaaagtgctgggattacaggtgtgaaccactgcacctggccaattaaacctctttctttataaattacccagtctcaggcatgtatttattagcagtgtgagaatggactaatacactaataaatctgataatgttacaatttttaaataactaattttctacatcacttcttctccacacttgggttttaaagtgctttcttaaatatatccatgtctatgtatatctacatctgtatctacctaggtagagcaataatagatttataatagatctaccagggtagatacagatgtagatatacatatctatatattcttaagtttttatttgctacaaattttataattatctaggttgtacatgtgtttcataaaaaataatagtgtaattataaaattaataaaatagcattctgttcttatcctcatcaacttgcttctccagaattaaacacttttacctatttgtctgttacttatctccacatttctaaatagcctccttttaaaatggatttttctggtttaaagtttgtatctctatttcttaatatcggtatcttaacatagaaaacctatattgcttaaatcatcacacacttcttttctctttattcaccctcctatgcactttctttctctccagtctcccaatttgtaattatatcataatgtatcactaattcaatttttagtgttcatataatactcaatatttagtatttacacaatatgactatggaagtactattttcagttgaatcaagttatgataatattttatttttgtacaaccttttttcctggggttattttcattattttctcttgtttaattctatacacctactacgaattcatcctcaaactttttgaaagatgtgtaaaacttattttaatcaaattggtttcatcttctttcccccttggagatagagatctttccagcacccctttggctctgatctggaccacatgctgtctaggttggctgcacagatgtcaacttggagcctccttttggcagcaccttaagaaactttttggcatctctttgttgaatcccactttctggacaccatattttgttccctcttgaattatcttctcatattgatggagtgcattctccatcagctttaggagaaagaaggcaaagaacttgaacattttgagaacttctatttctgaaaatgtctttattattctgattcatacttggttgaacaaatttctaggttaattttttttccttcagaatgttgaagtattgctacaatgtcctaaacttgagaatgtgtgtggggttgtcaagaagacctcatcataagggtgaggaacagtatctatgtaaaggttagaatctacaggtgttctctctaggctggtttgtgttttccagagaagaaggatccagtgctctgctttggctgaaagagagaagatgactgtacagtctcactattcagaaatcaatttcagctaacctctgattctcacccttcctctcagctgtgcctggtatccttaaagctatctctgccatggatcaatgtctttagacagtgaatcttttgcctcctgccaaggaggatgtgtagtttagggaaggagattggagtctagatgctactgatgtaaagtttctaccagtctgcctgttttcagctttactcagtgcctcataatctcatatttttcagggttctgagagaaaaaactggtttgcttcttgtgagtgttacccctacaagctgcttggttttagctttctcaggacagctaaattggttaacattcatatgctttgcagcttctaaaatgttgttctctctctgcttctgttgctcttttatatttcctttaaccttgtgggatttttgtttattccttattgtcattttagctgagatttaaggagaggaatttagcatcttcatttaatgtattctttaaatcacaacttctgatcaataataatttctgcctttttgcctctccattataatgttcctctccctgaaatagtaaatgtcaggaatagcacaaaattctgatcaaatatggcagagtgaaggttttcattacattttctactccaaaagaaattgcgaaaaacaaaaattacactaaaaactcaacacacagaaaataagacaacaatttaagtgaaacggaatcagccacaactctgaaaagaatactttaaaaatagatcaggagatacatgaaatatacagaaaaacatgcaacaagctgtagaagaaagggtgccaagtgcacacccatctgtatatttcttgcagcacatagaagttttctaaaatacattcactatagaaataaaaattaaactagtagcagcaacatataagctctgctgaaaggtagttatagatatggatgagaggcttgaaaaaaatcaataaaaatataaaaacaaatgaagctgattagacaaggggaagaagaaatgaatcatgatgtaaatatcaaacaaggtggatattgatagaccatagactttgaaaatataacagaagagatgaagcttatatgggattttagttcaggacaaacctatgttttcaacgggcgcccatcagaacctcttccatggccaaagggtactaaatagagtcagtgggtaattttcaggataggtgaaactccaatattatgtttgcaatttagagaaaaataacatttattttctaagatactattataatacctagaaaaagtagtctttggcagggggtgggggtaagaattgagtaaagtttgatgttgtaaataaaactataaagtattttaaagtataatttaattttcagaatgggaaacctgttttggttttaccaaaatcgcatatattaacttttaaatttttatatatagtatgtaacagatgtgtgtgtgtgttctatctttcatacattctaatcttgaatgaatgatttattcatttaattgccttctcaatacagaataatttcaccaaaaattatacgtgtaaaaccagaagtgacttgttacttccctactgaagatattttaagtaaacttagcctcactcccctctttgacagcctgagcaagctggaaacctttcctgtaatcctttcttgtatctaaatcaggggtatccaatttttggcttccctgggccacactggaagaagaattgtcttgggctacagtaaaaaacactaactatagctgatcagacaaaaaaattgcaaaacaatttcataatgttttacaaaggtttacgaatttgtgttgagctgaattcaaagccatcctgggctgtatgttgcctgcaggccatgggttggacaagcttgatctaaatgaaagaagtattaactaatctgaaattatagattcttgaaaaatgtcctttctcagtagataagaattttatgtaacatgatacttggtattaaattctaatgagaataagttttacaacagatttaagttgagcttcagatactcaggctgataatatttctttgtaggatttaatttttattgacacattaatgaaactattctctactttagagcagtagggatgacataaatttcattattttaaggaataaattttattaaattttcattaagttactaaactgtaggatgtttaaaatgtttttaacatgatcaatgcagttaccatggatattgctctttattttaaaaccacctcagaataaattgtggtctgctggtcaaccaggcttcccttctactcctcaaaaaagccctgatttgtagaatttgctgatttctgtattaaaccctgcattatggctgattttgagctatcaatctgatgtcactgatggtgactttagggagaaaggtgaacaatgggctctccttggccatgtgagccagctctagcacactactgcattaacacacaggggtgcatcacttaacaagctgagtgtgttctgagaagtgtgtccttaggtgatttcttgtgtgaacatcatggagtgtacttacacaaacctagatgatgtagcctactatgcacctaagttatatagtataggctattgctcctaggctataatctgtacagtatgttactaaaataaatactctaggcaactgtaacacaatggtcagtatttgtataactaaacatagaaaatgtacattaaaaacatggtataaatgattttaaatggcgttacctgtgcagatcacttcccatgaatggagcatgcaaactggaagttgctcaaatattttctttctttatatccttattctttagacatttttttctatttttaaaatgctttataatttttagttttttgaaagtttttgttaaaaagtaagactcaaatacacacattagcaaaggcctactcagggtcaggatcatcagtcaatatcactttcttccacttccacattttgtcccactggacgatcttcagagattatcttcagagataataacaaggatggagctgtcatctcctgtgataataatgccatcttctagaatacctcctgaaggacctgccttaggctgttttagagttaactctggctttttaataagctagagtatactctaaaatgatagaaagtaaataataaatatataaaccagcaacagcattatcattaccgagtattatgttctgtacataatcatctatgttatacttttctgtgactggcagcacagtgggtttgtttacaccagcatcacaacaaacgtgagtattgcattgtgctgtgacattgtggtgtatgacatgactagggaataggattttttcagctcctttgtaatcttatgggaccaccatagtatatactgttcatcattgactgaaatgtcattatgtagcgcatgactgtaatcatctttgtaattttcttttttctcaaaatttatatacacctttaaaaagtcaagtaggaccagaagcatttataatgaaaaatgatccaaacctcattctaccaacatccttcccagacagaagttactctcttgaactgtttctgtttttagttctgccagttattatttcttcccaaatctaaataatttgctgtaaggctattttttgatttggcaataatatgaacacttccaagtctttcaattagaattattttctattatctagtaactttctcccctctattttctctgttctctacaattcctgttagttggatttaaggtcattataagtgatactcttgtcttttcttccatatattttattcatcttttctgctgtttcaacctttttttgattttatgtaccaatcatgtgtttgtatatttgtgctttttctcattttttcttagcattgtcttcttgcttaaataagaaaatattacttgaatttatgaatctaattaaagttatttataatcttttttaattcctgaaatatctgtttttcttttaagttccttttttcctcttgagctatatccttttattgctggttttcacatacttgttgaccttttgttgtctattcatatttagcaatgtgggatgagtatgatttgtctgctgaatgatttgagtgtcctctttacctatatatgaagttttcacactaggacattttaacaggtctttgagcacctttcatagatgtgcaatgtgctcaggcttcaatttgggatttttctggggaactcccaaatgccagaatggagaagccttaaaatctagtgcataacctatcagcctttgttttgctcatgcatttcttttctgtttattaaaaaagatgtgagtgtgtgtgtgtgtgtgtgtgtgtgtgtgtgtgtgtgtttatgattctctttggcagaatgtgttaggctgcctgcactcagcaatttagcaatagaggagagagaatggatggtgaagaggcacgtggggagtagctgcaagatgcagttgtttcatggacagaaactgcaccaatcctatcctcctgcccccatccccagttttccaggcttttgcacagtacctacggattccaagtccagcgcttctttagagttttgccaaagatatatggatctttttcttatgcagatcatttccatgcattctaagtgtagcttcatttttctgtttgatataatgaagacttcagtctgtcttcatttacccccaaatttttgaaatctctcattcatcaaaaaggtccttcttttttactaatttttctgtaattttattccatttttttcctacacaatcatatgaatatgaattggaagtcatgatctattgcacagtgaatccatttggaatcttacaatcagtgaaccatccctgtacctctttgggagctatgtacattgtatcttgtatatgtacagagttacgttttttagattttgatacaaacacccaaaaaaacactgagcaatcccattagggtttttgtttgcttttaaaaaatactggcatcaagaaattcttttattctaaaagtatacctatttgaaaaactcatatccaaaattctggtttgtaaaattatgagcattatatatgaagtttagaggacatttatggagattccttcatatagaacaaaacaaaatcttataaattattataatgtcatgttactggatatgatttcttttttaaaaaccacagtcaaaatataaatctgcattctttaatgcttcctttgacaaaacaatctttagaaaacatttattgtcacactactttggcctgaactatgaattctaatttaatttttatatactctgtgttaaaaataatttgatttggggagaaatttggaggcgcttcaaggcaattgacattatgaagacaaattctgtttatttcttgaaagtttctcttcatatgagtttaattgaatttttttttttttttttgagatggagtcttgctctgttgccaatgctagagttaagtgttgccatctcggctcaccacaacctccacctcccaggttcaagcgattctcctgcctcagcctcctgagtagctgggactacggctacacatcaccatgtccagctaattttttttatttttagtagagatgtggtttcactatgttgtccaggctgatctcgaactcctgacctcaggatccgcccgcctcggcctcccaaagtgctgggattacaggcatgagccatcgcactcagctgtgtttaactgaatttctaaaacttgaatatgattttataataagctataagtttattctctcagtatttcaaaccatataatacaattcttatgcttctatcttataaccatttaaagttatttagttggttagctatttaaaggttaatcctatgttttaacaatattaaatactttatataagaaatgtgttcatattttatagtaaattatcaaaggaatacagccattcaaaaaataaacattatttgccacatttatttctgtgtatactgctatgaatgcaactcattattcttagaatatagtttctctgtattgtagaatatatacttctatgtgtatatgtagcttttatgtatatatgtgatattaaatgaaaattagcacatatatgcatgaatggatgtcaaatgtcccctatttttcatatatacacaacactaattcatatatgtgtgtatgtgatatgcacatactatctttttttgtatatatgtatatatgctttcaaggccagattaagcagaaggatgctcaaatttctcctccctcctcctatgcctgattattctgcaccagaccttcacttttattgagtagctagggttgggctgacacttttcaggctgaaaggcagaaacatttatcttcactgacaaacaatttgtgaataccttccttgggttgtgagacacttgctctaacacaattctcatctgttttattatggagtccctgcaacatttgacatcctcttactgaatttgcgtgttgtgaaccgaatggtaccataggttgattgtaatatatttttttaaagttcatgccaatttttctgtctttgaaatttagaaattaatgtgggattatttcacctgtattttttaggaaggaactctattaatttttcctctgaatataaatgtaatctgtgtttctattagaaaactatgagaatatgagaaaataccaggaagaaataatatctatataatatctatgatcctactaatcaatgataattgctattagtattttatatatattctttaatcatgtatttatgcataaacatgcatgatattaacttaatgctagaatcatgcagtttatgtttgcagacttttgtttgcttaattttgaatgacattaaaggcttggtttttaattgatgcatgatatttcatcttatgtactttctgacatgtgatcacctcctattgttgcatatttacgttatttttatttttgatattctgacttaaaccatgataaaattcatatgtaagggtttatgcacatctacagtagtttttagccattttttaaggttttgtatgtaacctgatcattcctttagcacatttaaaaaataatatccatttgtgttttcttattgatttataagtcattttttctacaatggtgttaatctttgggctatcttatatgttgcaaatgatttctacttttttggttgttttacattatgtgtattttttatatatatactgtaatttaaaatgtccactttagtacagcctctatggaaaactggttggcaatttctcgaaaggttaaacacacatctactttattatctagcaactttatgcataagtatataccccaataattgaaaacatatgcccacaaaagacttatacaaaaatgttaattacgtctttcttcaaaataacaaactattggaaataatctaaatttacgtcaaaaagaatagtttaaaatttgtgatatatttataaaatggactacaactcaggattaaaaggaataaactatgaatttacacaaaaacacagacgaatcccaaaaacatactcattgaaagaagcaagacccaaaataatgtatattgtatgattctcttgctgtgaagttcaacaactggtgtaaatgatttatagtgtatggagtcaggagaatagttgcctccatgaaggggaaagggaatgaaaggaaagagacacatttatttgtcacaaatcaacaaacgctactattatggggctgaattttgttcccccaaaattcatatgttgacattctaacttcctgcacattagaatgtgaccgaatttggagacagagctttaagacataattaagagtaaattgagttcattttggttgccctaatccagtatgactggtgttcttaaaagaagagtagattaggacataaagacacacaaagcaggaccgtgtaaagacacagaaagaagacagctatctataaaccaaccctgctaacatttgatcttgaatttctactttccagattgtgagaaaataaatttatgttattttattacctggtctatggcaaaaatcaaaaatgtttataaaaatgtttaaatatccagaacccaacaatgtaaaatcataatgtttggcatccaaacaaaaattacctggcataccaagaagcagaaaaacatgactccaaatgagtacaaaaacatcaatcatctataaatgatctggaaataacaatgatgatagaattagcatacaagtatattaaaacatttaaataactacatatcatatgttcaagaacctaaaagaaagcttaagcaagtgtagtagacacaatgggaaatataaaaaagacacaaattcaacttctagagacggaaatcatgtctgagttgaataatgtcacttatgtctgttttcctttgcatttatgctaagtgcatacaccatcctgagataaaaatattaaaacaaacttttttgtaatttctttgcaattttcatttcttattgaaatcataccttaaatgtattttgtatataatctatttttctgtattattaaacaatattcagaactctaattgttttgttacccatcactttctcattgatttgaaatgccagtttttaacatttatgagtgcaggtatgtgtaaatgagtatacgaatttaaaagtctctatcataagaagaaatgttctttagcaattaagagtgcaggctaacaaatgactacattctaactgtaaccttgaccacattttttttcatgagtcttgacagtaatctacttgtatgtaataaatgtcatgtggatagttgaacatattttacagggttgctgtgagatttagtaaggtaatgcaagtacagtcttgccttgaattataatagggacattttaagaaattttaaaggaaatttacaattaaatgttaaaggaaatttaaagcatattttatctattctttcatccagaggtatgtgagtgtgtgtgcacgtttgtatgtttaaggtttgtgtattggattttattttaaatgtttctattttgcctcttaaattttgacttagtcttttgtatagttcacattctttcaagaggatgttgatttttttcttcttgtttttactcaaatttgaataaagaaattgctatttggatcaagcattaggttgaactatatgaaatttcgtttttactgtgtaaaaatcctatatagtgggatttcatatggatcaacttaaaattgcttaaaaatcactgagggtagatacataaagaatctccagtaatgcaatggctgggtcaaatggtatttctaattttagatccctgaggaatcgccacactgacttccacaagggttgaagtagtttactgtcccaccaacagtgtaaaagtgttcctatttctccacatcctctccagcacctgttgtttcctgactttttaatgattgccattctaactggtgtcagatggtatctcattgtggttttgatttgcatttctctgatggccagtgatggtgagcattttttcatgtgtcttttggctacataaatgtcttcttttgagaagtgtctgtttatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagacccattactgggtatatacccaaaggactataaatcatgctgctataaagacacatgcacacgtatgtttatcgcggcactattcacaatagcaaagacttggaaccaacccaaatgtccaacaatgatagactggattaagaaaatgtggcacatatacaccatggaatactatgcagccataaaaaagatgagttcatgtcctttgtaggtacatggatgaaattggaaatcatcattctcagtaaactatcgcaacaacaaaaaatcaaacaccacatattctcactcataggtgggaactgaacaatgagaacacatggacacaggaaggggaacatcacactctggggactgttgcggggtggggggaggggggagggatagctttaggagatatacctaatgctaaatgacaagttaatgggtgcagcacaccaacatggcacatgtatacatatgtaactaaccttcacattgtgcacatgtaccctaaaacttaaagtataataataataaaataaaacaaacaaacaaaaaaaagcaacctatcatacattaatgattgaactttaaatatagtaatatgtttttcaaggaaataattactagatggtatttaagacaattcatacattgttgtgttattttattaaaatgatcacatttttataatttaaaaaaaaaaagaatctccaagggctggtagtggaattctgctctatataagttcagtgatactgcacttggagagtaatagggagcagtgagtggaagcactgccaagcatatacatcttctttctccacagtcaggtgtttttggtttttgatgtctctatttttggcaaagccacctcttaacatttttttttctgtatcttgatttcagtttggtttagtttacaatctacatagtcattgtgcttgtgttttttctgcttcttggttttacagtctgttaaggaatagaacctattgatgtcacaatgtcagttacctacttctctgatgtttcggtcagttatgtttgcttgagtgtttcaggacacctgcttcctgatgttaacatacttggcagcagacctttctcaagcttactcttatttccaattattgcttcttaatacagaaagtatcagtggggtttattcactcactctttcattctttcaatcattcgtgtattagttcagtactgacagtatcaaaagaatgtttgctctacttttatgaggtttttgtctataagattaggtaacaattacaaaacaaatggaagcaatacataattccaagctatgatagtgaaaatgttctaacaaatttaaacccactttttcagagatcgatattgaaaatgactctgttttctttcaatatggtcccaacttctgtacatgtagcaaaaaatttgatgaaatgtttggatgatacatttttctaattaccagagtgattcagttttccctattttaaattcctttggtcatttcaatcaggattaggtaggatgtgatgttacagcctgtgtttaaattgacatcctatgtcaaatttattatatatgtccttaagaaattaggatttactttgattaaaatctttctgtgcctcaggaatgagtagtatattttatgattttctaaggataactttctctgtaatttaaaagaacaataaagtgtttatttccttttcttaaaaaaataaaattcactgattcagttaacctagagaaaacaaccattgtgcatagttactgagggagtatgttaataatcactttttaaaacaatgtggagaatgtctgcatcaaaggattctgccatcaccctaagtattttctccctatcttatctttttttctcctttgactaatagctttaacattgatttagttgaataaaacatttgacatttttaaggttcagtgcacaaaaaatactatttaccattcacagggttaggattattttgtattaaccaaaaaagtatgtatgtacatatgtacgtatctatttatctatttatctatctattatctatctatcatctatatatccacatacatacagacacacacataatcatcattgatatttaggatatttgtagttttctttgattagatatactctgtaaacactttgccagtagaaatgtactgtataatgtgacagtgatctataaaaatgcattttatttcattcaaacttaaaactatgcacataatctggttatcttctaaaacaggtgatatgcttctttagattaagatttgccttcttgtgctttcgggaagggtttgaacaatgagtgatatgtgattgaatttatggtgaagaggcagaaatgctcttaaatattataaattccgtagattcatagtacaacattctcttcagctgtgccaaaattatccctgtagaatgtttttatctagtaatagcagcgatgagtagttgatctcatggcaatgtgataccgcccctcatggacacctgctaaatcaccagtatctgttttatctgaagtcatagcttgtggtgacaatgtttaaatgctcattaagcacattaaacatagctaagttcaaagtgaaatttagctggccaaaaacttattactcgagtcttgtaatatgttttgtacaagtctttttcaacttgtacaactatcactgggtgtttatgaaaaagtccaaacaagttttcactatagaatgtttgtgtctttgtacccatcagacctatttggtgtttggcaaacaaagcaagcaatcatgatttttctgacttaaaaaaatgcatgattgagtgatttcttgctacaagaatttagtgcttcactgtgttacaaccgaacaaaaagtgaacactacagttgtccttgttaataaaccatactattaagcatattaatttttgctaaaagcgtggttaaacaaataataatacaagtacataattaatgaaaattattttcaggttgttactgatatttaaaaaataaaaacgttgtaattttaaacaacttaccaaaggacagaaatctaaatactaagtttggtataatgagtcttttaatttcatctttgtacaccactattttaatgtactgacatattttgtgtgttgtaatcgccttggtcagcacaatttttagataaaggaagtgaaataaatcgagtttcttattagcacaatgataccattatatttcttaatttttttttttttttttttttttgagacggagtctcgctctgtcacccaggctggagtgcagtggcccgatcttggctcactgcaagctctgcctcccgggttcacgccattctcctgcctcagcctcctgagtagctgggactacaggcgcctgccaccacgcccagctaatttttatttttttattttttttgtatttttagtagagacggggtttcactgtgttagccaggatggtctccatctcctgaccttgtgatccacacgccttggcctcccaaagtgctgggattacaggcatgagccaccatgcccggcccaaaaacaatcattgtatttctaactgaatctttatattacacaaagtctgaagttccctaaacttggaacttgggaatatcagtgtggatatacatttattacataattatcatttattttcataaatgtaaatacctttatataaatcaatgaaaatttaatattacatttcattttctgtcattatttcttttcatctttaattaacaaaagtttctcagcctttagttaattgctttgttaatgatttttcaaacagaattagaagactttaatatttaaaggaatatttccatattatgaaaaataatactttaaagaatgtttcatttgtagttcttcacaatttggagaagttggagaatgttcagtgaaatagcatataattatgcattttaattaaagtagccaatgctgtgacttaaaaaatggaatattatgcttcagactttacttttcaccgtaaataaaacaaccacagaaatgccagacagaacaggaacattatggtacctgcagtacactcgggttacatacacacaccaaaagagagaatgtgaaaatctagggagagggatggaagctatttgtgtgtgtatgtgcgcgtgcatgtgtgtgtgcgtgtgcacgcaggtgcactcgtagagttacaagtaaagactagaggggctttcctctgcatggttaatatttacatatgtgctaattctgccattgattaggtcagtactattgttaccatggtttttccttttttgacacttctgtcattgtttcatttacggtgaaaacgaaaggctgagaatgggggccatgaggaaacggaggtctgagtagtgagagcagtaggctgtttgaggatggatttggggagaaaacctgtagtctctagaggaaaatccctcaaaagccttaccattaggatgcagaaattaggacgcatagagtgaaaactgctgacagagtatgctcttgaaacatcttgggccatgcacggtggctcacacctgtaatcctagcactttgggaggctgaggcaagtggatcacctgaggtcaggagtttgagaccagcctggccaacatggtgaaatctcttctctactaaaaataacaaaaattagcctggcgtggtggcacacacctgtagtccaagctccttgggaggctgaggcaagaggatagctcgaacccaagaggtggaggttgcagtgagctgagaccatgccactgcactccagcctgggtgacacagacagactccatctcaaaaaagaaaaaaataatcttgaagattggaggaggttttggctagaatagaagagagaacccttccaagatgtataataaacataaagaacaagaatttcagacctctatcgacacacagctgaaaagaaagcaatagtggtttgtttctcttctgcaaaagcaggtggataattaacgtcttcccttgtctatagaaagaaatgtttttgacagttgagaaattgttttttccataatttaagtcctacccactgagttcttcctcactgggggttgacacgtagtaggcctggggagtggatggagataccaactttatggttaccatatgagtcccaggtgccatcgtctgtaagtaccacaaagtcagagttagtttaatccagcaaaaaaagtctattttcatagacaaattctcaatattaaacctgagctatacttgatgtattaaattagtttgatgagaatttttttctgtaattaaaaagaaacgtaacaagaacacagtttacatgggaaactgtctcatatataagtgaataagtaagaattgtaaaagtctttgctattatgtaatttaaattaagttagtgcatattaaattcttttgaagatggtacttgtggtcattcatccttttcatttttatttatttttacatgaaacctagctaatataattatttttacaaagctttactttcttcagtgttttcttattcattaagaagaaagcattatcttcacattacaatttatttttgggataaaaatttgtctagttcaagtttaaaataaagaaaaataagaaacaaaatattgttatgtattgctgctgtttttatttacttctttctttgtcagtaaaatcctcccagtaagccattgcattaccacaagtttttcaattacttaccctcactgatgtcactaattatgatgcattaaccatgagaatgttaatgcagaaaaataaaaacaacaaccagaaaaatcaaaacaacaaatactaagtataagaatattgcgaattaaaagatgcagaatatttccactgagattatgcaaatagaaagagaaaaaatgagttgatgcagctatgtatgtctctgatagttaatgttactgattatagttcttaaattgttgtttttttagtttgctcaatgctatatattttcttgttttacttgaattgtggaaacatttgtgtcacagaagaacaaattaatcccaatgtaagcagtagaaagtgaataataaaattaaaatgaatcaatggaataaaaaacagaaatgatagagacatcagtgaaatgaaaagctggttctttgagaagatttataaagttggtagatatccagccagactgatcagaaagaaagaagtttcaaattcaataacaaaaatgagtgatggttcattgctacaaattttccaaatgtttaaaagataatcagaaagtattaagaacaattttatggtcaataaacacactttgatgaaatgaacaaattccttgaaagacacaaactaccaaagcttactcaagaagaaatcgatgagctaaagagcccctaagaaattggttaggttgagcatctcattttatttcttttttatgaatggtcatttcatatcttttgcctatttctctattagactctcagtacttttttatttgttgggttttttaaattttatatattgatcccttgtcagttttagacgttgcaaggaacttctctattttttattggttaatttcaactatggtgtcctttattgaatggaaatgtttatttttaatgtacccaattttcctcttgtggattttaatttttgaattttattcagatctttccccattcctaggtaaagagatactctagtacatcgtaatttattttctttattgtttttctattcagatatacatatttaattcttctgcatcccaatttatttgagatttaatgtagcaatcctgttcatattggtaattttccgagatctctatcctgttccactggtcactttgttcttgaccaaacagctttattatggtagcttgtaagtatattttcatgttggtataatgagcctccccactttctttggtctttttaaaatcaaaattgacataaactcttcatgcacttttattctaccagatacaccttgattaatcatattgacttcctaaaaaacactgtatttggaattttcactggaattgtgttgaatttataagttaattttgggataattggaataattacattgctaaatggttttattgatgcatatggtaaaattttgttgatctctttcaagccttttaatagaagctttgcgtatttctcaatgaaagtcttgtgcatgctttgtttaatttctttgagtagcttcccatatttttcttgtcttctctttcaggaatgcatgctagtcaaatgttggacctattgtactggctttctgattttttttttatcactttctctcctagttagtccatccttttttcttctatatggtcccactctctgaataacttctttgactttatcttggaaatattaaattggcattttaattttaagtaacatatataattttcaaaaactgttattcctgcataatctttcttcataatattcctgcttatattctgtgagtacaataccttcttttatttgtaatagactattaatcatggaattttaaaaatatactttaattttaagagcagttttaggttcatggcaaaactgagcagaaggtacagagatttttcatatatcccatacccccacacgtacatagcctccttcttatcaacatcctcaaccagagaggtatattcgttttaatttataaacctacatgaatacatcattatcaccaaaagtcgtagtttacattagggttcattctcagtgtcatatattctatgggtttggacaaattcataatgacatgtatccaccattatagtatcaaacagggtactttcactgcattaaaattcttctgtgctctacctattcatatcgctcccccctcgtacccctggcaaacactgattttcttcactgtctccatacttttgttttttctaacatgtcatgtagctggaatcatatagtttgtagccttttcagactggcttatttcacttggtaaaatacattgaagttttctccgtttctttttgagacttgatagctcatttgtttttaatgttgaatgatattccattgtctagctgtaccacagttcattcattcacccactcaaggacagcttggttgcttccaagtgttgaaaattgtgaagaaagctgctataaacatccgtgtgcaggttttcagctcctttggataaatactaaggagagagattgctggattgtatggtaagaaattaccaaactgtcttccaaagtggctgtaccattttgcatctcaccagtaatgaagtagagtttctgttgatccacatccttaccagcattttgtggtttatggtcattctaacatgtgtttaatggtattcattgtggttttaatttgcatttttctgatgacatatgatgtagaacatcatttcatttgcttatttgccatttatatatctttggtgaatctgttaaggtctttggcccattttaaaatcaagttgtttattttcttattgttgagttgttgtaaatgccttttgtttattttagataatactcctttatcagttgtgtgttttgtaaatattttctcccagtctgtggcttctgtttttattctcttgacagtgtctttcatagagcagaaaatttaattttaaggaaatccagcttatcaatttattttgtgaactctgcctttggtattgtatcaaaatagtcatcaccaaaccctaggtcatctagattttctgttatgctatcttctaggagttttatagttttacttttacattgaaacgtgatcaattatggaatctttgcagttttttctgcttgtatcacttctgcttatcttgagttactttttatatgtttatctactttggttcctgtttttttatgtgggaggttttcctttattgtttggtgatcattgtctcaccattatgtctaagaatgaaacactttacgcttgggaggggtttgtgtgatgtgatggcccaaaacaaaccatcattttaactggagaatgccaaatgttgatgtccataggtcttttctctctgtagagaatcaccttccatatacgaacttccaggaatataagcctggtttctggtgacccaaagctgattagcagaggacttggggggaaggtcactactctttttttagaatgtcattttctctttttgtctttagttgggtgccttacctttgccttactttgaaatggggtccaagtgttgaatttttaaaaataatatatcttgcaatttttctatgaatgaggatgtgagaccaaggactctcaggcctaactgcttcttaaacagactagtcaatttctctacttttactttaatttacatgatttttttaaatcctcttttgtatccctctctgtaaacacttaggcttgctctcttctgttttgctaagtcattaccatttctccatctgtttcctgttcattatattgcagggtggaattacaggtgccccttttttttagcaagcatagcatgtgttattactctctttgttttttgttatatctttaccttgttgtgtttaaagcagaagttagatatgtattttttctacaatgcatttatttatagtgctcagattagtctctgaacacagaaagaatttcataatagtttcagattgaacattacaaacatgtaataatcacaatttaactcaacaaatattttactaaatctcggtaactgtgctaggcaatgggaactccattcttgtggataataaacaaataaaaactatatgagaattggagttagtggtaagtgctatgaagaaaaacataggagatatgacagagtggatgtatattttaaagagtttgttaaagcggcctcctccttgtttcttgatatttctttttaaaatattcttgtaacacaaggaccaaatgaatcactgaaaaattcactcagaaataagagtgagacttgtaacggttagtaggggttataatcaccgtacaagaagtatatctcttctcgttgctttgtctgcctttggcgaattggaaatataaacctgtttaatgaatgtgttcttaaaataccctttggaagtttaaattactattgaaaaagctgtataatgcagttatattcctttgtttatgtagctagaagagagaaggaaaagaacctgaggctaatagaaatagattacatttcactatggagcatagattaaaataatgtattttattgtggatctcccttcagaattcaaactaaatatcatttactttttctatttaagtaataacctcagggctctttaaaaaatcattatcagaagataacctaatatatcattgatatagtttcttcctatcattgacaaatatcatattagaaataccacctttttatagtcttgaaataatataatagaaaagggctccaaaaatgcaattgttccagtaaaaatagtcatggtgtattctttattttatcgaaagagaaataatattaaatccttcccttgcatttctttgaaagtgaatacttatttggtctactcgaattaataatttattttcttttgaatgttttgcagatgtttatatatcagtagtttcatttaaaagagctcttaaatgtcagtacttttctactaaaattagtaaacataaacatttaaagtattctaatatcattttaacctattttttaaagaacagtgtaattgatttttaaatcatgacattttaaatcatggtatacagaaagagtgtgattttagagtaaagagtatttttaatttgagaattaaatcaaatggctataaaattgtatctataaaactaggtacacagtgaaattcccattgtcagcatggtcctgtctccacccaggtaccatactccacctgcaagtaaccatttaatatattttttcgtatccttcggaggattcatttatatgcaaacaagcttgaacatacattcttatttgcccttatgtacctaaaatttagcttattttaaggttgctttgaacattgtttttatcacttacgtctaaagttctttctaaattggcatagaaagaacttcatatctacattgtagtattacgttgtataatataccaagattcatttaatctgtttccaattggtacatatcagccttttgtccaatattctgctactgcaatcaatgacctatatttaaattgttttggacataaaactttacagggaaaagccccagaagaggaattactgaatgcaagggtcaagttcttgtaattttggtgaatattaatattgccagatttccactattgtatcatttttacatttttaattattttatattacccccaccaaaaaattgatagtttatttccttacagctttttttttcggggacggagtttcgctctgtcgccaggttggagtgcagtggcgcgatcttggcgcactacaacctctgcctcccaggttcacgccgttctcctgcctcagcctcgcgggtagctgggactacaggcgcccaccaccatgcccggctaatttttgtatttttagtagagacggggtttcaccatgttggccaggatagtctcagtatcttgacctcgtgatctgcccgcctcggccttccaaagtgctgggattataggcgtaagccactgcgcccgacccttacagcattttttcaagattttcggtttctatctatatgataggtgcgtaatcaaatactcacgacagtttttagtttcagttatcttattataaatgagattgagaatgattttaaaagctactatttgtgctttctgttctgtagattttctgttcatatgttttctccatttttcttttgatgtggttatttcagtttctatgagcccttttttgtatgagataatttatttttgtatggtataaactttaaatattttcccatttgtcattatctttcgagtttgcttatagtctataattcttaagttttgaataaaaaattataaaaactgttttcatgcaaacttttgaagggctactcccgtgtttgatagttttatgattgtatattttatattttaatataaatgcatttgtcctggcttgtcatataaagcgtgaatgccactttattttttttccagatgacactgttttgttccaataaaacttttataattattcttttctcgttatatttaagatgtcaccttcatgatatgccatatacttgaatgctttttctttctacctgtggtctatggaactcaaaatggaactcaattttaatatgaccaattttgtttgtaatcctatttatttcttttctgttttaaaatgttattcttcaaaaagacctataatataacattcaaataggaatttttacattatagattttaaataattttcctatgatctatttaaaaattttctcttatattattttctctaaaatattaaattacagattttatttgatgcattattaataaaagttcaaatttatgagtttctaaaggtattttaatagttaattttgacagctatctcatcaacatgtctaaaattttattattttctcttactcctattcctttgtcaaggctcaaatcaggagtcacctctgtttcttacttctcactctgcagtcctattgattctgactactaaaaatatcttagtttcttcacttctctccaacagcaacttggttgtctctatcttagacaaaattgccatcaccactcatttgtgttagtccaacattctccatgtggaagctaaacagatctcctaaagaaatgaaagtaatcttgccccatcccttactaccaacttcaaaaacttgaaaggcttcttaccttgcagtagtagtgtttgaagtactcatatctcaatatctgctaatatgcattaaaaacaaaatagaacaaaacctcatcagttaaatattttaaaaaggcattttaattgtatgtatatgtctgtatttgtgttcattttatttatagtaaggttaaaaaatttgtgctttacttggatatttgttatttgagggaggtgacatatctcttcatataatttgttcatattattttgtcttattttttgtaataatttaattaaaaattttaaaccttattatgccacttagggtctgaatatttttatagttgtatttgacaaaaagatgcttttaagtttttacatttattcacatctatcaatacctttatgagtttgggtgtgtatgtgggtgtgttcactggcaaatatttacttattttattctaacaccatatttatgttacttccttacttttacaattttatctgtaatttgtttttatataatttgaattaggaatatcacagacttttttttttcagaattaatcagcatcatttattgaacaatgctacttttccaccaatttttaaattctatggttatttatattcaaagtcctagtcttctttctattatagtctgaccatctgacactattttaacactattcaaattatgcgcttttaatgtatatttaaatatttctccttatcttaggattttcatcttcaagaaaatctttagcaattcatttggttccttgggaaaacatgctgctggtacttttatttggagtgcattttatttacaatattcttttagagaatttatgtcttttcaatattgatcaatctcatggaagaatatgtcatggcattccacttactcaagtatacttttttatctctcaagaaattcttgccattttcatcatatcagatctacaaaattcctttaaacttatatgtagttattatgcattatattcactgttacaaatattatgttccaacttttatattccttatttcacttaactgtctaaatttattggctatggggaataaaaaatagtaaagctaaaaatgatcacctttatatcattgctgactttaatgggaatgtacctatagttaaaataataagtatgatattacctgtgaatttggaacagccatttttaatcatgattatgaattatacttttatgcatattttaaattttctttttaaatcaaagttttttttacttttagcattttaaatatatctaataaatactttttatgtattactataattgagagatagctcatgaaatcaagatattttagaaaaattcagaattttcctaaccgtaatagtcagagatttggaaagcccaactcttaattttatttttctttgcttattccttcttttcttctattgcagacagttttcttcatgttccaaaaattaagctactgaaagctttggtcgtttgagagactcctctgaagctccttctggctccaagtccagaaatcattcagaaggcttttctcccaacttttggaccaagtagtctggaccaagataaatgtgtttcattgcacaatatggcttatcttgtagtgatatgtgatttttcactggcattagggggcatttcccaagaaaagtactggcaggtggtcttcatttcaagaactctgcagtattttacttgttgagtgctatttgcatttatagtgtaaatgagattagtcaatgggatttttaaaatttactatcagtattatttttaggttttggtatcagagtatcagaaatgttctggcctgataaaatgaagttgggacacttctgtcatctcataattctgtcaaaatctgtgcaggtttctattcagatctttagatacttagaagtgggcaaagtttctatttcctatagtgttattctgttaagttgggtttcagatagccataggaatagagagagttccttagaaggcatctgagttgaagggacactcactttttgctgaccactttcttttctgtggttgtaaaagcagtctgaatttttcaacagtgacgtccccactccacttctatatttgacctgaataccattttgaagaactagctgaaataatgccagaaccttgcctatcatgtcaaatctgtcaggtaatagatgaagatgaatacagtttttagagtctcccttgactatgcccagtagcaattcccaagatctttataggcttgggaattctatgccatattttgcacttgtctaaatctgcctccattcatgctactccaagtttgggcatactcccttcacctttatttggtcttcatatcagttgtttgtaagaaataggaagtaggaaataaggaaggtgtgcagagatatttggtcctatcagaagcttatttttcctttgtctcctccttattttttgttttaggtcaaagctagtttagccattcttatctgcctttcttgaatttgctccctgctttagtatacagacactctgcgccccataaatcatggaaatgagcattaattttacattttgaattgtggactctgcaggtttctaaaattgcttgatttccctaccctccaccaaccaacaacaaatatctactttcttcccgagccctgcttcttcatgctatggacatttctgcagaaactgctagaattctatcactaaccttcctggtggggctctccttagcatatgctctggttttacatgattctttattttctcaactctagttttatatgattcttcattttctcaactcaactgtttctgtgttgaaatatttatatattgataagctgtgttttccagagctgatataatttattcatttcaaaaacatattctcaaacagtgatatcatcaagatagtggagtaggattgtgatgtttaatattgagtgtcaacttgattggaggatgcaaagtattattcctgggtgtgtctgtgagggtgttgtcaaagaagattaacatttgagtcagtggactaggagaggcagacccaccctcaatctgggtgggcaccatttaatcagctgctagcgtggctaggatgaaagcaggcagaggaacgtggaaggactagactggctaagtcttctggcctccatctttctcccatgctggatgcttcttgccctcaaatgtcaaacatcaaattctttggcttttggactcttggacctacaccagtggtttgccaggggctctcaggccttcagccacagactgaaggctgcactgtcagcttccctgcttttgaggttttgggacttggactggcttccttgctcctcagcttgaagacagcctattgtgggacttcaccttcaccttgtgatcgtgtgagtcaatacaccttaataaactccccttcatatatacatctatgctattagtcctgtccctccagagaaccttgactaatacaaggagacactagccttcatctgtccatacacaaaaaatatggacaactatttacaaaccaaaataccccagaagcagcccacagtcacattaaagaatctgcagcaacccagtggagcaaaaatatggagaatatccacatagaatcactggtaagaacagcatacccaagtacctgagatgccagaagaaagctaggagtaaagaagaatggtataggctatcagcatggttcattgacaggaaccgctgtggttaccagtatcctggtccacagagaacacaggcatctcttgccactgaggtaaccaatagcctcaaccactttaacaatcctctgttaaaagaggggctgcacgctcctccccttcaagaagtggccactgttgaaagtagaggtgctcctttctcaaaatgtatacccatctcttccaaccctgagtatatgcactgaccctggaactgtggctacttcacgagtgaccataccccagacctgggctctgtgactacaataggcgtgatcatgtttcatataccacagccattgccatagtgagctagattgtattgcaagacccagagccaagtcctctctgtggatgcccatcctctagacacaagctcagctactctataaagagctaggttctgctctaacctcagggccattttaactctgcatacacctgtgcactcctgcagactcctctgctgctttacaaacaccctttctttgaatactgttacagacttggcagtgggggagtcagtgccccaggtaccagttctattatcaccctgggttccagagccatagccccttcatgtttgcccatgcttcaggcctaacctcacctctctggcctctccatcagataccagtaccaccaccactacaaatgagtacacaagacagatacagttccaggacagattccccttagtaacaacttctctggtatgagaaaaggaggtcatgaggacattaaaaagtatcaccatcaaagactctaacaacacttgctgccactgtggacatatacagtgttggttgctgaggatcccctgaaatcttcatcaacactgacctcagttaccacagcagcacagagactacatttctggcattctcactggtaccagaaaagctgcactttatccagtaagttcccttgcaacaaccctagacaaaggtctttccacatggaaactaacttataaagtctgcaagaggtccaacaaatgtgcagacatcaatgtaaaagcaacaagaaacatagaaagccaataagatttagcattatgaaaagaacaccatgatcacccagtagctaatccctctaaaaatggagatacgagaacagcatgacaaagaattcaaaataattgttttatggaagttcggtgaacttcaataaaatacagataaataattcaattaaataagaaaaataataagcaacaaaaatgatagagaaatcaaaattataaaaaataacaaacaaaacttctagagctgaaaaaatacgatgcaatggaaagtgtcaaagcagaattagtcaagcagaaaaaaaaatctgtgaatttgaagacaggctattttaaaacacaaaggagaacaaagaaaaaaagaaaaaaaattaatgaagaaagcttatgggctttattggatagcatcaaatacaaatattcaagttataagagtttaagaaggtgaggaaagagaccagaggtagaaagctcatctaaagaaatgatagcacaaaactttccaaacccgagaaagataaaaattattcaggtacaagaaggtccaaaatctgtagtcagattaaatccaaaaaagactacaccaagacataatcaaattatcaaaaaacaaataaaaagaggggaccccaaaagcaccaagagaaaagaagcaaataaggtagttccaataagactagcagtgcacttctcagcagaaaccttatagtccatgactaaatggtatgatatattcaaaatgctgaagggaaaaacaacctgccaaccaaaaataagttttatccagtgatatggttgggctttgtgttcccactcaaatcttaaattgtaatccctataatcctcacacatcaagggcaggagtaggtggaggtaattggatcatgggggcagcttccgacacactgttctcatgatagtaagtgagtctcacaaggtgtcatggttgtataagtgtctggcatttcccctgcttgcactcagtccatcctgccaccctgtaaagaaggtgcctacttctcctttgccttccaccatgattgaaagtttcctgaaacttcctcagctatgaagaactgtgagtcaattaaacctcttccctttataaattacccagtctcaggtatttcttcatatcagtgtaagaacagacaaatacatccagcaaagctgtcttttacatatgagacaagatacatacattcccagatgaataaaacctgagggagttcatcatcaccagacttttccaagaaatgctaaagggagctgaaaggatactaatgagtcacacaaaaaccctgaaaatataaaacccactggtaaaagtaagtaaacaatcaaattcagaatactctaataatgtaataatactgtgtgaatcacttgtatctttagtataacggttgaaagacaaaactattaaaataataatagctaaaataatttttaaggggtaaaataaaaatatgtaaattgtgacatcaaaaacataaaatggggggtggaatgaaagcatagatttattttatgcaatcaaagtttttgtctgcttaaaatggcctgtaataactgtaaactgttttatgtaagaattttggtaagcaaaatgcaaaacctatagtagatactcaaaagattaaaagcaaggaaccaaaacatatcactggagaaaatcaccaaatcagtaaagaagacagctaaaaaatgaagaaaggaacaaaggacctaaaaaacaacagcaacaataacaaaatggcagtagtaagtccttacatattaataatgatcctcaatataaatgattacatcttccagtcaaaagatgtaagggggctgaatgggtcaaaaaaaaaaaaaccaaaaaaaaaaaaaaacaagatctaactatatgctgcctacaagagcctcactttacttctaaaaaccatgtataaaagtgaaaggttgggaaaacatattctatacaaacagaaaccaaaagatagcggggatagctaaacttatatcagatacagtagatcttaagtcaaaaactacaaaaagagaaaaagaatatcattatatgataaaggaataacttcattatgaagatacaaaaattataaatgtgcacctaacatcagaatacctaagcatataaaccaaatattaatagatctggagagaaagaggctgcaatacaataatggaaggggacttcaatatccaactttcaacaaagaatacatcatccagactagaaaaataataaggaaacactggacttgaactatactctttagaccaaatggacaaaacagacatatgcaaaccattccatccaacagcagaacaatacattttcttctcaagggaacatggaacattccccaggatagatcatatgctaggctacaaaataagtcttaacacatgtaagaagattaaaatgatcaagtatcttttttttgaagatgttctttcttcacttctctattcatgtatctgccagatttccaaaataatatcagtcatgatagttttatatcaaaagtcaagaaagtatttcactgacataaaatatttaagactaagcatcatgcttggaatatgctcaaattagtatagcataatataaaaattaagcatatgttatttgtgggtttttttctcagtaaataagttgtattttccagtcaggtgattgagtaatggaccatgtcagacaagcactgcctttagatctctgaaatctgccagctaatggctatctctataataatgagttacctatcacctttttaaatctcttaccagccctttccttgcttagtctttgttattgttttattgtaagcacatacacatgcacaacatatgctctgtttcctgcaattttatatacatgtaatattttgagacagctttgaaagttggaaaattgtaaacctttcaaatattttggcttattgactacattttcatgatggataattatatctaattataattatatgtgtatatataattatatgtataccattaagaatagagtattctgaaaacgttttaaattgctgagtctttccagggaatagtatatgaaaaaaattagaatgaaaagtaaaggcaagaaaagttataaatggtaaaataaaaagcagtagtttatactttttaaataagtttacattaaaaaaaattgagttgaagtctcactctgctgcctaggctggtctagaattcctgggctcaagcaatcctcccacctcatcttcctgagtagctgggattacaggcatgtgccatggtgcccagcttgagtttacattttgaaaatacttcttttttcagattcaacaaaatctgcctattgacttgtttaatcctatcaaattaattttcttctctatatttacatttaaaatgcattcttatgtgattatatatttgcagcataatcctattctttctaaagggattttttaaaaaacaaggaagtcatcagaactagagtaaaatgttcattataggcattttgtgagttttcatttctgaacgatatttattttttctacttggcatgtaagcaatttttttaaaaacagcatttcagaggaacagattagatagtgatccaatgaatgaatactttataaatcttgtttttgtacattttattagttccttataaacatattagtgcttgaatgaatgtaaacatattaggacctgataaagtaactatgtgaaaattagccccatagccacattcccctttcatcttccacagagcatcatactaacaggttctaaaaattttaaaaatgaaacagatgaactcattataatatatttaagcttaagatgtcttttgaaaatcactcaaaatttggtaagaaatcatatgtttctaagataaagagaacaagttggaagctttttattccataaatattattaaatgcttataataaaatatgaataaaatgttttaactacttctaattattgatttagccttatttattacatgagaattttttttttgtgttagtcatgtacagggactgtagagataaaatcaaagtaaaagataaagtctttatgtatctgctcaattttgttgtgaacctaaccacttaaaagataaagtatatttttaaaaaagaaactttatcctcaagaggtttataatctaattaagaatattcactatacaagatagttctgtcataaagatataaatcagatggtataatacttttggtcctaatttggctatttttggaaattcctttttagttaattttacctttttattatggaaaatttcaaacacccacaaaagtggaatggtacaatgagcctccatgtaccatactcagcttcaaaaatcattcgttttatattatttacttttttgctcttctctcctctctcatctttcctgagatgtttcaatgcatgtcgtgacatcatgtcatttcactcataattacttcaatatgtatctttaatagggaaaaactttataaagcacataatcataatggcataattacatgaaaaaatagatagtaatttcttgatattatctaatacctaggcctcattcaaattccttcagctgtatagaattcattttagccatacaagctctgaaggaaatatttaagatataaaattaattttattcttttgacgcaataagaagacaattatgagtgctagttttctatgcctgtctcttctaaagcaaaataacaactgtcatcctgaaccgtctctgaattatctacacattccaaacggagtggcagtgtttattctcattttaactgagagatgtcagcaggtgcatgagcttctaaccttgtgatggcaatgtgatgtcatgaagcttttcagcaaaagaatacaattattgtcacgagcatcaatgcactactggtaattgcaatcatttttaaggagaaacaagaggaaggagaaatcttaccgaatgaaaaaaattaacagctctagaccatttttacataaattgcataaaattatgcttgcttatctaacttacctacagatttaatcaaaccacaaattatgttttagactttgaatatttgttacattataaaacattttctcaatatacttgtaaaattatagtgcatatattttaattttagttactcttacaataagaaatgtataacatggctaaaaatgtacaaaaccttaagaaattttttactggctgtttttccctaaagatataatttcccagtggggtaatagtttaaggtttcatagagacaatcttattctagttaaaaatatataaatacatgttattatttcatagaacaaaaattgcctcattttcaacaaaggtacacttaataaattattctacattacttttaatgattgacaatcaatattttaaacacggcattctgataatatgcttttaatttatataggtattttcttgcatgtttatgctattaggccattaattttgcatacataaaaattttgagagattcaaagataaaaatgcaacctgttccctaccccacccagcctggatatggatacatatggctcatatattgtttatatattataaatattgaatgcattcactcaggaaatgcaaatgtttaaaactatatcaagtccattctgattatcctcttatttccaatttttcttttattaagaagcctccatagaagaaaaggaatgcttaataggtttgtggatctcagcaaaattctagggcataataaagtatttgggatatagaggattataaaaaatgtggaatatttcttatttgggaaaagataaagctagaaactatgtttagaaagtttgtaactccttgaactaacaaaagtcacaatgagtcatttttttccttcataggaaggaaatccacatgcatttcaagcaattctaacttgatgaagagaatccattcagatataaagtaatatcaatggaacaagttttagcaaacctccaaaatataattttataattttaatatagggacatggaaataaaagttcaaaatgcattgaagaagaaaaatgaataatgaaagattctctaaatttatattctcagatccctttcttacatatagctatttttgacaatctctgtttttagtttttctggtgatataagttgtatgttttcgtatttcttaatatgtcacctctaagaaaaatccattgtttctccacaatgtgagttaagaattacttttctttccttgttccacttcctactccttaagagtttattttctttttataaatttagttagtaaaagttcagctttatttcagtctccaactattttaaactactatctttcaactacacacaatgaatgacgaagttagcaaccattaactttttttgtgggggagatggagtcttgctctgtcgcctaggctggagtgcagtggcacgatctcggctcactgcaacctctgcattccaggttcaagagaatctcctgtctcagcctcccgagtaactgggattacaggcctctgcctctacatatagttaatttttgtatttttggtagagatgaggtttcaatatgttggcaaggctggtctcgaactcctgacctcaagtgatctgcctgccttggtctcccaaagtgttgggatcacaggcgtgagccactgtgccaggccagcaaccattagcttttgtccagtttcctccatcttcccaaattctatctgatatgctagtactttaataatttcagttattaaaatgtatattagttagaattacctttaattttttactatagattcattctgaaagttgatttcaatgaatagactttataatattatgattatttaactactattgactacatattctggttggatttgtgcataaaaatataatttcttacatttaaaataactaagagtatattggaatgtttacatcaccaagaaatagtaaatgcttgagtggatagatattctatttaccttgatataatcactcattgtatgcctgtaccaaaatatctcttgtaccccataaatgtatacacctactatgtacccacaaaagttaatatgcatataattctttacctctagcaaaattttgctccctgaagtggtatatgcacacatgaagagcaataggattctactcttaaatgtaatgtcttttttagaatcaagtcatatttttgtttgttttatttcaacaaagacttcttaatgttctatttttacaagaatttcaaactgcctttatttttattatttttatcaaaaaatgccttttgttgtataactaatgtactccagctctgttatcacattatgtcttgaatgttccggtatgtaatgatattgtgctaggtcccttggccacctattattctgaaatttctttttgttgtattcctatctgatgtgcaatgtttcttgaattgcagtttatgctcagccaattattctgtcttgaaactgtctttcattttgctctagcgaaagtgtcttccaatcatttaaaggaaaatgcatgaaggtacattttctgaattcttacatgtctgaagtgtctttattttgctttcatattagattggtaataccaatggccagacgattgaatattcagaatcattttctgcaaatagaagacattttaccattgtctttcagaattcatagttgctaatatgaacaaatgctgacattttgcaggtaggggagaagaaagttcatgtgtttctaggctcttcttttgatttttgttctgaaatttaaccaaaattatgtaaatacgtgaaattgcttttgccctttgtggtgtatttaattctgaagactctgatctttagtagccatagaacagttcatgttatctctttaattcttccctctcctctcttaactcctctttttctggaaaatacaaatatggatattgactcttaagtttgttcaggctgccataacatatcaaaatatcataaactgggtagcttataaacaactgaaacttttttttctcacagttctggagactggaaagtccaagattagggtgctggcagatttgatgcctggtgagggccaatgtcatatttatagatggtgctatcttctctctgacctcacgtggtggaagaggcagatctggtgcctgggaaagccaatgtcatatttatagatggtgctatcttttctctgtcctcacgtggtggaaggggcagatctgatgcctggtgaggccaatgtcatatttatagatggtgctattttctctctgtactcatgtggtggaagggacagatttgatgcctggtgagggccgatttcatatttatagatggtgctatcttttctctgtcctcacgtggtggaaggggctagctagctctctgaagtctcttataaggtcactaataccattcatgagggctctgccctcatctaaacaccgcctaaaggcctcacttcctaacaccatcacgctgggcgttaggatttcaacataggaatttggcatggcgggggaacacagacatttcaaccatagcagtgaccttctgtattcatcttctatgtctctattttgttttccttttgtgttttatttttttagtttttcatctgaattggggagatagcttcatttttttactttcaacacttaacattaattttggttttatattcataattatagttttactttctgtgaactcttaatatctgattgcttcttttaaatgacagatttttttttcacatatgccatatatcttctggaatctttctgagaaagccaattataatttgttcttgaacttttgagtttttgtttcctcccttatcagtatgtgtattagtcagcttgggctgtcataacaatatactatagactaggtggctttaataacagacattaattttctcatagttctggaggctgaaagtcctaaatcagagtcccagcatggctagcttctagtcagaactctctttctggcttgcagattactgccttctttctgggctctcacatggcagacagagagaaagaagtatttcttcctcttcttaaaaggccaccaatcctattggttcaggaccccatccttatgaactcatttaaccttaattacctcataaaagccctatctccagaaacagtcacattgtcaggtagagtttcaacatgtgaattttggaggaacacaattcagtccatagcagtatatggtctttgtttttctcgtttctcttgttattgttttgttcatcttcctcagtgcttattgtttgcacatatttattaacgaaggactaaacatattaatgtacatggcttcttttggttttctctgctatcacatttctacaccctgaatgagtgtgctgattgcaggtgccatatatgtggaaaaacatggagtatggaaaaccagcttcttcttctgctccccctacctgcccattggaaagggaaaggaggaaagggagctttgtgagtaaaaagaagataacatctacctacattaagcattctcttgtgtggatgtgatctatgacttcctcgggttaggttaatctatttttgccattttatcttccttcactgcatttctcttgatgtaggtcttttgctcttgctgatatttcaatgattgactgaggatagaagaaaggagccaaaggcagtatgtgtgcccactctattatgttgaactagtaatttaaaaaaaacgagtatgtctgggaggctaaggcaggtggatctcttgaggtcaggaatttgagaccagcctagccaacatggtgacaccccatctctgctaaaaatataaaaataagccaggtgtggtggcaggtgcctgtaatcccagctactcgagaggctgaggcaggagaatcacttgaacctgggaggcggaggttgcagtgagccaagattgcaccactgcactccagtctgggggacagagtgggactctgtcttaaaaaaaaaaaaaaaaaagagtatgtcattaactttttaagtcataaaaatctgtgaagaaacaatatatgggtgaaatattttaaatgaaattacttgtaaattactgtggtgacaacttgtagtacatgccttgtagcacataaacaattagtgaaatagttgttgatgtaaaaaccaccaccgcctcctaacatttattgaacatgtctcatgtgtcaagcactgttttgagtacttaacgttcattaactttgttaatatgcacaagaatcctgtgagttttataccactattaactctattgactacatgttgtagattaggaaactgaacgtaaaacaattaacagacttgcccaaggtgaaacagctactaaatgacaagagccaagattaaattctgtagtctggctcctgagcctgcacatttaattacatcacattgaaaatattataatcacaaaaatgaattttatctgtaaaaattgaaaaacttactggttgttttatagtcactattattaaaatatttattttaaacaaattcagtagtaattttcttgagaagagttactcaaataagatgtgtcagtgttactttctataataagaacattaggcctagctctacccccagcactaccgccaactagttctattaatttgtttaccttctcttctcttcagttttcttttctgttccatgttcatttcattccacaaggaatatatattgactactacattacaggctctattataagagcattggagacattaatgaacagaagaaagagatactttcttcagggttcttatattccagagggagacatagtccagaagtaaatacaagctcaatatagacttttgcttccagcaatgaaaacagcttatttctaagcaattcttccattgagaactggaaacctaagcaaaacataaaatatcatttgttataaagcatgcgagagctactcaagtgagatttacagacatcaaaatctggaaagaatggaaacacctaaatagatgatcttgccagctgaagctgcttttccccttagtgtttttaattccaaagcatctattgaaaggctgggtggctgagcaggaagtggaagctgagaggttgagaacacaccaggattgtcaggaagcgaaacttagaaataaggcctgccaagagacaaactccctggctttcagttgagatgctgaagggctaggagttaagaatcaactagtaatagcccaggcctcagaaggatggaagaccagttttgaataaggtaggccttttaaatactttgtcccatagcccagatgaatgccagaagcaaaagaggacatactgatgattcaaagcaatgataacgattgttgaagacattttggtagaatagaaggcaagggaggaaaataccagtcctgctaagggttgaatgattatgaggttcatactgggttggaaaaggagtaaaagcaggagaggattcattagcccaggagaatgggaatagcttttaaactagaggtcatggtgactggatacagaaagttgtgatcaaaaagctagtttttccagctgaacagttcaaaaattgataatgataaacttcagagtatggcaaagtcaatgggttgctggagtgaaggaggaggtaattaaacaagaagaaactaagaaattgtgtggttaggtcgttggaggaattatccaaattggatagtgaaattgcaaacgatgctagcaggagtaaaaattgagggaagtgcaaagcctcttagaatcagaagtatttaaaacgttatattattagtatttatttaaggagattttaacttcaggcaaaacattcagagggaaaaaataaaaaccatttatcccttgtctaagggtcaatttgtttctctcacccccttcaatttttttattctttaatccttcatttaagaaaaaaatacaatttgaggaaaaaggatcttttaattactttaaaaatccagccaagtattgagagtcgacaaccttaaatttcatagctattattttattataagtaaattgctatgcttcacagtaatttctgaccatggaataatgacctaagctcactgtgcaacatctggtataccctatgttgactaaaaatcaattagaatttttaattatttttgcaacatctgcataacaatctaattcaaagccaaattaaatggtccttctggtgatggtgtataatgacacattcataacttaagaaaactgccctttcccagagcataagacttgaaaatattcagctcgcctttcctgatttagttgccagattatattgatatagttaatggtacacactgttatattttaatagattgtgacaccaaatataagaatcactttttaaattttctgaacacatcttttgactctagcacttaattttcttatcaaactatttttcatagttagccaacagttttaaataatcctcatataattaactgctgataatataatgttcatccttctggcttatcttgagctgttgccagtgctgtttaaatcttctcatgaggagagtcagatgcaaacagaaatataatagagtgaccagaaactccagagacaaagttggatgctcatttctaatcaacacagattcttttttttttttttttttttgacttatccctgaaattttattattaaaattacttgtttgacattgtttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaacttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatcgttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatgtgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttccgaaggaatggtaccagttcctccatgtacctctggtagaattcggctgtgaatccatctggtcctggactctttttggttggtaaactattgattattgtcacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtctctatttgattcttctctctttttttctttattagtcttgctagcggtctatcaattttgttgatcctttcaaaaaaccagctcctggattcattgattttttgaagggtttttttgtgtctctatttccttcagttctgctctgattttagttatttcttgccttctgctagcttttgaatgtgtttgctcttgcttttctagttcttttaattgtaatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaagtcactgaggacttgctttatgaatctgggtgctcctgtattgggtgcataaatatttaggatagttagctcctcttgttgaattgatccctttaccattatgtaatggccttctttgtctcttttgatctttgttggtttcaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcttttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacatagatttggtcttttcacatagtcccatagttcttggaggctttgctcatttctttttattcttttttctctaaacttcccttctcgcttcatttcattcatttcatcttccattgctgataccctttcttccagttgatcacatcggctcctgaggcttctgcattcttcacgtagttctcgagccttggttttcagctccatcagctcctttaagcacttctctggattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggagtaccctgccgtgtgaggtgtcagtatgcccctgctggggggtgcctcccagttaggctgcttgggggtcaggagtcagggacccacttgaggaggcagtcggcgggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctctacccagttcgagcttcctggctgctttgtttacctaagcaagcctgggcaatggcgggcgcccctcccccagcctcgctgctgccttgcagtttgatctcagactgctgtgctagcaatcagtgagactccgtgggcgtaggaccctccgagccaggtgtgggatgtaatctcatggttcgccgctttttaagccggtctgaaaagcgcaatattcgggtgggagtgacccgattttccaggtgcgtccatcacccctttctttgactcggaaagggaactccctgacccctcgcgcttcccaggtgaggcaatgcctcgccctgctttggctcacgcacggtgcgcgcacccactggcctgcgcccactgtctggcactccctagtgagatgaacccggtacctcagatggaaatgcagaaatcaccgtcttctgcgtcggtcacgctgggagctgtagaccggagctgttcctattcggccatcttggctcctccccttctctaatcaacacagattctaatcacctcagatttcagtttttaatccttgattaattctaattacctagaacaatcatttttatttctctgtgataatttttgacatctctctgttcttcaacaggatgctgttatttaaaaagaaaacaaaaataaaactttcaccaaaattgcattaatctgtacatgatgggtacatgtgattgatctctgttgtttgcattctacatataattgcattttggtaaacagtagctacttttcaatgctaaaagctcagccattaattttctgcagtatagaattctcttgaaatatttcactgtttctcactgctctaattgctttaggaatttcctttaatacatattttgtatatatttttatacgtattttaagtttttctaggtaaatgtaagtccatgatttcttctactatttttggagtttggaattatcttaattttgtcataaatttctgtgaatatttgttttgctggtacaaacaaagatttgataattttctaagcactcccagaagctttgaataaataattttggtaaccacatgatgatatttatgaaatacataaagctcttaaagtttagggcaacctaaaccagtgtgaatcagactttaatgtgcatacttgtcccctggggatcttgtgaaaaaatcagattcagatttagtatgaaggaggtaaggtctgagattatattaatacatttctaataagttgtcaggtgatgcctaagctgctagtacccagactataatttgagaaaaaaagaaataaataactttatgttttgatatgtttatttttatccagtaaaactgtattttagcaagtttattaattttctctacttgtaggttatatgctatcactctgtcctttcaccatagtactttgtagaaaaactgtctaatcttgtttatccagtttttcatcagccctgctgggactatatacaatcaaatttttgccccattactttccatgactgttttcttgatgttctatgtgaacttattcatctccaaatcatggctatttatgctgactggttataggaaattaaggagtagaggacaaagccaaattttaaggagacaaggagcactctacatcagagtaattgtggtaagaaaatctgtggtactagagttgttgacatttaaggagctaaacatggtgttgggcagggaggaaaatcccatgtgccaagaaggatattgtgaaatgagcaccttctgttacacatgaacatgttctcatgctgctagataatgttaaaccatactaattgagttcatgttaatccctcacccttactcactgtagttgtaactccttacgatcaccagatatatatcatatatatgatatatgatatatatatgatatatgatatatatatgatatatgatatatgatatatatatatatgagctatacctggtcatggtcatctttatttttctcttagtcaattgtgaactaggggataaggtgcaatgtgcagcatgggacagtatctatttaacagctctttataaacacacatctgtgtgtgtgtataaattgtttatatattatacacacatacaaccataataatggtttacaccagtttctgcagtttgccttcccatttgatcaccgaggacaatgtatggtcaatttctatccataaccattatccgttattttccctttcgtctacttcttatttgtcctgaaatctttctgcattgcacctaactggtgaaaagctttttcttgcttctcccacagactaaaactctatgaaacattattcatcaacacaatgctactagtatctctaaagtctttagttatgaattcttatctgtaaagtgagtgaggagatgagactagctgaatatctgataagagtatttactcctcaggaaaccgagtattcatacttatattcagagttgaatgcattagtttaaataacaagatattacttgcgaattttcattttcttgaaacaacccacagcaatactttatccttttataggattttgttttgttttggcataattatgttgatactttgaaagtaaccttaaaagcaataataaaattaaagggtatttattgatttcatttacatttttcttgacttttttattcatttgagatctattgtcttatccccatattaattaatcaaatgttaagtcttatattgggaattattgattatagcttcaaaaggaggtttgtttataatgattttgtgtatcccttttccccagtgacttccactgtaagttcaggttgtttaataaagacattgaatattattgatctatgaaatgtcatgccaatttctaattgcttgatttcagtgtaattccatattatatttttattcattcaattgttcattgaattagttgttcagcaattcatatcaacattatgtattatttccactagtcaatacaatgcaatggatatagctcaattgtaggattattatcacagaaatgtatccattttaccaatctctgttattttgtgtctcacaaatcattcttgcattgtaaaatggaatttctgataataagtatatgccacaaatctgtaagattacttaattgattcctatgtttttcatactgcattttaagtttcttttgctttttgtttggaaatccatttgctcaaagttaaaaaaagcaacacaagattgtcctgaatggtattgcctaggttgtcttccaggtttttatagttttaggttttacagttaagtctttaatccatcatgagttaatttttgcatatgatataatgaaggggtcctgtttcagtcttctgcatatggctagccagatattccagcaccatttattgaatagcgagtccattccccattgcttgtttttgtcaggtttgtcaaaaatcagatagttgtaggtgtgtggtcttatttctgggttctctattctgttccatttgtctgtgtgcctgtttttgtaccagtaccatgctgttttggttactgtagccctgtagtgtagtttgaagtcaggtagcgtgatgcctccagctttgttctttttgctttggattcagccattgaggaagacagtgtggcaactccttaaagacctaaggacagaaataacatttgacccagcaatcccattactggatatatacccaaaggaatataaatcattctgttatgaagttgtatgcacgcatatgttcattgcagcactattcacaacagcaaagacatggaatcaacccaaatttccatcaatgatagactggataaagaaaatgtggtacatatacaccatgggatactatggagccataaaaaagaatgagatcatgtcctttgcaggaagatggatggagctggaggccattatccttagcaaactaacacatgaacagaaaaccaaatagtgcttgttctcacttaatgggagaactaaatgataagtgggaactaaatgataagaacacatagacacatagaggggaacaaaacacactggggccttttggagggtggagggtgggaggaaggagaggatcaggagaaataacaaatgggtatgaggcttaatacgtgggtggcaaaataatctgtacaacaatccccattacacaagtttacataggttacataggtaaacttgtgtactgagggtttgttgtacatatttctttgctacccatgtattaagtgtcatgattatttcaggacacttgtacccctgaccttaaaatataagttaaaaacaacccacaaaatttcatttttctctttctgtctcttgtataaatacataattagttcaattaataaagggtacattttaatagaggaatcaacattatatactctttatgaaagaaaaagggaattaaatttaaaaagaaaatattctgtggcaacataatcctagataaccagaagtacatccttggtctaaatagctctgcctgacttgaacattattatctacttcctgtatcatcttacccttgagttcaaattggaccttgtttggcagatgcttatttttctcacaccacaacttacattcccttttgggatctgtgcaatttgtacttgatagctgctcttgctcaggtaaggctttatgatatttttccagtcccgtttcctaatcctcttccctccgtttcctgataagcccatctcaactgtttatttctgctcaaatacattaactattccaaagtctgtactggggcttctaaaaaatagaggtagacttataggaggatccaatcctgacacttaagataattctggtagtgacaataattatgtttttgctcctttatgttactctgatattagtcattaaaatatttaccaagcatactttatctttattttattcaaggtaaggcaagaaacagtaactcattcaaagttgctcggttatttgagaatgcaacatgttgcagaaatgaagtccagctgggcattctggagacaaatgctgagacttctgagatattgaaaaccattagggaaagaaattatgactcttgtcctcttgctctgttcctggggtcaccatcgctctgcctcatactgccttttatgtttgctctatccagcctcctctcaggaggaacttcctctgcttgcattcgatttttgctctgcaataactaaaactcttaaggaacctgattatcataacataactctgtataatcaaatgtccacctctgttccaatacattgtagcagaaggaggaaatgtgtatgttttaaaacatcaaaaaaaaattagtgaaaaagaggctgattgcagacaagtacccgaaacatgaccactgtaatctgccattttaatctatgtcttaataataaagtgatacatcagtcatgttttctttattgacaagaacataggatctcaaagatcttgatataatttcaatattgatgatttaagttgtttcagacaggacagcaattgccagtgaaaagcaaacaacaataagttgtttaaagtgtgagaaaactactttgtaaattaatgtcaactgaaaaaagctaagatgctaaggtgtgtattctttgaaattatattggttgtacaaaaaataaactttgtattaaggctattttaatattttcttatattttccacattattgtaaaagttgaatattagagattattaaatgatgtaagcatctcgtgaacaatatttagtaaatccttattttatgaactacaaataaaatctaggacttaagacatgggttgtttaaattgaaaatgctacttgaatgaaatcagaatgactcaaggcatcgcttctacactttttggctaaaatcaagtgtaaaatgactcagggatagagtcaaggttgcaagagttttcctacattaatatggagacagatgaaaaagacaactattttttttctgcttatattgttgtaaagattttaagttttgaaaaaatattaaggtaacaaatatcagctttgttttttccttgtaaattttttttttacataggtgaccagagtttcatgccattccttttgtaagaactgttaatatagctaaggaaaaattataacagtttctcaagtaacttcttgtgtgttttatcataaaaacccatttaagtgtttctcagcataaggcaattttaagaacttgcattgttttaagataatacagtagccgaatcagtgttatattgtgtaaattttagagtatttttatcttcaagttatttttaatatatgtattgaattttaggtatttaacattgtactttcttctacaatatccctgtagatcattttcatttgagcacactttgagtttgtttattgtataaattcatctctttataacttttgtaatgtaataagggattctttggtattaagagaaactctggatctgagcagggctgatgtggaaaatggggcttgattccaaagggtgatggcagctatttcactgctctctctacagaagggcagttgcccagatagggtgtgtgtcttcaggtctcagcagcttggtagcaagaaactttctctcctgttttataacaatagttacttctaatatatactttgatattggtcttattaaaactcttttaaaaagaaatgtacctaataattgacaattctcattaattttcatttgatctaaaataagtgcactctccttgatattttatgctggcaaaacaaaataggttgtagataggatccattaaaaatgatctcttcatacatatatctaaataaagaaggagtaattctcatttgtgtttcatttatgatttatctttagtgttcttttttgtataatcaatttcgatgtccctttacattgatttgacttaaaagtctataattgtatgtgcaacttttcaataacatgtttattttgttagccaaagcaataaagattagagatgaggtaatccctcccaattctcccctggtattcctcaccaacaattttgtatcatgatctaatattaatcaagatgacattgtgatcaacaatcatatcaaaataaaaagcacagttgtgctgctgatagtgattatacataaataaatatcaggagattaacattgtttatctaaatactgatggggttcaaaacatactataccccaaatatggcaccttgccatttgagaaaacagtagaagtaggaaggtcactctcaccttccccccaacttcgttccccctgaagcaagctttaaaatctagctgacctttccctgaagtaggtcctaagacccttattccagaggtgcttaccctatacccagagaggaatatccttatccctgaaatgcaggagacaaagaagaatctacacaaacaggcctatggcattcccccattagtttattaccattagatcatgaccccttgtccatcatacttctccacaaatacccacttattcatcaaactaagaataatatacagattattttatatctttggatcttcatttctgaagccttctgtgtcatgtaaaacttaaatttgtatgcttttatcttgataatttgtcttttgttataggtgcctcaaccatgaatctacctatgagcaaataaaagataatactttttctcctcacaataccattaaatattgtattacataattctatgggaaagtatatctaagatttgtttgcagctggtgttggtagattatttcccaaaagattgtcatgattcacaaccccaacaacaatggatacagtgctatctttttaatccttgcctgagtgcatgttgtttttctttataacttttctctactcagaagaataaaaaagtcatctcattgttgtcttaacttgtctcttactaacagtgagatagattatctttagatgagtatatggatgatatataatttctgttctgtgaaaatcttattcatattccttacaattttttatttatcattttaatacaaatttataggtacttcttgtcagacatttatttacatgccagaagttttgcacatgtatctcccagcctatcattgttttgtgtgtgtgtgtgtttttttactatttagaaattagacttttgtaattaagtaagcctatattttgtttatggatttgttcctgttttgcttaataagatcccttctaattcaagtttacttttttgaagttttttacattgaaatgtaaaatagtacccagtcttacaagttaaaacccagagacacagagagtttaataatttgttgggtaactctatagctctttttagttactagtaactatgctataatgatcataactattaataatatctggcatctcttctgaacatctgctattaggtactggcaaccttttatactctatttcttttttgagacagagtcttgctctgttgcaccacctggagtacagtggtacaatcatggttcattgtagcctcaagctcctgggctcaagtgattctccaccttagcctcccaagtagctggaaccacagttatgtaccaccatagttagctaattttaaaattttttttgtagagacagggtcttgctatatttctcaggctggtcttgaactgggttcaaccagtcctcccatctcagcctcctaaaatgctaggattatatttatggccactgctcccagccctctatttaaaggccctaaatgttcttcagaaaaccacccttgatagccatgaattgttgctctcactctcaggtccaagctgattttgactggattaagctagtctccacatctcattcccagtacaattagagccagtggatctctagggaaattgagatgaaggtagctaaaaaggagcctttcactattcctcttgatttggtgatgttaagctgcaacacttagaatgtctgccactgtatgcctatgattatggaagccagctgaagatagctaatacccagaagaagcatggcccaaacagagatgctgtgatttataagatgtgaatcaagggtgctttgcttgatgccttgcttcaaaggcaacttgccctttcatttaaaagagccacaagatttccttttttgcagtaagccattttcagatggttcctctttccttctccctgtacatcatagagagtcatcagagacattggttaattatgaaatgcaaactatggaatggaggaagaatctcatccttaaatgtcctgatgcaatctcaagtcaacttaacctaaattatattattatatttaatttacaatataaacacttaccttttactcttggagagtaaaaggagagaataggtacaatgaagaatctacatgtggtaactttgatactatccaaaactttttctaagccttttaactttgtagtgtaagtaatatgacatttttttccctatactgtgtccttcctaagttattttgtaacatcatcatggatcttacttttatgcataaccttttagtttttaacagccaggtgtggtaaggaataaaagttatttttaacattgacctcaggttctttcttatacaaaagcattctgtaattggaaggtagctgagtagacagctttagccatgaaacatgaggccttgaggtcatgggctgaaagagatagttgaactctgtggcatcagaagttatagtgattagagattggggcaagaacgaagatagaaatagaaaatgagggactttaaaaagaggagtttttgatattcagtttaagttattttttgtgctagagaaatatttttagaaagggcactctgtgcgtaggatggcatgttgttcaatgtattgaagcaaatttagctgcagtaggtcacaggtgattcctgataatgcttgaaaattacttttttcagtggaagagaaggaacttaggttactgtctttggtccagtctgcttgcattttggtaggagagaatgctattctgcaataaatagaatgttcatttttatttggaagttatctttttaggcaccagtgactaattatataatcaacagaacctcattttctgaagcagtactgtgcatgttatttcactaaattttttaaaaggtgataatacaaccataacacaaatgtaaaaatgaaagaggcacattaaggtttattgaatgctatgtcattttttatttaaaggtaagttaacagctatattcattttagcaaattaggccattgtttcttttttctattttgcttcaggtatgactactgtatatgccacataaagtagagcatcttaaaagaaaaagtatatatagtatattgatgtataaattaaattgactgctctatttcagataatttttgccaataatgcattttccatggaaaaaacaggctcctttccaaatggaatgaaacacatatcaacttgccagtgcatgaacagtctgtacctagtttggaaaattataagtaacgctggatccaaaacaaaagtatatgatataatgtttaatattttctcaattttttgacattggttggcaattttcctttaaatagtcattgttactgttcttggagaaaacatcagttgtggtaaagcacttttccaaattttgttaactagcttgaccttctttagaaatgacagaaggtagaagatgatactgcatttttccactcacatgtgtgtataatgcttcatatactgctaaatctttatagaagactaaacataaagagattgtgttagaggcaaataacagagtagatattgacatttgggggggtggtaactgagttagaaaaacaccattttgtctgaggtttcagtaactaactgtttaaacatcttctcagctgccttttgtaaagaaaaaaagcaatagtttttcctatgattttttctcccatatttgatcttcattatgatatcttgactactttttaaaataatataattgacaatgaaagacaattttgttggaaaatctggatttctatgatttcttttaaaacaatttgagattgtagtacctgtgaagattgatgttaaaaataattttatgtttcaaaaggtagcaataaattacgaacaacgtgagtgcagtttctttcacctaccatttggctcattaaagaaaaaaagtacctgacattcagtcattttatgaaaaatcatggactaacctttgtagaaatgtaaactttaacaagattatagtatctttgaaactaggagttatgtgacaaccaagttctgatgtccttataagcactctactggatgaccccctaacatgtagtattggccaaatttgtttacaatgtgtttattttgcatttcttcattggatttttttttatactagtccaactagcatgcctggtggtgtgttggaggaagcatggctaaatgtactcttatcgtttttaaaatgtcttgaatgaggcccagcatttgaagccaacttttgggaaatgcagttgggttactgacattggagccttacaactgcagtggaaatatatgatgacttgaaaagaaaatgggaaaacaatggtgacatttagaagaaaattaagtttggggttcagtgttgcttaggaaagtattgttctaatatatagtaaaaatgggagagatcaaagaatctcagtgaaaaaaaatcatagaattttgtgctcactatttgattgaggtagtattttctattcaagaaaatgtgtcagaaactagatagggaaagaaaaagaaataaaggaaaggaaaaaggaaggaaagaaggaaggagggaaggaaggaaggaaggatgaacggacagacggacggatggacgggaggaagtgagggaaactagacagagttatagggcaggctctcgacttttggaaaagggaacttaaccatttctaaaactcattcatcaatattgttcactgatgtcttcactttaaaaatttattggtggctaggaaatatattgtaatagtagtgagtccaactagcatgcctggtggtgtgttggaggaagcatggctaaaatgtactcttatcgtttttaaaatgtcttgaatgaggcccagcaaggtggctcacgccagtaatcctagcactttgggagggtgaggtgggtagatcacctgaggttaggagttcaagatcagcctggccaacatggcgaaaccccatctctactaaaaatacaaaagttagccaggcatggtggcatacacctgtaatcccagctgctcaggaggctgaggaaggagaattgcttgaacctgggaggtagaggttgtagtgagctgagatcgtgccactgtactccagcctgcacaatgagagtgagactccatctcaaaaaaaaaaaaaaagtcttgaatatttaacaataccttttgaaggatccttaaaatagatttcctgacttttacatatgaatgatgaaagatttttttttttttgaaatggagtctcactctattgcccaggttggagtgcagtggtgcgatcttggctcactggaacctctgcctcctaggttcaagcaattcttgtgcctcagcctcctgagtatctgggactacaggtacgtgccaccatgcctggctaatttttatattcttagtagagatggggtttcaccatgttgaccaggctggtctcaagctcctgacctcaggtgatctgctcaccatggcctcccaaagttctgggattatgatgtaagtaaccagcctggcagaaagattttttagaagtataaaggctttgttttaagacaaccaaagatgatcatacgtctcttgctaaacatattaatttcatccatgcatctcatagcaagcattttttttgcatttaaattcactcactctaaaatatatcaaagttcttattcttggagaggtgaaatataagcactgtcaaatcaataaattaatttgtaaacacttatatttgcataagttaacctcaacaaatcatttttgaaagtgacagaattgtcagaattggtttgatttatgactcttgcccatgataaggaaatagtaccaaaaagattaaaagggactgcttttgaaacatttattaccctcctccttctttttttttccaaatgaaagcatttaatctaatcatctccataacatatgatgtatacagtggtgatgaatatactgacgtataccatgcattcagattcctatttttagagattacataagaaagaagtagtacattcaacttaaattcttcttagccataacaattattatttgaaatcttacccctagaatagttttcggtggaaaactggctatatgaaataaaacattaccttttcaatcatttctatgatgagccagtatcttagttcattcaggtggctataacagaataccataaactgggtagcttataagcaacagaaatttgtttctcacagttctaaaggattggaccatgagcaaggtgttgacacattccatgtctagtgaggcccacctgctttctgtttgatagatagtgccttttggcacggtagaagggaacaagacagctatctagcactaatcccattcatgacctaatgaccacccaaaggcaccacctcctaacactatcaccttaagagttaggatttcaaaatacagattttggggaggacccaagcattcagaccacagcgtttcaccccgacactctcaaattcatgttcttcttacatgcaaaatacatttgttctactccaacagccccaaaaatcttaactcatttcagaatctaccttaaagtccaagttcaatgtctcatctaaacatgatctaaatcagatatgggtgagactcaaggtacaattcattctgaggcaaatttctctccacctgtgaatctgtgaaatcagacctgttgtgtgtttacaaattacaatgatggggtagacacgtaacattagcattctagaagggagaaacattgaagaagaactggggcaataggatccaagtaagtccagaataataaagcttgagaataatctttgacttgaggatctgccctctgggccctctggggtcatagccctgcccacatggctttgggaagccccacccttgtagtgtcttcagtgtctctgtgcctgagcctccttgccatgctattgtgattgtctgtgatggcccccacctctgcagcagctctgtgcctgggtcttagcgctcatggcttttctgggcttgaatcttgcgctggtgatgatcagtagtctccgagcagccctgtccttatagttccatggagcatttccctagtggaatgtctctgtggagactctgacaatgaggcaattttctttctgggccctacatttctccagggagtccttctaaatctagatagaagcagccacattcccacaactttgctgggtacagtgcatgctgtacctgggtcagctggagccatcctaggtcagatgagctggtacttgggtcagctggagccatacctgggtcagccatacctgggtcagccccatacctgggtcaattgaggagtacagcaacagagtgcaggaagcagagcccatgatctgaggtggtgctgggcagccctggcccctcctttgaagttgttctgccctaagacccagtactctggccctgtgataggaggggcagctcctgatgatctttgaaatgccttaggggccattctttcattgtcctgatgaatagcacctgactattcataccaatttctttatcaaatagtcacttggccacaccttagtattctttccagaacacactttcttattccttttaatatggataggctgagaattttccaatttttaaagtgttgctttccttcagattaaaatattttaaattctctctttttactgtaagcaaaaataaatcatatttttttcaaatgtagttcactcacaagttctaccttccacaaaatactgggactcaaagacaattcggccaagttgtatgccactttataacacttttaggaggacacaaatattcgaattagcgtacccattatatgattaaaactaaaattctctttgggtcatatgccccttagaaatctttaaagaaatatatggatgaaaagtttagaatgattgatcaagaggaacctagattacaataagataaactcatactatttcactaattatactgtaacatgtatttttcataatggtttgttattcaatcacaaaataatctttttagtatggttcctatataaaatgaaatgtaacatttatcctgtgatatttaaaattgtcacctgagtagtatgtgaaagggatttttttctttaagcaatatattaagcatcaaagacacatgcataatttgaaatagtttcagttcatttcctcctttttatcttttctaacagagcatttatatgttgttcattactaatcattcaagaagaaaacattctcatattcttatattaacaggaaattgaatatggaccattacaatgagggtctatagtaatttaatatgacaaagaccgttagaaagcttcaaaattatttttaaggaaaacactaaccacctcatttatttgtgattttttttttttttgtaagggaatccaaaagtacaatatagtgatattgtgataagactccctatccatggccgggcgcggtggctcacgcctgtaatcccagcactttgggaggccgaggcgggtggatcacgaggtcaggagatcgagaccatcctggctaacaaggtgaaaccccgtctctactaaaaatacaaaaaatcagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaaaaaaaaagactccctatccattttgagaaactacaattgagtagcaaggtgtcagaaagtacaatcagttcttatatcaagattcttacatggtagaattgctggtttagaaaaatcagttcaaatttaaacgataatctgatcaactccttcttggaaaaataaaccttattattcataactttttaaaatttatattagtcaatcattatttattaggttttacaaaaaacataagcaaaaagtatagtaaactgttgattacattttacaatactctcttgtgaacaaagaagaaataataatatagaatgcttacatgcttatgttcatgtatgaagtttcctcagttgtgttgggctaatgtaaattgcccaaacttcttctaaatggcagaaaattagatcacaatgtggatgaacaaacagaaatatctctacatcattactttatataaccagaagtataagcatatattcccgtttgaagtattttgttaacaattaactttgctaaatatttgtaggtattttattgataaatggaaagtgctaatttttcaaatcaattagaatatttcaataaacaataaaagttgatttctaatttctcccaatattacacctggtaaattgctccagattttataatacaaattggagcagatgggactgtgagagtggctctgactgtggcaaatcaattttctttaaacatttcctgtgccagggtagggcccactcccatcatgtcttccctagagaacgccaccgcagcttcacccttccttaaaaataattttgggctgggcgtgatggctcacacctgtaatcccggcactttgggaggctgaagcaggtggatcacctgaggtcaggagttcaagaccaggctggacaacatggtgaaatcccgtctgtactaaaaatataaaaattagctgagcatagtggtgcacacctgtaatcccacctattcgggtggctgaggctggggaattgcttctacttgggtggcagaggtttcagtgagccgagatcgcgccattgcactccagcccgggcaacagaacgaaactccatctcaaaaaaaaaaaaaaaatcctttgaacactggggactctgtgtgcttttctgagtttacattttgtcatctaacctcaggaataataatattccctcccattcttcttcagtttgcataattatgactgtattaatgtttctatcctaattctcaaccaacttggcagtcaaaaaatatatattaaaaagctcagagcgtttgctatgaaaatcaggctagaaaatggccaaattcctataaaagctgtaacacctaaattctaactgtttttacacgtaattgcacttgtttaaaattttaggttcagtgggtacacatgtatgtttgttacatgggtatattgcataatgctgaggtttgggcttctaatgctctcattgcccaagtagtgaatatagtacatgatagatagtttttcaaccctttccctccattcaccctccccatttttggaatccccaatgtttgcatctgacaaaggactgatatccagagtctataaagaacttcaacaaaacaacaagaaaaaaaaaaaaacaaataaccccattaaaaagtgggcaaaggacataaacagacatttctcaaaagaagatgtataaccagccaaggaacttatgaaacactagcatcatcactagcatcatcagaaagatgctaatcagagtcacaatgagatgccatctcatacaagttaagatggctattattaaaaagtcagaaaataacagatgttgctaaggttgtggagaaaatggaacgcttatgtgctgttggtgggaatgcaaattagttcagcccctgtgaaagcagtttggagatttctcaaagtactaaaattagaattactgttcaacccagtaatcctattagtggatattcaactaaaggaaaataaatcattttaccaaaaagacacctacactcatatgtttatcacagcactattcacaatagcaaatacatggaatcaactcagctactcatcagtgatggattggttaaagaaaatatgttatctatacaccatagaatattacacagccataaaagagaacaaaacctttacagcaacatggatgcagctggaggccactatcctaagcaaattaacatagtaacagaaaaccaaataccacacattatcacttataagtggaaaccattgggtacacatgaacataattgtacatttttgtacatttttattctatattcttgccatctttatcttctaggttataggaagcattatgatctgtcacttaagctatattagattttggagtatgtgttttaaagtaattcaatttcctgtatatgtcaagggaagatcacctaattctgacccttaaaaagccctgttttgaaaaattttaatagtcattcacacttctagaaacacttcttcacaaactctagtttctttgttcttgctaacatcaattagtagtaagaattatataatattttatcaatgtattctaagagaagacaatgcctccaagatagtaaagacatgtggatcaaaattaggggtaaaattccaatatgtattataaattttaataactatttgaaatcattttatgtttatcatgtcatttaaaaatactaccagtgtttataaaattattcagtgatattaaagaatgataaggcaggcattaatcaggatcatcatgataggtatagaaaccactgcaatgaggttttgtggtggggagagagattgggctcgactccaaatataacaaggaaaaatgataatttatagccaaggaacagtgtgtgtggcaaggggtcagcggatggaaaattgctaagaagaaacatgaggagtaaggaggaattctggctaaactgacataaaaggattcttgctgaagacaggccaggagatcagacaacacctgtgggatggggtatggtggaggatgaggaacccgattagattttgagagtgaccagatactagcatgaagcagtattcttgctagaattaaacaatgcagaaataaacatggaagctcaaaagtcaaagcctggttgagcaaagagttcagaggaggctgagtaggttcagtcgggagagaatattgtcatcatgtttaaaattcattgctctgtatatctcaattatgtttgaaattttattcatatttttaaaagtaatgcaaagaaacagctttcaccattacaaaatttggctttcagcatataaaaaacaaaagaagacctctaataccagcagaactataacagaaaaacagctttactctgaatattaaagtgcaattataaaaatttaaaaacaatcacatgcacacacataatgataaagtagatctacctgctttactcgtgtaaaataaatatctttatgtctcagattgaatcgctctagtgtttattatatctgtcttgtattttagatttttattaggaaaaattaaataaagggtttgtaagtctacatactaatattctgaagtatttgcttaaaaaagaaatactttataaaagctttatagttagtaaatcaaactattggttgaaaagtgcaagtatttttaaaactaaatatatatgtttacaatcctgccctactgcctgatatttaatatctaaaaaacatcccgcaatcttaacaatctagtaatagactagatgactccttagtcccttttagcagttccttggggacctgtgggaagtctctcttcacaggaacatcttcatttgaagataagagctgttatccatgtgtgctctccatgaagggaggaggttcagagtttgaatggtgctaatgaagttccttgctgtgcaacacagagcacatgcaatttgacgttgatgcaaatgaccctaaatggtgtgatcacttcgtcagactgaatatactgttcctatagcaggtggctattctgcactggcagaaaccgttttaacactttcttcccatttgaacgcagctcttctaacagacaagtataacatattgtaatgtattttaatgatttaaaaacttatattaatctccactttagtaaataccacccccaccccaccaacaccaccatgttttcctgaaatttctatattcttgcttttatctgattagggaaaaactcaatccgtatgtatatatatatttttacttgtagagaaacacctaatatactgatttctcattcaaagattagccaatgtcttttcctggaagctgcctgagaagtaagaaaaaccgaggtgatacattggagttctatttcaatatgcttcttgatattttcctgtgtggcttctaatacccctgtcagattgaacagtgcatttttctgtaagtccatgctctttcctggaacctgactagatcctgcatgctaagattctgtatagaccttgatcaaattcatggacttatcatcacaattttgatttggaaaatgcttttatccttctctttttagtttccatcccatcatctatgtctcatttctgcttatgagctcttaatattacttgccttataagttaaaagtatacctttttaggtgctttcatttgcaaaattttagatatatttaattttgaaattcaaataatgtggtttgtattatttatatttgtatgtttcctgaagatttctgtcaatgttgtaagtcatctggtttgccagtttgattgctaatatttttctctgaaattcttgagaattattccttctcttttctaggtcatcatcctctttcctatttaataatggttaactggagaatcaaagtagatttctcataccccatcatccccaccacatcttttttttttttttttttttttttttttttttttttttttttttttgggacggagtctggctctgtcgcccaggctggagtgcagtgtagagatctcggctcactgcaagctccgcctccccggttcccgctattctcctgcctcagcctccagagtagctgggagtacaggcgcccaccaccacgcccggctaatttttttctatttttagtagaggcgggttttcaccacgttagccaggatggtctcgatatcctgacctcctgatcggcctgcctcggcctcccaaagtgctgggattacaggcgtgagccaccgcgcccggccatccctgccacatcttattaaacttcaactctttagctttgagtcacacatatttttcaatgcatcacattctttccatctctactggcactgatgtaggtcagaccctcatcatacctagcacagattttaggagtcttttatctccttgtcttcaactcttcgcttcctcttcaatctaacctttgttttccacccagtggtagctctttcaaagaaattttcttctaaataaaacctctcagagatacccatgacctacagatttagtttcaaatttttcagcatggtagataaggtcctctgtgacgttaagttgggctaacataatagctcctctttatactttaagtttcattgcaagcctcatgaagagtacttggagttcttccttatgactgttgtttcatgcatttgtgatttttgcggggagaatgggggtgtgctcactcttttttctctttctatacctggcaagcctctgttcatcttttaaatctcaaatatcattgccccctgaaaatttcccatttctctttgggtttcactaagtgattactcctgtgggttcccagtaaatgttatcgcaattcatcatttacgtttctggctgcctcagttcttgaagcagggacttggctgatgtataaccaggacgtgataagggatagacacacaggagacaattaacagatgtttgcgaactgacacaaactttttcattctttttaaatccttcgtcttgaacatatgttcttttaaaatgtattctccaatgtttcaaagtacatttttttgtgtgtctgaatagaattaggattataatgattttggaattaacttacttttgcattgtccatatccttatctgtctgtctgtctgcctgcctgtctatttatgtatctacattagctcaaggttttatatttattttagagggcttccttgaccttctgtaattaatgttttacacattatgaatgtaaccgtagcattcaataggtatactagataagctttctcaaggagaaaaaaataatattcaaattttaaatgataatttagaagcatgatataatttaacttttgaagtatgcaaatgataggctgctattccatcaaaataaaaataacacattcaaaagaattcacattctaacctatgaacttttccttttatttcaatgtaactctcatgcaattaattaaaactcagtggggtattgtggtgaaaattttaatatcatgcagttactttcattaataatatcatttctttggctaagtagaataacaattgagtttatccagctggaaaaagttagacaaagacacataggcaggtaactattgtctattaggtaagaagaaatgcagcttttcttttaacatatatcaaacgacatattctgcattttctaggattcctttaaactgttttatgtggtaactgtcagaagtttagataatttaggtagttatggagttaatagttttagaatatttctgttacaaaacataaatatctttgcgtaccacctataatgtcataaaaccctagactagaaatatctgtttggagacattaaataaattaaattgctaccttaagtaatatggtggattttaagttccaaacaagtcaacaaaaattagaattaaaacattctgaggttttttttactttatactttggaaatattaatcatgtagtctttgtatgtaaatgacagaaatcactatcatgaaaattagatagcagtttttttattaaaatagagtatttattctgcaagttattgcattcattatccaacagtatattaaaatgtactttgatcaccattgtatacttcatcaatgtgcttttgtgcttcattaattagtaactgactgaaagttaatgttcatcctgtgtcagtctgctctagatacatcattttgctattcaaggccaaatcacaaaatgattataaattaccagcagcatttatttgttttacttctcattatgacaaattcaaagatcaaactgatagcatatcacatacatagaataatacattttaatttaataagcaataggccaggcacatttctctatggggaataataaatgaattgattgaaagcagaaggaggttgtaagctttttgataatggtgcagagcttttacatgttgatttgaactttgaaaaaatatgtaatatccttgtctttctcatgaaatatgatgtattttagattttggtttcttgagggtactttaagggttatcttttcttgaaataacatttatttaggcctttagttacacagatttgcattgttggtagtcttcattcagatcacactaattttatttcaaaccatactcacttttgattatgaaacataaaggttgaaatccttcaaatctgaggcatctctctgacctaaatttcagatgacatttaagaatatgattaaacaaattttcaaataaaaacagctggagtgcaacagttttcgtacttttagatactttattttgccactggggaaattatagtaaattaagattaaggattctaagtgaaactctataatcctagtgggttgtttggtattggaaggtaaggaaaagattgttgaaagtcaaagacaaagattgagctctcagatcagtatacaccaattgtagagacaatgtagctggctatccaagttaatggcattagacctctgaaattaaacacgttgccttcagtatgaatctgtagtcaccaagcaaacttctgattatttgaccccctcctagtttttttttcttgcaaggagaaaatatagggtcagttatacaaacagctataattacttttctctttataaaaagggtggaggttacaaaagcattttgcggagacttatgaaataaaatggtgagaatgcaagtgaaaaagacattacaagacaccaaagactggctttttaaacaggcacaatctgaaataaaattgatatgagaatatgcctcagcagaagtgaccttgtcacaaagttttccaacagagctttgcaattcagtagaggtgactcactgaagaagatgcctaaatctaatttatttttaataaaatttattcattcattcacatgttgattggtaattcaacacatatttactacatttttattcaaagtattttgctggtcactggagctacagtattagccatacattccagaactttcttctcaagttgcttatagtcttcctacagcattgtagaatatagtcaatatatatttttatgacttctttccatccttaatttaccttaagtcctcgttcttgccaaccacagttctacaaacaacaacatttcaaaataatttatttaacagttatcataaatataatgaatcatatgtgcttaaataaaacacacatccagtaatttctaaattctagaaatttactgaaacaagattttaattcaaaacttcatcttgctatattataatttctttttttgctcaagttaatttacataagtgtcacttttggccaatgaaatatagtagctaaagtctatgcgccttgtttctccaaaatctttacaaatgccgctatttcatttaagaaaaaaaaattttgttacatattttgcaaaaagcttgaaggaaataaaaactttaaatcttttgcccccccaaaaacttctctgacatattttaagatggctattcagagggcctgcaaacagaagtatgcaaagctatattttatgggggagatttgcatctgtcgagaaaatctgccttgatgcagccaggctttctctgaggctctccctttttcaattttggaaagattaactgagaatctggcacatttaaaagtctgaaacatttaccatttattctctctgagggctgctatctttgaggtttcatctacataaaaagaccacctttgctagccaggcttcctctctcttcctcccataacctgtcttaccatcatcatctgtttttggccatgctctgagccccaattatttctgtaatctcaagatgttatataaacttctgtaccccattaagtggttggagtaattattctgtggttctcccctgtacacattaataaatttgtataccatttcttctattaatctgcctttgtcagtttacttttcagagaaccttcagagggtgaaggggaagttctcccttggcctctataggttccatcatagtttccaaataccaaaattaataatgatattttacctatacagtgagtagttttaagatgccttttgaggtatcaaattaatatttattattaatgtgtcaagcaatgtgttatttgtcacagaggcaagattgccagatgccagcttcattagagtgtaaaatttagggtactaaacattgatgatcactgggaagaattccagatgattgaagactgtgaagccaattgagttttgagcattaaatgaagtgttattaagaatgatctgacctcctctcatgaattgtttcttatgttttctctgttgtctctattgtaatttttgttcagtggaaattaaagtcactcaaggtctcaaattaaataataaaattgaaattgcacatattttctccttttgtggggaaagaggtactgagacaggaataatacatggtggttgcaggagaacagaaaattccaggcagcagtttcacatgacatattttggtaatgggtcctagagatgaaacataactaattttagtatgtttcatcatgttacataggcttcagtgggaaaacaaactctgtggacaacctagttacttattgcctttgaatatgaaatatttgactcagaaagttgacctttaaaaagtattagctttatatcatctaaattgagcaaatgtgtataggaaaggttatgtctcctcatggtcattctttatattattaaattttaatgatatgtttatttgttctcttaggagaaatagtcacaactaaaatattctttccagaatttaaagacttgaaaaacaaatatagttttaaaactcagtttacttgtaataatctaaaaacacaaatagcctaatgattacagagtgaagaagaaggacaattcttaaggcagtatttctggagggttatctgagaattatatgctgcttcttgcttgctttcttgatacgaactacaaattacttacaattccaaactattcccaagctcaactgacataaactacagttgtcccttgaaaaaacatggcattaaactgcgcaggtccacttatacttggaccttcttccacctctgccagccctgggacaacatggccagtatcctcctcttcctcggcctactcaacatggtgatgacaaggatgaagacctttatgataatccactgccacttaatggatagtaaatgtaatctctcttctgatttttagaataacattttcttttctatagagcttactttattgtaagaatacagtatataatacacgtaacatacaaaatatgtgttaaccgacttgttgatgttatcagtaaggcttcttgtccgcaagaaggctattagtagtttgttgttggttttttgttttgttttgttttgtttttgagatggagtcttgctctgtcacccatactagagtgcagtggcacaatatcggctcactgcaacttctgcctcctgggttcaagcaattctcctgcctcagcatcccgagtagctgggtttacaggtgcctgccaccatgaccggctaatttttgtatttttagtagagacggggtttcaccatcttggtcaggctgacctcccgatccacccgccttggcctctcacagtgctgggattacaggcatgagccgctgcgcctggcctattagtagttgtgttttatgagtcaaaggttgtatgcagattttctgctgtgtaggaattggcacttctaatccccatattgttccagggtcaactgtattggtttaaagttcatacttaaaatttttttctctttatattttttaatttaatttggctttatataaaatattgaaataactgaataattgttttagactcttagccaatcccctttctccaactctccatttcaagcatcctccaactctccatttcaagaaacctaacacatacgttatgcatctcagatttgcaacattatattctttcttcctgaggagaggatagaattttgaggattttccaagtcttcagccatggattctctgcatcatcttttatttattcccttttcctaagtggttcaaaatcatcaattttagaattaattttgcctcattgatatgaaggttttggattccatatatttgcttaacaaatgttcactgagctcttctatgttcctagtattgtggtaggtgctgaatctgcctcacctggctaaatgaaagtatagtatagataaggtgttcttccaaagctttatatctttcagttaccaactttctccatccaatttatgctgtaattgtttgtgacaatgtgggaaataggaatgatgatgtattagtttgtagaagtgtgaattgtctggagagaaatttggccgtacttagtgacattaagcatgcatattccttggactccaattattgaatttttacccgagagaaattttagcagaagtttaaagacactctctgtccttttccttttctcgctatgtgttgtagaggcaaaggaaaaaacttttaccttcactctctgaaggttcacttaaaagttaattgataaaaggcaaattagtatgagaaatgacatacaaatttattagcgtgcagggaggaaaaatcacagagccattactccaccacacaatgaggtacagatttttatatatcctttgtcttaggggaaagtgagatggggaagtgtggatgattttaagcaaggagagtaaatgattgtagggaaatgcaatgggcttggagaacataaaatggcctgggacaaagtctgttgggcctgcagaagaggcaatggttttgaaaaaagtttgtccaggtatgttgacagatttcagtctttcttcctgtcatatgagttcagttaatgaaaactcagggaagggaccagaggtaattgttttcttctttggtggatctgaactttaaccagaaaagggaatttcagagaccaacttcatccagtgttttggaagagatggaggggagagagaccttgaggcttctttttcagttcatcatgttaaaatgccatattttggagtatcagtttctgagccctaacattgtgtacatgcatgtatatgtgtgtttacgtgttcatcataaatttagaggctaaatacaactttaaggtgaaacgctagggtgtatgcctatgatgaattactatggagcaattagaaatagatatctacaaaccaacatgaatggttcccattaacacagttttaagtaaaaaagtatgatcaactcaccttaaatctgaaatgaataaagtcaggtgctgcataaaaatatttaggtcaacaatcagctgtacaaatgtatatgacagtggtcccataatattgcaacatcatattttactgtaccttttctatgtttaaatgtttagatacataaatacttaccattgtgttacaattgcctatagcattcagtacagtaacatgctatacaggtttgcagtctgggaacaataggctataccatataccatcagtcctcaacctttttggcactggggactagttttgtggaagacaatttttccatgaaccagggtcagggtgggggatggtttctggatgaaactgttctacctgaagtcatcaggcattggttagagtctcataagaggcacacaagctagattcctcgcatgtgcagttcacaaaaaggtttgcacacctgtgagaatctaatgccactactgatctgacaggaagcggagctcaggcagtaatgctcacccttgcctgccacttacctcagcccagtttctaacaggccacggaccagcaccggtctgtggactggggttgggacccctgccataggtgtgtaataggctgtatcatctggctttgtgtttggtacactctatgatgtctgcacaatgacaaaatcacctaataatacattttgtagaacaaatccccattaagtgacccagatctataatttaaaataacagtgggaaaccaaactagtataataaactcatttccaggccgggcacagtggggctctcgcctgtaatcccagcccgttgggaggctgaggcgggcagatcacgaggtcaagagatcaagaccatcctggccaacatggtggaaccccgtctctacaaaaactacaaaaaaattagccgggcgtggtggtgcacgcctgtaatcccagctactcgggaggctgagacaggagactctcttgaacctggaaggcagaggttgcagtgagccaagatcgtgccactgtgctccagcctggcaacagagcgagactccgtctcacaaaacaaaaaagcaacaacaacaacaaaaagaaacttgtttcccacccaaaagctggcagaaaataatttttaataatttcctgcatattatttatctgttttttgttttgaatgttgtatatttttctcaaatgattaccaatttcttagttttatatattgaactctttattgaataaaatctttgatctcattttatttatttttcccacttgggtaattgattaagaatgtattctctgctaggttacaataatattctcctgcacatccttttaactttatggctttatatattgcattcaggtgtttaattcacttacagtgcatatttgcaattggtgctagttggttcagcttttttcgcaataacaaataacttcaaaagctcatagacttaaaacagcaaaaatatatttctcattcatttgcgtgaaaagtgcaggtcaacactcatgggctctgccatcatgttttcatgttgtaactagactgaagaggcagaggcagcctctatcttagaaatataacagctgttttatcaaaatctgtccacctctagtctttaaacttcataaggtaagggacagagtctgtattttctactttctgtgaaacccttgtttatatctttcgctcatttttctatgtattgcttctgttttatcacaaatttgaaaggaaattttaaaaatgtttctatgccaatcttctgatgcttatacgcattttccgtatcttgccaactgtggctggttttctcactttgattatgccatgttttgatgaaaagttgtttatatttaaatggagttgagtttattaattattttcttcatagttataatttttgtctcactgagggaattcacgctattcaaaaataacaaaaattatctaatattcactaaaagagatttaaaactttgctttttacacttagatcttatatccacatagaaccatttattatttagctgttttaatttgttttgggaatatttgtgtggggaatgagatagaaatcgaataaactatttaaaagactaaatggatgagatctattcataaaatgattcagtgctatcttatgatgtatagaataaaatccaaactctttttctttcctacaagcgctgaatcctctggcctaccattcacactccagttcattccattaattcccttgcttattttgtcactatctgtggctttaattcagtttttcaagtattaaccactttcttttctctttccgtattatccatctcttacccaaagacttcctggttttttttttttttttgagatagagtctcactaagttggccaggctgaagagcaatggcacgatcttggctcactgtatcctctgcctcctgagtagctgggattacaggcatgcaccaccacacctggctaatttttgtatttttagtagagacagggtttcaccatgttggccaggctggtcttgaactcctgacctcaggtgatctgcccgcctcggcctcccaaagtgctgggattacaggcatgagccaccgtgccctgcctgacttcctgtttatttttgtgtgtcagtttaaatgctgtgtttttagggaggccttttctgcgccatctatttaaattgtcatttcccttcaatttctgaagctagttctgttttttacagaactcttatttttttcctttattttttgttcatttcattattactgatttctcttcattgtactcaagcttcatgaggcagaaaccatatacatgtatattttttacttttgctccttgaagcccatcaaattcctggcatttataggtgctgaacaaatgaacaattgaattatgtgtcctcatttccttcttactttcatctaattaatcatcatattgcctaggttcagtatcttccatattctcacattagtccatttttgttaaaaacttatgggcactgtcttattatataaatctatgctatttcttattgctactgccatattatagatctacattatttattaaattgtaagctgtttttttctcttttacctttcccttctacagttctatttctacacaatagatcttcctaattttctaactgcatggcttttctggttataattctttaactcttcttcatttgcttcaagaaaaaaacctaaatttgtaatatgtacacaatattctgttgattcaacattctattccagctaccttctcatttcttccactttttactgcataattttgtaaacgtttttgtaaatatttattttatttatattatatataaaatatttatattaaatacaaaactttatgttttgtataaataaacattgagttctattatctttttcgcatcaccaaatctcttttcctttctctctgtgtgtgcatatatgtgtatatatagtttttattgattgattgatttgtggaatatttcatgtatacatgaaaatgtaaagaataataagatgaacttcttgtacccatcaagaattagtgacttgtagccaatcacactttatatatgtccacccaactatctcaaaatactggataattttgaagcaaaatcagacactttatttcatctataaatactttggaatgcattttttttttttttttgagatggagtctcgcactgtcacccaggctggagtgcagtggtgcgatctcagctcactgcaggctctgccttctgggttcacaccattctctggcctcagcctgtctgtaatctcagcactttgggaggccaaagtggaaggatcccttgaggccaggagtttgacaccagtctgagcaatatagcaagaccccatctttacaaaaatatattttttttttgagacagagtttcactcttgttccctgggctagtgtgcaatggcccggtctcggctcactgcaacctccacctcctgggttcaagcgattctcctgcctcagcttgcagagtagctgggactacaggcgcctgccaccacacctggctaattttttatgtttttagcagagatggggtttcactgtgttagccaggatggtctgcatctcctgacttcgtgatcggcctgcctcggcctcccaaagtgctgggattacaggtgtgagccaccgcacccagcctggaatgcatttctgaaagagaacttttagggcataatttacatatacatagtaaagtacacaaatcttaagcagcttgatgcatttttacatatgtatacaattatataaacaacttacatcaggatatataatagaccatttacaccatactgcaatttttttcatggttctttccagatggcatcctctatgggtaaccactattctaacttcaatgaacattggttaattttgcctttattaagactttattaaccttagaggaatgtaatctaatggcatctctatggtgtctggtttcttccattaacataatattgctgagatgtatccaagtagtgggtgttagtgatttattcctttttggtgttgagtagcattccattatatacatatgccacaattatggtgaaaggcatttatattcttcctaatgtttgctttttatgaataaagctgatgtgcacattcgtgtatgagtcttttggtggatgtatgctcaacaaagtggggacatgttcaggcatattatatattacaaaaccattttccaaaatggttgaaaaattcacgctcccacaagcaatggatcaaagttctagctgattcacattttcgacaacattattagtcctctcaattatagctattttactgatttatattgatatctcattgtgttttgattgaaacttttctaataaattgtttgaccatgatacatatgcttctctgacattacttctggatttgtgctaattacaaataatgtggcatgcacattcttgtacatctttttacttggtgcagttaccaaatatccacctgatcctagtgattaatttgcagctatgcctactacagatcataatttctattcttatctttagcctggattttattatctacacttggccctaagactctctactttagcttgctgatttcagcagatttctgtgtctctcaatctgtatttagcaatgaacctttccctaattctagcatcatccataccttcggcaaaatgcaaagcttcatctgcactacagtcctaccatctcaccatcttggcatcagaaacaatggcgaataatctacagaatattatgagaatcattgggtaaaaataaaaggatggagaaggttttaatagagaaggcaaaatattatcatggaagaaaacagcagagacacgtaatagagtagaaatcagctggagaagtttatattgcatgtgttgagctcatcagaaagatgatatgtttggtagatgaaagaagagactagttggtaaaatgtcttgaaaattgatcagtttcgttttgatttaatagcaaatagtaatcagccatgaaagttctcaaattcagtttcttccatgaacatattttacatgatagtttttcttatttcacaaaagcataatcaattattaaaatttaaatgtaactatgaatacatactgtagtaaaatatttctttccttgtataaagcaaatcaataatttttagaattaaatattttctattgcacctttcttaaaaaaagaagtcttgatccatattttctcagtgcctaagtaatatattaggtgtgtgaattaactttctagattaatattggtagatgctctgtacctcctcctgtgaaatttatgaagattaagtccattcactcacagcacctgtgttagtaagaacattttaaaattttctcatgcactgtttaatttaatgatttactttttataaaggagagtgctagtaggtattattgtcattttatatctgatgaagaaattactgaaattaacttagccattgaggacaaggcttagatgcacaccggaatctactgattcaaaacccatacctctgtctaatgtgagttatctgccctcttcactgcatgatttccactcatgtgcattctaaaatacatctaagatacaattgggattctatctaggagggtttcattttatttttcctgcagattgcagggaatacttgttttcttctctggagaaagttgataatttgtcaggtgcaactgcctccgattttaggaagtcatttaagtaatttcccttccattaaggctaataagaaccttccctacttgtttaattttgtgctttctggacttcaatccatttacaatactttagaaagtactaaatttaactgtgatcctttatagtgtgaagtataattttttttataatgttatctattaagaattcttgagacaacaggttcaaatctatgcccatcaactctttctggttttgttttttctgagtgtgtgtgtgcgtgttaggaggggagcagggaggtggtgttcacaaccatgatagatattatactttccattttttattctattattattatactttaagttttagggtacatgtgcacaacgtgcaggtttgttacatatgtatacatgtgccatgttggtgtgctgcacccattaactcgtcatttagcattaggtatatctcctaatgctatcgctccctcctccccccaccccacaacagtccccggtgtgtgatgttcccttcctgtgtccatgtgttctcattgttcaattcccacctatgagtgagaacatgcggtgtttggttttttgtccttgtgatagttttctgagaatgatggtttccagcttcatccatgtccctacaaaggacatgaactcatcattttttatggctgcatagtattccatggtgtatatatgccacattttcttaatccagtctatcattgttggacatttgggttggttccaagtctttgctattgtgaatagtgccacaagaaacattcgtgtgtatgtgtctttatagcagcatgatttataatcctttgggtatatacccagtaatgggatgggaggtggagtctcgctctgtccccccaggctggagtgcagcagtcgggatctcggctcactgccaactccgcctcctgcgttcacgccattctcctgcctcagcctcccgagtagctggggactacaggctcccaccacacccagctaatttttttgcattttcagtagagacgggtttcaccgtgttagccgggatggtctcgatctcctgaccttgtgatctgcccgcctcggcctcccaaagtactgggattacaggcgtgagccatcgcacccagctgggtattgtactttcaaagagaaaagcaataaaaataaaagaaaaataaaagcagacgatcttttaaaagatctctataaaaattacataagtcattttgcagaaattattgtaaaactggttattcatctcagagacttgacttcaaaacaaaaatgaagagcctgaacattatccactgaatttttccattctgaaaattaaagccagaaaaatcccagatcactggaagcctttttgcagctatcagcttgattctatgttctaaattactggaacagtgatttatagtgactatttctaaccatttcacttacttttggctaaattgtctttgctttagagcaatggtaacctctttgactgtacatctaaaattctgttttaagtatatcccaattcttctgtgcctctgttgccatctcagttttccaagcttttgttttctctccctgttttcctcttcgtggtcttttaaatttattttgaatgctatatcttctggatgctaagttggttttcttacataccacagtgactagccagtcaccctcttgcactcatgaacagcaatctattgagttccatgtatcactaaacatctttcctagtgctgtttcaatcatattcatgttatattgctttctattatataggagctgtcccctctgggcattttctgcccatctcccccactatttccttttcactccaaactgccactttatatgtctctcatcattaaatgtgtagattgatcttactttctttcagaatttcttgactcagcaaattgagttttgatctttaattcagcttttaatgatggtagtgatggtggtgttctggtgatgtgtatgcaggtgtattttattcatagcttcttcaggttttaattctctaaacaaaatcccctctgcctattcataatccagccaatgtaatccccaggggcacagagaaagcagccttcaattagggattagtcaggccaggtcatggttggctaaggctcctggctgagcctcctactagatcccgctgtcactctcctactgttgtaattatggccacttttatttaaatacccctgccattttatttcaaagttattggctgattttttattttccctttcttccctatattaataatatttttaaatattttactgttaagtattgagggaaatcaaagtatttcactgcaaaatatacttctttgacaaattttgagaagtttgttaagaggacctgcaaacagaagtagccctgcaaagctgtccttttgcagggagatttgcatctgtagagaaaatctggcttgatgtagccaggttttctctaaggtcttcccttttcttaatgtaggaaagattgactgaaagtttaacacttttgaaaatctgaaagaaacacttaccatctattctctccgagggctgctttctgtgagatttcgtctacataaccagaccacttttgctggccagacctcctgttctccccatcccataacctttttatcaccataacctgttttgccatggtccaagcttttttctgtaaccttgctacaggaaaagggtcccaatccagaccccaaaagagagttcttggatcttgcgcaagaaagaattcagcgcaagtctgcagtgcaaagcaaaagcatgtttattaaaaaagtaaagtggtgaaagtacagattctccatagacaaagtaggacattcctgaaagtaagaggaagaacgcgtctaccctaggtacaatgcttgtatatatataggattaaaaaaaggtcatgaggagatgtgctctgttacaaggttttgtggtgaagaattagttttcttaattactatattttgcaagaatcaatattattatctttaaagtaaaattaggaatctctttgttctcaagatatcgggatatctggacactcccaagtctgggtctattcagtaaacattatcaatcggtttccttaaccataaacatctagaggccaggaacacctttcttccagggaatgcagcccagcaagtcccagcctcattgtcctagctcccactcaagatggagtcactctggttcgaacgtctctgacaacctcatgatgatagatacatttctgtaccccactaggggttgggggtagtcatgctgtggttctccctcatgtgttgtccctcccaccttaataaatttgtgtgccatttctcccattaatttccttttgtaacttgatttttcagtgacccttcagagggcaaaggggaagttttcccttggctcctatggcatgttttttgtttaaaataaaagtcaaaaacattgattaagttgacagtccattggtaagcatgtattaatagcatgtttttttctatgtgattttatatttaggaatctggatgaataccatactatttgaaaaaataaatttaatggttaccaaattgaagaataaagaaggttaaatcttggtaagctatattagatatactgtaggggatttcaatccatttttatgggtttgtttggtttaaatggagtgtttagttaataatactttgaatcgtgccttctattttatttactcacagatagctacaccattaaatgctctatttttaggagatttgctatttagactagtaataaaatgtccagggtaaatggagttttccactaggaaacatatttttatccacttatacatatcaagttattagctaataagctaataataggtgataacatattgaagaatgtaaatgagaaacactaggtttcattttggagaagtaaagacatctcttgtttcatattgttttacaattgaaaccacagatttatttacttaaaaaaaattaatagccattttccctatggcgcttcacagaaagttacccatttgtaacacttctttcagaatgttctccacaatcaatattttttatgggtggaactatgaaaaccaagaatcaatagttgattataataataatgacattagtaataaaagttgcaatgctttatgtaaatacagtgacttttttattgatctcaaaactgcttgtgtgtgtaattataatattggctgattcattcatattaaatacctatagcaaaaatagaatgagggcttgaagtcattggcgaatatttccatatgaaatgttatgtctcttatctttagtttagatatggatatttatgtttaattttttttgaattagcaaacatgtagtaaaactaacaggtgttcaaataacattcagaggggaaatgtcactattaatatgttttacacataaaatacaaatatctacatgtttaagtgccctaggataagttattataatttttcttttttctctctcagaattatatcttctttaaattattgatttccaaatatttctcttgagccaagacaccacgctgaattccacctgcctactttgtgtcatcacttagatatctaatagatattttaaacttaacatgtgcagatataaccttctgaacctgtttcttttttgcctcagtaaatgacaactccattttcccagttaacttggttcaaaaatcataaaatcaaccaccaattgatcacaacctgttacagatttctttgttccttcttcgcgctcactgctccacttgactagccttgaaaaataaaaattaaaataattttttttgagacgcagtttcgctcttgttgcccaggctggatggagtgccaaggccccgtttcagctcactgcaacctctgcctcccaggttcaagcgattctcctgccttagcctcccgagtagctgggattacaggtgcctgccaccacgcctggctaatttttgtatttttagtagagatgtgttggtcaggctggtctcgaactcctgacctccggcaatccgctcgccttgacctcccaaagtgctgggattacaggcgtgaaccaccgtgcccggcccgaataattttttaaaatgatggaatcattattggattttatttttctccaataccaaatattctaatatttagggaaacctattgggtttcttcagagtgtatgcagtatctgaccacttctcaccattttcatttttaaccacttatagtccaagctattattccatatcacctagattattacagtgatctccaaactggtttgcctgcttatccctgtgttccccttcacccccagccaaatctattctcaatacaaaagccagagtaattctattaaaatatatggagatcattgtactccttggctcacaaaactcattggctctttatttaacttaaaataaaagctgaagtccttctaattaccaacaagaccttacatgacttggagccctgttgctctctgaccttatctcctaatgctctgcctccttgctcactccaccccttactggtttccttgacttgattttaatagactaggtaattccattctcagggcctttgcacttgccattcctgccacctggaataatcttccctcaaatatctataggcattttttcctcacctgcttaagttcttgttcatatgttagtttcttagtgagctctttcctatctaaatattgtaaacatctctgacacctcctatctacattttgtgcttttttctccttagcacatattttttagttaggtttattgttctctgcctcttctctagaatgcatttttttctgtgaaggcagaacttttttctttttcttttcattactgtagctccagttcttgatgcataatagatgctaagcagtatcttgtgaatgcatggatggttcttcctattcctctccctataggaataaaaaatttggaagtaggcgagagaacactgcttagtgaatataaactaagaatggaagtacttatctcaaaggtttcaaatagaaactgatgttatgatgaatcattctttcaatctctttgtcacacagtgtggtcagggagcaagagctcctctaggtttgggaacaggatagcaatccactctaaaatcccatcctcctgttgtgttgggagaacattttgaattgagggtatggtaaaatactgtttcccaaacaacttactcattgaaacattgttggctggggtgtgtgtatgtaagggagagtagaacattctggaattatatgaaactaagtctgttttgctaaaacaaaatgaaagttctcagcattcactaggatttttaacgtcctgcaagtgattgattaagcttttccaacaactgatttttgtaacaaatttcatttaaagggatacaaatggcataataagatacatgatatatctttttattttcctgtattactttgtatctctcagtgctacccagaagacagtcactgatggtaatcaacaggcttctgtcactctgagagatagaaagagtggatgcaatttactttaaattctttttaaaccaacccttgatgcctggcttattgcagatacctggcccttttggctatcagtccttcagaggcatcagagaataaatacccatcacaacagctcctggtgttgtcctgggatagtggatgccgctttcttgaaaactgggtattccatctgttgataaggttgaccacaaatgttagcaatagtcccacataggtcattataatatttgtatcttaagtgtgattaatcttcttctttcagtttatctgtgaaactctcttatgcttttataagatattaatgggacattagtataatcttaaattaagattggttaatactgcactgttggtacataatttatgcttttagcaaagatggcttgtgatgtaaatattgcttaaaaacatcaatacaggacttcctggaagttccataacattttacccaatgatggggtagaggttaaaaggagtaatcaatgatttctttgatttttctcactgctgaggactatcctaagtgctttatatacatttacattaattcttaaaacaatctctcaagattggtattattagaaccactttattgataactaatctgagagtctcagagtggttaagttgatttacccaaggtcaagttgacagacggttaatctgcaaatacttactgaacatatactatgggtacagttattctactgagatgatacagacaacaaacagagttgcaatcctcatgtcttgccagatgataaaaacccacctacaggagtaccaaaattgttattatgaattaataatgtattcgtattcttgagattttgctcattgtagctgtcatttaaaacaaactttaggctgggtacggtggctcacgcctgtaatcccagcactgggaggctgaggcgggcagatcacctgaggccaggaattcgagaccagcctggccaagatggtgagaccctgtctctactaaaaatgcaaaaattacctgggtgggatggcatgcacctgaaatcccagctactcgggaggctgaggcaggaaaatcgcttgaacctgagaggcggaggttgcagcgagctgagatcatgccactgcactccagcataggcgacaaagcaagactatctaaaaaaatgaacaaacaaaaacaattaaaaaaaacccaaaaaactttattttgcaagtgtagacatgacaatgtattaacttaaattaacctgataactttagccaaatgtttattgtgttgtgttatttaacgttagataatattagtttgttttgtgtaaatagctgcaattacacattaaacaagaatgcaggaccagcctataactgtagctaatagcatatatatattatgttatagggtttacaaaatgattgttactttttgcagtatcacaataatcctatgaaattagtccattttgggggtgggggcaaggggagggatagcattaggacaaatacctaatgtatgcgaggcttaaaacatagatgatgggttgatgggtacagcaaaccaccatggcacatgtatacctacgtaacaaacctgcatgttctgcacatgtatcccagaacttaaagtatgataataataacaaaagaaattaatccattttaccgattaggaaactggagatcaacttggttaacaaatgctcaaagccatgtaccattaagtggaagagggggattcaaacccaagccctctgtgccatttttctagctcttttcaagataacaatggaagatgtgaactcactttctgatgttctatgattgaaaagaaacatgcttccacaaattgttctaattttactgcataattgagcagattatactataaattaatgtgttggcacagttaactatttcttgtttacttttctttccctaaggagtctgctactctgcaggaggccttttaaacagaaacatcccattaactttcttaacacagaggcgagaaaacaaacaacaacaagcatagctacaatcgctgttattaggcaccctgaaaagatgtaaccctgagcattggatagcagtaaatcatagaaggggggtgtcaggatggggaagccagaaagtctagcttactttttctcaaaatatgatctgctttagaatcctgagggagttgattaaacatgcagattcctgatctctggcccaaactactgaatctcagtctaacggcagagttcctaatgggcctgttttcataaagattcctggatgatggtttttgtttttcactcttgtacattaaatattaggactttgagaatctagttcattctgagtcatatgcttcagttaaggtactctgtctgcatagggtactctggctaatttaaacaaacaggaatttactaagagcacccaaaagttactgagacaagaagcagtattgggaataggaaggaatggagttaccttggggtctaggaagcaagaaccacaacatgaaaaatctgttcaggctattgtagctcagtctggatggatgctcgccgtttgtagtgtctttgtttgcatgcacaggtcatgtgttggtcccgtgtgtaatgggtaggtgggcccctgcagatgaaactggattgaatagggaaaagataagtccaaaaaggaaagggaaagaagggaaattaatactgagtagtccaaacatagcttttctacagtacaaaataatctagtttcactattgattgaagctaattgctattcctaagtaccctcctaataagacctagtctggaagggcccttcactcataaaaacaatgaggcatttaaatgctgatgatgggcctggcaccatagcttatgtctgtaatctcagcactttgggaggccgaagtggagaagtggaaggatcccttgaggccaggagtttgacacttgttccctaggctaatatgcaatggcctggtctcagctcactgcaacctctgcctcctgggttaaagcgatttttctgcctcagcctcccgactggctgggattacaggcgcccaccaccatgttcagctagtttttgtatttttagtagaggccaggtttcaccatgttggtcaggctggtgttgaactcctgacctcaggcaatctgcccaccttggcctacaaagtgctgagattacaggcgtgagccactatgcccggcccaaaataattttttttttaaaaatgagcaaggcatagtggcatgtgcctgtagtcctagctactggggaggctgagtcaggaggatcccatgggcctaggagtttgaggctgcagtgagccatgatcaggccactgcactccaggcaggatgacagtgcaagatactatctcaaaaaaataaaatgaataagtaaatgcctcttatgaaccctattgacatcaagtaggaatgagcactagagctttaagaggcctcagctcagcctatccagccctttggtggtgctgtgtgtctacaaaactttcctttgtacacagctactttttcccctacactcacctcaaaagggcttgtcaaggttgaggttgtagcccctagttattgaattgtttaattcaataacttgttttgtgaaaacgtagcagagataaataactttttctatgtaatagaacccacttaggatagttagctgattaaagtttatcatataactatagtgtccataccattaggtttccattgtctgcccttggccttaacatttcctcaacatagaacactcctccaaatcatatttctgactctttctcagcatttgtatttccgctcaaatggcattttctcaaagggaaatctttatgaacttcctcacaatgcccctgccttctactctatcctcactgcctgatcactccctagtctattatgatatttttccttcatagcagtcattatctgattaataagcatttttacttgtttaagattagtctctttatgctgcctcccaacatacaaacagtccccccaaactgtaaagtatctgctttcctcaacaggttatgaataagattgccatttatttaaagtaggacttgaatagatatttgttacttaaatccaaagctatcataatgccaatctctttaacaggggcacagaaggcccttcctttccattctatctttaaacacattatcatttatcctatgccttaaacagaatcgtgtttatagtttgctgaatatgctatatgctctttcatttttcatgaggatttctgttttttttttttctttgcatgcacagaatttaaaaaaaatttaaaaaaaggaaaagtcacaaggtggattaggttgctagaccttaaaacactccatgatttctttgtcttagtcatttcctttttttaattgctaaattttctttccagattccctgcttttcttttagtaagagtttaactgtaccttatacaaatcagtaattattctcttaataactagttatactacagggttagatagttggctcattcattaacaaagttaaacattttattttaaaacaagttttattttgtaaatataaccatttagcaataacttaaatttaagtttaagccataaatggaaaaattactacaacggtaaagcaacatgtaagtcagtctcaagagtgtttaaattttatgcaatgattaggaaggatgataggtatcagatctgaaactttataaactgtggacccttccctctcagcctatacaaaaatcaactcaaaatggattaaacacttaaatataggatctgaaactgtggaactactagaggaaagcataggggaaatggttcaggacagtcaacaaaaccaaaaatagacaatgaggttacataaaactgaaaagcttctgcacagcaaaggaaacaataagcaaggtgaatagacagcctgtagaataagagagaatatttgcaaattattcatctgaaaaggggctaatatccagactatataaggaattcaaacaagtcaacagcaaaacaacccccaaattattcaactaaaaaacgggcaaagcgtatgaatagacattcctcaaaagaagatattcagataaccaataatataaaatgatcaacatcactaatcatccagaaaatgcaaatcaaaaccacagtgagatatcatctcactccagttagaatagctaatataaaaaaagacaaaaaataataaatactagaaaagatgtggagaagaggcaactcttgtacaaggttgatgaaaatgtaaattagtgcagttattatggaagtcagtatggaacttcctcaaaaaactaacaataaaactcccatatgatccagcaatcctaccactggatatttatccaaaggaaaggaagtcggtatatttaacaggcatctgcacccccatgtttattgcagcactattcacagtagccaagatatggaatcaacctaaatgtccatcaacggatgaatggataaataaaatgtggtacatatacacaatggagtactatccagacataaaaaagaatggaattctgacatttaaggcaacaaggatgaaccggaagacattatgctaagtaaagtaaggcacagaaagataaaataccacatgttctcactcaggtgggagctaaaaaaaaagtgagctcttagaagaataaagtagaattatggttattagaggctgagaagtttagggaagagggaaagaaaaaaaggttggtccatgggtacaaaattatagcttgataggaggaataagttctagtgttcacagcattgcagagtaaatgtagttaacaataatttattgagtttttttttttttttttttttttttttttgagacggagtctcactctgtcacccaggctggagtgcagtggcacgatctccgctcactgcaagctctgcctcccaagttcacgccattctcctgcctcagactcctgagtagctgggactacaggcacccgccaccacgcccggctaattttttgtatttttagtagagatagggtttcaccgtgttagccaggatggtctcgatctcttgacctcgtgatccacctgtctcagcctcctaaagtgctgggattacaggcatgagccactgcgcctggctgtattgtgtattttcaaaaagctagaagagatgattttgaatgttcccaacataaaggtttgataaatgtttgaggttatggatatgctaattactctgatttgatcattacacattgtatatatatactgaaatatcactctgtaaccataaatacatacaatgattctatataaagataaaatgaaaagtaatgtttatgcttttattgtcaaatgtaattatatatatttaatttttgcttatgataagactattagagtctgcagataaatttaagtgcttaagaaattgaaacacatcagagttttacattgaaatgtgtggatctttcttcaagagtctcaagctcatgcttaactggacaattgaaaaatatcactctttactgatttatatcaagttttatttgtactaaaaactagttttagtacttacctttaattttctagtactaaaactaaaaactagttttagtacttacctttaattttctaaggaaagctagtaagatgctttggctaactttattgaagaataacttggtatgaaattatgatttgtgatagaaaaaagaacttagattttattatttattttcaaaaatcaaattaatgaaatatttagattgatcttttttgttagtcaataaattctgactgtggttgatcatggttttccagggcagacactatattaattttagtgtcatttgaaagaaaaatatgttacaactgagaatatactcatgaaaagataagtaacaatttaaacaatacacatcacaaataaagcagaacctattttttggaaagacttgctgtattattaaaagaggctactattggtttgattagtgtgacaaacttcatgatggagtgggaatttttaatggtcatggaaaattatttaatttcaggaggcgaaatattgatggatgagacattcaacaaagggttgatagagggagataggaaaggaaatagaaatgtacctggagacagatattgtcaatatgaccagggagaattaattgtgtatggaacagtgagatacatttgaaaatgtggtataggatagattatacagaattctgaggagtttaatactgcatttgtatccattagcaatggtgagctgtttaaaagaagtttttgaatctttagaatatttatttgaaaggtttgatatatttgttttccaagtgtgatctaaagatagatcacataataaaattgtctagagagttgctaaaaatgcatcaagctcccaaaccctaaccttctgatgtagtatgtttgggtgggaaccaggactacattttttagcaagatctcttattatttatcacttcacaataagtcttagaaccattggaggaggaactatagcctgtggagctcccttctctaaggttgctggagcccagtctctcatgcctctctcagcttattttcaaatataaaccatctcaaacattgtgactcaacaatacacctgaacaattaaagatgagtgcattttttttcctatgctaaacctcaaatgagtgaaatggaccacccaatagtcccatagctagctttttaaaatttttattttataaacatagaaattgactcttacggtcttaaagtttcaaagttatatttgttttatctgagttccttcctgaggaaaggaccttcaggcctctcaaaaaacgtgtcaaagaactgaaactcatcagatcaccatgtccagacaatgaaatactgaaccccctcattcatcatgattactttcttgccgctccctagttcctgttttcttacacattgtttcatttctttcctgctgtataaactcctagttttagtgtgtcaaggagatggatttgagaatgagctcccatggcctctgctgcagcacccaattaaaacctccttccttgacaatactcattgtcttagtggttggctttctgtgcggtgagcagcaggacctagaccaaacccttggtgtttcagtaacatgatcagaaattgtgatttgcttccaacctgtgttcaaagccaaggctctcagagaacatcattggtcacctttattagactgtcaccatattaagtaggactcttctgattgcatgatataaaatccagagactatgcaaacttagcaatatattttatagaagaataactttttggtagaaaaaattaggagtgccacttgggccttgttttgttttgtgtgtgtgtctgtgtatttttaaagtataagtctaaagtgacattcagaagagaaatgtaactctatacctttcattattgatgcatcgatttgaataatttgtgtaagttcttgggttaggcacacatggagtgtgtgtgaagagtaacgaagccttccatttgttcttcacaaatttttaaatgtgtctcctttattctttccattttgaaaaattaaatcattctcacgcctccatttgctaggtgtagatattcatatttggaaatctttgtatcctctgattgatgggtataagtctgtcatggaggttgccatgtaaagctaaatgcagaatttgttttctctatgaattgattgctcatgtaaaatcactttttactgctgctggtatttaacacataaatctatcatttactttttttttaagtgaaggagctactggtttatcatgtgtaggaaactttttttcactatgtcatcactaaatcgaaggtaaaattatgtttttttcctgaactatgaattctatgctttccttgaaatagataaaatagataaacaagtaaggtattagaggagtctggaaaatattcattagtatccacctttaggtttacctgaagtagtcaggattttctttttagtattccatttttatatgaagtaccattttatatcaacttcttttgttccattgtcagaatctaaagaaatattatctttctacctggcatttaaactggttctctatttttaatggatgatgtgcattgatttgaaataccttgataaataattatttaaatggatgaagagacaaattgttccagtaataaatatttaacctaggagtaggttaggcactttaaaaagctgtagtaatacatgcaaggcattttggttaatattcaaaaactgacctctgaaaataataaaaaatgtgttaattataatccaagacataccagagtaaacaccaatgaatcctcctttattttaccttgtctctcaatattctaattctgtaacaataaatatactcttaaaggtgaattttagacattatcaatttatctattagaaaattatatgatgctaattccatcatgatacatatttaacaatgtaataaattaattaagttaaacacaatttattagattaattacatggggcttaattagtaattaaataaactacactataacatatttacaccaatttatggaaaatgcttttctctttatctttattttttaattcctgacaacctggtagaagttaaactacagaaaaaacatctgcattctagattttgattattagtattctaaattacaaatgcttgtacttgaacaaattatattatggtaatttttttcctttaaagggagaatatcaatggttgaagatcaggctatttatcatcatctttgaaaaagcaaagtaacaatacagcccatttaggagacacattaatctcccatgtgactccagaagcaaacagaattttaaaaagcatcttcagaaattatttggaatatacttctgttctctaagaatatatctctaactttcttttaacaatttaagacataaaggcaacactagatactgatgcttcaggaagtgtcacagtagaaaagttttaacagagtttatagccctggggccttggaaggaaaagctaaaaactataagtagggtagtagtgaattacaatgataaaaactaaatgtcttccttttgcacattaagttatgttaaaacactgactggtaagttacagagctgcggtttgaacctacatttgtctgaaccaagtttccacacttttgaccacaataccttgatgcagtgattaagaaggtattttgttgaagcagataataggaattcatacacttcctctgtacttgctgaatgcatgatcttggacaagatacttaaggcctttgtctcaggtttttgttttttttgagatggagtcttgatctgttgcccaggctggagtgcaatggcgtgatctcagctcactgcaacctctgcctcccaagttcaagcgattctactgcctcagcctctcaagtagctgggattacaggcacctgccaccatgcccagctaatttttgtatttttagtagaggcggggtttcaccatgttggccagtctggtctcaaactcctgacccctcaggtcatctgcttacctcggcctcccaaagtgctggaatttcaggcttgagccaccacacccggcctcagttttttaattctaaatggagtgataatactataaaagtacttacttcatgtattagtccgttctcacaaagctataaagacatacctgagattgggtaattgacaaagaaaagatgtttaatcagctcacagttctgtgagctatacaggcttctgcttctgaagaggcctcaggaaacttacaatcatggcagaaggggaaggggaagtaagcacatcttcacatgagagcaaagtgggaggtgctacaatggataccccattctccatgatatgcttgtttcacattgcatgcctgtatcaaaacacctcgtgtaccccccgtaaatatatataccgactatgtacccacaacaatttaaaaaaataaaataaaatgacttctccccatctgtagattatctttaatttctttaaggtttattttacaggtcaaattccaacataaccatatttatcaatcttctattttatacttagtttttttatgtcttatttaagaaatcctacctttcccaagactttcacctttaatatttgactaaaagtctttttgttgttgttactgttcttttttttgtttgtttttgtttttgtttttgttttagacagagtcttgctctgttgcccaggctggagtgcagtggcacaatctgggctcactgcaacctccacctcctaggtgagttcgagtgattctcctgcctcagcctccggagtagctggaattacaggcgcccaccaccacacccagctaatttttttgtattttcaatagagacggggtttcatcaggtgagccaggctggtctcaaactcctgacctcaggttatccacccgcctcggtctcccaaagtgctgagattacaggcatgagccaccacacccggcctctactaaaaatcttaagttttgttattgacatttcattcctaggatcttctggagtttgtccttttatatggagtgagaagaggtcaaatttcatattttgttgttatcattgttcatatggaacattttgtgagtctctgtgaggcagaagttccatacaaaaaagtgtgtttggaagtaaaaagaaaaatcagaaaccagaagattctgaaaatgaaagattatcatgataaggaatcatattagcagtccagcatattaaatggaaggaatgtctgaaagcaccaagcaaagataacaagagatggacatcaaggaaaagatatgagttccaagagttaaaccatgaaaaacaaaactgtaaatacccggatttttaggggaaaaaaatagctgcagtaaaggcagtaatgaaacaataaagaaaatttcatttgcttaaaaaaatggagtctcaacactgaaagattcagcaatgaaagtataataatgaaaaatatatataacattagtttaacagttgaactcaacatctgtttacaaatttaaatttagacagtcttgctctagaatcactgctgtgtgaatctgtatgatttgacaattacaagtttgcatgacacactagatattattactatcgggctcaatttttttttttttttttttttttttgaagatggagtctctttgttgcccaggctggagtgcagtcatgtcatcttggctctgtgcaacctccgcctcctgagttcaagcaattctgctgcctcagcctcctgagtagctgtgactacaggtgcatgccaccacacctggctactttttgtaattttaatagagacggtgtttcaccatgttggccaggctggtctcgaactcctgacctcaggtgatcctcccaccttggcttcccaaagtgctggtattacaggcatgagacactgagcccaccctgaattttttctttttagaccaaagtactatagacaaaagcacacaaaagtcacactgatctctgtattccaactcctatctttggcatttcctatgaagttacagcgagactattttactcagcaaactatgtaccatgcaccatctgtggatggcagtggggaaaaagataacacaggaactcataatttaatacagtgtcagtacagtattatgagacaagataggatagaagcgggatcctcactattgaagagtctgcaagtgctataagatcctgcatggcagagagcgttcctcacgtggttagggagagaattacagtggagcaaaagaggcaataaattacaatcagcctatgtgactcagtgtcttcaaagttaataattgctaagaatctgaaatctaaaacaaatactgattattattaaactacagtgtaacacatactttcttcttggctatcaggtctttcttctttcaatacctggaggaaaaatactcaccatttaagccacttgcggaaagcccctttttgctttctaaaatttgcttcacaaaatgtatcattttctccttcctgtattcaaagcagttttagtcctattttagcaatttcaatgtgcattattttagttgtctgtctcctttaccacactatgaactcctgaagcatgatgtcaatatatttcttgtgtctaaaaagaaaaggaactcaacaattgactgttgaaagaatgagaatgaataaattgacaaataaatgaatgaactgaatgatcagcttgagaactcaaacatacaaaccaaaacagtatgccaatgggtattcatattttaaataacttaagcctcaaaaattgcatctcttgtgtttacattgaagtcaaggtctttggtccagctatcataccacaaaatagcgtgagtgcttcgcagcatcactgttactattctttcctccagttctccaatcccatcatccaaagtagtatttctctttctttcaatatagaaatgtcactattgaaaacctatcacatgttttattctattcaaagagaaagtaagacatgagccttagcattgcctcacccatattctcatgccctgcattgttaaagaagccactcagcagagctgtgctcttttaacactagcttgaaatttcatctctcagtgttgtcacagccaaatttttacaaatttgtgaatatccagttagagttcaattgtgagatcaacctttctcagcaactagatttccagccttttcttatgaggtcaggaaattcttgagtgttttccaagatgcacatgtttccagtttcacaaatagtaccaagacctaaatgaagctcctgattcctcccaggagtctagtaaagcacaaagcaaattctatccatttatggcccttctgtgcactaaaattacagctggtcctttgcaatttttatgtagagggaatttagtctctttattatctttgtacttgaaattatgaagagtcttattcaaagcaccgtacagtttcaaccaaagaacaggtatgtgccagatttaaaaatttggacaagaaattattaagtgactaatgtctgatcatagaacattgcacaatggacccgtttattttacatatcatcacaacttggattcgcacaacttgtgttttgcttgtaacttctatttcttgacttgattgctttgaaaagtttgcattctttaactagccttaattatttgtgtgtatgtgacatcacttttctctaaatggtcaaagttactttgaattttgttaatatccacttttaaatcaatgccaattgtcaaaatattaaatatataatttatctcaccaataaggaaactgaaattacctaaccaaggtactcattttatttaccattaattccctttattcagtcagtttgtgtctgttaagcgtgttgtttgtattaagcactatggtagatgctaaaaatgaagatatatatagcactgaacctaccctcaaaatacctaagaaaaagagcaaaagaaaaatcaaggtgaatggcctattacaatacagtgttttaagagctctgacagaggtaaggcaacaactttttcagaggaagaaactcataagcaaaggactggagaaaaagtagaaaggaattattaaaacatcaacgaagttaaaagactataggttttggagtcagaaacccagacttgtaacacaaacttacttagtatgtgactatttttgacttgtcccttcaacagcctcatcaataagagcaataaagtggtcagaatgacagccccaggaatcactgtagccatttcttcttagccattgcaaccaaggactacacgtgttaccaacccacagttctagctgaagcacctagccaactaactagcaacatttagggaattaaaatgtgaataatagtgaaattcaatatatattccgtcagtctcttgtgtatgatcccaaaagaaagacacaaaattgactttatgttcttcagaatccaacacaaggagagaatcctgattggtggcataatttagagcctgttacatataaacaaatcaattgctgcgaagagtcaaatctatttcccatcctgaggaatgagtacaatttgcactcatgcttcctcatggaatgatgtggcagtcctgggtcagcttgccttcagatctattcctcatgcctcttttgctctgctcaatgcttcagggtgctgatatgaaagctacttttttccagggttccctaatagttgacttctggctgggtataggcaatgggaagtgctgattgaattattggaagggagtagccaggctatttctccttcagcctcgctgtctaatgtaaagtctctagaagctgctgtgtctccttcctgggtctggctctcactctcagtgcacaggcacagcctcctttttccagggacctctgaccctctggcttcagaaactccatcttcttatattttccctccagcctaggcgtgttaactagtctgtcactattttctcatttgcttcattgtctcatttgacttctcaatgttcccatcatccatataaccattgccctgcattaaattccctctattttggcaacttaaagatgtttctggctgggcacagtggctcacacctgtaatcccagcactttgggaggctgaggtgggtggatcacatcaggtcaggagttggagaccagcctagcgaacatggtgaaacctcacctctactaaaagcacaaaaattagctgggcatggtggcagatgcctgcaatccgagctactcgggaggctgaggcaggagaatcgcttgaacctgggaggcagaggttgcagtgagccgagattgcaccactgcactccggcctgggtgacagagcaagactccatctcaaaaaaaaaaaaaaagatgtttctgtcttcacagatgaactgatattgagggcataagtttcatcatcaattatatcatgtctataataaaaatggtaagtttgtaagttatatttcttctaacatttatcagtgtgggctgggatataatgtaaaaacacagttcaaaaaaagtaattctacaattttaagagtagcaaaatgatgaatgcaaaatacccagctcattgatggctgattaatgaatgagaataaaactgagaatatatagaaacatagatagaagtaaaagtgatttagagacctccaaaacatatttttccccaactatcaagttttatataagtagtaaggtagtaagggcagagagtacttgtttctgactagtacctggaagaacaattaagagcactaccatactcctcaaaattcagctgagttggagataagataggcaacggtctacctgggacataaataaacaaatgttaatatagtttaggaataaatgatatcagaggaaaataatacataacaacatggtagtgacttgagatggggttgttgtggtggtggcacaatataaacactgaataatcagggaaggttactcttaggaggtgccctggaggaaagacctaaacgatctgatggtgccgaccttaatgaaaatccagggaaaacactaccggcaaaactacagcaaatgacaaggcccaaagtagaacaaatttggcatgacttgtttctgaatcagaaacttatacttgctagtttctcaggtgtcaaaaagtacaaaaaagagaagtacccccccaaaaaaagaccaatttgaaaatgtttttaagtggcaataaattcatttcaaaacaaacaaacaaacaaaccatggactatgtagttgtgaacagtgtaaactcccagaaaacactcggtggtaaacatatgttagtctaacttgctaaattagttgagcatgtattatgttccattgaccattctgagtactttaaatgtattaattcgtttaattcttatcacattatgaagtgatatggtttggctctgtgtccccacccaaatatcatgttgaattgtaattcccaatgttggaggtagagtctcgtgggaagtgattgaatcatgggggtgaaattcccccttgctgttctcatgatggagttctcatgagatctagttttttgaaagtttgtaggacttccataacttgaggtcttagatttaagtatttaatccattttgatttgatttttgtatatggtgaaagataggggactagtttgattcttctgcttacggatatctggttttcccagcaccatttattgaggagactttcttttccccagggtatgttcttggcacctttgtcaaaatcgacttcactataggtgtgtagatttgtttctaggttttctattttgttctatgggcctatgtgtgtggttttatgccagtatcatgctgtttggttacagtagctctgtagtatcatttgatgacaggtaatgtgattcctccagttttgttctttttgtttggaatagctttggctattctgagtcttttatggtgccatataaatattaggattttttttctatttctgtgaagaatgtaattggtattttcgtagggattgcattgaatctgtagattgttttactagaattgacattttaaaaatactgattcttctaatctatcaacatggaatatttttctattttttgttgtccttttcaatttgtttcatcagttttttacagttttcattatagggatcttttacttctttggttatcctaggtatttaattttatgtgtggctacagtgaatgggattcctttttaaattttttttcacattcttcactgttggcatataaaaatgctattgatatttgtctgttgattttgtatcctgtaactttactgaatttatcagttctaatagttttcttgtggaatctttaggtttttccaaacatcagatcatatcatctgaaaacaaggataatttgacttcttcctttccaacttggatgacctttatatctttcttttgtctgattgctctagctaggacttccactatcatgttgaataacaaggatgacagtgggcatacttgttgtgctctagatcttagaggaaaagctttcagttttctcctattcagtatgatactggctgtaagactgtcatatatggcttttattatgttgaggtatattccttctatctccagtttttttagtgtttttattatgaaggaatgttgaattttatcaaatacttttacagcatcaattgaaatgatcatatggtttttatccttcattcttttgatatgatgtattacattgattgattggcgtaagttaaaccatccttgcattctagggataaatcccacttggtcatgatgaataatcttcttaatgtattgttgaattcagtttgctattactttgttcaggctgtttgcatcaatattcatcagagatattcacctgtagttttcttctatttgttgtatctttgtctggttttggcatcaggctaatactggccttgtagaaggagtttggaagtactcccacctttgttttttagaatattttgagtaggattggtattagttcttctttgaatgtttggtagaattcagcagtgaagccatcaggtcctggacttttcttcactgagagactttttattatggcttcaatcttgttacttgttattggtcagttcaggttttggatttcttcctggttcattcctggtaggttgtacgtatttaggaatttgaccatttcttccagattttccaatatgttggcatatagttgctcacacgagccactaatgatcttttgaatttctgcagtatcagttgtaatgtttcctttttcatttctctttcaaaaatttctctttttaatttctagtttcataccattgtggtcagagaagatgcttgatattatttcaattttttgaacgttttaagacttgttttatgctctaatatatagtctatcattgagaatgatccatttgctgagtaaaataatatgtattctgtagctcttagatgaaatgttttgtaaatatctatgagatccatttggtctatagtgctgattaagtctgatgtttctttattgatatagtgccagtaagatctgtccaatgctgaaagtggggtgttgatatctccagctattattgtattgggactatctctctctttagctctaataatagttcctttatatatttgggtgctccactgttgggtgcatatatatttaacattgttatattatcttgctgaattaacccctttataattatatgatgactttatttgtctcttcttatagtttttgtcttgaaatctattttgtctgatagaagtatcacagctgctgctcttttttggcttccatcagcatggaatatctttttttatccctttattttcagtttatgtgtgtctttgtaggttaagtgtgtttcttaggaatagatccattaagattttgttttgtcatccattcagccagtctatgtcttttcattggtgagtttagtgcatttacattcaatgttattattgataagtaaggaattacttctgccattttgttatttgtttttgggttgttttgtggtcttctcttctttctttctttcctgtcttcttatagtgaaggtgattttccctggagatatgattattttcttgctttatattttttgtgtgtccattgtatattttttggttaccctgaggcttgcaaatactatcttataacccattattttaacctgataaaatcactgtttgcataaacaaacaaacaaaatgaacactaataaaaactatatgcattaactttgtctccctcactttttaactttttattgtttctatttatatcttattgtactgattatgtcttgacaagttgtggtagttactattttttattggttcattgtttaatctttctacttaggattaaagaagttcacatgccacagttacagtgttataatactgtgtgttttcctgtgtacttactattaccagtgagtttcatacattcatgtgattatttattgcttgttggtgtccctttcttactgcttgaagcactccctttagcattactttttatttatttgtttattatttcgatagttttaggggaacaggtattatttggttacatggataagttctttagtggtgatttttgaaattttggtgcacctataacccgagcagtgtacactgtacccaagatgtagacttttatctgtcatccctctcccaaccttcctcccgaaccctcaaagtccactatatcattcttatgcctttacatcttcataccttacctcccacttataagtgagaatgtaagaggcttggttttccgctcctgagtaacttcacttggaataatggtctccaactccatccaaattgctgtgaatgccattatttcactcatatatatatatattccatggtacatatatatatactccacattttctttatcctcttgttgatttatgtgcattgggctggtttcatatttctttttctttctttttttttttttgagacagagtctcgctttgttgcccaggctggggtgcagtgatgggatctcgactcactgcaagctccacctcccagttcatgccattctcctgcctcagcctcctgagtagctgggaatacaggtgcccgccaccatgcctggctaatttttttgtatttgtaatagagatggggtttcaccatgctagccaggatggtctcgatctcctgaccttgtgatctgcctgccttaggctcccaaagtgctcggattacaggcgtgagccaccatgcccagccctggtttcatatttttgcaatcgtgaattgtgctgctgtaagcatgtgcaagtgtctttttcatttaatgacttcttttcctctaggtagatactcagtagtgggattgctggatcaaattatagatttacttttagttttttcaggaatctccatactgttttccatactggttgtactggttcacattcccaccagcagtgtaaaagtgttcacttttcacaacacccatgccaacatctattatattttgttttttaataatggccattctttcagcagtagggtggtattgcattgcggttttgatttgcattttcctgatgattagtgatgttaagaatttttttataattgtgattatgaaaaaaattagtgactgaagcactcccttgtttcttgaccatttgtatatcttcttttgagaattttatattcatgtcctttccctactttttgatgggattagtttttcatgctgatttgtttgagttccttgtagattctgaatattattcctttgtcagatgtatagtttgcaaaaattttcttccactctgtgggttgtctgctggctctgctgattatttcttgctgtgcagaagcattttagtttaattaagtaccgtctatttgtctttccttttgttgcatttgcttttgggtacttggtcatgaactcttagcctaagccaatgtctaaaagagtttttccaatgttgtcttctgaaatttttatggtttctggtcttatatttaagtctttgattcatcttgagttgattttttgtataaggtgagagatgaggatctagttttattcttctacatgtggcttgccaattttcccagtaccatttgttgaatagggtgtattttccccgctttatatttttgtttgctttgtcaaagatcagttggctgtaagtatttgggtttatttgggggttctttattctgttccattggtctgtgtgcctatttttatgccagtaccttgctgttttcatgactatagccttgtagtatagtttgaagttgggtaatattatgcccccagatttgtgctttttgattagtcttgttttgatcatgtgtgtgcactcatttttggttccatgtgaattttaggattattttttctagttctgtaaagaatgatgttggtattttgatgggaattgcattgaatttgtagattgcttttggcagtatggtcatatttacaatattgattctacctgtccatgagcatgggatgtgtatccatttgtttgtttcatctatgatttctttcagcagtgttttgtagttctccttgtacagatctttcacctccttggttaggtggattcctaagctttttgtttgttttgcagctattgtaaaaggggttcagttcttgatttgattctcagcttggtcactgttcgtgtataacaatgctactgatttgtgtacattgattttatatcttaaaactttacagaattcatttatcatatcttggagctttttggatgagtgtttaggggtttctaggtgtatgaacctaaattggcaaaaagtgacaatttgacttcctttttatcaatttggttgccctttatttctttcttctgtctcattgctctagccaggacttccagtactatgttgaatagagatggtgaaagtgggcatccttgtcatgttccagttctcagggggaatgctttcaacatttccttgttcaatataatgttggctgtgggtttgtcatagatgacttttattaccttaagttatgtcccttctatgctgattttgctgagggtttaaatcataaaggcatgctggattttgtcgaatgctttttctgtatctattgagataatcatgtgatttttgttttaaattctgtttatatgacatgtcacatttattgacttgcatattttgaaccattcctgcatccctgtaagaaacccacttgatctttttgatatgctgttagattcagctagttagtattttgtcgaggatttttgcatctatgtttatcaggcatattggtctgtagttttctttctttgttatgtccttttcttgttttggtgttagggtgatactggcttcatagaatgatttagggaggattttctctttctgtatcttttggagtagcttcagtaggattggtaccaattcttctttgaatgtcggatagaattcagttgtgcattcatctggtcctggacttttgttgttgttggcaattttttaattatcatttcaatctgctgcttgttattggtctgttgagagtttccttttttttcctagtttaatctaggagggttgtatttttccaggaattatccatcttctctgggttttctagtttgtgcatttaaatgtattcatagtagccttgaatgaccttttgtatttctgtttttgagatgaagtctcactctgttgcccaggctggagtgtagtggctaatctcggctcacggcaagctctgactcccgggttcatgccattctcctggctcagcctcctgagtagctgggactacaggcacctgccaccacgcccagctaattttttgtattttttagtagagacggggtttcactgtgttagccaggatggtctcgatttcctgacctcgtgatccgcccgtcttggcctcccagagtgctgggattacaggcgtgagccatcgtgcccggctgatcttttgtatttctattgtattggttatagtatctcccatttcatttctgattgagcttctttggatcgtctatcttcctttctttattaatctcactaatagtctatcaattgtgtttatcttttcaataaactagctttttgtttcatttatcttttgcattttgtttgtttcaatttcttttagttctgctctgatctcgcttatgtcttttcttctgctgggtttgggtttggtttgttcttgtttctctaattctttgaggtgtaaccttagattatctattcatgctctttcaaactttttgatgtaggcatttaatgctactaactattttcttagcagggattttgctgtttcccagaggttgtgtcatgtttgataggttgtatcattcagttcaaatcaatttttaatttccatcttgatttcattgttgacccaaagaccattcaggagcagattatttaatttttatgtattttcatgattttgagggttccttttggagttgatttccaattttgtcccattgtggtctgagagagtacttgatataattttattttcttaaatttattgagacttgttttgtggcctatgatatgtcctatcttggagaatgttccttgtgcttatgaatagaatgtatattctacagttgctaggtagaatgttctgtaggtatttgttaagcccatttgttctagggtatagtttaagtctgttgtttatttgttaactttctgtcttgatgacctgtctagcgctgtctgtggaatattgaagttcctcaatattattgtgttatctatctcatttcttaggtctagtagtaactattttataaatttgggagctccaatgttaggtgcatatatatttaggattgtgatattttcctgttgcatttatctctttatcatttttatataatgttcctctttgtcttttttaactgctgtcactttaaagtctgttttgtctaagaatagttgactccttcttgcttttggtgtccattgcatacaatatctttcttccatcttttcaccttaagtttatatgagtccttatgtgttagatgagtcttttgaagacagaggatacttgattggtgaattctgtccattctgccattctgtagcttttaagtggagcatttagaccatttacattcaaagttagtattgagatatgaggtactattctattcaccatgccatttgttgcctgaataccttgggatttttgtattgtgttgttgttttataggtcctatgagatttatgctttaaagagattctattttggtatattttgaggatttgtttcaagatttagagctccttttagcagttcttgtagtgctggcttcgtagtgctgaattctctcagcatttgtttgtgtgaaaaagactttatctccccttcgtttatgaaacttagttttgctggcaaaaaaatcttagctgataattgtttttttaaggaggctaaagataggatcccatccctgctagcttacagggtttctgctgagaaatctgctgtaaatctgatacattttcctttgtagattatttgatgattttacctcatagctctttagattctttcctttgtcttgactttaagtaacctgataagtatgtgcctaagctataatctttttgcaatgaatttcctgggtgttctttgagcttcttgtacttggatgtctatatttctagctaggccagggatgttttccttgattattccctcaaataagttttccaaacttttagatttctcttcttcctcaggaacatcaattattcttaagtttgttcaataatcccaaacttcttggagaatttgttcattttcttaaattctttttttctttatctgtgttggattgggttaatttgaaagccttgtctttgagctctgaaggtcttccttttactttttctagtttattgttgaaattttccagggtattttgtatttatctaagtgtgtctttcatttccagaagttgtgattcttttttatttatgatgtctattctctggagatttttttcatccatattctgtttttaagttttggttgttttaatttaagtttgttttctcctttctttggtgcctccttgagtagcttaataattgaccttctgaattctttttctgacaattcagatatttcttcttggtttggatccattgctagtgaactagtgtgatcttctggaggtgttatagaaccttgttttttaatattaccagaattgtttttctggttccttctcatttgggtagactatgtcagtggaaagatctggagcacaggagctgctgttcagattatttttttctcattgggtgctcccttgatgtggtgttctcccccttttcctagggatgcagcttcctgagagctggactgccgtgattgttatttgtcttctgggtctagccacccagtggggctacagggctctggtctgatactggggagtgtctgctaagagttctgtgatgtgatctgtcttcagatctcccagctgtaagtaccagaacctgctctcatggaggtagcaggagagcgaatttgaggctgtgagagtccttggttgtagttgtttagtccactgtcttttttgaatgctgggtatgctagcagtaaagttgtcatatggacagactcaggacttctggttagcaagggtgttaaagttagtagaattagctgttattttctccttccttggagcagggttgttctgttatgacttgctgtaatggcttgagttggttggccttcatccatgaggtaatgctttcaagagatcaccagctgcagtagtatagaggggatacaccttgccctgaggccaccaggataagtatttgggtttctctggtaatggatagggctatagagcttccaagagtttgtgtcttttgtgttcagctaccagggtttgtagagacaaaccatcaggtcggggcagggttaagtgggtctgacctcagactctccttgggtggggcttgctgcaaccactgtggggaatgtgggggttgttctcaagccaatggagttacgttctgaagggaattaaggctgcctctgatgtgtcatacaggttgtcagggaagtggaggaaagctggcagtgacaggcctcacccagctcccaggaagccagcaaggccagtctcacttctgctgtgctctgtcaacaacaaacagtgccaagtttatatccaggcctccggcacacagggctacaagactccctgctgagaaagaaagcagggcttttaggctttgcccttccctgtctgccacagcttctgtgcttatgtctgcactttgcatttgctccccagactctgcccaggaaaattcactctctcttgaatttactacaaagtttagtggaagccttcttctccctgtggcccttccctgattccactggctgcgttccccaaaggcccctgtgaaattaaagtcagaaatggcttccttggggttccctgaagattgggcatgcctacaaggctcttcccattgctcattctacttttgtattttacttggctctctaattttgtttcagctcttggtaagggtaaattattctcttgtgatccttattttcattttcctgagtgtattagtccattgtcacactgctataaagatactacctgagactgggtaatttataaacaaagaaggtttaattgcctcacagttccacatggctggggaggcctcaggaaatttacaatcatggtggaaagggaagcaagaactttcctcacaaggcagcaggagatagtgtgaacatgtgaaggaggaattgtcacatacttgcaaaaccatcagatgtcatgataagtcactcactatcatgagaacagcatggggaaaccatccacttgatccaatcacctccttcttttgacacatggggattacaggtccctccttgaggattacaattcaagatgagatttgggtggggacacagagccaaaccatattactcagtgaggatgtgtgtttgggggcagactttccacctctcgcactttgggaacgcacaatgtttcagctgtttcatggaggttgcagcagcaagccacttcttccaaagggtttgtgaattattttggttttcctgttgtgttccctgcagtggttcttggagcaaaagttcacaatgtgaatctccacatgctagttctgtccatctgagtgggagctacaagttagtcttgtctcctatcggcaagttttttcatcaccaacttcctttagtatttcttataggacaggtgtgatggttaatactgagtgtcagcttgattgcattgaaggatacaaaatattgatcctgggtgtgtctgtgagggtgttaccaaaggagataaacatttgagtcagtgggttgggaaaggcagacccactcttaatctgagtgggcaccatctaatcagctgccagcatggctagaatataagcaggcagaaaaatgtgaaaagagagactggtctaccccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagactggtctaacctcccagcctacatctcttttccatgctggatgctttctgccctcaaacatcgaactccacgttcttcagttttggaactcagactggctttccttgctcctcagcctgcagatggcttattgtgggaccttgtgatcatgtgagttaatacttaataaactcccctttatatgtatgtgtgtgtgtatgtgtgtgtgtgtatatatatatatatatccattagttttgtcccgctagagaactctggctaatacaacaggtctgatattgatgaaatgcctcagctttttgtctggggaagtctttatttctctatgtttaaagagtattttcactggatatgctattctagggtaaaacttgtttttgtttgtttgtttgtttgtttttattcagcactctaaatatgtcatggcactccctcctggcctataaaggtttccactgaaaagtttgctgccagatgtattggatcttaattttatatatatatatatatatatatatatatatatatatatatatatatatatatatatatatattttatctcttgctgctgttatgatcctttctttatctttcatctttgggagtttgattattaaatgacttgaggtattctttgtattaaatctgcttggtgttctacaaccttcttgtacttggatatcggtatttttctctatgtatagaaagttctccgttattatcccattgaataaactttctacccctatctctttttctacttcctctttatggccaataactcttagatttgccctttggaggctattttctagatcctgtaggcgcccttcattattttttattcttttatcttttgtgtcttacgattgtgtgttttcaaatagcctgtcttcaagctcactacttctttttttttttttttttttttttttttttgagacgcagtttcagtctttgttgtcaaggctggagtgcagtggtgcaatcttggctcactgcaacctccacctccccagttcaagcaattctccagtctcagcctcctgagaagctgggattacaggcgcacaccaccatgcctggctaatttttgtatttttagtagagatggagtttcaccatgttggccaggctggtcttgaactcctaacctcaggtgatccaccctcctcagcctcccaaaatgctgggattacaggcatgagacaccacgcccggcccaagctcacgaattctttcttctgcttgataaattctgttatgaaagggctctgatgcacccttcagtatgctaattgcatttttcagctatagaatttgtgctcaattctttttaattatttcaatctctttgttaaatttatctgacagaattctgaattccttctctgtgttgtcttgaatttctttgtgtttcttcagcacagctattttgaattctctgtctgaaatgtcacatttctctgtttttccaggattggttcctggtgacttatttagtttatttggtgaggtcatgttttcctggatagtgttgatgctagtagacattcttcagtgtctgggcattaaagatttaggtatttattttagtcctcactgtctgggcttagttgtagacatccttcttgggaaagctttccagatacttggaaggattgggtattgtgatctaagctgtatctactttagggggctccccaaacccagtaatgctgtgtttcttacagacttgcagaggcacctccttcacagtcttggacaaggtccaggagaatcctctggattcccagggagacactcttgttctcttcccttcctttctctcagtcagtctctttctctctttctctctctctctgttctgaaccacctaaatctgtagttggagtaacataagcaccactgtggctgccaccactatgatggtactgggtcagacctaaagacagcacagtgctgcatctcacccaaggcctgctgtaactacttcctggccactgcttatgttcactcaaggccttgtggctctacactcagcagggggcaaaaccagccaggcctgtgtccttttcttcagggtggcgatgtccctcaggccctgggtggttccaaaggcactgtccaggagtctgggactagagtcaaaaaccttagacgtctgcctggtattgtattcggctgagctagctctcaaatcacttgatgcagttcttcccacttttctcttccctttccaaaggcagaggagcctcactcctgcagccacaaccaccgcaggccatgaggagtactgccagactacaagccaatgtttccttaaggcccaagggctcttaaggcagctgtggtgaatgaggaactggactggaactcagcttttagggcagtgggctcccttctggcccagggcaggtccagaaacatcatccaagagtcaggtcctggaattagggaccccaagagtctgcttggtgctctgccttcctgtggctgtgctggtacctgaggccagcaagtctcagtgtctcacccaaagcccttgatgcagtacctgggtatcgctgctggttattcagggactaaggaatcttagttagcaggtgatgaatgctgtcaggactgagtcccttccttcaaggcagtgggttcttttctggcccagggtgtttgtctaaaaatgtcatttgatagctagggcctgtaacagggacctcaggactctgttgccctatcctattgtgtctgacctggtatccaagaggcaaggcaaagtcctctcccttcttctctctcctcttctcaagcaaaatggaggggtctcttggagctggaagctctgcaacttggggattaggggaggggtgatgccagctctcccttggctgtcccagctggtgtctcagtagtcacgtggcccccccagtcaactgtctgtgagcctagttcagcattaagtgtcacctaagatttgtagtccttatgacccagactgcctttcaaatttacctggagacaagagcgctgtagccatctgtgctgaggtttgaaggcactcaagttctgatggctgtgatccaggattctcctcaggctggggctggtttaaaggttccctcagtgggccagtgtcagttgagtttggttcagttttcttttctgttctaacaggacaccactgagtttagtgcctcacaattgctgtgctctccccactactctgcctagagatgctctgggcacccctccaaacctgccccaggtcagggaggggtggcatcatgattcaaaactgtttttcctatcccttcagtgcctctttcgacgatacaaagttacaaccaggtactatgagtgctcacctgatttctggttcttgtgaaggtgtttcttcagtgtagatagctgttaacttggtgtccttatgggggcggggttgggggatgatggagtcttctattccaccattttgctctgcctcttctctagaaggcatttttattatatacaatgaagaaagtattatcaacaatatataaataaatgctaagtcaattaaaaagcaccagcaatttcatagataaatggccacaaatcatgattagcactttacagaacaggaattatatattgctagtaaacatatatgaagacatattttggacttaatagtgattagagaattacatatcataccatggtgagttctcttttaaattcatttgattggaaaaataaaataaaaaggtcattatatcaagtgattaaaaagacgtgagtcctctgagtcttttatatatcatttctttaaacataagttgataccaatgctttggaaagcagttagatattattgtgtataattttgtatactgtgtgatgaagtaattttggctgtagatccaggggataatctctcctgtgtactctggaaacagcaggttcacagcagctctcttcacaatagcacatctgtagaatcaaatcaaatgcttccacattagtcaagtggctgaatatcatgtaatatgctgttataaatccacaaaatgaatataccacaatgacacacaacagcatgcatgaatcttagcaatataaacataaatacttagcaatttaaacataaaacaattaaaatgaaattaaaaattttggaaagaaacatagatgagtaaaaagaatatgaaaagaaaagaaatggaatagcaaacaggcttcagaagggttgttctcttgggagagggaacagaggaaatgaggtgaaggaagagaaaataaatacatattaatgattggtgagattctactctttgtattgtgtggtgggccctcagttgcttattacactactcaagagggatgactgcataaataaaaacagacagccatgcatgaatcagttatgacagtatcatgcatatacgtacagttgagcaattctatacaccagggttggaaccaaaaattgccatctacctacttcacaacagtaatctactgccattattccagagccagttctgagtcttctgcttctttcacctttcttttgagcttcattaggagcatgctattattttattttgctcattctttaagactcaggtcccgctgctggcatacagtgattcacagagtaggggatggtgtgtttcctctgctccattcggtctttgttttcacaacaggcagattagaagtttcttattgaagccccagaaggaaaccatctctgctcgcccatctttttgtagtctcccagcctcagtcatgcagagaaacttgaagcttctcttcaagctctgaaggtcagccagaccagaaactaatgtgacatagagtctcttttccaatctctgtaggtcaggctcttgccaggatctgtctcagcctaatctaaaccatggaccctatatcaccaggccccaggcactgtcttctctgaagggtgcaagacatacctcaaatattttttattcttcaggactaaacgagacttgaaggctcagttgcctccttcaattcattggctcccttacgtccacagcagcttcttggctcataggaggtagatgtgttaggtttgatagcaaagtgtagccaggatgtttaaaatttgctattttcccagaaatgtctactctcttaaatattcttttaattttaataaagttttcatttttataggattatccgctcaaaattataagaactttgtatttatctattcattaaccccctttataatcatttcttttccttcatttgcaagacgtaaccattttttatattttactttgcaaagtaaaggaaagatgaaactctaggaatagcaagcaaagttttaacatttacagatggcagagcaggtttgagaataatctaactttgggaatgactacaaagggtgttaattaagtagcaggtgttttatcacctatgtctattcaaaaaaaaatgtagcacagatgtagaaagcttaagtacatctatagtttgtataacaaaactctatattcattgggttccatctgccacactaacctcaaaccacacttagtgccaaccaattaacaccttgattaagctatagaccacctgcagcttcagcaatgtaatgaattcactgacttttatacaaattcattgtaaaacctagactgaaactgcatagcaaaaagagaaaaaatgataaatgattcatgcatcagccttggtgtaggcacacacagacacacacacacacacacacacacatttactaaggcatgcacatcaattgtctcatctctgctgctctcttcattttttaaattttctttaacaaaggagacttggctaaaggcatttcaggcttataaacccacaaactataagcagaaaagaatatcatatcctcctccatcaactcaaattttaaaaattccaggaaagtactccaatttgcttaactcaggtcacatgctagttctgaataggattgggcattctggttgacacagtttaaattggttgcctaatcctgtggccacaatgaaaggatatggctgacagaccctaccataaccatgcggcaaaagcaggtgaccaaaatatatttagtctgaaaaaaaataatctaaatgaataatgtaagataattgatacatgtatgtgttgttagaagtatattaaattctctgtcttcactttttttggtgaaatcttcattgctcacttatgaattatggaacagcttttctttccatactgagaaaaaaatagttacttcctatcagagaaaactaagagataagttaaaataatttaaagaagaaaagagacattttgaataatgaattttgtgacacctgacctactaacagttggcaggattgattagagaggagagagctggaaaaaatagtagacttttatgatcatctttatgtaatgttgtaaatggaggaaagttaaactggaaagataggtctgtgtttctggagaaaggttatacaatgaggaggtagctgggtgatgactgttctactcacgctgtcgcaatgtttgcagtagttatgaattatttttttctcaacttatcatggcagaatgccacttataatttaaaaaaataacccagaatccaggaaagatgaaaaacagcaacaacagtataaactagggtaaaaatatattttatttagcacagctcattttgttttactttattttgtttatttatttattttgagacaggatctcactgtcatccaggcggtagtgcagtggcctgatcactgctcactgcagcctcaaccttctgagctcaattgatactcctacctcagcctcctgagtagctgggaccacaggtacacaccaccatggtgggctaatttaaaataaaatattttttgtaaagaaaggttcttgtttggttgcccaggctggtcacgaactcctgcctcagcctctgaaacatgagccactgtgtccggagcacagctcattttattaagaagctcattgcagagctagttatccaaaactatgagaagagattcatccagttattcaggatttagcatcagggtgtattctaaataaaggggctcagaggctgtcatgactttaagtgtcatcattccataccaatcctttttatgaaaaggaagaaaaagaagttctcgaattttatttgttctcaaggagaactctcaaggagaagaatggcagtttttagtttacattattatattcatatggctgatgttttacttctgccctcaaaatcctctctgaaaaaatatcttttgtagcctaccctaattggaaatatacagagaaggaaattctgggaatcacagttcaatctgatccagtggacacattatagtcactacagttcatgcattttgaacctgaaagctccacacttctttttaagccatatgtaatctacaagtaaacaaagccatactcctgcctcatatgaaaatatgacatatctctcctgccttataactgaacatagacttagtcttcattctaacggttacaaagtcccatttcaaaaagcagttttcttctttcatctgattcacactccttctttaatatcctataacttacttagtgagatatgcactgatagctactattaatgcattgtgtgtttggcgataggggaataggaaggggaaaaacaatacttgttatatgtgtgtgcatgtatttgtgtgtgtgttcatataactaaggaagaaaaaactattgtagtcttaatttctgcaatcagtcatgtggttgcagcagatacttctatctgcccttttccactgcccattccattttctcagcagtggtcaactacctcaagtgagactattacaggttctacagacaagggaaagctagctttctcaggcaggaatggaaagaaaagtaggcttagtggaattcagggattcaatcttgtcatttcatctaaatttgcctatatgtccccatcctaattttcagggttccatttatttccaattaatgccccaaatttgagaaaaatgattctgtgagttaggaaattcaatttgtattgtaattcagccattatgattagattttgggtttggtttcagatctttcagacctgaggttataggagataaggatttattttagggaaggcttagaacttacccaggttcttactgagattcaatctgagaatttaaagccatgagattattttcctttgataactactaaatactgtatcaataagaagcagaatcactatgaacattatacacacacaaacacacacaacttgttacaaggatttgagtatatacaattatgtgagctggttgcaacagtctctgtaaatttgctgattttggatttgatactggtgcttgaagactctagggcaggatcagtcaggaaggaaaaagaaggatgtaaagtgggagagaggaaagccaagtttaaacccacaaatatgagctgaagcccctgaggacaaactggagcacatgttcattctacaacattggtgataggggttccctacaggagaaaccggtacttcctttttggcagtaagcagaaacctctcccaagagtttgggaagctgcaggaaggtccatgggtagcctagccactgcaccatggtaatcagttgagcaagcagatgagtgacatgtattaacaacaaaagctctcttgactgtctcaatctctttccaaacataagaaaccatatgactactgcttggcttcttccctctaaattgcacacgaaaatgtctctgtggttcactctaatctgaaatatcaagggaaggaatttctggaaatgtaatttagtctaggcaagtctacacattactaagccaccacatggtatctttaggttgtttcgatattgtttgggtattgtgtgtatacaattgattaatatttctaagttttgttttataaattgactttcattgagatctatttcttgtaaattcaatcatgtggaaaatacaaatagtaaatcaaatataattttatataggtttgagaaatttctgcatttctattggcagtaataccccagactactctctgattagtcttacgtgcatgtaatgtactttttggtctttgacattccaaggcagctcagtttaatgattttgtcccccttatttcattagtactcatattttatagtaattaaaagcacaggctctggatatagcctaaaatcaaatgtcagcatcaccacttattagctgtgaccccaggtatactacttaactgctctttgcctagttttttcttgtgtaaaatagtctaggattaaattagctgatatttataaagtgttcagaatagtgcttgtctcattatgttctgtattttccccatatggtatatactaggggagggattaggctttttgttgaattttttcttgtttttttaatgaatattcaccaataatcattcacccaaaattgtcacaaacactcatgttggccatatggatcaagctctcctaaaatgtggtaatcatgtataattttttgaacatgctttaatacacacacatacacatacatgcacaactatttccagaattattgtgtctttttttatatttccagcagcaaggtataagaaatccagtttctctgcatcccttgcgagcatttcatattgtctatattgtattattttatctgttctaacaggtagtgatatattgtcatggttataatttgcattttcgtaaagctaattatatcagacatttttttcatgtgtttatttgtctgttaatgtcttttgtattattatgaattggctttctttaccattgaatttttcaggattctttaaatattctagatacaagttctttgtgagatatatggtttacaaatacacactctcaatctataggttgcctttttatcctctgaatatggtctttttaatcttgattaagtacagtttatctgtgttttacttttaccgatcatgattctgtgtcatgtctaaaaattctttgcctagctcttggtcccaaagattatctcccgtgtttcttctaaaagttttattgtgttgcattttacatttcaatctgttatacctgggccatcttttgacaacttctatggttcactgcccggcatcttctatctagttgttcatagtctcctatccttttataaagaaatgttagtggcatcactgggtcaaagaagtctttttttacagctccgggatatggataggtgtttcaaacaccattctaaatttctgattagcttcatgtgcaaacgactattctaagcaaatcttggataacctctacctttggttaacgatattttgaaatactgatgtaattattcttccttatcctaatagtaaaaaggatgaatgaacttttttcttcagtagtctcaatataagctgtgggactaatacttgtcataggccctttgaaatagcaaacacagtgactttcatactatttccacatccccctaagctcttgagctcacatttgcatttctcttcccacttttcccttctatatacagatagtaaatacctttgaagatatcattcaagtgagataatttgttgcaatttttcaatgtttcattctagtttatacaggtcaatgcctttgctatgattttaaggcttaagcaaaaccttggtgttttatgaatttctacttattgagcaaaacctatatttgagaaaacaatgtgtatagtggcaaattgtaagaaaatatatccatctctcaaaattgtataaaagtatagtagctttgaattctaaaatagatccaattcctcaaattgactatcattatttttttcctttggaactataaacaatcaccatttctgattaatttctgtcatataaatcacaatccttgctttgtattattttacttgatatattctatatataaaacatacagttcacatatagttaccatttcttttccatacaacagctaaagatgtatttgactattgaaatgcttaagccttacttaaaaaattttacatttttataatactaatttttaatagcacttttgaagataatttgaaacaaaatttgagaataataaaatttgtcattttataaatatagaaattgatagactacagagttgatgattgcaggtttgtagtttaaattggaaagattttgtacaaatctctctgatagtcaatactaaatcagtaatggagtaataaaaacctcttaaattgctttaattcatatattcacttatctaaataccactggcctgtatcttaaattattgagaacacaactgaaactcagtatgtcaatacaaagggttctgaacatctaaataacaaatttcaaaacccatcaaataataattctcaagaaaatctttcaggtaactttcaattctaatggacgcttgaacatctattgtttttgtttgtttgtttgtttgtttgtttgttttaatgttagcatattagaagttgcaatgtggctgggtgcaagtggctcatgcctgcaatcccagcactttgggaggccagggcgggtggatcacaaggtcagaagatcgagaccaacctggctaacacggtgaaaccccgtctctactaaaaatacaaaaaaaaaaaaaaaaaaaaaaaaaaattagccgggtgtggtggtgggcgcctgtagtcccagctactcgggaggctgaggcaggagaatggcatgaacccaggaggcggagcttgaattgagccgagattgcgccactgcactccaccctgggtaacagagtgagactccatctcaaaaaaaaaaataaagaagaagtttcaatgtaaaggaaaaagaggctttaaaaacagcagttctcctacaactagaaatggcaccactatcaatattatattaaatgtcaatggagaaaaaaggaataatgccaatactatcaaaaataatttaaaaattttagcagttaagggatgtttaaacggtgaatgatactttgaaaggaccactgtagagtaaaatatttgatgttcatagtgattactctgagttattagaaaatatacatcgagcattacattctgattttaaaagggtagtgaaactactccatatgatactacaatggtgggtacatgtcatcataaatttgtccaaacccatagaatgcataacaccaagggtgaactctaatgtgaaagtgtgaactttgatgataatgatgtgttcatgtaggttcatcaattgtaacaaatgtaccattctggtgaccaatattgatgacgagggaggctgtgcgtatataggatcacgaggcatataggaagtctctgtaccttctgttccgtttttctgtgaacccagagctaatctgaaaattaatgtctatttttaaaaaactctttgagctggatattggagggaagaagaaaaataaaacgatttgtatggaaaccctgggctctggaccctagattatacatatctgaaaacaaaagagaactttagcttgttaggctgaaatatctgcattcaaaatactccactgttttacctagtgacaatggatgaaaaaaattgatttacatatgtataactaaaacacatgttggggtggtatggtatgctatgctgttggaagttaggataacggtaatccttgcaggggtagtaactgaataaggggcttctgggatgaagataatattgtttctttgatcctggggctggtcacataggtgtattcagttttgagatgagccttacctccaaatctgtccttgaataaatttcttgttggttccccttggttgatcaaatcctatcatctgctttataataatacaacttaatgattaaaattttaaatgtacctaatccctaatcaaatataagaaaaatgaatagaacttaattgcattgcagctaagttccaatttcataagtgaaaaggaaattgttttcgtttattttagctttatattaaaaaatacacgaacaattgtttggagactgttatggaatttcctagtcatttccatgaactatttctggtgggttttgaaactaaatgtagttacagggcaattgtttttgctgtgtaattctttatgtctaataattggtagtcttcattcaagataaaatgtcttagatattataaattttcttctctgcccgaatatgctgctatagactaaagtgagtatctttaggaaaatacatttgtttcaaaagtacatcctgctattatgcacaagtattaattgttttgatgtgtgcctttttttgtttttgggacggagtctcgctctgtcgcccaggcgacctcggctcactgcaagctctgtctcccaggttctcctgcctcagcctccggagtagctgggactgcaggcgcctgccaccacgcccagctaattttttgtatttttagtggagacggggtttcaccgtgttagccatgatggtctcgatctcctccgcccgcctcggcctcccaaagtgctgggattacaggcgtgagccaccgcacccggccgatgtgtgccatttttatcatgactagaatcactcatgggatagatttgcacatttttacctcaggggttgttgaagaagtcaggccatgtagtactcatgaggccttgtagtactcatgttaatttatgtcatgttcattttgtttcactggtaggcaaggaagaaacctaggccttcagatttttggttttgctcaactatcagaaaagcctacatgaattatgtagacactgatttggttgcagttcatttataacttatgagcaaattatatttctagtaagaaaagtattctataatttgaagaatctcaatattttatatgcttcaaaattgacagtttaatttcagggatttgtactttaaatatgtatattagaaagaactttgaatagttcatggagaatctctgaagtctcagaaagaatctgttccatatcaaagaaataagtggcagctacagtttaaaattaaacttaaataagaccttttctatgcctgtctgaacgtttcatttctttagatcttgatgttaatagaatgtaaatattctccaacttcattatttcactgaaatttccaagtattcaacatgataaaattctttctttttaagtctttaaaatattttggtgacctttgctggtcttttcatttttaccaaggcagagtttattaggtttatgttttctatttccatatcaagttttattcatgttaaaaacttaaaattaatggattatgtaaagtgataagtgcatcaatgaatatataactggctggattttaaacatacataaataagtatgttttaagtccttcaatgaaggcacttaatctatttctccctcatttcccttctgtaaaatggggatataataatatacttaaaaccttagcagagtgcttgacacataagaagcgctccttgagcattaactatattattattttacagtgatattgaatatttgatgctgtatatggtacttttaaaaaattgattgtctaataagcagaaaataaggctgtggtaaatcaaataaaggataaatgatttagaggctaatttgaagtaaagtataaagtatgctcttttaaatttttatgtttttatgaaagttttgggtgcttatagcaacttttgaattcctttcagcagtgtgttctttcttacacaatttcagagttttgaatctcttccttgggaaactttttacagaaaggaagataatcatcaaaaatttgtgattttaaatatcctcttaaaaccaaagttcccctttttaatggtttactgttacaacctattctctataaagagagaaaagatatagtccacatttatactagcttcttttaaaatattttagaagaaacagaagaatgattagtagaggttttcattttccattgataaaaaatcgagaatgagtctttctacctgtagtttttcctataattgttttttcaaatgcagtctactatgtgaattaactactcagaatccattctcaatccctttctcctttgtcttttattacttttcagaatgggaagcttaaatttttgatttcacaggcttctttgcctctagggttacttggttactcatgcaacacaattctgctatgaggaggtgtttccttccagaataaaaaggcctcaaaacaccaggagaaaatcctatgccttttctccttcctctgaattaaaatcttacaagcctactccagtctcatcttaagccctcctgttcttctctcactggctggtgtgctccactttttgcttaaaaacgtaccctgtgcccagaatactctcctcagcaatcctccccttctgctatcaacttcctcataatctagcccctctttccccaactcatccaactagatcaggcttcctctctcatgtattattcctgtgtagtccttatcacatttttatgtatatatgaaatatctggatacaagccacaagcagcagggacatctatcttctttatccctgtaccttaaggagcaagcatttaatgagccagttatcatggggcaagcactgttctaagcactttacatgctgtcactcatgctctgttcattacaatatcttattttataggtgaggcaactgaggtagtgaaaggtgaagtcgtgcatgggtagcagagctggatcaaatgtaaatagcttgccccagagtctttgcacttaaccataactgccaggaactatgtctctagagaggtgctggagtgaagagtttgaggcattttatttgaaaaacaacactaggccaggcactgtggctcacgcttgtaattccagcactttaggaggccaaggtgggcggatcacgaagtcaggagatgagaccatcctggccaacatggtgaaaccctgtctctactaaaaatgcaaaaattagctgggcgtgatggcttgtgcctgtattcccagctactcaggaggctgaggcaggagaattgcttgcacccgggaggcagaggttgcagtgagctgaggttgtgccacagcactcaagcctggcaacagagcgagactctgtctcaaaaaaaaacaaaaacacaacactaatagccactctgttgtgtaatgttctaaatgacatttagaaacctttgtgcattattgtgtattcttcaatagctcttatgtctaaccatccattgcttgcacaacttccttttgccacatttctttgttgtgttatatgtgaaagcagttgttctctagtattaaagtgcatgagcaacatggcagatacctttagaaagtgtacattctcagtgcttcctctaccagtattctgattccacagatattctaaggtaggggccaatcatcttaaaaaaaaaaaaaaagaaaagagaaagaatcccaatggactcacagagtgggtttgctgaaaatgaatattcccttaatgaatatgataaaaatgaaacagattttgttttaaaaaattgcaattataaagttaggatagttacatcattttttaaaatatagcatttttaaagtgtcccagaggctagaattattttttaatattagatttcctgtggatgatacaactacaagcagcactgtaaatataaaagatcaaagtgggctaagcaacatttctaggagatgattttcgactcacaaagcaacttcctggactttttaaacacatttaagcacagtaaacaatgctatctcaaaatgaggcaaattcaactttttctattccagtaaccatattaagtcagtattttttttccattttctaattactgcacttattttatcagtgtgttgttaattatatttaatcctatgaaagagcaaaattaaacaaaactaattgttccttgctatttacttatatatttatatacatctgtatatatgtttatgtgcaggtttatttttatcatattcattaagggaatattcattttcaacaaacccactctgtgagtccattgggattctttctcttttctttcttttttttaagatgactggcccctaccttagaatatctgtggaatcagaatactggtagaggaagcactgagaatgtacactttctaaaggtatctgccatgttgctcatgcactttaatactagagaacaactgctttcacatataacacagcaaagaaatatggcaaaaggaagttgtgcaagcaatggatagttagacataagagttattgaagaatacagaataatgcacaaaggtttctaaatgtcatttagaacattacacaacagagtggctattagtgttgttgttttttttttttttctgagacagagtctcactttgttgccaggcttgagtgccgtggcgcaatctcagctcactgcaacctctgcctcctgggtgcaagcaattctcctgcctcagtgtatacatatgtatgtatgtatgtacatatgtgtgtatgatgtaggtgttggggaaaagctgagtgttgggaaaaaagctgagtcagggcttgcatgtctgacataatgtaaaagagtcttggaacatgtctgggggccaggatttaaaaccccttgtagcctttggaacagcaagctctgtgccaaagggtagaaggctgccctgctgcaccataatctaagtccagggcataaaatccctcttggcttggatggaatccagggctcaggggataaaaccccttgtggcctctggaatgcatctagacttgctggctccttgcttcaagcactcccaggatcatagatcgattgcatcttaaactagaagaacatgttttccattatttcaagtagcagaacatgttccatatgcttcaaaagaaatgctaaaccattacagctgtcgatcatgtgcttgatatactgctttctttcaacccccacatcttcaccacctgcttctttgtttgatcaccaataagtagtgctggcttccagagctcagggcctttgcagtctccatactagcatcggccccctggtcccactttatgcactcttaacttgtcttgtctcattcctttgactctgccagatttcgtagcccccactgcctggtgttgggtctggtcactccaacatataggtagccttggtccatggtggtgctaggtctctggttggtgtttcaccatgtgtttgtgtaatattacataccaccacttttatcttaaatatatgtttggtgtgcatacagtttacctaagtatgaaaataaatgttggaaaatctttgtagaatatgcctccatagactttaaaaggaagtattcacagttgttagtaaacatatcctttggttcttaatgatattatagattgctttctcactgaatagaatttttgtttcagattggataaaaactgaaaagataaatatattctaataatgattaagatacaactattttaattaacattcacatttaatttgataatcagattgtattaaagtatttgtatttttctaatatgaatggaatgctaggtgtgtactcaccagacttctctattatacctcgattatactcaaacttaaatagattgatcaatatttaatgggcttcagcatgtgaaagtgggatattttgatttgtttcttttgattttaaaacactggattttgaagacttaatgccaaagtaggcttcaggttctactgctactttaatgtaaaaatttccttcatcactcattttgtcttttgtttaaaagtttgttttaaaaagcacagcattttaatgataatgttattgtttttccctgaaagataatttaattaaaatattcaaatattctttttgtcaaaaatgtgttacttatgttcaattatcagtgaatccagataataattcctgaattaccccaccttataattatccagaagaacctggtttctatagaagtatatataccatctttcctcctcaaagactgtgctgatgttctgctaacagaatgtttatgatacttatgtattattgtgagttatgtttccaggatttctaaaatatatttctatcttttccttagcagctattttcacctataatatacagtattgataaaccttattaaaaaccttctccaggccagatactaggctaggtgccaaggtttagttgtgaacaaatggtctatcaaccttatatagttgtggggaaaggtgaggggtgagggggaggggaaaggtttggaaagatagacatcattcattacaaggttaaatatggaactcagatctgaagtatgagtagcagacaacaatttgtaggaggtgggaggggtagcttaagacttctctaagtaaaaggattagcctatgcaagaactgaaagaattcatggaaagtgaacacagaatatccaaggaactaaaagaaggccagtgtggaaaaaacgaaaggcaatagggaaagttatgagagatgaagctagagtggttgccttaggccacgccatgtagttgcaaatatattatgtttaggattttgtgtgttatcccaagagtaaatgaaagccagtaaatgttagttgacagtacaattaaaatctttgcagtatctaataggaatataatatgacatatttagccatataccaatactaagtaaggaggcatcatttgaagtttgaagataatacttaggccaaatttgtcaataactgattttttttcattgcattcagtaataattttttctcttttcaagaagcttattatttagttgggaaagcaatacagaaataatttacttactaatagttaacaaaatataataaatattatagtgtcaaaaaattatgacagattatgagttgctgagatctctaaagagatcagattgtattaaagtatttgtatttgacaaatactttgcatttgacaaatgtttgtaaatgaaggacaaaaaaatacgattcaatattccaagaggttgtaataacctgtaatgtagataggttcaagaatgtataagacatatttcttgaattatgtaattagggcaccaataataggtcatgatggtaatttgggcttagatggacatcaatctgaaatctgagaattttcaggttaatttctgtacaggagctaatatatttgcccaaaaaattaactttagtgtgactgtatgatcagatctgttgagctgtgtaggaaacatctgccagttcacagaaggtgtttattttcatgatgaaataggaaaataaaaaattctatagtgagttcttaatcccttctgtacaccatgactatggttcctctaattttaatcaaatatggccttagatttttatgcatagactcaagtttagtttacaatactaaataaacattttgttaatgtgaaagcgttcaacaatatatgcatttaaaaaaataaacagtaagcagtgtttaaaaatagtaaacaaaaaagtaaattaaattgttgtattttgtatgtaacactagcaagtatgttttttaagtgagaaccatcaaggcagttcattattttaaaacaagtgaaatggttgctttcaaacacacttagaggattataatcactaaaacttttatggacagcaatttgataacgtatacataaaacatccatcctgtttgatgcaatagttacattctgacagtcttccacaagaaacattgaaacattttgataaggatttattgagaaaaatgcattttgaattatttttgcttcctatataagatgtaacagcaactaaatatctaaaaatacaaagttggttaagagaataatggctcatacatttgatgagctattatttaatacacaaaaagggtgcatacaaaaactttaatggaataagaaaagtttcatgatattatcttagtgggaaaaagtgggaaattaaattgtatctgtggtgtgcatgatgtattagttttccattgtcactgcaataaattagtataaacttagtttaaaacagcacaaatttattatcttacagttctggaagtcagtaaaatcagtctcagcgggctaaaattgaagtgttgtcagggctagtttcttctggagactctacaggagaattagattttttgcctttaagtttttagaagctgccttcattctttggcttatagtccctgtcatattgccttttctccctctgtttccactgtcacataggcttctctgtcactgacccgttggtatccactttataggagccttatgattacattgggcccaatcagataatccaggatttatcttcccgtcttgaaatcctttacttaacacatctgaaagtcacttgtgtcatgtaaggtaacattatttataggttcctggaattaggatgtgaacatcattttggggacattattttttctaccacacatggaataactatatttgttatttaaacaaggacactgttgaaaattaaagagggcgttattaataattatttcaggataacagaggtaaagaggagctcttcttagaaaatccagatagtaacctaagtacacggctagagtgataagaaatgacaagctctctgagtttaaacagatttcctttctttgaaagtgtcatgtttttgttatcttgaaaaactagttttttcctttttctttgtagttctggaatgtcaccattatgtgcctagtcgtggatcttttaactcactatactcaaggaagctcattatactcaaggattcttggattctcagactcaagagaaacactaagaaatttctattattactctgactttttcacctcaaatattttttctctttcctctttctgaaacttcatatatgtgtgtgtctgtatgcatgcatatatatacatatatacacacacatattcatatacatattgacccttctaagtgggttctcaatttctcttaaatttttgttgtattttctatctctttttgagattctgagatttagtacactttatgttcctatttactactatactcagcttaacttgcctgctttatggatctgtggactttgattttgaaacatctcacatgtttgcccagcatttcttctgctctggtttctctttcaatattttcccttgcacatttcagcttcataaaagttattagaatttctggttctctgatggtatctttttctgttcttagtgctgatatagattaattcatttttaaacatttctgcaataatttaaatgaaatttgaggagcacatgttatgtttatattagctttccaactgaagctaaattgtggctgcatattatttcactgtacaaaaaggttataattagcttacccaggtacttaatataagttgtttctactttaatagctattatgatattaagtattccatgctggataaacacacacacacatacacacacaaacacacgtgcacataaattagggaacatatctgtgattatttccctattaagggacaaggatatgttgaattgaggttttccttttccacaagaaagattgcaaatttcaaatttctactaattggtctgagattgttcagatggtagagtttcattatctgatagtcatgttctataaagtgaaggaatactgaaccattgcttctaggagaaatgaaggctcaaattcctgaagatctctggtcacatttcatcaaccaataaatacataaccttgttttatgtgtgtttatttttaaagatgccttatttcatattttttaaattaattaacattgaattcatggccaacatcactatcactcatgcctgaatgaagcctatctaacaaacatattttctctgtgaggtacatcacaatcttctcgagcttaggaacactagctagacttcctcactatgcttgggagctgaaatcaagccacttaaaatagagaaatcaccagcagaaagcaaaatgatgcaaaacacctggcactagaaagaccatgaaaaggacacttatttacaatgtgagagttgaaccatgaaggcagagaaggccttattggaccttagttagaaacatgtgggttgggcgtgaaagcactgtgagcattgatttggagattacaaaatattttagtgagtgggcaattcataaatgtaaaatcacaaataatgagaatagattgtgtttcctttctacatattccataacatctattaacaactttggaatacaaaaattaatccccccaaaattcgagtttttcttttttttgaactagactgctttatttcagggagctctcaagcttcttgttactttgttaactaatcattgaattttccctcttggtcaatcatacaaaatttagaattaatacaatactatcattccccccttttcaataaacttactgtgtaatcttcagcttggcatatattaactgggagcaaaattttgacactgcgaaagaaaagattcagtgatatcattagttatcccacctatatgcttagtcttataaaacctaggactgcatgtatcatgttgaaaagatacttcaacctttgcctaacaccagtgtcccaatcagggatctactttcatttttcatttactggaccattactaatgtccaattgacaagtttattaagctttgccctcacccactttgatctacaaacctgctcagttcagaggagagaatacaagacccactgctattcgttttacagaaattcaaatgttctttatttataaatataaaagagggtttgattcagtttccagaagaagagaagacttgaagagttacactgaggactacctgatggctctgtaggtggagaaggaaggccagtacaaaggaaagtgcaggagttcagattagaagagacacatccatggcttaagagagtagcaattctaaaacattctaaatattctaaaatattatagaatggaaatctggatacaatggtgactctacaaatggagcaccataaaccagttgtagaatgcatttctatgaagtccagaaatgtattgatactcacttcaagatctcttgcctgttagaatgaggatggtgattgaggaggtaatggagaaaaggttaaatcatctctccaagtcatattcttctttttgagcatctaatttagatttcttatagaaaaagtgttttaaaagaataaaacatagacatgaatctggataaataatattgtttgtatcagtcacggactggaaccatgagaacatatgacatgaactacatgttggtgttaaataaaataattaatgcaatgtaatataaaatagatcactaggaaattcaggaggggaaatttttgaagcagttccatagaaacagagctactctgggagtcaggagttctgggagatgcaaaatccaaagcgggttcttgcacccactctgggatattttggccagtcaggttcttggtgctttgggttcctcaattgtaagatgacagaggtaaactaagtgatctctaaaacagtcccaatatctactattcaacaagtcacagtaatagacagagaagtaggaaaattgtgttttaagttcctgtcttagatgctgtaaagaagaaagtgatacttctacaaagtcaaagagattgacgttggagagatcctcttctgatttagcaaggacatagttattgaccacattagatatcatctgattataattaagttatggaacatttaagtggggaagataaagagagaaataaacatatttatattccaaatatagcaataactaaaaaaatcggcaagtcatatctcacatacatagacatgagaagaaatgtggtcactggacattgccctttttctatttttacaaatgctttctttagttttttccagagggtggtgaggtacatagggtagagtacatagttaattttatataattataaacgagtgtatttgaataaaaattctactatttatttatttatttatttatttatttttgagacaaagtctcattctgttgcccaggctggagtgcatgatctcggctcactgcaacctccgcctcctgagttcgagcaattctcctgcctcagcctcttgaatagctgggattacaggcatgtgccaccacgcccagctaatttttgtatttttagtagaaacggtttcaccatgttggccaggctggtctcaaactcctgacctcaggtgatccacccacctcagccttgcaaagtgttgggattacaggcatgagctatcatgcctggccaaaattctattttttaaaaagtatatcttacctatgtttagataatttttctgatgagttagtactcatatgggtgcttttttttttttgaaatacatagactattggtcttagacataacaggacacacactaaattctattaaaacaattcagggactcacccatgcatacagcaattatgattgtgaacatccaagacaaattagtatggaatgtcttaattaaagctgggtaaagtaatttttttacagatagattgaattttattaaatatttagagtggtatattttcatttcactcttatgtaattaatatttagcacagttctttgggtatcaggttgcattatttatgcacattttttgagaaatataatagtgtttttttgttttgttttgttttgttttgtttgttttgcgatggagtcttgctctgtcacccagagtacaatggctggagtgcaatggtgcaatcttggctcactgcaacctccacctcccgggttcaagcgattctcctgcctgaacctcctgagtagctgggattacaggtgtgtgccaccacgcccagctaattttttgtatttttagtaaagacggggtttcactgtgttagccaggagggtctcggtctcctgacctcttgatctgcctgcctcggcctccctaagtgctgggattacaggcatgagccactgcgcccggcctgagaaatataatagtatttctaagaagtctctggaaaatagaccataattttttttattatattcaaaatgcaaattttgccttttgctaaccagataaaaatacttatgattttcgtatttgcttagttacaggtattaactgagcaaaattgttaaaatgtgtttgattttgtttggatagggatttgttttcatgttttcaaactaaagttgagaatcttttccagtggcattcttaactcatagatatgatgtgaaaattgtagttgccttaatcctgctcttgttgtctttaggaaaactgtgactcatatcagtagcttattaccaaagttacatggctattagagtttgagccttgggatagaagagtaaacattctgcttttgtcatgagatactgtttttttggctatagtattccctctaaggcagcctctaagaaaagcatcatttatcttagtttagctatgagaagtctacagaaatcctttcctcattttaaaaaaatgagttttcagaaatatccacaaatattcaatgaatagttaagcacaaaactgtgtaatgtttagtaacactcaacagatgttttgctaagccttttttaaaaattataaatcaataaatacataaagaaaaaacaccttgaaaatctttatatcctttaatggtaaaataggacagtatgaattctcatctagtcctatggttttcacattgggagtaaaagcgcttggatttaatgagaagtgttctgttggaatgaaagaaaactgaatttcttaactctaggcagtagcttattagcacagtattgttctctggtaaatacctttgcttccattttctcacctgcttccactcgtaaattctcacctcctgcaatagaaactttgcctcttagtgactttgtggttgaaactagagaaaagctgtttactcagcaacatctagtattttgctgcttcttcctgggtgattagatttagaaatcatgaaaatggaggcttttttcttctactttttgtttggcaagcatgttctaattctttttttttttttgagacaagagtttcgctctgtcacgcaggctggaatgcagtggcacgacctcacctcactgcaaactctgcctccggggttcacgcccttctgcctcagcctcccaagtagctgagactacaggtgcctgccaccatgcccagctaattttttttgtatttttagtagagatgggatttcaccatgttagccaggatggtctcgatctcctgaccttgtgatctgcctggctcagcctcccaaagtgctgggattacaggcgtgagccaccgcgccaggccaagcatgttctaattcttaaaattgatctgccaatgactgtggaaaaggtaatcacttatttcatacagcaataatttattattaatattttttaaaaatactaaaaattaacctcatatcacaaacttttttttctcataaactgttgtgtcactagtataatctagaatttaggaggggagttattttttaaagaaatcacttatttgtgattttttttttcctaaaaggatgatttaaaaattatcttttgacttttcaaaatcaaactttttctccttgagtttaaatatttattatgtttcaaatgtcttaggaaaaataaaagataattttttcatgtactgatagtatatacattaattttccagagctctgtctaactagtgctgattgatcaccagagcactaatttcttcacattatgcatgcaaatataaaactgctctcttgtctgtgttatttctggcttttaaatgtgtttacaatattttagaaagttgcttagtttttgaatttctcaaatgccgcatatatcagtaagcaaaataaaggccattaaaaaattacagcagaattaaaatttcaaggcagaagtatgtcactctcacacgataagccaaaagaggtcagacttgtctttctaattatttccagagacctgccctacaaatcaggaaccatcacatggatacataaaagtgtctttaattgtgaaagcaactatgcaaattattcattgctatcatccctgatcaattcccagattattttcaaactgagagacccaaaatgacataattttaagggagttacatggaatagtcactttgataattgtgtactcattttaacatactagaaaaatatgatatattaaaacaaagctttgactgatattgtttaggataaagctaaataaaatttataaataagtcgatttaaataaaacattaaggagaaaattggaccctattgtaggagcttgactatggcagccattctaagggtagcatgtgattgaggttcagtaaagtgaggtccaaagcagcccttttggctctgtaggtattatttgattgaaaggagtcaagatttctctaagaactctcagagtaaggagccttgttttggggaagatgtccatgagtggcatacatagcagaactgtgagcaagatggcacttcagagccactgctgtcaccatctctctccttgaatcttggtctttttctccctctggtgcttctgctgtctcccatctcctccataagatttcttcctctaccctccttccaacttcaactattgctctaaataacttaatgactatggtgtttccctatgtatgttcccaaaagttatttcccagaccttgctctctaaatttagatggtcttgagttaagcaccgcacctttggtataatcagttatggccagggtgctgcagggatgccagatctacttagagctgtgagcagggcacgttcattcagacagtctgtgagctgaagaagacagtttgatgtcatctccaggatatcattaatgtcacccaggaggaaattgaggcctaggaatgattatacagcaaatgaatacacattcaagactagagtccattgggttcattgctaatcaaatattatccccatttatctgaaaatatttattatgcatcatcagcacatgagatattatgaagtaactaaaagtgatttagccatagagtctttcccctttagaaaactaatataggaaatagatcccagcaatgtcgagaattattatggactgtggaaatgaataggtttagactactataaagttgtgaaacaatgaaggttcatttcctgaatctactgaatttctttgattttttttttttcatttccttttctgtctttcctttccaggggcctagtactatcatgacatgtcttgttctagaattctcttcttttcctcactcagtccctatcaagctagatatatttgctccccaaagaaaaaaatgtttctttcagctcttttttcttcttttcctttcctttccttcctcccttctttcctttctttcttccctatttctatccttcctttctctttctttccaacattgccaactgacaaacaacccttctcaggtaagattttttaaaaggaagaacctctggaactatatttatttttttgtgcgtcactgattacttttttgttccattgtttacatttcccgtcatcttactgactgcctactgctgttcttcaagagctctatatttgtacctctttgcttttctattttattgagtctattgtcatgtcatatatttttgcatcccttcttcttatattatcagtttctaatcatatttccaactgcttttataatatttatatgggtatcacattattgcctcatcttaatgctttgaaaattaaagcatcacattggccctgctctgcaatagggatattcctatcctaggaattagttctaaataactaattttcatcaatgatcagtttttttttgtttgtttgttttattttgtttgtttttttttttttttttgagacggagtcttgcactgttgcttaggctggagtgcagtggcacgatcttggctcactgcaagctccgcctcctgggttcacccattgtcctgcctcagccaatgatcaggtctttaacttgatctttagtcttctctttcttgaatttcaggatgttaccactttttgcctttattaataatgtgcgtgtggatattcaaaaatttttaaatctattttcctctatattcaaacccttcctttccttcaagaacccaaaacctaccacactcataaaattatcagactgccacagcatttggtaacctctataactgtatttttctgacaccacatgaattagcaatcattaggttaaagagatattttaagaataggaattaatatttctagaaataaaacatctaaaaaatggtttataaaaagtcacttttttaggctaatcaaacataatatagtcattataatgttactataggcagagaaacttacagggctgatgtacagtattaatttttaggttcattttaacatgcagttattgggtccagatattataatagagtggaaagattcaactgtctattaataaaagactagaagcaatcatggcacctccatacagtaggctgttttatagttttgaagaagcttggcatatgtcctgcaagaccattgagtcaagggaaaaagcacattgcagaagaggatacacaatctaatatatgcatacaacaaatgttcatacaaatatgtacacacattttatatttgtacagggtcagtgttgaaaatggtgcaacaaattgtccacactggcttctactaaggtaatgtaatagttactttatacattttattatattttgaaatttcccaataagcctaaattaatattataataaaacaaatgtattacaaacaacaaaaaaaaataaagaacattggaaaaataaatgctatcactttaacggacatactcattccatttctagttgtttaataattgtgaaagtgaaaaaagtctcatgttacagtacattcattctatatgaaatattaacaactttaatacttaatagttgcaagtgtcatttataaataaagttatatttttaaattatttcattattttggtgctgtttataaggcttcaaaagatactcatattacttgagaaatatatgttgtcttttcttctaggtgttataaactttaaacaaatttaatttgctgtgtattttagttgaatatggagaccgacctgctgaagtaaaaataatagtaaaagtaactctatatcattcaaaaatggcatgctgttataattttatagtttcatttataattttacagtttgtaatttcatccagttctctacgacaacatacttgattcttttgggattagactttggagcaataagatgtgattttttttcttaaagtcattgtaatctaaaattgtccaggtctcacaaatcttgctgctctttttttttttcattattttttattattatacttttaagttttagggtacatgtgcacaatgtgcaggttaggtacatatgtatacctgtgacatgctggtgcgctgcacccactaactcgtcatctagcattaggtatatctcccaatgctatccctccccctttcccccaccccacaacagtccccagagtgtgatgttcccctttctgtgtccatgtgttctcattgttcaattcccacctatgagtgagaatatgcagtgtttggttttttgtccttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgcgataaacatacgtgtgcatgtgtctttatagcagcatgatttataatcctttgggtatatacccagtaatgggatggctgagtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaagtggtgtgagatgatatctcactgtggttttgatttgcatttctctgatggccagtgatggtgagcatgttttcatgcgtattttggctgcataaatgtcttcttttgagaagtgtctgttcatgtccttcgcccactttttgatgggcttgtttgctttttccttgtaaatttgtttgagttcattgtagattctggatattagccctttgtcagatgagtaggttgtgaaaattttctcccattttgtgggttgcctgttcactctgatggtagtttcttttgctgtgcagaagctctttagtttaattagataccatttgtcaattttggcttttgttgccgttgcttttggtgttttagacatgaagtccttgcccatgcctatgtcctgaatggtaatgcctaggttttcttctagggattttatggttttagggctaacatttaagtctttaatccatcttgaattgatttttgtataaggtgtaaggaagggatccagtttcagctttctacatatggccagccagttttcccagcactatttattaaatagggaatcctttccccaatacttgtttttctcaggtttgtcaaagatcagatagttgtagatttgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggtagtatggccaatttcatgatattgattcttcctacccatgagcatggaatgttcttccatttgtttgtatcctcttttatttcactgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctaaagttgcttatcagcttaacgagattttgggatgagacaatggggttttctagatatacaatcatgttgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccattaatacctaatttgttgagagtttttagcatgaagggttgttgaattttgtcaaaggccttttctgcatctattgagataatcatgtggtttttgtctttgattctgcttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctgttgattattgccacatttcagctcctgttattggtctattcagagattcaacttcttcctggtttagtcttgggagagtgtatgtgtcgaggaaaggaacaaccggtaccagccgctgtaaaatcatgccaaaatgtagagaccatcgagactaggaagaaactgcatcaactaatgagcaaaataaccagctaacatcataatgacaggttcaaattcacacataacaatattaactttaaatgtaaatggactaaatgctccaattaaaagacacagactggtaaattggataaagagtcaagacccatcagtgtgttgtatttgggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgatctacaaagagaattagactcccacacattaataatgggagcctttgacaccccactgtcaacgttagacagatcaacgagacaaaaggtcaacaaggatacccaggaattgaactcagctctgcaccaagcggacctaatagacatctatagaagtctccaccccaaatcaacagaatatacatttttttcagaaccacaccacaccgattccaaaattgaccacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaaggagaacaaagacacaacataccagaatctctgggacacattcaaagcagtgtgtagagggaaatttatagcactaaatgcccacaagagaaagcaggaaagatgcaaaattgacaccctaacatcacaattaaaagaactagaaaagcaagagcaaacacattcaaaagccagcagacggcaagaaataactaaaatcagagcagaactgaaggaaatagagacacaaaaaacccttcaaaaaattaacgaatccaggagctggttttttgaaaggatcaacaaaatagatagaccactagcaagactaataaggaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaaatcttgctgctcttaaccactatcggtacaccttcagaatggccatgttttatgccggaaactgccttgtttactctgcaactcccttggtatttcactttcacccattatcagttctttcatgtttttctgtcctaccctcctactgcagaaagctcacttcctggcagtgcccagtcactgttcctagagcagccctagggattgctgttttctgctatctgtggaagcccaaggacagaaaggttgtacgcaggcagcacttcctttcagctttaccttaccagagacttgctgtttggaacacagaaatgggtgaggacactctactcttaccgttttgcccccatctcatcctggcaatgcttgtgttgtggttcctttacctataacttcctcctgtcaagacttgtaggaggtttaggagaggctgttctggggaatgtgcagtttgtgtctgttgctgcttccttttcttggttcctggttcccacctctcaggcatgcaccagacatcctccttagacttccttaacgaaggacaccttctctgcatgcaaatcagctcttaaaaatggatacctgggggtgaatcaatgtctaacctaattctaaatataaatttaagcttagcctgcaattctgtgacatgaaacagatttataagtttgcttaacattatctatacactatggtcatgtaaaattgctttgactggaaacctgagaaaaacatttttacttacaatttctttttaaaaatttgctttctttcagagtttgaattggtatttccaagaaccagataataattacaaatttctattcttttgcagttttgctcctttcccataattctggtactccagaaagtagaactaaccaaataaatgtgcaatttgatttaaaattgtaccactggtcctgacagtaagaacaattgtaattttgccttaacgtccttttttcacacttaccagatgccttgaaactgtaaatacattttaaaaacgtggagaaactttttttcccacttcctacttattttgttctaactgtatttcacaattccctgttgctccggtgatttatgtgtttgccattttgtctgtgatgaaaatatttgtaaagttaccttcagtaaaaagactatatccattaacttaagaatggcatgatactttaaatttttaaaatgaatttgataagggaattattttagaaaaataaagactttaagtttgatgttttggtttatttttcaataagatgacaaacgaagggtaaagtacatggaagactagatgagagggctatcacaggaagcacccatagactttagatacatatgcaaagggatttaataatctattcaccaatttggtgagggagggattcttgttttaggattatggggatagactaatacacaatattcacactagattgtacagatgaaattgatagcagattatcacatatacacactcctagcacagggaaagaggatacagcacaccaccgtgggccacatgaagttgcactcaaaagcagaaggaacaagtagaggctgtgggagagaggcttcatagtgtcaagagagcagggtgacacctgattcccatgggaggatgtggttggcttatttgaaaaattccaccactggcagaaaattgaaacctgctactcaggtatcagcaagaactccacctagtccctttgataaggagccttgtttggctgggggaccttatccacaggagcataatggagaagggagcttgtgcgtaagccatttgagtccttattggtttcaccagagggccttagttttggcattacaactcaaaatgactcctgtgttgtctttacttacgaggaacaaataccttctctagtagttaaaaaaaaaaaaaagatgttttattacaaaggcaaaaacaagggctcttatggatgtccaaggccctgcactatgggaagagttcaagaccctaaacctgtattctatgttctccaagagcagtcctctttctctcattcgtggatgatatgctcgaatatgtgtagagcatccttgcaagtagggagctacttacactttctcttcctaataattgtcaacaaaaagagtcaaactctgtaaaatattttaagagatttattctgaaccaaatatgaatgaccatggcccatgacacagcccttaggaggtcctgagaacatgtgctcaaggtggtcagggtgcagcttggttttatatatttttagggaggcatgagacatcagtcaaatacacttaagaaatacattggtttggttcagaaaggcaggacaactccaagttgggggtcttccaggctataggtaaatttagacattttctggtttacaattggctgagtttatctgaagaactaggatcaatggaaaggaatgtttaggttaagataaaggattgtggagaccaagttttatggtgcagaggaatctctcagatagctgacttcagagagagagagcaggttataaaatgtttcttatcagacctaaaagggtacctggctcttatttgattgtctcctggacctggaaagaaaggaaggaaaacaaaggggaaagaggattctctataggatgtggatttttcccacaggatactttgcagggcaatttcaaggtatggcaaggaaatatattttggggttaaatattttttccttgtcttgtaatgttatgccagagtcagactgaaaagtaagtcacaatatatagggtcaaataaaatccatctaatgcgaatttatggttgtcaggcatgactccctagaccacttaggtaggaatttgggtaagataaaaaatcagaacttagtcctcataatcttgtatgtttctcttgagagtcttgactttccagctacagtgcttgctaacaactctttctatgctttccagttccaattccaaagagatctgatgatctcttttgccattgttgcagagggattaacacatggccaggttatgaatgagctgcttctgagacaggcatccattcttattatactcagtggtagctaaaatagatgtggagacacataacaaaacatggctaaataaagaagcagaaattgagggcatgggtttcctcatcaaggaaagatgtgggaagcaagaccttctgaaatatgcatagcaaaataccccagagcctcaaaccagttctgcactgcatttttttctttcataaaataaaactttaattttttaactaccaagtcaaactagtgaatcagccttggcttttccctctttcttctttccactccccatctgtatttttgacaaactaaagatgtgaagttttctttcttaatatttctctcttcctttgaaatataaagacattacccagatccaggctcctttcccttcagcgtgaatctgttacagctgtcctctggcacctttagggatcctgtacctccagaatctctctttgtcagtccctgctgtacccagcccaaccaatcctaatgaaacaccagtttcaaataggcttatgtatctccctattcttccagaattgtcctcaaggcaataccttgaattgactcctatctttctatgtatctgccctatttcctgacaaaaggaggctaactttagggaattttacacctgcatagacaactggaattgcaggttaggatgagattaagatcaagattgttatatgttttgctgcatttgttgttttccaaaccagatcataaccccctggaggataggaattaagtcaggttctttttaccctagaacccattcaatcatatacactttgatgttgatttctttatactttgaaagcatttataggaagttatttgtgtaagagttaaagaagaaagaaacacaaaaagtggctcaacagtcaaagacaggtttattttggagaataaacctgagaggggcatctggccaattttggtcaggagcattctctcttacagactaagggtatttaagcgtttaggaagggagagcttatcacaagctcagaatgtttctgtgcacaggagagttttattgtggggtcggcatgtctctggacagagggtaggttatctcagggctggcatgtttctggttggagtggaggttatctcagggctggcatgtttctggttggatggagatttatctcagagctggaatgtttctggtcggaggtgtcacttgtagtttatggtcatgctgacattagtcattaggctaatggtttggggctggatttacgcggtttttaatcaaggggaacttaaaattgctgtgtttgtcctagatggtgatgatcctgctctgtcaatttgtattggttatttgattcaactgcttagaaaaaaataagtatggctattttgtcttatctgatgggattacatagtataaaaacagactggcttaagtatggcatctcaacatctcacagccacaaactggatattgcgtcctaataatgaattcacgttgatgatcttttcagtggtattgcaaaagaactcccttattgattaaacacagctcttgatttttctaagcatataagtaaaactcaaagaattaaaacaataaagttttcctgggagaggaaaatcaggaaatctgacataaaatgccagtttgccttaaattagtaattacttgtgtaaagtgtgcattaaaagatacatagcctgggcacagtgcctcacacctgtaattccagcactttgggaggttaagccgggcagatcacttgaggtcagaagttcaagagcagcctggccaacatggcaagaacccatctctacaaaaaatagaaaaattagctgagcatggtggcatgctcctttagtcccagcttctcaagaggctgaggcaggagaatggcttgaacacaggatgcagaggttgcagtgagccgagatcgcatcactgcattccagcctggatgatagagtgagactccatctccaaaaaaaaaaaagatacataaataccacttaactatgtgatttgttgaaattatgttctatgtatttacttttatcacattgaaatacattctgttcttatatattttttttcaagttaagggtgaatgccaaacatgcataaacctcacctatagagtctattgcctttcagccttgttatgccttaatactgattctgtatgcatatatacataatttggtagatatttagcaatgttacatttggaaaaactaggccagtgtactataatcagctttggaaaagttgttctcatttgcaatttttcttacaattgaacaaatgactgttaaatacttcatttttctaagtatatggattaaaatatagcttgtagaaatgtcagagtattctaacttgaaatgtaggaaagcgttttgtgtagttttgtaagttctttcttcaattttgtggattagtaagtacataaaaagaattcattctgactgtaggctgacaacattggattggcagctgaaaaaagttgtcagcattgcctgtcagattcaaacttagcagtgtacaaggtttataaaagcttgaagctatcctgtcaacactggcatttcattaaagattaattaacccgaatttgcttgctaataaagatcaaaatatcagtcatttctctcacaaaaaacgtgtgactaacttgtagcttatgccttgtgtatgtgcatattcatggttaagaaatgaagtactataggtcttttttaagtttatactaaaggcaatggtgtgcaaaggaaagtggaaggttttagttaaaattagatcagagcatacacatagctaaaactgacttcagtatttgctgcaaccaggaaaatagaggaaaatatctcttttctttgaagaccattccagaattgattttacacttcacttttctaatgttcacatattagaaaaaaagttaatcctatttaaaatgtgaaaatagatcacttcatatttccaactgactacaatataatacagtgaaaatgttgctaaagttctatataaactatatgtgttaaataagtaaatgaaattaccagaccctcatgacttttccgctcttatagcaataataaaaacatcatttaaagctgctgtgttacattaagtcattactgggcaacttatttaatgaaaaataagcttatccattatgtaacaaatgttttattggtaatgtattgtgttccctgaactctgcaatgtaatgaggataaatggtaagcaaaacagacacattatgtatcctcacggatttaacaatttattgggggaacaactatgggtttaagtcatactacaatgcaaaattgcagctctacatgtgctatgaaggagtggtttccaggaccataagagtctgtgataagggggtttacagaataaagcagatcaaggaagtcctctttaagaggttgccctggagtttagacctgaagaatttgtgaggaggtatcagttgaaagagtcagggaaagatctgcccagacagaagggctgaataaaagaccctttggcaagaaggagtgtaacaaacacagggactgttatgggttgcattatgtcacaccaaaaagatatgctgaagtcttaaccccaagtacctcagaatgtgactttatttggaaacaaggactttgcagattttacaaagttagaatgaggtcactggggtagaccccaatccaatatgacgcgtgttcttgtaagaaggagaaaggtgggcatggacatgcagaggaaagactatgtgaagagacacagagaataaggacatattcaagccagggaattcctgaggttaccagaagccaggaaagaggcctggaactgatccttccctagcaccttcagtgggagcatgactctgctaacaccttgagtttggccttctggcctccagaagtgtggcacaataaatttctgttgttatcagtcactcagtttgtaatactttgttacaacagccctaggaatgtaatacagggactgaaaacatatcagtgtagattgcaaaggaagaataagagcaacttgatctgaagagaggatagaacaataggcagggacaagacaataggtcctgaaggccatttttatgagtttcctttttattctaagagcaaaggatttaagaagtacaagaaaaagatgatagtagcttggacactagagtggtagtaatggttatagagagaaatcattggaaatagggaagtgaataaaaaattatgaataaaccacaaaaactcaggcttactcaaggacatcatttaagccattgtgtttgcttttgtcatcaatttttcaatctctattaaaaactggttttcgttaacagattgaggagtagttggcatgtaatataatgcatgtttaaaaagtgtgaaatttaataaattttgacatataattataaaggtatcataatcaagatagttaacatccaatcatctcatatccaataatccaataattaatgtctaaacccaaaattttcctagttcctctatgtgttactttatttatttatttattgagatggagtcttgctttgttgcctagcctagagtgcagtggtgcgatcttggctcacttcaacctctgcctccccggttcaagtgattctcctgcctcagcctcctgagcagctgggactataggtgcacaccaccatgcccagctaatttttgtatttttagtagagacggggtttcactatattggccaagctgatccaatctcctgactttgtgatccacccaccttggcctcccaaagtgctgggattacaggcatgagccaaagcgcccggctgttactttattttaatattcctttctctgaaatttatttttcttatattgtcatcccagttttttattattagcatgacgtattatttcccactattttaaaacttatttgtatctttgtattaaagggagttccctgcagacagcaaataattggattttactttcttgtttaatttgataatgtctgccatttaattggaatatttagttcacttacatttaatgtgactattggtatggttaggtattaatccaccttttttttttttttttttttttttttttttgagacagagtctcgctctgtcacccaggctggagtgtagtggtgccgtctcggctcactgcaacctccacctcctgggctcaagcgattctgcctcagcctcccaactagctgggacaacaggcgcgtgccaccacacctggctaagtttttgtatttttagcagaggtggggtttcactgttttagccagggtggtcttgatgtcctgacctcgtgatctgcccacctcggcctcccaaagtgctgggattacaggtgtgagccaccattcctggctaacccaccattttctacttgttttctatttgtttcctttgttctttgtaatttttcccttttttcctgctttctttaggattatttttattccattttatgtatattgttaccttattagtcataaccctttattttggtggttgtttcttgcttcaagtaatattaagttatgtacctcttcacatatagtatgaggaacttgtaagaaaatattactacttccaatttcttctcctggcctttctgttattattgtcatgcatattattgtatatatgttataaaagtcacagtacaagtcatttatcacttgaatgcatttaactattaaggaaaatatcttatgtatttacccaaaaaagttaattctacttgtgatcttcatttctttgagggaattttaatttttacatgattatcattttactaaattacttttttggacatttcttgtagtgtggggtttgctggtgaaaaattggttcattttctttgtctgaaagtacttattttagcattttttaaatgatattcttccaggttataaaattctagattggcgtcctattatttcttttagtatttaaaaatgttgctcaactgactgcttacttcattgttttctactagaaattggctgtcattttgatctttgtcttttgtaaaggcatatgtttttttgtctgacccctttcgagattttatcactgattctgagcaatttgaatataatgtatcttgacatagttttcttcatgtttcttgtggttgaagtttgatatgattctcggaactgagagtatatagttttcctcaaattgcaagattttggctactatttcttcataattttttgtccctttttatttctcctttcctttagagactcccattgacaaaaagattcaaactctgtaaaatatttgaagggatttattctgagccaaatataagtaaccatgacctgtgacatatccctcaggaggaactgaggacatgtgcctaaggtggtcagggtgcagcttggttttatacattttagggaggcatgagacatcaatcaaatacatttgagaaatacattggtttggtccagaaaggtggggcagtttgaacttggggggaggatttccaggctataggtggtaaatttaaacattttctagttgacaattggttgagtttgtctaaagaccttggatcaacagaaaggaaatgttcaggttaagataaagattgtggagaccaaggtattttgaattctcatagtggctgccattaaagacaatagatgacaaatgtttcctattcagacctttaaaaggtcctagactctcagttaatctcttcaggaatgggagggcctgggaaaacaaagatctagctatgttaatagagattctttacatatgcaaattttctcccacaaagtacagctttgcagggccatttcaaaatgtggcaaagaaacatgtttggattttcttctttgtcaggtaatgttacacataaaatatttggattttcttctttgtcatgtaatgttatgccagagtcagattggaaagtaagtcacgatatatagggttaaataaaacccatctaatgagaatttatggtttgtagggcatgactccccagatcccttagataggaatttgcatgagataaaaaaaatcaaagcttagtcttcaatcccattgcatttatattagttcactttaagtattccacagtttatggatgctctgttaatttttttttcagtttgtattgttttgaattctatgcctccaaattaatttttctcctgcaatctctaatctgcttccatctagtaaattatctcagatattatattaataattctatcaccagacattttatttgatcctttttaacttccctgtttcttcttaacctatttaatctttcctctcattttttgaacatatgaaatttgatgtaatgacttaaaatgttctctttttttgagccagagtctcactctgttgcccaggctggagtgcagtggctcgatcttggcccactgcaacctccaccaccctggttcaagcaattctcctgcctcagcctcctgagcagctgggatcacaggctcctgccacggtgcctggttagtgtttgtatttttagtagagtcagggtttcaccatcttggccaggctggtcttgaatgcctgacctcgtgatccacccacctcagccttgcaaagtgctggaattacaggcatgagccactgctcctggccttaaaatattcttgtctaattttatcatctgtgtcagttatggattggttttgattgacttttctcttcacatggttcagattttccaatttctttgtgtattgttaatttttgtttggatgccaaacaatgtgagttttactttttgggtactggatatttttattctatattctttagatttcttttgaaaagcagttaaatcacttagaagcagtttgatccttttggatcttgattttaaacttagaacagaatttagtgctggggctttttttttttttttttttttttttttggtctcacttcaaaagtgtgacctctctaagagcagtgcccaatagccatatgaattaataagattttttagtttgaaaacactcattattctcagccttactgagttctgaatatattgttctcactattcttttcaggtggctcttttcatatccttggttagtgtcctaacaaacatgtgctaattagtacccagctgaatattcgaggagaattgtttacagatgtctggaattttctctctgctgccctcttttctctttagtgtgcactttactatgctgctgtagagaggctatcctactccagaaagacttgtttataatttcttcacaccactcatttattcattttctcctttatacttcttccaatctggtttttacatcctctgaaattcttatcaagtcatcagaccatcattttgctaaatctagtgtttatttttggtataaatattctggcctccataatgtctgacctcatcttttattaatttctccttcaatccatcacattaaaaaaattcttcgatcacagtaggcatgattttgtcttagaacatttatactggctattttttctgcttgaaatgccctttcttcagatatttgcctcgttaacaaactcctctatttctagacttaactcttcgtcttagtcttagtccatttgtgctgctataacacagactgtggaattgataaaagacagatatttatttctaacagtctggaggctgggaagtccaaggtcaagtcaccagcagatttggctctccagcaagggctgcatcctccagagtgaaggaaactgtgtccttacactgcctccagaggcagaagggcaagagagagacactccctctatccactgctttgataaggatacctaatctcattcatgagtatgatggttaatattaggtgtcaacttgactggattgagggatgcctagatggctgatgaagcatgttaatagatgtgtctgtgagggacacatctatttgccagaggagactgatatttgagttagtagactgggagaggaaaattcatcctcaatgtgggtggcaccaaccatttgtctgccagtgcaggtagaacaaagcaggcagaagaagaggataggcagcttgttgagtctttttgctccttctcttcccatgttatgctggatgcttggcttcctctcctcgtgcccttggatattaactccaggttcttcagcctttggtctgtgaggcttgtaccagcaacctcccaggggctcttgggcctatggcctcagactgagggctgcactgttggcttccctgatattgaggcattcagatttaaactgagctatgctactggcttctctctttctctagcttgcatatagatagatacagatatagatatagatatatagatatatatatagatcctattggttctgtctctctgcagaaccctgactaatacagtgacggaggagccctgaaggcctaatcacctcttaaaggccccacctcttaatactatcacactggcaacatctgaattttggagagggcacattcaaaccatagcactcttcaataagcctaatcaccctacttaaaattccagcaacttcccaggatagccagtctctaaagataaccctcaataaaccttgtgtaaccctttcctcttgaatctgggctagccctgacttggagccaatagaatgcagcaggtgtgacaatctagatcttctgaggcagtcagaggacaacttgcaaattctgactgggtctgcttaaatgctagctgtcagggtgctcactctcagtacacatggagaggccacctttaggcaccttgatcaataacctcagctaagcctacatttgacaaccagtatcaactgctggccatgtgatggagctgtcttggacctctagcccagactaaagccctggctgatatctgtctgtaaacacatgagaaactgtaagtgagagccaactagatcagctaaaacacagtaatacaagttaataataaattgtttgaagccactaagctttgaagtggtttataggcaaggatagctagaaactctgtttgccctgcacttcaatttttaatctcttgctctttgtctttttccctcagcatttgttatcatttaacatactatatgatttgtgatttattatgtttattatttattttttgtcttgttgtccccaccagattgaaagctctaaaaggtggcaatcattgtttgttgtgctctctgatatatctcagttgtctagaacagcatggctaatacatagtggaatttcaataaatatttgtaaaagtaatgaagaaggcggtagtctatcctaaaaagttaaacaagactcattcaaaagatgatcacaaatttactcaaatgtggttcattcccaaagccaaaatgataaattaagatgtcaacaaatatctatggaacacaagctaaattacagacttgtaattattaatagcaaactggagagtaattattagaaaaaaatgaaatttgaaattactttcaaatattacaccattataagcctctgggtagtgattttagattaatataaaatttgatgaaaccaatcataatgaaaaagatacctaattattgtcactcaaaaataataatttaaacaaaatttaagggcatataaccacaatgttcaatacttggatttgttacagtaccttttttaagtgattacagggttaacataatttgagttgtgcatatttatttacattaatttcacttcacttaatggaatctgctggagattgacttgtgtttgtactaaaaatacataaaatatattaagaaaaagcagagagagagccactgatttattgtgtttggtgtccaagaacagctcaaactgctttctgtgaaagagttatgccttactgtttccttaaaaatgttttgtctgccgggcatggtggctcatgcttgtaaatcccagcactttgggaggctgaggtgggcagatcacaaggtcagcagatagagacaatcctgtctaacacggtgaaaccccgactctactaaaaatacaaaaaattagcccgccatggtggcgggtgcctgtagtcccagctatttgggaggatgaggcaggagaatgccgtgaacccgggaggcggagcttgcagtgagccgaggtcacgccactgcactccaccctgggtgaaagtgcgagactcggtctcgaaaaaaaaaaaaaaagaaaaaaaaagttttatcttgaaaactatatgtcagttcttagttgagttagtaatatgaggaatggctacaagtttttaaggaaaaaatacattttaagaatgttcactgaaaacccttttaaaacaacaggttctgaattttaaaaatattcagatagatttctttttgaacatataactggaatctttattacaaaagaatcatcaatgtttgacttctaattcatatgccaacatgcatttctaagcaaactataaccaagaaaaatgccaagcacactctgtaagcttagaatgcatgtgaatttcatattaattctttttgactcctcctgaacttgagcatcttacaggtctgattgggcaatttatcagttctcatgctcaatgaattcagtcgtagggcacatgcaacttaaagcaatgaggcctaactgccagggtgcttagaaccatcagtagggatgaatagcacagagtcagcatacaaatagaacatgaacatagagcaaaggcgaacatttagcctgactttggagcaaaaccagagttaagaccaagccctacctcagcacactgacgcttcagttttacatgtttgcttcgtagacagaactacttcacatttatttaccttccattatacaatctgcacattaaaaacaaaagaaaacaaaacaataatggccattaaacaaaaatacatgatgtagcttgctaaataatttatgggctttttggaagtgttttgggcagatttcaacctaacattactcttatttcctattcttttccttatagaatggagtatcatgataactaggtactaagtcaagtcaacagtgggccaagttgcctctgtggaatttaagctttacatgaagagagacttaagtatatttagtccttggtggtagaactctttagtgtgaagtcaagtagttgcttttgtagctttgattcaaagaagccaaaatcaaatgctatggggcctggaacatggtgaaagtggactatctggcactgaaacttggaaaccctatctaaaggaagcagtcactacttagctctaccaatagttgccatgctagattgtgagaccagggatgccaggtattttgtttctgcaagagaagccagaaatatggatttatcatgtcaactctcctaataaatactgaaatgtacttcattctttggtgctttatgcaagacaaaaaaaaaaaagaaaaaagagagggagagaaagaagaagcgaagaaaagacatggactctcatgtagattgaacttggtccacagtttactagcttgagatctgtaagaataaactaaggaggtaagagaaggaggagggcatattacttaggtgagaagtaattgtaaaatgtattataagcatttattagcacagtaaaatttatggacaaaatagaaacttcaaactacattaagccttctgtaatcgagctgtatcacctgcttctcattgatatcctttttcttactacttcctcccttattcagagaagtgttggctaattgttcacaattttactatgcactcactttccattctactctattaattaacactatcattcatttatttaatgaataaatatttttcaagttccatatgcgttgctttctagtatacgtggaaatgtggtatagccaaaaagtcacaatgatcacgtggatgctattcctaacgccttggcctctcaatatgttgacttccctgaattccaaaaggcatcatcattttgcttcagctcaacattcctaaggtcataatctggacattgctgttaccaggaagtgttccatgtctaaattcatgaattcagatttttaactcattgacccacccttccttccttccttccttcctgcttgcattcctctcttcttgccttcctttctttatccttctcttttccttctttccttccttccttccttctactctcccttgcctctcctgttctgaattctgtaagtattattgcactccatctattttttgctctcattaaattctttgaatcttgtaatttctcttatatcaacatcttctacctcccagtagtatggggtcctgttttattcaagctaatcttcatgctctttcatattagtgaatctcatgacaaaatctgtactctttggatcttgattttttatagacttgacatgtaaaattctacctttttgttaatccacttccctccactactggaggttgataccactgtgagtttaggttcatcaaatttgattagacctcaaaattctctagatttctagatcttttacatatcttttaaccatatctttttcttactcttcacagtggctattttaaacctttctcattctactcaagctccgactgcaactttttcttacttaacacatgaccatcagggcaactgttcttaaatttcttcacttacctcatctaccaacttaactaacaaggtatcatggttttaaaaagtgctatgttcaggataattccttcaactatgcttattatactatccgctaaactgtccttatttttcattcattcattttataaatcatatattaatcacctagtttgtgacaggtactgttctgggctctttggccacaccaatgagtaacacatattaggatcctgttctcagaaagacgttccactgaaaggaggtaatcagctgttagaaaaatattagtttcagctagtaataagaactgaaaaaatactaagacaaggtgatagatatatcagatagtgagtacctgggtgtgaagacacttccctgaggaagagacatttggtcagagaatgacaagaaggagccagccatgagaagacgtagaggagaagcatgtgaattcacaggaaagaataagcacatgcatcctaacttgggaaaggacttggtgtgtttcatcaatgcacatgcagttgaacaatcatgggtaatagtgggagatgagattagaaggtcaatcaggagcttaatgtaggttatgcaggaagccttttgtggttgttaagcatgggattgatgtcatccaatttagatttttaacaaaaacccataccatgctgaatgttgatggagttacgtaagggtagaagaagagatattatttagtaggtaattcaagtaatgtaggtgagagataatggtggcttgattttagggtgatactagggaaagagaatggttgacagattaagagtatatctagagggtaaagccaaaagatttgctgatctatggatatggaagttaagagaaagaaaggaacaagaataactcctagtgttttttgtttgtttgtttgtttctttgcttgactaattttgttatgtcattcattaaattgagaatgaaagaacaatatttttgagatcaaaataaagttgcaatcctgagttaagttttatgcatgctaaatttagatgctttattaggcatgcaagttaagatgtctaattgacaattggatatgtgagtttggagttcagaagagaggtcagcactggccatcaatattcagtacccgatgtcttgtgggtggtaaagccatgggactaagtgagataatctagggagaaatcagaaagagaaaaaaattcagggcacatccctggctcactctaatacttaaataataattagagaaagaggaaccaacaaaagagactgagaaatacctagcaagataggtgaaaagacaaggaagagtgatacatgctatagaagctaagaaaagaaagtacttaaagaggatgcaaatgtacatacttgccagagctaaaaaagaaaaagatgcaaatgaccaactgtttagctgagaaactagtaatgttaaaactgtgaaatagctgttgaagttggtctggaggggtgtcatttgttataagaactatttcaactgaattggagtcatttgaggagagaatgggaggtaaacaacaggagacagagacaacagacaactcttcttgtaagttttatcatgaaaggagaccaagaagagaaatagtagctggaagagaatgtgggctaaagcagggttttataaagtgggaagattctagaatatgtatgctgctaggattgattcaatagaaacaaattgatgatgtaggaggaagaggatacttgcaggaaccaagttcattagaaagtgagtcgcagatggagctagagcacaaattgagggatagaactttgacgtgagcagggacacttcatttattgtaaaagaaagaaaggggatgggtagaagtttaggtaggtaggtaaattttgtgatgaaaacaaggaagccctagattgaatctatttaacaaggtcatcatttgaaagggaagagtgggtggaaaagaggtagggctggaggccactacacaaagggagaaggtatgaatactcattttacatagtgtcagagtaaatatgcagtgcagtggagttgcagagtattagagaatgccattttgtcactcatggtcatgtatttagagtgagacaaaatagaattgctgtgcatcttgaagcctgcacaatgtgataggctgaataatggtccccaaagatattcagattccaatctctggaatctatgaatgttaccttatatgacaaaagagactttgcagatgtgaaaaaattgaagattttgagtacatgagattaccctatatttatcagatctgttctaaatgtagtcacaactgtccttataagaggaacaccatgattttagcccagtctgactcattttgtacttttgacctacataactgtaagataataaatttctgttgctttatgccactaagtttgtggtactgtgttgcagcagcaataggaaattaatacagtccactacttcattcctttcctttgtatctttatcctctctcttctttcaggccatttcctgttagcaggtaaacatgcttaagagtttccttttaaaaaacaacattaataaacaaaaaaccacagaatttcctacctctacctgctcagctctagctaccatccctttttatatagtccttttaacaactaaggcttgttatttttattatttccttctcatctctcatctactcaaatcttctgccaactctcgtcaacttcttttttccttagtaaactgctttcaatatttggcaaggtgctcttattcttaattccagtatattatttttacttctacccttttcaacctctttgttaatcagttgatttccccattctggtgatattctctccccttgggttctatgataccacatttttaaaaaattacatatttgctctctgaccgttcttctttattctcctttatgggctacatttttctcatggctttttcttggtgcaattttttaaatttattattattatgatgattattattattttgagacagggtctccctctattgcccaggctggagtgtagtggcacaatcatggttcactgcaaccctaacctcccgggctcaagtaatcctcacacctcagcctcctgagtagctgggactataggtgcatgctaccacacttggctaattttgttattttttgtacagatgaggtctcaccatgttgcccaggatggtatcaaactcctgggttcaagcaatccgccttcctcagcctcccaaaactctgagatcataggcgtgagccattgtgccttgctttattagtgttgttaacagggctctacttttttctcattctacatattcttttacagttatcttagctatttcccaaaactttctatttgacactcttagtactcacctggacaaatatactctgttctgtacaccttattgtcatgctaaggtgtcctgagttggaaagacaggctctcttgtcctgctccatggcacactcatgtccgactgcagtgattaactgtattggatttggtgtcactgaactgattttgaattctgaccttgcttttttcctacctgaaatagcaagtgatttaccacctgaatgtgtaaaacagtataaacccactaaactgtattaattaaatgagataatgcacatcaagtacaacgcatagtacctggcatatagggggttaataaatgtgggcaaatattagtatcgctagcttcttcttttcctctctaagttctgtttctgctggtaattctaccatggaacttctcttttccattgctgttgttgtagtagtttctaatgtctcctacaacgtttgatgttcacagcccaccattgccacccccactcctctttttatttttctgcttcacctttcctattactcttgtattatttttatttttcccccattttccccattattcccacattctttattttttctgttttccttacgttgttctccttctcctccaccttttattttttctgaatttgcacatctcaacaaatagtccagaccactctttgcagacttcttcattgccaggatctgcttcttagttttcatagttactgtttactttttcattatgatttatagtaaagatgggaagaaaatgactagtggcaggcctgcaggcctttcttaactaaagacagccctagaaaagaaatttaaagaaaatttctcaaaacatgttagtgacagaccacctggcaaatactaataatatgggctaatgggagagtccttatctatggactgctgcagcaggatgtctagtatgcttatggaaaacaaatctagaacctacggatttatgtgtcatggcccctggaaatgtatataccctatgtaactatcctaatataaaatttaaatgtttcataccaaaatagcttccttttgtgtaagttatgtgactatgcacattccatagcagctttgtttgttaaatctgggccactgtgtcctgatgtgataagaaaggcctgggaatttgtcattgtctttctggatctttccctgctttgtctgtgctgtttgattacatttgtccttgaagtcatcagtaaagcttgatactaagtaaggtttataatttgtgtgagtctgataggacagcttgaatccttccttgtgttttctcattggatatggtggcattccagatgattacagttgttaggaaatttctctctggatatctgaagcaatagtaggctatgattccaacatatctatctgtcatgattacagttctctttgtggtaatatattatcatatgtaattcagtaaagaaatgtgtatacatgcatgtaatacatcaatgtctatatctctgggtccatacaatgccataagagcaaatgtcaatctaagcattgatttgatgttatagagcctctagaatttttgactgctaaaaaaaaaaaacaaataatttgttaatttggtttctatttaagaaaccatttccatagaaatagatgcagttcttttactgaattacatatgaatcaaattcacaaataaagttagctcactttaaaatcatctaatctccttttaaaatgtatgacataaattatttaggtgttatttataagaggtggaaatataacacatcatatttatatcctttttttgctgtaatgatgaatattacaatttcttgagtgtgctattttccagacaaatgtgtattccattgtattgtcattagaaccataacattttctagaatgttacttacatcttaatgaagggataatcatgctatgaagcttttatattttcaacattacatttatttctcagtaattctctcactttgcagaaatgattttcattcttttacatttttaatgtgtgatgtacctaatggaaaataaagataatgctaaatgaaaatgagtgttattcattgataagaattcaattaatctatacaaaggtccctttcattacctcttttacagatttttaaaaattctctatttcttttataaggtttccttagatattctctatcattgtttttctttgtgcatttaaaaaagatgatctaggccaggcgtggtggctcacacatataatcccagcactttgggaggctgaggttggcagataacttgaggttcaggagttcaagatcagcctggtggccaggcacggtggctcatgcctgtaatcccagcactttgggaggctgaggcaggcggatcactaggtcaggagttccagaccagcctggccaacatggtgaaaccccatctctactaaaaatacaaaaattagctaggcatggtggcacctgcctgtactcccagctactcaggaggctgaggcaggagaatcgcttgaacccaagaggcagaggctgcagtgagccaggattgtgctacagcactccaacctaggcgacagagagagattccatctaaaaaaataaataaataaataaataaataagatgatcttataggaaggggatactacagtctgtaaggacgtaggagtctcaaaaatcatttgagttcaaaagaaatagcatttaataacaattacaatgtaataacaatgataacgagaggtgccaacgtgctagcagccctcactcactcttggcgcctcctcggtctcggtgtccactctggccacgcttgaggagtccttcagcccgctgctgcactgtgggagcccctctctgggctggccaaggccagagccagctccctctgcttgtggggaggtgtggagggcgctgctctgtggcgcctggtcccatcgaccttccaagggctgaggagtgcaggtgcgtggcgcgggactggtaggcagctccacccgcagccctggcgcaggatccactaggcgaagctagctgggctcctgagtcgggtagggacttggagaacttttatgtctagccggaggattgtatatgcaccaatcagcactctatgtctagctcagggattgtaaacgcaccaatcagcactctgtgtctagctcaaggtttgtaaacgtgacaatcagcactctgtgtctagctcagggattgtaaacacaccaagcagcactctgtgtctagctcaaggtttgtaaatgcaccaatcagtgctctgtgtctagctaatctagtggggacttggagaacttttgtgtctagctaaaggattataaatgcaccaatcagcactttgtgtctagctgaaggtttgtaaactcactaatcaatgctctgtgtctagctaatctagtggggacttggagaacttttatgtctagctagaggattgtaaatgcaccaatcagcgctctgtgtctagcttagggatcgtaaacactccaatcagctctctgtaaaacggaccaatcagctgtctgtaaagtggaccaatcagctctcagtaaaatggaccaatcagctctctgtaaaatggaccaatcagcaggatgtgggtggggccagataagggaataaaagcaggctgcccgagccagctgcggcaacccgcttgggtctcttttcatgctgtggaaggtttgttctttcactttttgcaataaatcttgctgctgctgtttgggtccatgcagcatttatgagctgtaacactcaccgcgaaggtctgcaccttcacttctgaggccagtgagaccacgaactcaccaaaaggaacaaacaactccagccacaccatctttaagaactgtaacgccgcgagggtccacagcttcattcttgaagttggcgagaccaagaacccaccagttccggacacaataatatttcatctttgtatagtctttttaatttttcaaaattatttcatcatatgatacttccaatatacaactatccgtaatctatgacacatagaagctgagacctcaaaatgttccagtacagtgaattacaagggagtgtaatttgacacattaaaatctcaaaatgtattttattttgactgttctttgaaaaggcctatttctagagttgatatatatcaagaagatttaagattggcatggaaaacaacaagctgctaatgggaagggaagcctaacaatagtactagcactcagacccaaggaggtgggcttctctttgggttttgccgtgactgtgttagtgttcatccacgcgctctacccttctatgtgggaggattatacctgcccacaatgtgaaactcaggtgtgctcatgtgatatggtccatgaaatgtccatagaagtggagggtgtcacttcctggaagacgttttaatggtcagtacacactttgccattctctttttccctctcctgtgataatagacatagtgggttccaaaagatgacatgacagagctgcagccaaccaataacggacatggaggaagagtgagatctaaacctgagtgttataggtctctgatatttgggaatcatttgttagtgaagcacaacctagactgtcttgactgatacaggtttgctcaaagattattaggaacttggctgtcctgttctccagcattgtcctttcctttttcatgttctcacctaaatgtggtcacaaaatactcttgttgattctccagcgcagagagagcaccaacgttttaaagactttactaaaattatgtctcagaaaactgtgaaacaaacccagggcctagtataattcactgtatttttgcagattcctcaattccatatggaaccccaagataaaaacatcttgatggaagtctagtctttcatgctcctggctaggaatcaaacggctcttaccatatgtggcagacaccacagagatgcaccaatcagctcccctttcaagaaaagactcattgtccatctgtgagggccatctgtgaacttcgcaagtccatctcagcttgagcggaggtcatgctctcctcagagtaacctcagtcagtgactaagcaagaatgtggtgcaagcacctagccatttcttttcaacaggggacttctgtaaaaggtgatctttgctctgaggctgtctgctgggctggcagatacgttgtcagatctgcattgcagtctggcagatcctcctacccaatcctgcattccccttgtttcttcacagatattaccttccaagatattttgtactcctaaattcagctcagcgtctgtttctgtgagtgggaaaagaaacttacataagatctacctacttattgagagtgttctcctagatataaagtcaaagatgagagtgccccatccccttgttcttctggctgttctcagtacctgttccctgtctgtgtttattcactgggcagccttatcatcagaaagacaatcatgcactataatagaacaatatcttataacagccatataacaatataacatacatccttaattctgtcaggattttgaaatgaaatgttctccttgataattttctcaagtgtaaagtgggaataataaaagtaattttctcacagagttgtgagaataattaatagccaaagtttattaagtgttcactttatgtcaggctttacaggcactacagtatttcattttattcaataggtgaggctattggggcaaagaaaggataagtaacatatagctaatgataggctgagtgggaactggggtctacacagagtgacatcacagcccacttacacaattactctctgctactctgtctctcaaagagatctgtcaagaccttagcaacgtgcctgcatggattaagcttaccatttgttggagtaggcaccccacaaatgttaaccactatgattacttattcattttcaaagttgaacaaataaaaaaaaaaccctgaataattcaaatacaaagaaataaaggtccttttaagctacctgttctccagcgttgtcccttcctttttcatgttctcacctaaatgtggtcataaaataagccaagtcaatgagtttggactttatcttttgggcattgaagagttattggagagtattaagaatggactgacatttagattcacagattaaaaaggtgactctatttgtagtgcagtcaatgaaaggaactgatgcataaagtggggtaagggaatggtagaatttgtccagacgaaaagcgaagtctgcctgaactacggtagtggcaacaggaattagaaaaaaaaaattaaataggctaggcgcatgggcttgcgcctgtaatcccagcactttgggaggcggaggcaggcggatcatgaggtcaggagatcgagaccatcctggctaacatggtgaaaccctgtccctactaaaaaaaaacaaaaaacaaaaattaggggggtgcctatagtcgcagctactagggaggctgaggcaggagaatcgtgtgaacctgggaggcggagcttgcagtgagccgtgatcgtgccactgcgctccagcctgggcaacagagcaagactctgtctcaaaaataagaaagaaagagagagagagggagggaggaagggagggagggaggaaggaaggaaggaaggaatcaagtagactagttaattgatttaaagtgtcacactggtttggacacttcatctggatgggcttcagttgatttatttgtgaaaatcttttggatgagatggttgctaaagtggtttttttgtttgttttgttttttccaattggcatctcttaagagggagctggaggtagaaagggtgggggaaagaaggaaacagagtaggtagaattgtaggaataaatatagtgaaaaacttttggaatgactttggtttggaaacttggtgcatttataacattattaagaaaatttttttaggcaaaaatctaaataaaatgcctttaacatccagctttatgttcccctaattttccaatttacttctaaactcccttaaagcaatacatttatctagtcttttgaaagagaatttataacatcttggagctctcaaataaaaagaggagagccaatcatggtggagggtttgttgttgttgttgttgttgttgttgttaagtataagaagcattaagcaagctcccaatgaaaccaagttttctttttaaaaatcctacaatttatgcaaatcccatatgggatttatgcaaattccatacgctttggtagtcagggcaaatagatatttgccataaagagaagtgagttgagtctatcttgcaaacaatatagataattgcagagaaagtaaggaaacaagctgcactttactattttatgctttggcaaattgtgttgcattgttatatacctggcaaaagaaagtgtatcattttggaaattgctgctgagtgtggttattgtgcacaaccacagcagagattttgaagtcatcatggagccgaggtggcagggtcactacgtgttctcactaccagggctatctgttagagtctgctgaatagctggcatcaatttcaggaggcaggaggcagaaaagtgctggactctatcctcatttggcaaagctttgaaggataatggttgagtgaataaaacttctactagcttactttcatttctagaacttcatgttatttctgtgaatattgaattaaacgagaaggctaagaaataattgaattcaaacatatttatcattctaaattttttttggaaagaatttatattttaaagtaatatcagtaaatgtaaatggagcaatgaagattaatgcaattctaaatatttaccctagtgggacaccatcacttcttgcctcaaatactgaaattgtctccttagctcccatttttgcattctgaagtttttctacacaatgtagtcagatttttctgaaatcaaaattggatcacggcactccctatttaaaaacctttggtagattaattaattaactaatgctacatcataactcactaaaacttagtttttcggaatgaaaactttttgttttttttcctcacagtttctgtgggtccacaactccagagtggcttagcttgggggttatggcttgaagtttcatgagattatactcactgtctgtagctacagatatatttgaaggcttgactgaagctagagaatctgcttctagtcattaacatggcggtcaagttgctgatgacaagttgtttttttctccacagggttgcttgagtgtcctcacaacaaggtggctagcttaccccagagtaagtgatatttaaaaagcaaggcagaattcttcactgatttttgtgactaacctcagaacttatttcatcacttctgtcatattctattggtcacataggccagtactgtttcactgtgggaggtgactatacaaggatgtgaaaaacgggaagcaaagattattaggcaccatcttgaaggcttaatatcacagttggttttcatttactttgggataaagttcaaatttttagacactgcttacaaaacctgtcatgatatgacaatttcttacctcttcaacttcatcctgcccctcatgaatcatgttcaagccattaaaaacgtatttcttcagttcttctaatgcactacactgttttcactctcttgttggatcttttttcccatcctttaaattgactcactgttactcactcttcatgtcaagttattagaaattctctttctcaaaagtttccatttgacttccaaatcatggattagtcacttggttttgtgaacccctaacatcttgtctgtcttaattatagcatttattgcacttacttttttataattattattttttcattgtgtaccctagtagattgatatgaaagtaggtgctctgcatatatgtgtgtgtatatgtatatatgtcattctgcctcattgcctatcatgtgcctaaaatgtaggaatatttattgaatgaatgattcaataaatgaatgagagactatcttgactctcactcagtaagtgatatttaccctaattttctaaggtgatggaaaaaaatctaataaactcacctataattacttttttgttagcttatatctctttataaacccaaacagaaaagaacaatctgatatactgatactggggtttggttccatgtgtgataatactggtaatttgttgaatctggagatatagatcctatatttatcttctaatgaacaatgatagagtaatgaaaatgtttttatctttctaggttacaaatcaatactatgacatatgagagtcagtgaaagtcaataaagattttctaccaaactatttttttctctcaaaactgtgaaattacaatactatggttaaaatagactgatccaaaatttttatatcattacatttagtaatgcctacatattattttccatagaccagttttaaagatgaacaaaatattacatagcaaaatatagtgttacttattaactgtacaaaacaaagatcagttgaaaagatttcaatgaattttaaatgctcccattaggtatgtcattttccccttctaacatgccacctaaaataaccagatcactattgacaataaaatatcctatactgcataccatttatagaaatagtagcacttaagaagagtatgtcagtggtaaaatttcagtcaaagatttcaatattttaaaagtattggggtggccgggcatggtggctcatgcctgtaatcccagcacgttaggaagtcgaggcgggtagatcacctgaggtcaggagttcaagaccagcctgggctgggtgtggtggctcacgcctgtaatcccagcacttttggaagccaaggtgggtggatcacaaggtcaggagttcaagatcagcctggcaaacatggtgaaacccctactaaaaatagtatttgaaatctctactaaaaatacaaaaaaattaggcaggtgttatggcacacaccgcaggagaatcacttgaacccaggaggcagaggctgcagtgagccgagaccatgccattgcactccagtctgggtgacaaagtgagactccatccaaaaaggggggaaaaaagtactggggtatctatttctcccaaaatgttaaatggcaagtgagtggagggaaacagaaggggatagttcatgtcccatcttactggtttacaactgggaaagcagagtaagatcttcatgtgggttgatgtgatatctgtatatatcagcagacataacagaatcttcttgttggcctatcctgtttagactaacattatggtattagttcctttggggctcacatttattctctgactgccctctagcaaaacttatggggcagacactttggtaaaaggtcccaaactataatgattaccttatattttgtcagtgcaccattggcattgaacaaaatttagtacattatttaataaccatggtagttcatggcaatccatggccctcttgcatattggcaaagttgaaacatcaagtaatctacattttaaaaaatgtctttgatcctttctcgtttgaaatatggatgtaacaggtgcaatggaaaaggaaggtgtgagagtcctttctataatgtttacataacgtctgtctataggagggacaagacattcccttcgagatttgggggtatttggacatagtcttgcaaattcacaaatatcttatgaaagaaaaaagaattaggaaacacttatggaatatttcaagctataattcagttaatcaaagttttaaattatgtttcatgtacctatgattaaaagagctttaattgattaaacaggggttcattttacttttgttaacttgacacatactacaaaaaattcaagatactaggagggaaaaaataaacactatcaaaagctatgttgtggaccttactctgtttttttcaagtatacaggtagaattttactaaccaataaagaaaagttataaaaaaacatggagaatatagttctttttatatacctgatgccccatcctccagtccctcttaaagagatagagtggtgacacacacttccttcaaaggctgacaaagaatatttgatttcataatgtttaaggtcatttctcagaatacacaggtttgaccattgcctaaatgctaatcattaattcaaaggctatattttattttttaaagaaagtttattatagtttgtgtattttgctattgaaatcaatgtgtaagtgcaagttactgtacacaaatttagaagttataggaggtcaggcacagtggctcacgcctgtaatcccagcactttagaaggccgaggtgggcggatcacgaggcaggcagataaggatggagatggagactctcctggctaacatggtgaaacctcgtctctactaaaaaataatacaaaaaattagctgggggtggtggcacatgcctgtagtctcagctactcgggaggctgaggcaggagaatcacttgaacccaggaggcagaggttgcagtgagccgagatcgcaccactgcgctccagcctgggtgacaaagcaaaaatctgtctttaaaaaaaaaaaaaagaagttataggaaatgacataaatcttcagaaaaatgataaaattacatgtaattcataaacaattacgtcatgctttttaaagttcattttattataactaagcgtaaggtatcttaagtctctggaacaagggtataagcatgtatctatgtattaaatagtaatgaaacatttcacaaacatatagttcaatgttcatattcaaaaacatatattaggatgggaatcacattgtatggctgtgttgtagtggtgtgttagtgtggcgactctgaaaaattactcttacaattaggcgtacataaatatgacataattctctcaacacactttagtaacatggcttttcccccaatgtgcaaggtaaaatagttttcctctgaggtactactttcgtggcaaaactttagtgaccaagaccttttaaatgaaagaaatccataccattgttgttaggagtccatattaagggcctatactggtatcgaagtaacttaagatgttgaccgtgtggtcaattttcttttctcccatcctgatataatgtaatgtggccatttaatgagttctaactcatttactaatgagcatattgtttcctcatcacatgctaggcaaacagaaagtaaacagcatctttttagcaaaaaccttttctggaattttttttttaattgtaataatataggaataaacaacgaaaacctatagcaattaccataaaagttttagtgcatttgtaatatgctaagtatttgatatattccttgtaaaagactatttaagtaaatctttagctgccggtgtttgcttgctgtacagaatcataaactatcaatattcctaaattagcatggtccagtcatccaacttattgcctcagtcactcaattttcaagtttatgtactttcctctcagttatcagatggtgacttttggataaattgttatggcaaaaattttttttaatatcatggtgaatacatgttgatgtgatctgaatatataaaatatcaatatctaaagatcatttagaaaatgtttatttttactacaaaagttatgcatgtttacataagacgttaaaagtaaagtaaaaactcatttcctgtgaccctgacaaaacatcattagcattttattaaaatttatcctagttattttctgtgtttatatatatttttgcctataataatttttatttattttttacaattttctttcctttttttttttttaaagacagagtcttgctctgttgctcaggctggagtacaatggtgcaatcttggctcactgcaattccacctcaggttcaagcaattcacctcccttagcctcctgagtagctgagattacaggtgtgcaccaccacacccagctaatttttgtatttttactagagatgggatttcaccatgttggccagggtggtctcgaactcctgacctcaggtgatctgcctgccttggcctcccaaagtgctgggattataggtgtgagccaccacgcccgacccgttcttacaattttctatttttatttatctctgtagacatctaacactatgtattctaacatcaagcttagtacacagtagacatttaataaatgtgattagttaagtatgttaaatatcagatgctagaatatttatacatatatataatgtatatttttaagggtttacacaattccaggaggcaccattctcattatctacacaaatggcattctcaggagggcacatttatttacatagactgcaatataaatggcctaggaaaatggtgtcttctagatgtacaatgatatggccatggatgtatatttgtgtgtatgtatacatgtatatgtatatacatacatataagtatacgtgtaatagccgcaggtatttcagtccatctataaaaccaaggcaaatgtcctcaaaattaaatgcattttcactcatttattatttattcaacaaatatttatgttcactgaaactgagctgagggctagggaaataatatatcagcaagatagacattgttctatatcctttgaaaatatcataggtgacagtgtacaagagtgttaaaaagagacttctacccatataagatacttaatagctctaacactgcagacagtagtcaggaaataccactgcacttcaaattagagtgccgcaccatctaagccagacttgtaaaagatgacaagagaaattattctggcagtatcacaccctctacacgtagtaagacaaggctgaaaattcatttgaatctggtatttgaaagatataatttcattgaaagaagtcagcatcctgtggcatttgcccttctttctctctagggaagaagaaagcttcttctttccttccatatcaagtgaagctgtctcaaaaaagaccatactgagaacttacttgagtcctcagaaattggaaaagtatcaaagctagattatggtttactaaaataaaataaaaataagcatcttttatttttgtttgtcttttaaaaggtaagaagatagacagcttccctgcttacctggtggcagggcgaggagatactgtctgtattagtctgttctcatactgctacgaagaaatacctgaggctgggtaatttataaagaaaagaggtttaatggactcacagttccacgtggttggggaggcatcaggaggcctgcaatcatggcagaaggcatctcttcacagggcggcaggagagagaatgagtgccgagcgcagtgggggaaagcccctcataaaaccatcaggtctggtgagaattcactcactaccatgagaacagcatgggggaaccgcccccatgatctaatcacctcctctgaggtccctcccccaacacgtagggattataattcagattacaattcaagatgggatttgggtgaggacacagccaaaccataccactgcctttgtcatgaaggacacttcttgtgaggcaggggatgggccatatttcttgtaaatcggatatggttgccacacaagagagagaactgggagaagtcttgaataggactttgtccaagatgtcctgctgaagggatgtagtaaccacagcaaaaggaggctggaaacagtactaaggggcattataagtgtcctgcatttggaggaatcacttcttaggaataacaaatgaggtctctaggggaggattctctgaagaagtcacaagtaccctacaaaagaaaaaacaaacagattttggacatcagccactttagggcgtcaatgacataaggcaactgtgccagtcatttcagctttcctctacttctcaccacttctccatcccacacagaggactcaagagacaatgtagagtaaaaattcaaggcagggaaagaaagaagctgtaatgacttcctgttttatctatttcaagacaaactggaagatagaaggtgagagtgattagctctcagggtttttatatcagactggactgggatttttaagaccatgaggtagcttgaaaagcaatgaactttaattgaaattttatctatcacaggaaagaagctgttgaaaggggaaattgaacaaagtataaaatcatgttcttcttacattttatccagtttgctttattctagtaaccattcacaaagaacaatgataacaaactatcaaaagttctataacatgagaaaaaaaggatgttatgggaacacaggaagagctttgcttccagcgacccaagctactctcctagcaaatcttccactgatgacagtaaagagagagtgatcttggatccctggtaaatcctgcctcagatactgaatgtagaggtgagctctctccaagaggtggatggaaagccagaaatccaggagctaagtaggtacaaacaactcgaggacaatatattgcctgtgtctcaggatgtgcagtggaatatttttagtgtactcaactttcttttgtggtgtctgccaaaaactctcataagcatcccataagggaaagaaagctttaaacacctgtcacattcagaaattgctgagccatcttacaataattccagtcaagaaagaacttaggtgttcttctcacccttttttttcttcctcctctttggccctagaggggagacagaaataacagctaacaggtggcagggaaggggaataaaagagatttttacagttgaacaaaattggaaactcaaattattcatatggtttagggcttttataattactaaattactaaactatatctttgactttaaagtcagccaaatttttccatttcctaataataagaaaaataatgaacaagcatggcccctactatgtgccaaacatgattgtaagaactattacctcctaatcctcataataatgctaaaatgcagaaattcataacactctgcatttcatagggaaaactgaggcacacagttaaatgacttgcccaattttattgggatttaaacccaacgaatctggtaacagagtacatgatcctaatcactactttataagttaaaagagaagataaatgatgtagttttcattaagtgccagacatcgggaacccaacccccactaagtaggtttgaatggagagagggagacaataacaaagttgcttctacggctataattctttgttcaatgtactgattgcttactttgtacttcagctggccgttagaagctactgaagagttttaaaatgatttgttcctatgatgggatttgcttttcagtgtgatcactgtgacttctttgtagagactggtttggaggagtataagagtggaagaaaataggtagatcagaaagactattatgagcggactgctgcctgaacaaagtaatgaaagtgggatggatggaaaagattcaagttaggtagatctatctgtctatctatctatctatctatctatctatctatctatctatctatccattcatccatctaagacagagtaaattggacctaatgattggatatggaggtgagaaaacattaagttataaatttccatgtgtgtatgtgaaactgctaaagtacatcataaaatatcataaagttagagtaaggatcaaattagataattcgtgacaagcgcttaccaccatgaactgtaagtggctaaggaagtttgctgaagtgaaaatagcttgggttctagcaccgtgtgtatatcctggggaaggtgttgtactctctgttcctctggcatcttatctgtgaaatatcagtaccttcctcatggtatacattgagtgaattacgtgaaatgattcttgtgaagagattagcacaattgctgacacactatagatctcaattaatgctagccatcttttactagactgttttcttttcatctacctgacattagttgtatggctttttgaggttaatttctgcatgtcacaaagcacactgttttcctcagaagaagctgatatttcataaagctagtttattgctcttatgcaaatggggcagtactttaagactgttaactactgaaaaaactagtattttgtcatgatgcaagtgaggagggtactgggacaccactccttccccatgggtcagataattagttaagtgggaaaaagttacaaaccacacagtgcactattgtatctagtaggaagtgataaaactattatcaaggattaatattgccctcatctatttgtttaaggcctataacaaagatttcatgggaattttctacatttttattttctaatttttacatatgacctctaatttggttctgaaatgaaatcaacttttagttctttttttatctcaagtgtattacatttttggagatgttatttataatactttgatttttcaaattaataaattgaagatgcaatacagtattcaatttgctgcaaaactctactcttcatacgaaaatagagatagagctatgacctaaagattaatacacagctccatcacagcatagcttgaaatgttaaacagctgatgtacaaaatgatgtgagagtatcagtgaataatacacagaagtgcatactgtaaacaaagcaaacatttctaaattgagagctgtctaattctagaggcaaactcagaatttggatttaagaagataattataggggagaaagaaagtaacaactatgttttcttaaaccaagatagagagtaagaaacatccttaaccaggaagctattgtcttaaactgctgttgttttggcatcattcataatcacttaccaactatttttttgagggtaaatcaggttatcttctgtttataattcttctgagggcaacttaacttcttttctttaacctatcatttctaactaccttcaagtttagccgtatacaacttaaatcacattttgctacactttttagatcttgagattgttttttggctactctgtcatcagtgtaatttttaaaattctatttgctatcggtaggacctggagtttacacatagccagaattaaaatgtattgacaagtgaaaataagttctttgatctcagtggggaaaagggatgcagctctgcactcctgaattctaccactttcatattctgagcctttgaagtttttctttgctttcctgcacatcctttggttcatagtttgtgcttattttttttcctgataaaattgtttgacaggcttagagctgtaaagataggagtgttgtttaataaataaaaataaaaagataattaattgtttctgtaaggtcgaatgcataatccatagagagcttctttctgctgtactcgctccctacgtaactcaactgtgaaaagcagaaacttttcatttttttttttttttttgagacggaatctcgtctgtcgcccaggctggagcgcagtggtgcctgccatctcagctcactgcaagctccgcctcccaggtacatgccattctccggcctcaggctcctgagtagctaggactacaggcgcccgccaccaagcctggctaatttttgttgcatttttagtagagacagggtttcaccatgttagccaggatggtctcgatctcctgacctcgtgatccgcccgcctcagcttcccaaagtgctgggattacaggtgtgagccactgcgcccggcaaaagtaggaccttttctatctccagtgtgaatttaaccacctggcaatatttgaaaggtagagattctgactcagaacgtccggagacttaaactctttttttttttaaacaagtttccagatggtcttcaggggaccacattttgagcagtaaagataaacaggaagaaaggaaagcagaagtattctaaatacattacttcaatactgttcactatgttagacatcttacatccattatctgctattaactcctataatatgtagtattatccctaaaatataggaaaataaatagacacagatgtagcaatacatagtaacaaactgatctttttgcaagatacagattacaaaattatttaacctctgagtgtcttactttccattttacaaaatggggttttaaacataagacccaaaaccataaaaaccctagaagaaaacctaggcagtaacattcaggacataggcatgggcttagacttcatgactaaaacacgaaaagcaatggcaacaatgccaaaattgacaaatgggatctaattaaactaaatagcttctgcacagcaaaagaaactatcaccggagttaaaaaggcaacctacagaatgggagaaaatttttgcaacctatccatctgacaaagggataatatccagaatctacaaagaacttaaacaagtttacaaaaaaaaaaaaaaaaaaaagaaaaccaccaaatagtgggcaaaggatatgaacagacacttctcaaaagcagacatttatgtggccaataaacaaatgaaaaaagctcataatcactggtcactagagaaatgcaaaccaaaaccacaatgagatactgagaggtgacagcatgctggcagtcctcagagccctcgcttgctctcggcaccccccctgcctgggctcccactttggtggcatttgaggagcccttcagtccccccactgcactgtgggagcccctttctgggctggccaaggctggagcccactccctcagctttcagggaggtgtggagggagaggcaccagcgggaaccggggctgcctgcggtgcttgcaggccagctggagttccgggtgggcgtgggcttggtgggccccgcactggaagcagccagtcagccctgctggcccggggcaatgggggacttagcacccgggccagtggctgcggagggtgtactgagtcccccagcagtgctggcccacctgcgctgtgctcgatttctcgtggggccttagctgccttcccgcggggcagggctcgggacctgcagcccgccatgcctgagcctcccacccactccatgggctcctgtgcagcccaagcctccccgacgagcaccaccccctactccacggcgcccagtcccatcgaccacccaagggctgaggaatgcgagcacacggcgcaggactggcaggcagctccacctgcagccctggtgcgggatccactaggtgaagccagctgggctcctgagtctggtggggacgtggagtctttatatctagttcagggattgtaaatacaccaatcagcaccctgtgtttagctcaaggtttgtgagtgcaccaggcgacactcggtatctagctgctctggtgaggacgtggagaacctttatgtctagctcagggattgtaaatacaccaatcggcactctgtatctagctcaaggtttgtaaatacaccaatcagcaccctgtgtttagctcaaggtttgtgagtgcaccaatcgacactctgtatctagctgctctggtggggccttggagaacctttatgtctagctcaaggattgtaaatacaccaataggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaatctctgtatctaactaatctgatgcagaggcggagaacctttgtatctagctcagggattgtaaacacaccaatcagcaccctgacaaaacaggccacttggctctaccaatcagcaggatgtgggtggggccagataagagaataaaagcaggctgcccgagccagcattggcaaccagctccggtcacccaccaattctggacacaataccatctcatgctagttagatcggcaatcattaaaaagtcaggaaacaacagatgctggagaggatgtggagaaataggaatgcttttacactgttggtgggagtataaattagttcaatgattgtggaagacagtgtggcaattcctcaaggatctagaaccagaaataccatttgacccagcaatcccattactgagtatatacccaaaggattataaatcattctactgcaaacacacatgcacacgtatgtttattgcaacactgttcacaatagtaaagacttggaaccaacccaaatacccatcagtgatagactggataaagaaaatgtggcacatattcactatggaatactatgcagccataaaaaaggatgagttcatgtcctttgcagggatatggatgaaactagaacaatcattctcagtaaactaacacaggaacagaaaaccaaacaccacatgttctcactcataagtgggatttgaacaatgagaattcatgggcacacggaggggaacatcacacaccagggcctttcgggggctggggatctaggggagcaataagattaggagaaatacctaatgtagatgaggggttgatgggtgcagcaaaccatcatggcacgtgtatacctatgtaataaacctgctggttctgcacatgtatcccagaacttaaagtataagaaaaaaaataggccaggcgcagtggctaacacctgtaatcccagcactttgggaggccgaggtgggcagatcatgaggtcaggagatcgagactatcctgcctaacatggtgaaaccccatctctactaaaaatacaaaaaaaaaaaaaaaaattagctgggcatggtggtgggcgcctggagttccagctactccgaaggctgaggcaggacaatggtgtgaacctgggaggcggagcttgcagtgagtggagatcgcgccactgcactccagcctgggcgacagagaaagactccatctaaaaacttaaataaataaagaaaaaaaatatttacctcacagtgatgttagaagggtttgggatatattcacatcatgtagccaagtgcctggccgaagtaagtcctttttttttttttttttttttgagatggagtctcgctctttccaccaggctggagtgcaatggcacgatctcggctcactgcaagctccgcctcccgggttcaagcgattctcctgcctcagtctcccagttagctgggactacagttgcctgccaccacgcccggctaatttttttgtattttttagtagagatggttttcactgtgatagccaggatggtctcaatttatatttcttgacctcgtgatccgcccacctcagcctcccaaagtgctgggattacaggtgtgagccaccgtgcccagccccaagtaagttcttaaaacattttctatcattattataattccaattttattttattattagtttttgagatggagtctctctctgtaacccaggctgagtgcagtggcttgatctcggctcactgcaacctgtgcttcctgggttcaagctgcctcttgcctcagcctcccgagtagctgggattaaaggcacctgccaacccgcccagctcatttttgtatttttagtagagatggggtttcaccatgttggcgaggctcgtctcgaactcctgacctcaagtgatctgcacacttcggcctcccaaagtgctgagattacaggcgtaagccaccgcgcctggcctataattccaattttagcagtatatcttgctaatcaaccaaaaggaacacttaagtgcttatattttatatttactgttagtcatttagaaatgatacaatttgaattatagatgtaattgacaaatttgtactttcattgacctgattggttaagatacttaatcatatgataccacttttcctctttaaacggtaataaccattcattgcaaattactaatatactgacttactcatagttttcactagtcagcactgaatcatactgcatgtgtattttgttctcagcatggaaaagtacatgtcaaatagtaaaccctagtatgccaatcatttagtaacttcaagattactaattaccataatgttgaagtgctaagattatcagggtataatgcattcattatgttaatgattctttatcttatccaagaatcacacattttccctgggagcaaaaagaatcaaaagaaccaactggaagcttttaataaaagtttatgcatttaagcgtgtgattaaccgacaatcatattacaagtgctttattttaaaggaaataataaaaagaaaaaactgtttataacgggtaagattttctttctaaacataattgacatttcactaactgaaattggaattaccaaagaagtgtaagacatgtcttgtgccctcaagggggaagaaatattacatacaaataatgaaactaattatagtctaaactcatagaaaaacaactacttataaagaattaaaaatgggagaaataaggttagataggagtagtcacagaagtgatgaaagagacgttaactcaaatttgaaagataagtacaggtggatagagtgtagaaatgaaaaacagctactcagaacaaagtatctctttttcttttttggaagaacatagtactaagcatcagaaaatttgaatttaaagttgaatttaaattgactgtacattccttgaaatgtgttctctcatttgtagaatgggagatttagaaaagaggtttccctaactactctatgcttctttaactgtaaaattttaggcctagctatatagggcaggaaatagaagggcacatgcagagcacaggtattagggcctggtagtaaacatggttgtgtgcagagcatgggtcaaactatacggccttcagaacctagtacttgagatggaatcagtacctgctgctaaggatggtaataagaaggaatttcacatgagatcaggattatgatgcggtttaggacaagcaatccagtggatataaaaagtaagatacaagacagatatgacaatattggaaaggctgtgtaacatgcagattgactctgaattgtcagtgaaagtggatgacatcaccatccaagcagttgaaatgggctctgtggggaaatgtcagagctgtacagaaaaaaaaataggtgcccagaattcataacaggaaactcagttgtttggggggcttaggatttgatttttatttctaagcctcttttataagggcatcaatttcacttatgggggttctggcctcatgatccaatcacttcccaaaggctccatctcttaataccaaaatgttggggattaagtttccacatgaattttgaggggacaccaacattcagaacatgaacagggacttccatttggagagattttgaagagtaacactcctggcctttcctccagcccggattttctcctctcctatggataaagagtgacttatctgattggaaattatagctcctttcttgctcttgttataattagataagcattctggtctactctttatcatccagtaagtagcctgcccctgtgtggatggcatgtggctggccagcttagcctctctgggatttagatactaatttagataatcatactaataataaagagctgactctctgctctttgttgttcagggtaaaatcttaggaaacccactgtgtttgcatatgaaagccaggttctataatccatgctacgccttctgtctgtctcatttgcttctgaagtctgagggaaagatgggtgttattttgcactgaattaccacaaaggatcaaattgttgaattgaatgtagaaggacagagagcttacccagtctcaaattttaccaatagcttcaaggatgcaagcactcaagaaacatggacaaaaaagagagtggttggggacatcttttatggcttgccaggtcttcctttgcttcaagagaaatgcattctaacccagaggaatagaatgtttgcagatcacctcagctaatagagatttttaggttatgaaacaagtttatttcacagccaaattgttatagggcttatataaccatttccagggagctgtgcttcaaaaattcacagactctcggtttgtatactatagaaaatgccaaaccagggatatcctgtctagatcattctatagataagaatggtcttccctgtaaatacctttagtttatttaccaggaagtgcctcatcagcatgtttataaagattacttaggtagcttgcttctttctttggcatgtctcttggtcatcagggtgagagagagaaagaaagataaaccacaggcacattgctttaacttcttcctccccagacccattaaatttccacagactggaatagggaagtgtaggagtgaaaacagacataggtctgcttctagcattaagccaagtaactatttttacttgacatgagtggaaatagtataaggaaaatattgtcttgggaaaaatagctcactgggacgttatagaagagtttaagggtgaataaatggagatgcaatgactagtcagaaagcatgatttagtgagtctgagcgttactgtggtagcaatgacaatggggaggaaggagtaaaacacaaaggtattttaaagaaagaaatgacagaaattggtaactttagcattaaggatagaagaaagataagactaaaatgttaccctggaatttctagtgagggagacaatatttaaaatgctaaaattaaaataaaccatgtatttccagagtaggtcaaagtcatttaaaaaaaggataaactgggccgggtgcagtggctcatgcctgtaatcccagcactttgggaggctgaggcaggtggatcacctgaggtccggagttcgagaccatcctggccaacatggtgaaaccctgtctctactaaaaatacaaaaattagccgggtgtggtggcgagtgcctgtagtcccagctacttgggaggctgaggcaggagaattgcttgaactcggcaatggaggttgcagtgagccgaaaaagcaccactgcactccagcctgggtgacagagtgagactctgtctcaaaaaaaaaaaaaaaaaaaaaaaaagaaaaaaggataaactaagtttaattgatgagtatgaaaacatgccagatcatcccaaaggatgtattagggaaaagcagaatttgtgagtatgtgaaaatttggaaattagttggagaaatctaatagttgatttattcagtcaacaaataggccagtatgcacactctcaatttaaggcatgagagatataatgtgactaaaacgtccaaaaccaaataagactctgctcctttttttttttctttgaggcatagcctggctctgtcgcccaggctggagtgcagtggcttgatcttggctcactgcagtctcaaactccctgagctcaggtgatactcccacctcagcctccctagcagctgggacctcaggtgtgtaccatcatgcccagctaatttttgtagagacagggttttgtcactttgcccaggctggtctggaactcctgagctcaagtgatccagctgcttaggcctctcaaagggctggtattacaggcatgaaccactgcactgagccaactctctggtctttgttattcaattgctgtgtgcctcactaatctgattcttagtactcccaaactctgaccttagtgatataaccatattctaaattcatcatcatggaatgcccatccatcctcatttctgttctgtctagccaaacctgcagttggagtcactacaaaactggtggcacagaattccaacaaaggacttccccatagcatcccaagatggggctgattgagattccaaagaaggaggtactagatgccaggaaaatcaatcccaagcatttattaggggaatttacataaagaagagggtgcggcgtgtcttagcaacagtgagaaaagagatattccacctagatatgtctgcaatgaggggatggagttaatggagttgacttgagtgtttaagaagtttggctcagggccaaagctagtttctatgtatgtaacaacatggctgatcttttagtgttttccaacagcaacctaaatagctttatcaatttctgagaaggttcaagactgaaggggaagacatagctggctgggtcacagagcagttaggtcactgtgtttctgggtcaggacattgaaagaaggcagggggaaagtgggggaccctacaatctgtcacccagagaccatgtcaagagagatctctttttcggcatttctcaacatctgtagtatttacagtcaatgctctgcccacgttcccttactcctacagtgcatgccagcctaatacccaactgccaatataataggcaaggagatactgaggacttcctctccctgctgaagttcactttgcccacctatgtggcagtccagaaatgatggggcattaaaactttccaggagcaaccctcagtcggtgactggcagtagacagtgtgtaaataaataccccatctctctcatccctagcattggctatctctcagggatgtgtcctgcactgcagaggttctccagcaggactgagatccagtcctccacagtgagctggattgattcctacccttcattaggtacctttcctttcttgccttagttggaagtactgtaggcaaggataactgaacaccaccattcctatccaaaatactcaaagcatattaatgtgtttagctagagaatacagttagagattattagttgccaaaccttgctttgaaaaaaaagtgaagaattttagcttctgaaagtcattgcaatcaaatattgagcaacatgaagataaatcgggagctcgccggtttctatcagaaatgtgcccacatacgcaccacactacactggtcttgaattggtatttggcatttgctttgaacatttcaagagctagaataacaaaaacagctgtgtcaaaagtaagtgtctacttggtttcattaatgtgatcacactcatatggattgttttaaaatatccaaaagactgaaggtcctgatgaatccgacaaaatagagtactttttagggaaattagcagccttaatgtcaaagacaaatgtcagattattttgttccaatttactcattttaggcttaaggattctcaaaagatagtgaacaatatataatacactagacattctactccgcaaatttaattttgagcatataataatagaattttatctttggaaagtttgtgaaaattcttatgcattcaatcttgatatgaatcattgtctttatagttgttttgataataatctaatattatcaaatcacgatccccaacttctcaagacataatgaatatacattgaaatttaaagtacatgtgtttaccagacaatgcctagaggaaataaataattcaatttcatatcatacaggaatattggttttctagacaattgcctttactgtttcaatcaattaatcatttgtgctgggcattacaaattaagtagtaactgaaatatacaatgcaaaagaacctcccttcctggagattaattctgcagaagagactggcagtttttttaaaaaaaagtttaaaaataatttaatggtgatatgtgctgtggagaaaaatatataaatcaatggagtgtgacaggacctgctaatgttggtttgagtgcttgatatcaattttaaataaggtggtcaagaaaaaaaatcaatgagaagataattgagcaaaaacaggaagccagtgaaagggtgatccatgacagtgcctgcactaagggtacaccaagcaaggagaactggtacaaaggcgctgacgtggaaatgtttctacatagcaattgcgttagtgtgacatggagaggaataaatgagaaaaggagtgttgggagataagggaagaaaagtagcaatggggctgaagctattccaaggattttggtttttaagctgagtgataagggatacctctaaggatgctaggcaatggaatgacatgaattgacttacattttactatgatctaactggctaacatgtaaagaacataaaagggaggtgctttagtcagattagatgaatgactttttattttattttattttattttgagacggaatttcactcttgtcgcccaggttggagtgcaatggcgtgatctcagctcactgcaacctccgtctcctgggttcaagcgattcttcttcttcagcctcctgagtagctgggattacaggcacccgccaccactctcggttaatttttgtatttttagtggagacgaggtttcactacgttggtcaggctggtctcaaactcctgacctcaggtgatctgcctgcctcggcctcccaaagtgcttggattacagacgtgaaccactgcacccggccaaatgacagttcttaaatctcactggcttaatgcaataatcattttttctcttatttatatacctaaatgaatgtgtttggcagagaggaattctgttccaagtagttggtgagagattcagcttgtggagcttgtggcttccttagagtctcagcccccagagtgtctactgcctccttctacctttctgcagtcaggggaagagaaacgaaaagcacttgagcagcagtggttattattttcaccagtaactcacaggcaagaactcaatcatatgctgtacttagcagcaaaggaaactgggagatgccgtctaaatctgtgttcaggaggaaaaggaaatgggttttagagaacacgttatagtctctgccacagggaataaggacagaaacagaatgctacttaggaagatgttgctttatacaaaaaggagatgatggtggccaggcccggtggctcacgcctgtaatcccagcactttgggaggccgaagcgggcggatcacctgaggtcaggagatcgagaccatcctggctaacacggtgaaaccctgtctctactaaaaatacgaaaaattagccgggcgtggtggtgggtgcctgtagtcccagctgctcggcaggctgaggcaggagaatggcacgaactcgggaggcagagcttgcggtgagctgagattgcaccactgcactccagcctgggcgacagagtgagactccgtctcaaaaaaaaaaaaaaaaaaaaaaaaaaaaaaaaaaaaaaaaaaaaagatgatggaatgatggcagccttgaccacagtgcttgcatgggtataaggagaatgatgtactggaaaatgtcccaaactatttattttttgatggggatagtaacattaataggtgatcaatgaaaaattgtttcagaagtaaaatacgattaggaaatgctggatttctctacaaaagatttcttgcaacatttattaggcttgaggatctttgttattttgttgtaaaaatataaaatatgcggttatcaaaatcatcaggaattttttaatagacaatatcacatagctaatattccaaagaatattctttaagaagacaagtgaattattggatagaagatagggtctggtttttgacacgtacttcctgtgtgactctggatgactctttaacctctttgagatttacttccctcaattctagaatggacacactaccttttagattgctcaccttacagggctatacaaagctaataaaatgtacatataagcactgtaagcatcagtgagtattattataagacttagcgtggcaacaaaggagcagagcaaactgagatgcttagtttttgccaggaggagcctgaatgtcagccatcaaggagtcttatcaggtagcattatcttgacagtgacccaatggccctcagtcctttgcctctggaattgatcaaactatatttacagagcctaactacatctgtcagcttataaacaacattgaaataagaatttctaccgattaatgtaaagttgtctagggacaactgtgctgatgttccctatttattataacttattttcaaaatgaggatatttgggaatggcaagcaaagacatttgtttagtaaacaccaaagatcagagagcaaaaacatcagatttttgtggaaggtattctctttaggccttggtgagaacagactaacatcagtcctcagctaggcagtgaccaagtcctctatatttaatgtctagatgaactctctatcactggactgagaggatgctccttttgtaaattaaacaaaatgagcaactctttacgtgcagacactcttgctccaaattagagagaggaccagtgatttgattttcatttataaatcatggtctgtttccacttatggttccttgcaattacctcaggtctctcagaaatatccagtggcctaaatcactcattcacagttgattaagctcgtccactttgcagattttagcagtttaaccatcagaggaatcccatttctaatataaaagacattgagtcaatctcactcattgtaacaccaactagggaaagactcagttaaggaagaaactgcagtggctgtggttgatggcaaagtttatgaaacatatcataagtattgtatagtgaataaagaagaagtttgggatcaaaatacaattatagggaaatcagtagcatatttttaccataagagcagctgattttgtatcctgccctttgtgggataattggattgtcttgacttttttattccatctcttccacttaattttgctgaatataactctagattgataggtttttctttcaatactttcaataactcacttcactctcttgtttatatggtttctgactagaaatctatgctaattcttattatcgtttctctatagataaggcattatttcccctatgggttctttcaaatatttttctgtctttggttttctaaagtttaaatatgatgtagttctcctacttggtgttctctgagcttcctgaatatttggtttagtgtttgtcattaatttggaggaagttctagccattatttcttccaatgttctcctactctgttctctcttcttcttcaggtattccaattaggcatgtgttatgccttttgattgttccttagctcctcaatgttgtgttgttttgtttgtttgttttacttgtttgttactttgcacttcgggttgggaagtttctaatgaccaatttttaggctcactgattttttcctttactgtgccaagactactaatgagtccatcaaaggcattcttcatttctattacatttttttatttttttatggtttcttagagttttcatctctctgcttacattatccttctatttttgcatattttctagttttccactagagtccttaatatattatacacagttaatttaagttccctgtctgataattccaacatctacattatatctgagttttttttttttttttttttgagttggagttttgctcttgttgcccaggctggagtgtagtggcgcgatctcagctcactgcaacctctgcctcccaggtccaagtgattctcctgcctcagcctcctgagtagctaggattacaggcacccactaacatgcctggctaattctttttgtatttttagtagagacggggtttcaccatgttgggcaggctggtcttgaactcctgacatcaggtgatccatccacctcggcctcccaaattgctgggattacaggcgtgagccaccatgtccagctgtttttttttttttttttcttttccaacttttaagttcaggggtacatgtgcaggatgtgcagatttgttacataggtaaatgtgtgccatggtggtttgctgcacagatcatcccatcacccaggtattaagcccatcttccattggctcttcttcctgatcctgcccctcttcccaccccctgccctccaacacgtcccagtgtgtgtgttgttctccacaatgtatccatgtgttctcataatttagttaccacttttctgttcctgtgttagtttgctaagtataatgtcctccagctccatccatgtccctgcaaaagatatgatctcattcctttttatggctgcatagtattccatagtgtatatgtactacattttctttatccactcttgatggttgtcttttcactccgttggtagtttattttgctatgcaggagctctttaggttaattagattccatttgtcaatttttgcttttgttgcaatggcttttgatgtttttgtcatgaaatctttacctgtgcctatgttctgaatggtatctcctagattttcttctagggtttatatagtttttggttttacatttaagtcttttatccatcttgagttgatttttgttgatggtgtaaggaagggatccagtatcaattttctgcatatggctagccagttttcccagcaccatttattaaatagggaatccttttcccattgcttgtttttgtcagacttgttaaagatcagatggttgtagatgagtggtcttatttctgggttctctgttctgtttcattggtcaatgtgtctgttcatccatcttggcaagccaaatcacaaatgaactcccattcacgattgccccccccgcaaaaaaaatgcccaggaatacaggtaacaaagaaagtgaaggagggatgtcctcaaggagaactacaagccactgctcaaaagatccactattaccctagattactgtagccctgttttggttactatagccctatagtatagtttgagattgcatagtgtgatgcttccagctttgttctttttgcttatgattgccttggctattcaggctcttttttgtttccacatgaattttaagatagttttttctaattctgtgaaaaatgtcatggtagtttaatggggatagcattgaatgaatctgtaaattgttttggggactatggccattttcacaatatcaactcttcctatccatgagcatggaataatgtttttccatttgcttgtgttatctgtgattttttttgagcagtgatttatagttctccttgaagataagcacttaggttgagttcatgtctttgttattgtgaatagtgctgcagtgaacatatgcatgcacatgtctttataataggattatttctatttttgtgtgtatatacccagtaatgggattgctgggttgaatagtatttctgcccctaggtctttgaggaattgccacactgtcttccagattaattgaactaatttacactcccaccaacagtgtaagagttttcctttttctcacaacctcaccagcatctgttgttttttgactttttactaatagccattctgactggtgtgagatggtatctcattgtggttttgatttacatttctgtaatgctcactgatgttgagctgtttttcatatatttattggctgcgagtatgtctgttcatgtaaagggttcatgtccttcacctactttgtaatggggttgttttttttttcttgtaaatttaagttccttatagatgctgaatattagacctttgtcagatggatagactgcagaaattttctctcattctgtaggttccacattttttgttgtgacaggaatgctggaaggggttgaaatgggaacagttttcttcctccagttgggaggaggaatatcccaataaaggtgggggaaagtgattttccttggagaacagacctgagtgtatttcacaatgattatttcttcatttcttctgccagagttatgaagggattttttttttttttttttttggtgtgtgtcttcatgagaacatcgtggggattctgaaagtaaagcaaacaaaaatgtaaaggcctccccaagactatggcctccaagactttcttgtatttggtttctagttagtttccaagctagtccatccttaacctccagtactttatcaacattaccattttgtggtgtcctcatcaatttatggttccagtggcttctgtttcaagtgagacttctgttgtgtttctcttgtctccagatttaagggtgatggtttgcctagtgacttcagttctctgataggttcaagaaaagttcatggtttttagtttgttcaactttttcttattttaaggatggagcaacttgcaagctcttggcatattagagttaaaaccagaagtcctttattctgttttatagccacttttatattcctttttttggaaatgagtttctagagaaagaaaggagtccgttactaaacctgaaacttactagatttagaagttcacatcacactgagactcactgtgattctctgtgaatataacatctgtcacttctctgtctaaattctggggaaagtccagtttaggcctactcttgtggcgtgcatttatgcccctgggtatgatttaggttacctaacagttttcattcttgatcgagtgatgggaggaaagaattgcaaggactgtaaaatgaaactggccatgagcaggacccagcaagaaaagagataaatgctagatggaaactgccatttgcccacaattctaacatcttaaattcagttcttagctattgggtgtcagtttttagaagtgaaaaactaacactcttctctccccaccaaaccaagagaaaaaagcattgagacatttcttgatagtcactataaaaaataaagataaactgagcaaagattaagtatttttccttcttccaaaataagataaaacttttattataaaatatgctgctaaatatggacatgctctttgaaaaaataacagaaatcatatgcttgcagtagatttatagaatcaagtttttagaattggaatgtattttgaaggtgagtgtctttttaataacttttaaataactaattttatccagttgcaataaaggggttatatgcaaatacaccagaatgctatgggttcttctttctcattctttcattttatgtagacttggacatgtttttttttggtatgaacatgaatttctttagttttcagtggcatttattataagccagacaatatgctatttatttttttgaattatttttaaacttttgaaaagtagcatatccaataaattctgtaattataaaataaaatgatggctttgtacttcatatgatgtgacaattgttaatctccatcgcctgtttcagtaggtctcaaccttttattcattattgtcccctaaggtgcctttctagatatttttttttcctaattactccctctcccataaaattttattactattgcagatatactccatatctgcttatgtactgcagcccttgagaagtccaaaaacactgtaatatctcctaatttaccccttccccataaaccagttttcacctcttgaacatgctattatcctagttgagaatgcatgccctatttgattaataataatggttatcttttataaatcaccaaactaaatatgtaggtgctggttctagagtcacattatttaggttagtattctggagcaactctttaccagatttgtgattgtgaattatttattaaactcaaagttcctcaattttctcaattcaaaataaaaataatagcacccgaattggtgaaagtaatactgacagttgtaacaaacatccccaaatgcaggatgtttcaaatcctatagaagagtatttctcagtaatataaattccaaacagaatgttactgagtgtcaggttagctctagtccaggtgctggcttcttccaccatgcgattcatcaactgaagctcatattgtttcccaggttgcactgggagttggtatccagccattagtcaagacaagataagggaaaattgcaaaataatgaaaagcctttaggggccagtgtggaagtgatacatactagttttagccacgttcctctcaccagaatttaggtccagctatgattgccacacttaagtaaaagaggggaatgggtgggaaatatgttccatctctgtgtttaggaaagataggagatgaatttcattaatagctagtcagtctctgccatggcagttatttcatagcattgtgaagattattaaactatttgaaagatatattatgtctagaattgtctagcactacaactgggatgttttgaatattatggatggggcataaaatgtaagtttagataccgtcattatacagatgagggaaatgacaggcagagataccactatcctaatgaggatgactggagatgagggaattgatatttatggagattaagaatttgctcaatgtcactgaggtagaattttaatacagcttaataaaaatttaaaacccatttgtttcctctcatttcactgtgcttactctattcaataatttaattagttacttttgctttttaaaaggcactgtcattctgttttccatgataactcaaggtttctttaatagagtgaataaataattatatcattttataaaatgttttgggattatcataataaagataatgatgatgacatcaattcttgagttcctaattgctgtaggttcagatttttttttctttttttgagatggagtctcactctgtcacccaggctggagtgcagtggtgtgatctcggctcactgtaaacttcaccttccaggttattctcccatttcagccttccaagtagctggcattacatgcacccaccaccacacccggctaatttttgtatttttagtagagacagggtttcgccatgttggccaggctggtctcaaactcctgacctcagatgatccacctgcctcggcctcccaaagtgtttggattacaggttcagattttaataagatgacaactgaagtgtgtttcacaggggtaataaaaatagagatcttaataccaaattaagaaataaatttctccaagcatatagaaattaatctaattgatgtgtgcatatatttttaaataatttttttttttttttgagacagagtttcacttttgttccccaagctgcagtgcaatggcgagatctcggcttgctgcaacctctgcctcctcggttcaagtgattctcctgcctcagccttccaagtagctgggattacaggcgcgcaccaccatgcccagctaattttttgtatttttagtagaaacggggtttcaccatgttagccaggctggtcttgaacgcctgacctcaggtgatctgcccacctcggccccccaaagtgatgggattacaggcgtcagccaccatgcccagcccaatgctgttgatcttttcaactaactcatgttagcagccctattaaggcagccaacattttatcagtttcaaatttattcactatgtcactaagatgatggttcttgatttatttttattaatttttatttctatagaaaatctatgaattgtgattgcagttttatggctgataactttctagaaaaaattatgatatacaacaaaacttaacgaatatcagcaaaaaggggaatctacaccttcacactattctattcacgtttgcactttcttccaattttctttgtgcatacgtgtttgcagttatagcatactatactctttatattttttgttgtttgctaatgtaattctgtatttctacggagtcttcaaaattatcacttttaatggcttcaagacattctctatgctgttatataattggtaacatttaaccgtttagtaccaactttttttctccttactttttctttttcttttcttttttttttttgagacggagtctcgctctgtcgcctaggctggagtgcagtggcgcgatctcggctcactgcaagctccgcctcccaggttcacgccattctcctgcctcagcctcccgagtagctgggactataggcgcccgccaccacgcccggctaatttttttgtatttttagtagagacggggtttcatcgtgttagccaggatggtctcgatctcctgaccttgtgatcagcccgcctcggcctcccaaagtgctgggattacaggcgtgagccaccgcgcctggcctctcattactttttcttacatgtatactttcttcttaacattagtaaatgtaggttgagaagttattttcgatttttgtcagcatgacattttgccccagttgtgtctctttttctgtctatagttgctacctatcaatatttttaaaaaaattctgcccctcttttaagccataattatcactcattcattcattgaatttcttaagtgtttctcttcattgtagttttaaatttttctctttctaaacactttatagttttctaaaaactttagcattcaaataatatcctggttttattgccttacagtgcaagataattcatattgaacagcttgttattttactgactgtaaattgattacattctcaaatctcattattgaacattttgtagagccagtatagttaagtatagtagtccgtctttacatgggggatacatttcaagacccccagtggatgcctgaaattgtagatagtactgaaccctaccctatatatgctatgttttccctaaacatacatacttatgataaaatttaatttataaattaggcaaggtaggagattaatgaccagttattcagaagatagagcatatgagagtgatgactgataaacctgtaaaagattttccacattccttaaaatataatgcctttaaggatatgaaactaatttatttcataacagtagctacattactattcttggcatatgaaaaattgaatgttgagaagtaccactataaaattttaaaaatgagaagtcatggcaaatatataccttataacttatatcaatacagaggtgccataagacattaaaaattatcattgctttctgatattagtttactattattttattgtttttgttattattgtcagtttagcatagttaaaaatatactgtatgaaaaatatgatagttataatgctgttcaccaattatttccaactctccgttcttttttaacacatggtaggattgcactttttaggggctccatttggggagatagggctttaagacaggttctgtccagtgggtttggaacagacatatcttctggccagatttcattgccagtatgacattctcaagctcattttcttctgccacaggtagccacgttacagagagtgactgttctgctcatattgatcttgatatgcatataggataaacaggaaataagtctttgcttacttttacttaaacaactgtgatttggggattgttaacatagcaaaatcaatcatcttctgctcatgacagaaaagtcagtttttgttttatttgggcaatttgctcatctaatatttgctcatcttattattatcctagtagcaatttataacaaatggttcatgaagagttctgatttcagattatttatttcccacgtagcctcagtaggataatgtggtttggttaatttggccccctattacttgtacttcaacaggttaattttataactacttattttataatgtaggtttcattgcttttattcagaattaaaatgtgtctttgcatagtaatatttcatttacaggataaatattcattgaataaattctcaaatgcacatctgttacctttgaaaaagttctttcttccctaagtttcatttagttcttaccttacttagatagatatccacaagtttatcatgaattctttaaaaataaactcttaatctaggcatacttatttagtggagcatagttcagcatatcatttatggaaaaaattgttttgacactaaattacaatattccctaatttaaaatctctgctttttcttttttttcctcctgagacggagtcttgctttgtcgcccaggctggagcacaatggtgggatctcggctcactgcaacctctccctcccaggttcaagtgattctcctgcctcagcctcctgagtagctgggaccacaggcatgggccaccacggccagctaatttttgtgtttttagtagaggtggggttttaccatgttggccaggttggtctcaaactcctgacctcaggctatctgcctgcctcgacctcccaaagtgctgggaccaaaagcgtgagccactgtgcctggccaaaatctctgcatatcctttgaaaaattaaatataaatataacttgtattaatatatttgaatttcaaatacatttggaagcacttagtttttagggcaacaatactatgaattcttttggaaagccaagatttattttgtccctttattcttaagaataaagattttataaaatgactcctttccttagactgaaaaatcatattacattacacattacatatatacctaaaaatgaagttaaatttaatatcatgttacatcagagatgtagctgtaagataatttataattacaaattatttttagtaatgtctcctaaattagagctaagagtggtaaaataatcaatataatctctattctgaggtttaaacagatgactccaggaatataaaatctgaggtagacacttcattagttgagtgaagtttctgtaacaaactgtaaagaaaggttgatgtcttatgaaatgtgaaaggttgatgtcttatgaaatgggagtggaccagaaaggaacagctgctcactaccaaaaagaggtgagtgaaggctctgcctgtaaagagggccacattttcttttaagaagtcaattttaagtcttctggtagattgcgttgtagttcaggccatcatcatttgcctcactctcatcatgcttactgaaatgagcaaatgaataaactccagggggaagtcccgtatcagcaaggcatcatatgccacagacttctactagttatagggcatatacactgtgtaaagtgaaaataacaagggtaacttactaacctcctcagtgagaggctgtggcaaagtcagtaagaggaagagaaagggtaactgttggctgaacacccaagagtgtggggtaaagatggggcgtgaaggtgaagctgggctatggacaaagaaagaccaattacttggaacccatttcactatcatttattgacagcattctaaccatccccatcagtgactgctgaggcaatagaaaccactttcaaacagattaaaacagaaattaactgttctttcaacctatgtttccttaaaatatatcatgccatagtgtgagtttttaaagtttggggaattttagggctaaaacagcaggtgctgagcattaagttattcaactattaatttaacgcctcataactttagttaatgtgacaactaaaagaaattaaaatataataaatgtttcttaaggagaaatcttattaatctttattaaaggtaagggtaaagtaagaatatatgataaaaatctgaataaaataaaaaatactagttaagcgcatgtctacaggcaccactttaaacattttctatgtataagtatatttaataatacattattgttattatttccatttcaaaaataaaggaagttaaggacagacagattgggtgatatgctgactcctatatgttggaatttgaattaaatccaatcagtattctctacctccccaagtctgagtatgctccattgccttcaaaaaccagaagcaaatatctgttaggatcataattgtaaatgagttaaccttacctgttgaaagactaaggaaaaaaaagtaaaccgctgagtaaaataaaatgatacacagagatgataaattaaagtttagtcaaagttatattaatcaagtacagataaaagaaagcagagattataatgttgatttcagattttaaaaaataattcatagcaaactaaaattgaatgtttccaagaaggccatttttattgcagtgtaaaatcttagggattttacaatgactaaacattacattagtcattttatatatgtgccaaatagcttgataggtatattgtaaattcagctttataaatttagagattatattattaactcaaattggatttgcaattgttatatctacctgttgaattaaacctgtatcattttgagttgttctcttttttccttgaactctcttgtctaatatttatagagttacactaggtttctttggcttcatatgtgcatggttattatttttcattcttttttcaacctttctgtgtaattgtgttgtagaagtcttttgtaagtggcttatagttttgtttttttaatctagttctcatttgtttttaattggagcattaaatcaatttatagttgatgtaataccaatgtgtttgggtttaaatctgccatctggttttgtacttgctgttctgtgtttagtattttttttttactctcttttcttggtttcctttttattacaaaagcattttcaattaaattttttccctaagaattttggaacttacagattgtttactaattttggagacagtacagattctgtcttatatacttctagttgaatattaataaattcatttgtcttccctttcaagaatacaaggacattagtatagtccatttgcacctcttctgactgacatgttactattgtatattttaatttcattctgttatgatactaacaagacattatcttattgttctgttcaattactagtttataaatttactcacgtatttaccatacccactgatcacctcacataaaattataaatacctctacaggtacactcttgatccctcctgtcttattttgcttatttcttttttttttttttttttttttgagacgaagtttcggtcttgtcgcccaggctggagtgcgtggcgcaatctcgcctcactgcaacctccacctcccgggtgcaagcaattctccagtctcagcttctcgagtagctgggattacaggcgcccaccaccacgcctggctaatttttgtattttttagtacagacagcgtttcaccatgttggccaggctggtcctgaacccctgacctcaggtgatccacccgtctcggccttccaagtaatcctgagtagctgggattacaggcgtgagccaccgtgctcggctgcttatttcttaattctacaaatttgccagtatttaacatgccgtattgttgtttttttgagacggagtctcgctctgtcgcccaggctggagtgcagtggtgagatctccactcactgcgagctccacctcccgcgttcacgccattctcctgcctcagcctcccgagtagctgggactacaggcgcccgccaccacgcccggctaattttttgtatttttggtagagacagggtttcactgtgttagcgaggatggtctctatctcctgacctcgtgatccacccgcgtcagcctcccaaagtgctgggattacaggcgtgagccaccgcgcccggctgtattgttgttttttaaaaaattattttagtgtttattgtatctcctcttccaactaaaatgtatgttctgaatacactgacattcatggattttttcctagtgcttagaacaatgcctggcccctataggaagcaccaattatatatttattgagtgaaagaatgaatttattcttaagtgtcttacactccatcctgagatcaacttccttctgtccaaagtatatcttttatgttccctttgtgaagatttgctgatgtgctcccttattttttccctagaaatatcttatttcatcctaaaaaatgtttttcagcatacaggaatgcttttattatttaatattaagacatttaagatattaattctctgacacctgacttccattattgctgttgagcagtctgctgtcagtcaaactgtccctcctttgtggtaaatttgtctgtcttctcgggctactactaaaaacttcttttcacattctatactcttcattttcacagtgttgtatttgttgcgcatttcttttttaattaacttgtttttgggttcattagatctcgtcttgtcttctatcacttctagaaaattctcagccatagcatcttcaaatacttgtctctgtcccattttcccactgttctccttttaaactttaaatgtgttagaactcaatctgttcttcatgtattttaacttcctttttagatttttcatctctgcttctgctgattcttattcctgctttttctgcttcgtggtaccttgcctcttgcatgcttagttatattttagtgtgagcatctctttttccttgggaaattatccatgggaatatttgaggctagaatgaaggtgtattcattccttcagaggatttacttttgctacctcccagagcactccctatatgagagtagtttatggaggttgaaggatgttttgtctgctcagttgatatgtattaatatttggacagctctgaaccaaagcagctttttctttttttcagcttccttgggttgtcaatgaagtaggtgcacatatttctgggtcgcatgtgccctctgaggatacagttatataattgagaatctcctccttgattttccatgttggctggaaactggattttactttatttctctcttaccaccccacagtcatcccaagcttcctgcccaggttatcagtctgtgatcatggaagcttgagctctccaagcttggcagttatctaagaataaggaattctgtctttactcttttttttgtcaggtctttagtgagatatttatacatgtaatcacaaaataatatattatcattacctagtttttaatactttttagctagagactccatctgacaatggaatcatccatagtatctttgtgtcattgttctctacaaataatgattttaaatcaatgggaagtattaggaactgtttaataataaaacactgggagaagtggttaatcattaagggatggaggaagactttgagaaggaaaaaggctgataactatgtgatttgaatctaattcatttcacactgcaactggatacatagtttggcatatggtggtttaaataccatacatataaggtgccattagatacacctttaccacttccatattaacatttctggtgactcacaagaacatctgtaacaaaattctggcattcatagattttcaaacaaaaatacatgtttacttttaattccattttgcctatttttaaagttttatactcatttatggattttgggtattgtatgacatacgttgatttttcttcatttgaagatcaaacataaattcacctacacaacttttccaaaactgttatggtttcacgttttcaacttctatttgtgaattagctttttctttttttctaaaaagttaaccagttatacaatgcaattaattaaatgcagatgtctatgattttaaaaaactatctatactacataaattaatttgatctatttctgatacattcatattttaaatatgtagctatttattttttttcttttgagatgaagttttgttcttgttgcccaggctggagcgcaatggaatgatcttggctcactgcaacctctgcctcccgggttcaagcaattctcctgcctcagcctcccgagtagctgggattacaggtgcctgccaccatgcctggctaatttttgtatatttagtagagacggagtttcaccatgttgactaggctggtcttgaactcctgacttcaggtgatccactcacctcgacctcccaaagtgctgagagtacaggcgtgagccactgcacctggcccaactatttcatacttattaaatatcatgattttatatttaagttatagatatattcatacttttaagaaaaatagtatatctgcattttccaaaattgttatatttaaaaatagctttgaattttgcgtacatgtttcacttccttattggtatgtctttagtatatggtgctttattcaaatgccataattataaaaatatcttataataatcaactttaaaaagggacatcggtttgattttgaaaaatcacttcttgaccttaaatactagaatgtaataataaaagagattatttgaaatggtgaactgagtacataaaatttgatggtacacttttaacacagatttttctattgttcatgtttaacttaagaaaggtggtaggtttcatctctttatgtcttgatttctcgtacaattgcttcatgctgttatgctaagatcagaattacagatctttcctggctgaaatgaatgatcaacatttaattgactaagttcctcattgtttaagatgctttgacttgtggacgtcagatgcagggaaacagatttactgaaattctgacccctggcatattttttgtcatagacacatagatattacttgaaaccaaatatgtatttttcatcatactttatccattaagccactgaagtcttttggaatattgtcttttatttaagtgccatccatctaaagccgcctgaagttgcagagttctgcaattactgacagtaatactctctgaaaaactatgttaatccagtcttatgccacttaacctcattttggtcaatgatgaaccacatatactatagtgtcccataagattataacagagctgaaaaattcctatcacctagtgacactgtagccgttatgatgtgttagtgcaaggcaatactctgtggttgtggtgatgcttatgtaaataaacctactgcaccgccagttatataaaagtatagcacagtccgggtgcggtggctcatgcctgtaatcccagcactttgggaggctgaggcaggcagatcacccgaggtcaggagttcgagaccagcctggccaatatggcaaaaaccctgtctctaccaaaaatacaaaaattagctgggcgtggtggtgcgtgcctgtagtcccagttactagggtggctgaggcaggagaatcacttgaacccaggaggcagaagttgcagtgagccaagatcgcaccactgcactccagcctgggcgacagagcaagactccatttcaaaaaaagaagaaaagaaaaagtatagcacatatgattgtgtacaatacgtaatacctgatagtgataatagatgactgttcctggtttatgtatttactgtactttttatcattattttagagtgtactccttctacttatcaaaaaaaagttaactgtaaatcagtctcaggtcctttaagaagtattccataagaaggtattgtcataaaaggagataacagctccatgcatgttattgcccccaaagaccttccgggggacaagatgtggatgtagaagacagtgatattgatgaccctgaccttgtgtaggcctaggctaagtatgtgcttgtgtcttagcttttaacaaaaaagttcaagcagtaaaagataacagtttttaaaaatacaaaaagtcttataaaagaaatctataaagaaaatattctgtatagctgtacatgtttgtgtcttaacctaagtgttatttcaaaagaacaaaacagattttaaaaaatttatgaagtaaaaatatagaaagctaaggttaatttattacttaataaaatattttttataaatttagagtagcctaagtgtacagtgtttataaagtcgatagtaatgtacactagcgtcctaggccttcacatttactcgccactcactcactttcttacctagatcaaattgcagtcctgtaggcaccattcatagtaagtgctcaatatgggtataccattcttatctttatactgtattttttgcacaaattttctgtgttcagatacacaaatagttaccattatgttactatcgctacaatattcggtatggtaacatgctatacaggtttgtaggctaggagcaacaggctagaccatatagcctaggtgtggggtaggccctgctatctaggtttgtataagtacactcaatgatgttcgaagaaggataccatctcagaatacatcaccgtcttgataccatctcagaatacatcaccgtctttaagggatacatgactatggtttagcagaaagatcatttatttgtctgtaacgtttgaatcagttcatctgatgatcaaaatcttgccacaataaaacatattctgtcattcagaagtatgctattgagacagctgaactttcacctttgctttccatataaaactcagggttctatagcaattaatttattcaagttggacgattattgttaataatacccttgtctttaaaaaagttattgacttaatccttttggattatttaaaaatgtatcaattcttttttttcttccagtatccattataaacttacagcacagttcatgaatttcaggttacaaaaaatagacatagagttgttaacagcatagttcatgaatttcaggttacgaaaaatagagttgttttcctcaagaatattttatgaaatacttttaaaaggaacatattcctaaatgaaaaaatatttcattgtgcatgtttcagaagcacttttattcaggtatgattaatacatagaactggaatgaacatttgttcatattctttcagataaaacacaaataggagtatatacatgtctttaaaaagatataagtaaatttgcattaaaagtttatgttcttttccaagtctatattttctctttttattaagttgaaaaaaaatgaagaaataattaataagttttatttcattagttctttgtaaaatattattagaatatgtaaaaatagctcatgctactgaaagttattaattggatatgtttactgtgtttatttttatgtatatcattcattaacatataaataagaaaggaaatctgaaagtaagcgtaaggactattatacataatcttgtgtaatttcccaaattcagaaatcaatacatgtgatataattactaatacctagatgatcaatttaattcttttttagatatgtaatataaatagaaaatttcttagggcttaagtaaaaaacaacagtgttttagtttttttctgtgtgaaaaaatactttcatttgcctcattctttacctgttaaaaagcctctcagggtggggcgtggtggcacacgtctgtaatcctagcactttgagaggcctaggcagggggatcatgaggtcaggagatcgagaccatcctggccaacaaggtgaaaccctgtctctattaaaaatacaaaagttagctgggcatggtggcgggcgcctgtagtcccagctactcaggaggctgaggcaggagcattgcttgaacccgggaggcggaggttgcagtgagccgagatcgcgccactgtactacaccctgggtgacagagtgagactctcagaaaaacaaaaacagaaacaaaaacaaaacaaaacaaaaaacactcagaaaaactttatttgctcccacttattttctactttttcttcttttgctattatatttatatttatgtttaatggtcatttatatttaatataaatctatttatataattgtatttaatggccattttatatttttctgtattctcccagttaacatatcctggcagcataaatgaaatttgatgatttcattatcagttatccaaacaagctttcctatccctgacctgtgaatctgtgctaggtggggtagattagaagcttcaggatcttgtaagggtgacgtgacaagggcagataactgatggtcctgatagcacccagagaaaagctacgttaaatctctgtcctccatatagctgaagtagtgtctagtatcagtttatggttcttcacttgaaatgagaatatgttgtatactatagatttaaataaaacaaacttagatttaaactgcttaagctaaagatcttggctatttagctataatttttagtgaaaatatcctagtttattgaatcttacctagatattctttttataagtttgattttattttgttctccttctttcctttttgtcatttctttacttaggctataaatttattttaaagactgagttttctcttgaccaattctttccataagttcacctgttttttatatgacttacactataagagcctatgtagacactcaataaatgtgttttattttgtagcagaatccatgacttattatcagtaaaaccctggttgaggtacttttaatcttgttttccacacctaaacctatctagccctgttgcattgtatcccgaggcccagcattattcaatattttgtgtatttacagtaagccaagtggagtacttattgtatcctggaaataataactatgtcgactaataggcatcaaaataagaattaatttttactttgcaggacaagtactccaagaaacctgagttgttaaggtggtaaacacagaaagcactatacaaagtatttgtaaagattaacattgctacagttatgcaagcacatatttgccttaacaagattagtaatgccagctgcctgcattcaaagagacaatttaacttcaattttaatattacctgaaacagtgtaaaatgacaagagttacatcgaaatatgtatcacaatttcaaatgaagaaattaaagcatacctttatgttatctgctgtgacttttataaatgaatgaaatggaatatatgaatttttattatagaaagctatttgtccaaaattaaaataatattttattacaatatagtttttactgatgtttttacaagtattgtattctctttgatggtaggttctcttgttggtaaattccaatcgattaaaaattcatgttcctttgtttaggcgttggtcatagtggatggtgaattgagtcacttcctcacctctctctattcaaccttttgtgctgcacaggctgtttcctaggaccacttgaagcttgagttctgttcataatttgggttctgccaattagatgcacttgagtaaaatgtggaaggtggaaagcagtctaggctatgtttctaaggtttttctgctggcagactcctgatagaattatctgatatctgtagagtgtcttaccagaataatgcttcccttaatatgggttgcatcctcatcataacagcttcctaatcatggccagcttctggaccaccgatgatacattaactccttgggtcatctagttctgtgaccctcacagttgttctgttaaatgcaatgtaaagtctgttttcagccttcaatatgattcagaaagttatttaaaatttcataatgcattttttatgtttatactacaaaaatgtagttggtctctgcatttaattgatacaattaacaataatatattttaaattttatttacttcaattgttaatttttttttttactaaagaaaatgtacttatatggtaaatgttataaattttatttactatagttgctgcctctacatttatttttagggctgacatagttatttaaaacctggtcataacctagttaaaatttctcctccacgtatggttgcttgcaatatagcccacttgttcctcatcccactgaccctaaactcaacataccccacagctgctaatcacgagaaaacctagtgttcaatattagaataatgtaaataagttctcccttcacacgtgttttctttaaaccagctaatccacaacctctgagggaaagcctaagtggtaacactcataggccttaataatggtgtagccacccaggttctctccatcgtttcctgctcactgggtgaactccctgccacctccagtcttaccgtcagcctcctgttgtcaccccaacctctctggaatctgtgagtaataaatatcttctattttctgcactgtggcttcacttccttattgtgtctcccctgacgcacacgcacgcctgaacttaaccttatattcagccagagctcttttgggcagtggctgtcttgacaagaataaacaagggtatctgctgtataaacaagtttcctgtgaaaggacgacctggtcacagtgagatacttaggcattaggccatcatcaggataaagaaatagcccaaaaaaggcatgctacaaactctcaggcccagtttttttactttccaggtcagaacagggctggagcttatggccagtcttgagagagaccacaaaaccaaattggaaacaattcataacaaattaaatcaaaactgtaaactaaaccgaaaaagtaaaggtgatacctataattaaaggtagcaatttattggccccactactcccactccaaattgccgtagctagaaacaattgctttttaatttttctgggttttgttattttggtggttacttcatatctctgaataacacacgtattccaacaatcatgattttctcatgcgagacatattccgttgatttttctgctagactagataaggactttgtcttcttaaccttcttcccagctcctctccccatagccacccaatgtagttatatcaccattttaatttctttattatgtttttaatttaaataatatgtacttttatcacctttccatcagctctagaaatatgatttttgactcccctctttgtaagatattatcagtgctaatcttccctgacctttctctcctctaccattctttcctccacttctgtgtttcttctgtagttataataaatagtacattttctttctcttgaaaacttctaaaatgcttaaggttttaagctttctttaaacatagtgagatcggaaaataaaggccttatcgaattactcatgattttatcttttctcatggtcatttaatgcctgatctttcaaaagtttcactttcttttactgacattcctctgttgccttggttttgtatttgctgccttcttactctttttctctgctttgtattttgtgaagcacaaaaagctacacagtacactaaaacacaactaattatacttcacattaatgaataggctaatgcttttccggtgtggtgggggagtttccaaaacctagattaggaagactatcaatttgttgactattcagttagcagtagaataagggaacagtatagagagactccagttccctttcctagccaatgaataaaagcttacaaaccatcgtcttatgttcatagattgttttccctaaatattttacatgtatttatatatactgaagttcattagtcaattctatgctaactcaaaaagttattattttttcaatttttttcttttttgagacggagtctcgctctgtcacccaggctggagtgcagtggcgtgatctcagctcactgcaagctccacctcccaggttcatgccattctcctgcctcagcctcccgagtagctgggactacaggtgcccgtcaccacgcccggctaattttttgtatttttagtagagatggggtttcactttgttagccaggatggtcttgatttcctgacctcgtgatccgcctgcctcggcctcccaaagtgctgggattacacgtgtgagctgctgcgcccagcctattttttcaatcttatgctatttatcttactactttctttctcataagtgcataggaaaatttgacactgctgagaaatcactgaactgtttgtgggataccaccagattatttatggttctataagatatttctcaggccaggccttttataaagcaattttaatatatgtatgaattattatatgtcatgtaattattctataattttagaatgtatattcagattaagacattagtttcatgtaatactttcaggcatgctgaagtcccagtagctacaggtagggaagaagcaggaaactgtaaacaggtggacccaggatcaggtacctcacatagctctaggactagtactacagagagtaatagtagtatagtcaacactgtacagtgtggatgtaatatggcagcaggttcttccaggacaggtgaggatacttgcagattgactggtaccatcactgcaattgtagatggcatgaatgacttagacctaactaggaacatgaagacatgtgtggtcttaggaaaaagggttgagtagatatggccagattatcaggaatcaggaaaatgctctaccttcataagaatgataaatcacagtcaagaaacaaaaggataattccagttgcatgttcagcaagccgtgacataggttagaagcaaagtctgcagctcactggacacagagatatcttgagagttaattctaacctagtatttatcaaaaggtgatctattataactctctggaatcctggtcaaaaactaagataattaggcctgttccaactcttagacttcagatcaaatccaataatctctgtgaacctccctgagtgatccttatgaatcttaaaatttgagaaccacatctttagacataccagatactaagtttagaacagaaagacaaatttgaggcattttatttcacttgcttactaccctttaccaaaatattgaggctagttttcttaatttactcttgtcaatgtggacaaaggcctgaaaacactgtgcttatagtttgaaagcatttatatttgcagtgatgtggagctggaaaatgaggatttgctcatttttatttatttttctatactagttgagtgttataataaaatataaaaactcattttagcttcatcttagtctaatgtgcttttcatgacaagtacttaaagattatgtctagtcagtgtagcttcataattgatgtaaaacaatgcagaaacatattaaacatatgacagcttatgagatctaaatttgtaaacttcataaatattaaaaaactttcatattttaaactttcatattttaaaataaatatgaaacctacgatagtcttacattagtcaaaatgaaataaaattaatgtatcacagcccaatgactagtttcttctcattcacctgatgaatgcaagaaagcctgttagttggagtaaaatcatctggtgtgtgctcagctgcatttaactgtagaggccttaagacatgttaagcaatgtgattttgatttcacctgctgactttccgaaggcaacttattataagaaacagttgaatagtgatatcatgctgttggcacttgagctttctgctggaggttgcaatctaatctttgcaaacctgtaattactatttcctaagtaattctaggtttccattattgaatctctaaatgtctaaaaggtactgagatgtaatatacaaaaaggcatagggatcaaatgataacaacaaactctttgtgtcagtaatactcaatttcgatgtttttgatgttataatgacatgttactggcaagaatatttggtgcattttgcaggttcagtgtatttttttatgttggtgttatgaagtctttgaaataaaaagatgttttattccagggttatcaatccatgcatcacagtttagagaaataagtgaaagatagtgattctactttgaaatttaaatgtttgtctctggttattcaagttaagtattttaaaatagttttgactgatatcatgttatatagaaaatgtgaagtcataggtgtctgtgtaatggaatatgaaaaacattgtttattaaaaaaataaaatcctggtagagacatcatttctcctttgaaatatatagataagtgatccactaaaaaagtaaacatctcaaacacaaagtttaattctgcttgtgagaatatgccatacattgcactttttttgtgaaagataaactactcttttttatcatttcattttaatgtgtttcatgtactgtcctaggcacaaggaatagaatcgtaacaaggacagggtttgcttttgtagagcatagattctaatggagaagatagaaagttaaaaagcaaacagaaatttcaagctgatgataatgatgactgagatgatagctgtcacagtgaagatgataggcagtggactttagtagatattagaaagatatacccaagagcactgcatgagatatgtaactaatagagaggaatctgtaataactcaagaaaataaagttctgtgaccaaattattcagacatatatgataaaatattataaaatagtagaaaagaatatttgcagtccctgtggctgcatttaaccatctaaatatatcaatatctatatacctatatatgaaaatccctatctaatgaaatagtttaaaaatcttcccaagattatgcagctacttaaatggctgagtaggactagatctgcagacccctgaggccagcctcagatatcagtcagagtgaacataacaaatcaaagtagtgtccttccacagaggagttaaaatatttaaacataagtaattttagcaatccaataggtgttaaaaaaaagaaaaaagtctatgggccaggcacgatggctcatgcatgtaatcctagcactttgggaggccgaggcaggtggatcacctgaggtcaggagttcaagaccagcctggccaacgtggtaaaaccccgtctcaaaaaaataaataaataaataaaaattagccaggtgtggtggcatcctcctgtagtcccagctattcggaaggctgaggcaggagaattgcttgaacctaggaggcagaggttgcatgcagtgagctgagatcacaccactgcactccagcctaggtgacagaaaataaaaatctatgcccagataaatctttagactaattgagcaaggcctttgcttatacatctttggtgtaccataggtttggatttgtagctgtagactttaacttttgcttgtctatagccactgcattacaaagatgcaaataccagacttttccaaacatgttaatatgggatctctgggagcgggaaccccctaaatggctaatgtataccaggccaattaaaatttaacggcctaggatatgtgtgggtatgcatgtgtatttatttaaaaagacactcaaatagtttttttttatatgaagaaagtaaagctttgacactgaaattaaatgatgtaataactgttatattcagctaatatctcaatgatggctttgaggcagttgatagtagatagcttttttaaagaagtgtttttgaatgtttagcatatgaaacccttatggtgttgtctttatagagcaaagagggaataaagaaatggaatgtaaaaaatcctaaatattccacataaaaaagcttactagaattaataaatgtattcagcaaagttgcaggacacaaaatcaatatgcaaatatcagttgtgatttcatatactaacataaatctgaaacggaaatttttaaaaattgggttaaaatagcatcaaaaatacatagaaatataaacttaacaggagactaaagacttgttctctgaaaactacaaacatttctaaagaaaataaagatggtaataaatagacatatatattcatgaattagatgacttaatattgttgtccatactacttaaagctatccacaggttaaataccatccatatcaaaatacccatagctgttttttttttctgaaatagaaaaagcaattctaaaattcatatgcaaccgcagagaaccaaaaagagcccaaacaatctaaagaacaagctggaggtcctgcacttcctgacttcaaaggatattacaaaattacagtagttaaaacattatggagaaatagttatagaaatatggtggagtaggaagcaccaggaatctgtcttcccacctagagaacaattgtactggcagaatctgtctgatatataactattttggatttttgacatctactaaaggcttgcaacttctaggggaaagcttgcatggcgaattatgattaatttcagtcaatttcagcacttaaccacagtagtagctacccatttcccacagtcacccctgtagcaggcagctgtgcacatgttactggagcagtctgcacagagcatgcaggaaccagagtgggcaaaaaaaggacctgtcatccaaatatcggcaatctttgctctgattgctgattgctgtttctggtcacaaagatggacgcaaagaggtgagtggttattgttgcacctctatccattattgcaagcccctccctgctggctgaagtgacttccagaagattaaaagggccagtgcccttctcctactttatttttctgtttttccccctttgacagctagacattaaaaagtagggcattcaaagtaactgcacatatggtgacaatcagaaaatgactaagttactaagtgtaaacttaaggactgtcttttctaagcctgtgccttgcctttcctttggcacaggcttagaaaagacagtctttaagtttacacttcagactgattcttggcacagagatagcctacaacagaatcctcttatgacaatataaaaagcaaaatcattgactgaagtaaccgcaaactctcagtaagagggagaatctaatttttagagttactatgttattagatccaaaatcacaattcatacaaaaaattaagaaactatgtcttgtccaaaggaaaatatgaaatccctaaaatgacttgatggtggatctgctacagagggactttaaaataattgtgttaaatgatcaaagaactacaggaagatatagagaaagtcaagaaaatgatatatgaacaaaatgaaaaaaattcaatggataggaaacctcacaagaagttaaaaaaaattgggagctgaaaagtacaacaacttaaataaaaaatttactagagcgattcaaaggaagatttgagcaagcaaaggaaacagtcagtaaacttgaagataggacaatggaaatcaaggaacagaaggaaaaagaattgaaaaaagtaaacagagtctaagggacctgtgtgacacaatcaaggagtcacaggaggagaggagaaagagaagagaaaacttgaagaaacaacggatagaacctttccaaatctgataaaagacattaatataaacattcaagaaatccaacagaattcaaggaagatgaactcaaaaagacataaactgaaatacattataatcaaagctttaaaaggtggagacaaagatagaatcttaaaagcagcagaaaaacatcaatatattacttataaggaataatcagtaagattatcagtatatttctcaccagaaacgttgcaggccagaaggcagtgggctgacattcgaagtgctaaagaaaaacaaaaacagaaaacattatcaaacaagaatcttatatccagccaaactgtccttaaagtgagggcgaaattaagacatccccaggaaaacaacagttgggagagcttgttaccattggacctgacttgcaagaaatcctcctgcagagtgaaatgagaagacactagacagtaacttgaagttgtgtaaagaaataaagatcttaataaaggaaaatacatagaaaattataaaagcttatattattgtaacaatactttttaactgcacttttcgtgttctacatgctttaagaggttaatatatatatatttaaatttgtataaaagttcatattatgctttgtaactccaattttgttttgtacataatttaagagactaatgaatttaaaatacttacatgtttatatttttgtataatacataaagatataattttgtgacatcaaaaattgagagggtgggggaatggagcttttgaaggagccgagtttttatatattattgcagttatggtggtacaaatttaaattagaatgttatatatgcaggatctaaaatataatccctatggtaaccaccaagaaaatagctatatacaaggaaatgagaaagaaatttaagcaaatcactaaagaaaataaaatagacaactaaatataaaagatagtaatgcaggaaatgtagggaaacatctataagctataacgaattcaaatagtggctgggcgcagtggctcacacctgcaatccctgcgctttgggaggccgaggtgggtggatcatgaagtcaggagatcgaaaccatcctggccaacatggtgaaaccctgtctctactaaaaatacaaaaaatagctaggtgtggtggcacatgcctatagtcccagatactcatgaggctgagggaggagaatcacttgaacccaggaggcggaggctgcagtgatccaagattgtgccatggcactccatcctgggtgacaaagcaagactctgtctcaaaaaaagaaaaaaaaaagaattcaaaaatagtaaaatgacagaagtagcttccttcttttcagaaattacttataaattgattaaatgagctaatcaaaagactggcaaaatagatttttttaaaaaagatctatgtgtgtacaagagactcattttagatccaaagatgcaaatagattgaaggtagagggacagaaaaagatttctcaggcaaataaccaaacaagagcagggtagctatactgagaacagacaaaatagactttaatcaaaaagtttacaaaaggcaaagaaggacattctatattaataaaaggtttaatacagtaagaagttataacaagtataaacatttatgaacctagtaacagatcactaaattatatgaagaaataacttacataatggaagggaatgatacacagttccacagtaatagttgaagatgaataaatcactctcaataatggctagaaaaaaaaaacaaagataaataagaaaatgcaatacattaaaaaaaaaacaattagacctaactctgtgcaacaacagcgtacacattcttctcaagtgtacatggtacattttccaaaatagactatatgttacttcataaattaagtctcattagattgaaaagatagttatagaaagtatcttctctgatcctaagaagattgtcttagttcattttttgctgttataacaaaatgccacacactggataatttatataaaaatgttttttcctcacagttttggaggatgaggaatccagaagcatggtgccaacatttggcaagggacatcctatggcagaaggcattagatggcaagaaacagagaaagagacagacatcaggggctgaacttgtttataactaccccgctacttcaataatgacagtagtagttttagtccttatggcaggatttatgggaggactctgcctgtatgacccactcaccccttatttggctccatctcctaacactgttgcattggagattaagttttcaacatatgaattttagggggacatattcaaaccatagcaaggatgaagttagaaatcaatataaataaaaccagaaaaagttacaaaactttggaatttaaacaatacactcttaaacaatgaacgttatcaaagagaaattgtaagggaaattcgaaaatacttggagatgaaggaaaatgaaaacaatatatcaaaacatatgggatgaggaaacagtgctaagggggaaatttatagctataagttcttaaagatctcaagtcaacaacctagctttacaatgtatggaactagaaaaataacaaattaaacctaaagctagcacaagaaaggaaataataaaaattcgaccagagataaacaagatagtgaatagaaaaacaacagaataaaccaatgaacccaagacttggttctttaaaaagatgaacaaaatttacaaaactttagctaaataaactaataaaaaatgagagaaaagattcaagtaacaaagtcagaaatagaaaaagggacattcaggctgggcacggtggctcacgcctgtaatctcagcactttgggaggctgaggcaggtggatcacgagatcaggagatgagatcatcctggctaacatggtgaaaccccatctgtactaaaactacaaaaacaaaaaattagctgggcgtggtggcgggcgcctgtagtcccagttactcaggaggctgaggcaggagaatggcatgaacccgggaggcagaggttgcagtgagccgagatcgtgccactgcattccagcctgggtgacagagtgagattccgtgtcaaaaaacaaaaataaaaacaaaaaaacaaaacaaaaaaaaaccctacagaccaatatctcttacgaatattgaggcaaaaatgctcaaaaaatactagaaaacagaattctgcaacatattaatgtatgataagccacaatcaagtgggatttcttcttggaatgcaagggtgactcaacatagcaaagtcgatcaatgaaatacaccacattaagagaacaaagaagaaaaaacacacatgattatctcaattgcagaagaaaaagtatttgacaaaatgcttagagtagtcaaaactgtaaagccaaaaggtagaccagtggcttccagggactgggaggaagggagaatgaggagttactgtttaaggggaatagagtttcagtttataaaataaaaagagtgatggagatgaataatggtaatgtggttgtacaacattatgaacacatttaatagcactgaactgtacacttaaaataggctgataaattatatgttatgttcattttaccacgataaaaaatggagaaaacaacaaaaaacaaacagtatggtactagaataaagacagctatataaaccaatgaaacagaaaacagaacctagaaataaacccacacatatgcaatcaaattatcttcaacaagggggctaagaacacacaatggagaaataatagttgtttcaacaaatgaatttggaaaaactggttaccctcatgtaaaagaatgaaattgaacccttaccttgcaccatacacaaaaataaacagtactaaaaattttaacaaagacctgaaactataaatcctatttaagaaaacttaggggaaaattttataacatttgtcttggcaatgattgcttggataaggcaccaaaagcgtaggcaacaaaggcagagataataagtcgaactacaccaaactaaaaagcttctgtacaacaaaggaagcaatccaacagagtgaaaatgcagtccacggaatgggggaaagtatttgcaagttgcaaatcttataaggggtcaatctttaaaatatggaaagaactcctacaactcaatagttaaaaaaaccaaataaccttatttaaaaatgggcaaagaacttgactagacatttctccaaagacataaaaatgttcaacaggtgtatgtaaaggtgctcaccatcactaatcaccagagaaatgcaagtcaaaaccacaaaatatatcacctcacacatgttaggatggctgttatcaaaataacagaaaataaaaattgtaaggatatagagaaatctgaatccttgagttgtgttagtgtgaatgtaaaatagtgtagcctcaatggaaaactgtttggaggttcctcaaaaaaatcaaaaacagaactatcatctgatccagcagtcccacttctgggtatttagcactaagaattgaaattaggatattgaagagatatttgtattcctatgttcattgcagtattatttataatagctaaaaattacaatgatacaatgtggatgaaccttaagggcattatgttaagtgaaataaaccagttatagaaagaaaaatactgcatgatctcacttatattaggtattcaagtagtcaaactcatagaagcagaaacttgaatagtggttttcagaggctggggagagttgctgttcaattggtgtagagtttcagttatgcaacattaaaaagttctaggtatttgctttacaacaatgtgcatatagttaacaatactatactgtgtgcttaaaaattttaaagggtggatctcattttttttttaccacgataaaaaggaaaagaaaaatgaactggaagtttggaatagaatatcagctgtgatgcaatatgatattgtggaaagaccgttcgttgcactcatgatgccaagatctggatgaccgtcttgctctcatccttatgaactattttacctggcacaagttacttaagctcattgactattttaggactattgtgagaagcaaatgaaataaactttgaagcagcagcttttaatatgagaaggactaatgagcgaggtttgcacagttgggcttcaggaggtgtgtgaaccaactaaaataaaacacaaatgtgaagggtgggtgtggattcatttccatagctctctcttttcagagtcacaagtgaatctctaagataccctcaaagactcaggactattgctcctaagtgttacacaaatattagttagatatcttgtgagttaattaagttattcagaaagatggtgatttagaaaaatgctgactatgtaaacgagattttaaaatgatgactaagtttttttttctctttttcttcatttctccaccactttgccttttaggagtaattttctttcagtttttgaggtagaacccaaatgaatgcttggaattttttttcttttttcatttgttttgttccccatactactttgcagtgctttatcagcatgggtgacattaggaacattcagggggaaaaaaaaaacctgagtaaattaaaattgtcagttgctggatgagaataaactacaaaagacaataaataggcagtgaactagatatagtgtccttggacttacattttgcaacgtagtagatgatatattgtattccacatattttttttaaactctctgaaaaatagagaatctagaaaagaaataacttctaggaacttcttttatttatatagctaaattgtttcatttttctggctggcttttctccgaattcagttctggtgttactatcttgaatcaaagcaaaatatttactactactgagagaacatgatattattccccaaaagctaatattaatgaaaagaatatggaaaagattatgaaactataaaatattaagttataagtgatattttaattatatgaagtatgtaatatattcaatattataattcattgccatcttgaaatcatttataattattacattttaacactttgtttctcaaagaatgctcattatgagaaggatattttatgcataaaagtctgaaagcacatcatgtcaattataaatgcttgactcaagcaagagtcagtgctcttctgtcacatgaaatgtgcctttctcatcattgcaggccttttccacttccggccactgaatcacatggaaaataaacaacaaggtcaacaaaatacaaaaattaacattaaaacagaggccgggcacgatggctcatgcctgtaatcccagcactttgggaagtgcccgaggcgggcggatcacaaggtcaggagaccgagaccatcctggccaacacggtgaaaccacgtctatactaaaaatacaaaaattagctgggcgtggtggtgcatgtctgtaatcccagctactcgggagactgaggcaggcgaattgcttgaacccgggagtcggaggttgcagtgagccgagatcacaccactgcactccagcctggtgacagagtgagactctgtctcaaaacaaatcaaaacaaaacaaaaaaagattaaaacagaaatttcagtgatttattttttcatcaggcttagaagaatggagatagaaaaagcaagcagattcccaattatggaatgccttctatgtcctcttgagtctatatgtgtatattcccagttagggaatccacttacctttttctgtctgcattcttacattccttacatttattcattcacaatgtcacgtgtgtgtgtgtgtgtgtgttatttacttgtttcttctatctcaaattcttccagtatatactcattcttcttcctccaaccttgttttaaaaatatgcttcttttaaaattaagacatttataggaatcacattaactttcaattaattgctttgttcctaacactgaagtactaggggggttctgtttttggtaatgacagaggtatggttgtgctggaagttgatgcttttgtagttggaaatgtttaggagatagaacaaacttaagcagctatgtagataggtttaggacaataggattagggaaacagatccagatcccggttcctcagtaaacgagaacaggccagagtcaaacaagaatgaatgtaacattgacctggaactgaccttggactgaaaggtataggaggacttctgtttcatatactgagagcttcgtggctttaacgctacatttcagtcttatggaagaatacactgtgtcttgggaattccgtattcaaggctctaaataagaaactggcttccacatggacttttataaaatgccatgtattgtatgattccatttacttgaaatctccaaaaccagaaagtgcatagaaatagaaagtagtttagtggttaccctcaggtaaagaacaggagaaagggagtgactgttgagaatacaggtttctttcttaggtgacaacaatgttctggagttagatagtggtcatggttgtacaaccttgtgactctactataaaacatgaattgtacacttttaaatggtgaatttattaaattatatcttaataaaaatacatctagtcacaggttgggagctctatgcagtgatctctgtcagcagctcagctgaaattaaaaaagagctgaactttcaggtgtcagggagctgatgaaagccacaagtcgaaaatgaaagttaagcctttaatcacttactgctatgctgtaagcatgattcaaaccagagaaatctctgacagctcagatatgggggtggtctcagtgtcgagaaagcaccaaacaaaaaggctctagtagttttatgagccttagattagggatggggagcagaagaggctaggaatggaaaagtgaagtacaggctactgagtcagagtggtgaaaagtgtcttcgagatgtgccacacttcacagtgaggaggtctcagcagagacacatgggctaggtatgcaaatatgcaaagagaatagctagctagagaggactgaattctggcctgcagcttcctttcaacactgtgatttattacctgagcacaaagtctgggttggagagggtagctttctcctgcgaggcctgccgggtaaaaccttaggaattacccatggtcaggcctgaaaaatcatggataggttttcagtcaggagccagactcctcaatctccatatcaccagttgtttttgtggacatagccaggcatacgtttatcatcccttacattcactgattggattaccatgtaggtcatcatgtcattcttcaaaggaaaaggttctcttcgttatcttccaggtgggaaattaattcatacattgttgggcttgtctttaccatcaatgatttaagttgtcttaacacgcattatatgttctattatccaagtattaattttctatcatataattatcactgaatatttaatacatacccataccacgcagtagggtatcatgtaataaatgctctcccttttagagtaaggaatgaaaatcagtagtgtaggtaggaatattagaaagtaaattaaggctgggtgcagtggctcacacctgtaatcctagcactttgggaagctgaaatgagaggatcacttgagcccaggagttccaggtcaacctaggcaacatagtgagtccccatccttacaaaaaataaaaataaattagccaggcggttgagaggtcgcttgagcctgggaggtggaggctgcagggacctctgattacattactatgctgcagcctgggcaatggagtgagatcttgtctttttgaaaaaaaaagagaacaacatacttcacacacacacacacacacacacaaaatcagatataagaatttatgaatcctttaggttactaaaggcagaagttttaagctatttttgatgttttgcctactttctccactggaataacttaaaattaatgtagttcaaattaatgtgacatttattgggcaacaaatgagcctgccactgagatggctttgagtgataaaatggtacagaagtagacaagatgtagtctactctttcagagtttgtagactagcaggcatgtataaataagcaattatagtatagtgtaacaaatattctgatgagagaaatggcagtgtgtcaaagtgctgcactggaacagctcttaactcagtttggcaatggtgggtaagtttgactgctttttaagatcttatccccaaattatgtaaagaaaataaaaaaggaggcaataagaaggaaagggtatctagtgaagaggaaagaacatgggcacacacctacaggtaaaggtgtactctggggtctaaacagattttaatatggtttgagcataaagtattgggggtaaaggactgatgaaagcaggagctagaaaaaagagataagaatgcaataaaggcaggctttctaagctatattataggaaaaatttgtcactaaacagggcaatgacataatcaaatttacatttcataatgagcctttctaacaccagtgccaagagtggattgcagatgagcaagagtgtagacagaaaagttactctgaaagctctgttgtgaattcaggcaatattgtagagttctaacttagactagtagacttcacaagacagcactatatatgaatacaagtaaatctttagaatttaatatttacgaggacaggtgactgggtatggaaggtgtggaaagagatctaaattttgaatttggacaactagttggaaaatgataccatttgttccaaaatggaacaaagggaaaataataggtctcagatgatgaaaataaatttcgaatatgttgaatttgcaatgtttgtgagaaatccaaatggaaatatccaatcacatatctgggtgtgtggctcaggagaaagatctgagttgtggctataaatttgtaaatcatcagcctataaggcataagaaatgtatgtcaatagatgtggccatgctggacaagtatgtatcagagaggaatgcctagaacaatgcccatctgaacacaaaaactttagaaaagagaagggggtaagtcaggagaaggctataacatagagaatccataagaaaaggtctgagaggtaagagggaaaccagaaaagtagtgtcaggaaatcccaggaaagagatggttggttatgagaaagaattagttgatgatattataaaaagggtgaggtcaggtaggaaaaggatgggaaagaaactagttcacttagcattaaagaagtattggtagcctaggcaagagcactttcactaacatgcttggattaaatccaaacatgagttgaatgaggaattggggtggataaagtcaactctaagttaaatgtttggggatacatttattaattttatattaccaattctatcttgaggaatttctcctccttttatatatcagtgagttgtagagatctctttctagtatagtgaaaatttccatagaagttgaaggtagtacatccttagttcatttgcggtagaatatggacttgaagacagccttactcagactttgaattgacagttggtataaagaagtagtgccaacagcatatcttttctggcagtggcattggtgacagcgttatcagattaggtggtataccagagtcagaagtccaagctgtggcacgtgcttctcagtaccagtatcagaaacaagggcagaggaatcctcatctactagttacctggcatgcttttgaacatagttctgatttttataaattctcttgattcctgctgatttccccagcctggctttgcaggatccctggaaattgctcactacctaatatcttttaaatatgtctctttctgtttaattaaaattcaatttctattgcttctgctaaaaaattttgactgatacacaatacaacaaaatgcacagacgtgtacagtttgatcatctttgacaaattcatatacccatatacagtttgatcatctttaacaaattcatatacccatcaaacccctatcaagacatggaacattgctatcaactcacaaagtgtgcccaataagccactgcaccctgaagcaaccagcatctgatttttactaccatagattaattttgcaggttctaaaacttcatataaatagaagcacacaatatgtactgttttgtccctggcttctttaactcagcatgaagatttgaagatttgtccatgttgttgcttatatcaatgctctgtgtatttattttactgagttttatttcaatatatgaatatatcacagtttatttatatatgtgtattaataggcacctggttgtttatttccagcttggggctattaggaatgaaagtgctataaactttcttgtacaaggttttgtgatgatttatttttttcttatttttttgtttttacggatatgtcatttttattggataaatacctagaagtggaattgctaggcatcatgataggtgcatgtttaacgttttaagaaattaagaagcattgttttctaagttgtataattttttgctctcatcagcatgccttttcattttcatcttctcaacactgtaattttaggatcagattatatatttttaaatttaatttaattttaagttccagggtacatatgcaggacatgcaggtttgttacatggggaaacatgtcccatggtggtttgctgcacctatcaatccatcacataggtattaagccccatatgcattaactctttatcctgataatatgcttcccctaacacccccttgacaggccccagtgtgtgttattcatctccttgtgttcatgtgttctcactgttcagctcccacttataagtgagaagatgtggtgtttggtcttctgttcctgtgttagtttgctgagggataataccttcaagctccatccatgtccctgcaacagacatgatctagttcctttttatggcttcatagtattccatagtgtatatgtaccacattttctttatccagtctatcattgatgggcatttggttgattccctgtgtttgctattttgaatagtgctgcagtgaacacatgcgtgcaagtgtctttataatagaatgatttatattcctttgggtatatactctgtaatgggattgctgggtcaaatggtttttctggttctaggtctatgaggaatcaccactctgtcttccataatggttgaactaatttacattccctccaaaagtaaaagtgttcctatttctccacagcttcaccaggatctgatgtttttgactttttaattatcaccattctgactgacatgaaatggtatctaattgttgttttgttttacatttctctaatgatcaatgatgctgagttttttttcgtatgtttgctggatgcatgaatgtcttcttttgaaaagtgtctattcatgtcctttgtccactttttaatgtttttttccttgtaaatttgtttaagttccttgtagattctggatattagacatttatcaaatggttagatcacaaaaactttctcctattctgtaggttgtctgttcactctgatgatggtttcttttgctgtgcagaaactcttttttttaattagatcccatttgtcaatttttgcttttgttgcaattgcttctggtgttttcatcataaaatctttgcccatgcctatatcctgaaaggtattgcctagattttcttctagggtttttatagttttgggttttacatttaagtctttaatccatcttgaattaatttttatgtgtggtgtaaagaaggggtccagtttcaattttctgtatatggctagtcagtttttccaccatttattaaatagggaatcctttccccattgcttgttttcatcaggtttgttgaagatcagatgatcatagacgtgcagtcttatttctgagatctctattctgttcctttgaattatgtgtcagttttggtaccagtaccatgctgtttggttactgtagccttgtaatatagtttgaagtcaggtagcataatgcctccagctttgttctttttgcttaggattatcttggatatacaggctctttttttgtttcatatgagttttaaagtattttttttctaattctgtgaagaatgtcaatggtagtttaatgggaatagcattgaatctataaattactttgggcactttggccattttcaaaacattgattcttcctgtctgagcatggaatgtttttccatttgtgtcctcttatttccttgagcagtggtttgtagttctcattgaagaggtccttcactttccttgttatctgtattcctaggtattttattctctttgtagcaattgtgaatgggagttaattcatgatttggctctctgcttgtctattgttggtgtagaggaaagcttatgatttttgcacattgattttgtaccctgagaccaccctcaacatgccagatcttgactatctcagaagctaagcaggattgggcctggttagtacttggatggaagcagatattttttactttttttcttcagtgatttgaacattttgtatcctatgtagcaaataatcttctaacataaggtcaaaactatttttcctgtgtttttgcctagaagttttttaattttagcttttatgtttaggttcttcctcattgaattgctgtagtactcttgcgaaaagagtactactatatatatgtgggtttatttctattccattgactggttagtgcatccttttaccaatataacatctttctgattagtataactttataataagccttaatgtcaggtagattaattctcctaaatttgttttctttcttatcaagtttgtttgggctactttagaatcaacttgtctatttctataaaaaagcctatgcattttggttagaattgagttgaacctgtacatcaatttgaggaaaactgacatctaacaatattgtcttccaatctatgaacatgaggtatttgaggtattctcctattccttttagcataattttataatttcactgtaatggttttatatatctttcattaaattggtccctaataattttttgagatgcttttatatacaatatgttctattttacttattctttttttttcaattttttcattcatatggtttgtttttcactaaagcctttaacatattaatcacaattattttaaagtctttgataattttgatatatgcatcatatcttgatatcatttggtttatcccttttagagttctttttatcatttttttaatttagtgtcttataattttgtttttaatgatggacatcatgtcttagtttcaggcagtttctacggaattctgttttatagatgagattttctcagcatttgtgagttttttcccacaaggcattcacacactcccttgaatctgagcaaagtcatttaggagagattttctgtgctctttcaagggaaggtgactttaaaacaaattgatgcataagaaaacttcatatttatggcatatagagtgaaatttcattacatgtatacaatgtgtgattatcagttcatgtaactagtatatccatcacctttcctgcatcagatgacgtttgctcatggcataatggtagtgtatcctttcctgggaatggtgtttctttttgttttaatttggaaatttttctttctttcctttccttttttgatggagtctttctctgtcgcccaggatggagtgtgcagtggcatgatctcggcttactgcaacctctgcctcccaggttcaagcagttctctatctcagcctcctgagtagctgggattacaggcacctgccaccacgcctggctaatttttgtatttttagtagagatagagtttcaccatcttggccaggctggtcctgaactcctgaccttgtgatccacccgcctcagcctcccaaagtgctgggattacaggcatgagccaccaagcctggcctaatttggaaatttctattgacctctcttcaagatagactcttgtctatctggtcctcaaataatccaaccaaaagaatttcttatattcattatcatatattatatttctaacatttccttttagcttgtttttatagcattcattgctcttttagaatcctctgtctgttcactcctattttctattcctattttttaccgcaatgtgtggtaaatggtgtaatacatttatcatagctattttgatgttctggttagataattctaatatctgggatatcttttggtctctttatcttgactatttttcttttgcctattggttatgtgtcagtttcttagggctgctgtaacaaattaccatacactgggtggattaaagcaacagaaatttattttctttcagttctgtaggttagaagtttaaaatcaaggtgttgacagggacataatccttacgaaaactctatgagagttctttcttgtcttttctagcttcttccagtttgcttataatctttcatgtttttgtcttgtagatgcatcactccaatccttaatcttcacatggcatttttcgtgtgtctgtctgcatgtggtcatcttcttttaaggacatcagtcttattgatttaggggtctaccctatttcctgtgatctcatattaagcaattttatatgcaatggtgttatttccaaataagttcatattctgagttaatgggggttaggatttcaacatattctttacaggggagacaattcagttcctaaaagagttctggtttcttgtttcttctctggtaccatcacttttaaaaataaaataccagatatttgtgtaaagaaacacttaacactgaagtcaataatacctgtgccctagataggagatggctcaatttcttcgaggccagtagtgtggcaggctgactcaacctatattttatctggacctaattttgttgaagctttagttagattcacttctcaggcttcaaatggtctaaaagcagaatcacaaatttttccttagtacgtgcatgaagtatgcatgctggagggttttctcatatctcctactcagctcccattcttcagcaggcccagtgtacctgtgtctcaggttggatctgtctcggcactactgtattgtttctaaattttctcaagacttgtcaaaaagagtttgttagtgagctcagattctcagagtacaactattttcttctagccggcatttatgacgacttgctccttttcctgctgctctgccaaagacgaaagcatcctgagtctcttctagattgaatgccttacattttagattttgttttaaaaattttctttgcatcctcagttctttgctgggctttataaatcataattgtatataccattttgtatttctttgtaattgaagtgctcttgcaacttttctaaatcactttattgtagtataattaatatataaaaatacatgtttaatgtatacaactaagtttgaagatatgcatatagctgtgaaattattactacattctattttataaacacagctatcacctccaaaagtttcctctcactctcctaatttgttattacctattttgtgataacaacacttaacataagatctatctaccctcttaacaagtttccaagtacacagtacagtattgctatctataggcactgtgctgtatagtagatcttcaggacttattcatcttacataactgaaacactgtacactttgactgatgcctcactgttttcccatcccctcagtccctgctacttaccattctactctccgcttttatgagtttggctattttagattcttcatataagtgttataacatagtatttgttcttcttgcaactttctacatctttataagtagaagtcactgatatcctttttaaaggtcttttcataattatcctttaccttagatttattaagtggaagctgcattttttggttttatttgtgtataccattacaactaagaaacacaatgtacaaactctcagtcaaatttattgaactggagattgttagtaaacccctaataaattagctccaaatagctatgattgctttctttccaagggttgtgtatttgccacattggcataaatgtaaactagataaagaaagcattataaattattttgtgtgtagttacatataattcaaggtctcagtaggcaaagtaaccccttcccaacatcccaaaatatctacatcccaatcattgggatttatgttacctcatatggcaaaggaactttgtgacagtgattaagttagagccctgatttgtagagattatcctggattatgttggtggacccagtctaatcataggagcccttaaaagtggataaatttattctggcttctgttcatgggagatgtgattgcaggagggagagagacacaacattgctggctttgacaattgggagagggctataagctaaggaatgtgggtgatcactagaagttggaaacagcaaggaaatggattctccaccagagcactcagaaaaacatgaagctcttctgggtccttgatttaagttcagtgagacccatgtctgactgctaatctatagaagtggaagataacaaatctgtgttgtttgaaaccaagtttgcggtaatttgctacagcagcaatagaaaactagtaaaaggccagaacaacaacaaaaaattctgaatatcaatttgtaaaagttgtgagggtgaaattttaaaaagtttttttttcttattctcccatgtttagttcgctaggttagttttataagaaataaaatagaaagctggaaaagacattgacttttttacagacattacttttagagactaatatagagaaataaatttggtttcaaatttgaagatcacaagaaaaggagatctcataatatcttaccagcgttctatgccaccccccccccaccccaggacccgagcattattcttaatataacacatacatgttcttaataagattaacataattttagcaaaaaatttcataagaaggaaatgttgatgggtctataatagtggaaaaaaaggtaaacttagagttatgtaagattaaaaaaagaaacaaaagtaactgactttttgaaatactgtacattaaccgtagttattaaaatgtcataggtttctttgttacttcacaattgagaacattatactatttttccctttttcatgtatatcatttgaaaaatatttcctaaagaaactattgtttttcctacttaaattcaactattctgacaatatattaatactaaccccaaatcttctggtcattcttcagcaagtgtccagtttgtaggaatttttttttttttttttttttttttttgagacgtagtctcattctgtcgctcaggctggagtgcagtggtgcaatctcggcttactgcaacctccacctcccaggttcaagagattctcccacctcagcttcctgagtagctgggattacagtcatgtaccacaacgcccaactaatttttttttttgagatggagtctcgctctgtctcccaggctggagtgcagtggcgcgatctccccttactgcaagctccgcctcccgggttcacgccattctcctgcctcagcctccccagcagctggattacaggcgcccgcctccacgcctggctaattttttaagtatttttagtagagacggggtttcaccttgttcgccgggatggtctcgatctcctgaccttgtgatccgcccgcctcggcctcccaaagtgttgggattacaggcgtgagccgcccaactaatttttgtatttttaggagagatagggtttcaccgtgttggccaggctggtcttgaactcctgacctcaagtgatctgcctgcctcggcctctcaaagtgctgggattacagacttgagccactgggcctggcctgtaagaacaatttaattgcactccagttgtgcctaattcaattgcactccaagttttttttacaggcaatccaattatactctaaaatatcatcttcctgaagagcaaagaattaggatccttgaaaaacttgctcttttagttttgctcttgagattataataaatttcttaggaaaggtgctagataataaatttctggatatgtaaaaatactgtatgtataagctgtccaacccaggaaatctaaatatatagaatgaacgttatactgtttaatattaaagtgtttgattcttaaatatcctgatactagatgagaattagataagtacatgtactacaaatcacacgatgattgtcatttccacaaggttgcttaacatctttaattagtctatctgaattcttagtttaacatatatacttaactataaaagttaaaataagaaagtcatacctagacttttttgacactattttgagaattgacacctgaaaacctgctattgaggataaaagaaaggggaacacacttaaaaaatagacttaattactaaagtcaaataatctttgattctttataataggggcaaaaatttttatacctttcactttcccagggcagtatgtagtatgctttattacggaccatatcaaccctagtgctttcatctctattatatcttcatccatcttttcaaataactctatcctaggttttgtcataactctcagtacccaatccactggccataagtcaagagcttaccaactctcatactcttagtacacattttcttcttttccatggtatattatctttctctcccttctgttctgtccctacttggctaaatccatcagtcatcacttcaaccaacctctgccactatctctagttctttggccccactgatctatcttcattaatgtagctgtttaccaagcaaacttctcttatgcaactggaaagccttgagttaatattaatgaatttttttcagttccatgtctgcagtgattctcagcaagccttctttggccccttaattatttacgttttcttcatactagcaatttcaaagtatttctgctccccataaactaatgacatagccaccatatttcattttattctcatcccatcacttaattcttcaaaagtaaagttaaaattgccttgagtgaagttactcaacttcccaccactaaacctgcacaaatgccttcatctatttcaatcctttccagttttccctttaacttttcacactttaaagagatgtattctttcctacttaatgtttcttgagaatattgctactccataagttttctttgtttttagttatacctccaacttctttttttccagatgtcctttattgagttcttaaatacgtctgtttcttctacattagaattgataacagtagtagtataatcaaaccaaaccttcaactccacattccatttttagatctgtaatatttaatatggcttaagctgcaaattagagtaaccttaacctaaaatgaatttaaaaattttaaaaaaattgtgcttgcctaacaggatttccaggaagtcagtgttccaactctattccttttgtgatatgttcagttctgccctcttctatattttggttttgttattcatggtcaaagatggctgccattcacagctaaagcaacatctgctttgttaatatcaagaaagagggagaggtaaccgctccttcaactataaaaaaaattatcattccctgaatagggtcatctggtgccctaggatcagtagtagtcatgagatgttgagatgattgacatatctggagcctgtaccagtcattggcaagaggaatggaattgctgtgatcaacttagcctactcaggattcttacctggagctcttggtagggataacatctcctgaatcataacgatgatgtaagggaagtctgaatacttaaaaattgaaacgtgttattttatcccagtaaggaagaaagtggaatacttgataagccaccagtggtgtctattacatgaagaagcaaagggaatgaagtaaacttaagtgcataaaaatgacttctcagaaaagtacagatccagatcctatggatacccaaattaattcctaatttattgcttaaaatagctactaggcatgctgactcctgtttcaccctgtcagagggactttgaataaaatggtactagattattaattatggggactagtcatgtacttcatgctctctcaaagcaatgtctagatctgtccttgctttggctgctcttcagccagctctggggtctggcctcatcctgcactccaccctcccaaccttttagtgagaggtacttttaccatctgcaaaggtaaaagagatacctttactatcacatggcatcacatttgccacatgatgtctctatcaaattcaaattaacctacccttaagggtaactgttgcactatctttagtctttctgattccaggtctcttcccatttttctctgacttgtgtgaaatatatacactttccttatatttccaggcatcttctcctcttggggaattgtacctttttctcttattattcctattttctggacctaatgttttttcaactatgtggaatctggtgttagtttcaagtagaaccttcctatgtatgctagtttaccaaagcaggtccaaacatttttcttttctttcttttttttttttttttttggtggtgagcgggggtgaatctcaactatcttagggaattccttttgactttggatttaagaactgagggaaagcatttagctctttgtgtatttgcaaaggagaataatttatgtactattacctttgtttccttcttattttcccaactttgagaactctattttgtttcctgaaactgcctgtatgctttttttgccagagaagtcatcttataaatacttggctatctataatttggcaatgataaaactaaaacagaaaatagcacacacataataataaagggtggtttggtcacaatcaatttctaatagtatacattaccactagctgtatatcatattccacatgatactattggtagtccacagaagactagacatttgctttacctgaaggcccatgtcaagtcattgtcagaaaaagccctgaaaaataatataggcttttacaaaattgccttctgaagtggtggcaacagagttacattacagacattatatgttactcagcaaaactcctttaaggtcttccttggttgagcatgtcttcctcttggttcctccattcctcaagccttccatcttcatagttcctacctccccttttttaggcggatgcctctgccttctgagaagctatctgttagtgtttgtctaagtcttctccattatggagagggaaaaactatgaaaacttatatagaatatttttgtccacatcacccaatgagaaataatttgctttttatagaaggcattaatagatataagatatattaccttgataaaataaaaagaaaagcaaaaagttgatgccctctcctaatcccccccaggtttcttcctgccttcttaatgctttcatgtgtagctctgctatctagagtgctcattctcctaacccctcccctgcccatactttccccatggaaggaaagaataccttcctttattccttacaaatgactaaaaagtctttagtcctgctcacaacagtatttaaattcaaacggaaagcggtattttacattaaggagaaaaatctttaatttaggacttttgcatatccactctgtacctagggaaggactgtgcactgggtaaattttctagaacttctgaaatcacattacgtggacaactttgtatttgcagtttggtcatgaagaagactgctcttgaatgtgttcattgaagagctttttccttctgtgattgtcttttggagcatgaaagtcaaaataccaaagaatgataaaacttaatcaaaatttaaattactgtttaagatctccaaaatccttttggaaaataatttcatagtacattttataactagagcaaaaagagctaatagaggcacgttttctatagcaataactacctcctctgtgttttcacctcttcagaggctaataacactgtcaaattgatggaaaccttcctgcttactgaattatagcacctccatttacattagcataatatatgccaaaaatgaaatactatctcatttcaaagtctgtgggtttattttattacttgtagttgatatttcttgtactctaaactgtaatagtcttcagttttttttttttaaataataaaaaaaggaaggaaagaaagagggatggaaagatgaagggaaggaagaaactgttttttagtgttcttcctcccatggtagataattaataaaaacattgatactaaacaatgatgtaaaagattatatggaaacagggaaatctcaaaaagaaaccaaatatttatatagtgaggtatggtacctaatggaagagcatttaagaagaattatgtagttataatagtcgtatagatatgtagtaccaaatgtaacaacttaacatgattacttcagcaactttcaatgaagtatttgtttcaaatattctttgatccctttcaaaaagaaattacatagctgttattcaataaagataatcgaggtaggtggaactgaaggttgaaattacaggaatctatattggtcataacacagaatttttgaaagcttcacaacaacccaaacaagtggttatggtaggttttaccacattttacagatgagaaactgaaggccagggaattcactgataaaagtatgagagggaactggcagtgggacattgactcctactctaactttagtgaaattctcactatgccatacttttattttttgcagatagatgttctaaaagtaagaattaaatattctcatgtttgtaatttttctcaagcaaactttcattatctcatttaactctgggtgcttctgtaaaagagttctaagaactgtgggagctttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgctgtgtttggttttttgttcttgcgatagtttactgagaatgatggtttccaatttcatccatgtccctacaaaggacatgaactcatcattttttatggctgcatagtattccatggtgtatatgtgccacattttcttaatgtgcacatgtaccctaaaacttagagtataataaaaaaaaaaaaaaaaatcttaatgacttaggaagaatcagagtgaagattttgaagcctttttatatataccatgagttatacagtcaatacatttttgaaggcagagtatctatatctattattttttttaagaacacattgttttacacaattattttacttccagaaacctatgccacagaagacttaacaccctggacaaaaaaatatatacgtatgaggaattttgcataattgtccatagtgaaaatttggcaacaaccaaaatctcacccccaaataaatgattaaagaaaaatatatttatacagtttatgttgtacagttacacaatggaattagctagttctaatgaaaatgaaagattttcttcagaatacagttagtgaaaattgccagttggagaacatatacaacactacttttggggaaaaaaatatgtaggtgtatgtaaatagtgaaaatattttaggcatgggattttggtaatcttcataatctacatgttaggagtgaagttttggtaatcttatgtagtctacatttgtacatttttgtattatgaagagaaactacagagaagtttgcattgtcatctcattaatataatttttaaaatttaaaaaggcttctctgagattgcaagaggtgagtgactttgccacaggtttttagaaaagtagatgactacacgcttaacatgttgttgaggtcatctatgcatcagcaatgggaggttcaggtattatctggtgtccttctagttctaagactctgtgatgctgagagatgggagagatatgaaatctgctgtgctgaaatggaagggcttagcttactcgtggcactccaactgcaatttagaatttcttatctcactccttcttcctggaccgaatcattctcactgtcccatcatattttaaggaataccattaggaagtcactaaagatttcactttttaagatttcactttttctagcacaactagaaacaatgtgatggatttgagttcttaatttaaaaattgtatgcttcatatagttatctagtccaaaaatattttacattgtatgtttataactaaagtgtatcttgttctccctccaccttgtgtagtttatcagtaaaaccaataaagcctactgaattaacagacatataatatcacttacaataaaagtaaatgtactttttacttacagtaaaacaatacaattttacttacgataaaattgtatcacttacagtaaaagtaaatttgtaataggaaaactggaaaataaatgcacagcaattatttctaaaaaaaaaaaaaaaaaaaaaaaaaaagaactgtgagagctccgtgatagaactatatgctgtttgctctctaagagattccaatataatggaaagaaaagagaagcacatgtcctaaagttcttacacctccattgtactggaaacttgtgcaactcttgaacaagtttattattttttttttgtagctaatgtccctacttttatgctcccttgagattttttgtatggtgctatttatgatatccacatgtattaagattatttgtaattatgtttcaaaattattttcaatcatgtcttggacttgtggaatgtgaagattagttcctattcatcctagttctataaggctaagtgtagtgcttacaacacagtaaatgttcagtacatgcttgtgtttggtatatatttattattagaaaggtctatacctctcatataaaattcaagcaatatggacgtatataatgtaaacagttaaactttacatgtctttcacccactcctactgctctcaggtaaccatcgttagcattttgattcagaactacttagactttttttacatggacaaatacgatgtgatttttgaattcataagttaaattcataagacgcactgagaatcaaaaatattctataagctgaagacattatataaaattaaaatattattttatgattttaaactacttcaactgtgttctgtagaaagaaaacaattgaacaggatgatcttaaaactttgatagttgtatagattatcaatagtattttacatgttacaccaaaaatattcatttcatattaacattctaatttatcaggacaacacactaaattttagttttctcattatcagacatcactttattttcacatacattggaatattattggtcaaacttttactctagtaagagctgacatttctatttattaggttctaaactagtgatttataaggtatttctgctttgcagagtattcccattcagtaatggaaataatccttggtcctttgagttaacatttgaaagtacataattaataaatgaacattaagaactttatatctatatttactattcttcaaaagaagtttagccaggcgcagtggctcacacctgtaatcccagcactttgggaggccgaggcgggaggatcaagagactgagaacatcctggccaacatggtgaaaccccgtctctactaacaatacaaaaattagctgggcatggtggcacttgcctatagtcccagctacttgggaggctgaggtaggggaatcacttgaacccgggaggcggagtttgcagtgagccgagatcacaccattgcactccagcctcggcgacaagagcaaaactccgtctaaaaaaaaaaaaagaattttatatatagacagcaattcaaatgtattttttagttttctttatttctatttcattaatgtgcttgactattgatagtcttgattaaggatataatatttactctatttctctgacttaaagaggaaatatatgctcctcattctctatgctacttagtgattttaatttttctcaaggaaactttcatcgtcccatttaacatttgcgcttctgtcgtaaaagaatgctaagaactatgggagctccgtggtagaattatatgctgtttgctctcagagagcttgttagaattttggagtttaagtggtgactttgacctaaaggctgaacatcaaattacaaatgttattacactttagtgagtattagaagaaagaaaaaaatggtacattattgagaattaatgaattatgattgaactaaatggattttagctagccatacagaaactgtgaggttaaaaacatggatttttctgtttcataaaacaacttataattatttgctatcatttaaaattttggactataaataaataaactattaccatgtaatttaattaaacttggtatgacaaacactttgtggcctcagatagaagatgatgtagagctatgcaaactgtgtattcataaaacatatggcagaaaagctctatgaataatagttgactaagagcttaacatatgtctaataatgtgttcagcatagattaatgggaaataaatatattgaaacaatatatttgatatttaaaaactgatttgagctgtgttctaattacctcattgtgccttaatttaatagtgtataaaaactgggaataatacaataaatttattgaggaatttgcaattagtaatagttactagagttaaaacaattctaataatttcatgtggaaagtgataaaaatgatataagtggtatggaaacaaatgaaggttatttattagtaaaattgattaccaacatttttgtgtgaaaggtctaagaaaatttacataatcaatattaagtttaatgtctcatatccaagtcgagtactagtagttaaatagcgttaggaaaaatagctaatgtatgctgggcttaatactgaggtgatgggttgataggtgcagcaaatcaccatgacacacgtttacctatgtaacaaatctgcacatcctgcacacgtaccctggaacttaaaataataataaagaaaatttaaaaaatacaagacttcatacttttctgaggataaagaagtagaagttgatgagtgataatggtattgatgctttctatttgcttttgaaactataagatataaataaatagaccaagagctactaagctactatttactgaatttttaccttattctaagtaattttcatatattagcttctttcatgacttgggtttagatgtgtgtgagaaactgaatgaaatataatatagctacaataccaaattcaagagaaatttggtgaggtgagcttggagataggaaggctgtagattttggatagccatgtaagtcatgtgccctttattttatgggcagtgggaaagcattgtgggttataagtatcaaattacattataggataaaatataattaaatgatttttaaattatatgaacaattcagatttgttttattattaaattggaaaacatcttaaaatttttacagtaacctcatgataggtggaaaaggaatagaaatttatacattgtttttaggagtggcagttgatacaacaatttttggatggcaatattatactatgaaataaaattttaaaatcacatactcttttacataggaatacaacttctaggaattaaaaatctggatactatcacaaaaatttatcgtgaaaactatatatttgaagatgtccaaaaatcctagaagagcatgtcactacttgagaaagactaacatatatgtgcaaataataagaaagaatcataagagctggtgttgttgataggacaattggcactcttaggcactattggattgaatcatcattatattcacacagaataatttaacctttatgaaagatttaggtttgactcagcagtttcgatcactcattctaagaaatttattggattccaatccaaaaatttaagtacaaatgtgctattgtaatgttgtttatcatagcaactaaaaattaagagttaaataaattataatacattaagcagctgaattttatatagtcaatataagtatttatagaagtaaatggtcataataacctataaaaaggaaataagctacacaatcacatttatacaaatctcatatgagtaagtcatatatacatatgtatataaatataaacattatgaaaacttatgctaagctattggtaatggtaaccctgtgatgatggaattttaggggttgttattgtttttgtggtagtgtttatctctacttccttttctttctgtgcaagattctttgttatttatttaattagaaacactaagaaaattatttacataaattctatatctcatagccaatatccacagtgtttttccttttaggagactcataaattcttcccctagaggagcctgatatgctaaatttcacaggaaggccttagaatagactacatcactgggacctttggtataggctgacttaatccctctgttcaaaacttgcttcaaatattgcctagaatatactcaattattaataaatgctgaaaggaataagacaacatctaaacccatctctcagctcttatatttgtttttgtttgcttgttttatggatgtgacattgatgatatacttgtgtgacgtctttatgagtgattctcaaattattgtgcaatttccataggtagaatctttccatttatattaattctaagtagtataattccttctctctgtttttatagcatcatttgctttataaagatagatgaaaaacaggagtctgaacgtttttcctgttttctctgtcactgaaagaagaatgtcagtatacttaaagataagcaattgaatgcaaataatttggaagaaccattttaatcaccataattgtactgaagcacttaaaaatgcatgtatggaattgaaaaatagattaaaaatcctttcaataagtgtactcatttatttaattactttgaagttggaagtaaaaccatcctttctgtaggctatagtatttcactttgggttaacaacttagtaagatgaacaccatttttgacagttagtgtgggtcttgatgttttatcagcattttaataaatttgacttcagtcatttatgtgctttatcattgagattttccaatatcttattccaataagaatgactaatagttatgctcatttaaaaagtaatattgcaatgctgagaatgatcattgcctttatgttcagatttatctgagagtatgtgtggcatctttcctgaaaaatacacacaaggtgattattttgttggagacattgtttgaagaccaatttatgtgttatcttttatttgaaaagcagcttaaaaagacaaaccattccagcacaacattcaacatttgacagttcggctcagtgataaccttattcactcacacgatgtaatggttatttttgttgcaaaggaaccctccctggttttcttgtatctccattatactttgtccgtaagctctatgatgctagaatttccaaatagattgatttttcaactaaaattgaatgtatctacttattcactttcaaacccaaaatatactcacctatttttgcctcaaattctttttaaagcagggaagttaaaaataatttgtaaatccctaatttctccaattttcggtaacgatatcattatcatccaatgtattttgagtcaaaactgtggtattatttttattcttcacttttctagatctttcttaaccacttatattaattaaaatctgcccttcaaaaatgatctctcatcttttttgtcccctcagtattattcaacttgattattgctattttagttaccttctaattccacaacatcatccactcccttgttctttccccagtggagtacctttgttctatggccaaaattattctcataaattaatcatgaattttattattaagcatcactgatgattcatcactgcctataaaataagatgcaattttttggcattcaagactctccacgatagtttccaaaattatcttttcagctctataatttcacttctataaacttttaactcctcatctccaactctcaactctcaacacttatttaggttcaagtccagtggatcatttatcattctctgaacattttctttgtaaagaactgccgtcactagcttcaatgttctccataactcagaccgttataaccaaaagcatatttttggtgtaatattatatctttcatgaaggtttaatggattatttttcttttttttgttaatttctacctcttctgtacttatattttcattaatatatttaaaatattaatattagtcttctaacagttattataatatttgttttggtctgttttattttgtgggtgaaaaacaccaattatatacaatgtgagcataccagtattgtgtatatatgtacatatgcatcctcaagcatctatgtgtatggtctaagtgtgtgcatgtgtgtatatgcatagaggtagaataatgaaggtagcttaagatgtaagaggtaatctttgcctgtataatgattttgtcatgggccaattctgattatgtcacatcagttgaagatgcacatcaagatgtctgaaataactttcttctgcctgttctgacctttgttgtctcactttaactcatcatccagctgctgcctgagtattttgctttaatctattctctactcagctaaattagaaatactattttagatgaaaatagcacataagtatccactgagaaatccctggtggtttaattatcactgattttttttagaagcaatttgaaatggtctccaattgtggttaatttagcaatgagttttcagtggtgtggacatagtaataagtgttaaaatattaaacaagccttcattttgattgccaaatttcttttagagcaaaactaatatagaaatccttacagtcaaggcttctttacaaatccaaacctggaatgtgtgtgtgggtttgtttttaaccttgcagtgaaaaaataaattcctcattaaagaaaactaaagtttgaaaaaaaaaacataaatcctttgcatataccccttatttttgaatcatgaggcatttttggtaaaagtggaaagcaaataatgtcacttatctttagtataacttctttttttatacaaagaaaatagttttaaggaataaaatggtacatcagattcaactcctgactagataatcataatatttacggaagactatttgacaacagcttaaaggatacacaaaataagagcattaaaccatgtaaaagggattagactagtgttctctcagcagtggtcagagttgcataaatctgaaacttgaatgggagaagaaatgtgtgcattctaatcctaaacatgaaaaatattcattctgaaatctacgttaaatacttcaaataaaaaagtatttataatatccatatgggttttctaaaatatattcttccaaaatataagtcaagcatggttaagacaggcccttatcatttaatggaaaggattaggagtgagtataaaaatgttttaagtcacgttttgcaaagtttattctgtggaaagtaagtcctacaaggtacttaatggaaaaaggtgttcatgaataaatgttttaaatattttgtacatattatgtcatcctgtattgaagttaaagcattcattaacatattaaagactgagtattttgcaacacattggaagccaacttttctcaaaattatttcagaacaagatagcttcccaagccaaatgtgtctttcttttttcttaaaacaccaagccagtattcatcgagacaaattctcagaaatgttgtttaaaagtgttaccaattaaaaacaaaacaaaactttacaggtttgtttgttacagaaaacagaattgaagtaagaactactttgcaatggctcatagtattaagtacataaaataaaagtgccaaggaatcccatagcttttgctgacggaagcaaatcgcactcactgtactgactgtgcaatattccatttgacttcattgaagttctgttttctcataaaggagcaacagttgtgcctccctcagtgtgttgaaaggatcatatacagctatttgttttaacagccctaaagtgctacaaaattttcaacttacatttgcctcacactgcctaataagcttgatttttcatgtcagttcaatttccccagtctgaaatgactattgtaaacatgttctcctctcacttctcttaggacactctagcagcattgttcatcaaacagcattgcttcctaattttcagtgaaaatgagtatcttttttttttttttttttttttttggagaccgggtctcactctcttgcccaggctggagtgcagtggcttgatcctggctcactgcaacctccgcctcctgggttcaagcgattctcctgcctcagcctcccgagtagctggaattacaggcatgagccactgtgcccagccgaaaatgagaatcttctgggcagtcctcagtgtctagctgccacatctctaaaactggcctccatcttgccagtgcttctcatctgagtgaaatgttggtgttcttttcttcaatcccaggaggtctgaatcccacgtctccaacactctaagatctttaagtaatttttccttctttagtattttctttttttttgagatgaagtctcactcttgtccccaggctggagtgcaatggcgtgatctcacctcactgcaatctctgcctcctgggttcaagcgattctcctgcctcagcctcccaaatagctgggattacaggcgcctgccaccgcgcccagctaatttttgttatttttagtacagacggggtttcaccatgttggtcaggctggtcttgagctcctgacctcaggtgatccacccgcctcggcctctcaaagtgctgggattacagatgtgagccaccgcgcggccttatctagtattttcattgagtttttctcctttagattcttactgtcaatattttgttattcctatcaaactaagataaacagtaccccaaacatacaaagcaacaaaacatgcaaacctttatcctgtacccgtcagctaccatcatacctcttacctctcaatgtcaaaaaattttaaaagagttataggtacatgccactccttctgcttaccttccagttactctgaataaataaattgccagtctggtttctgcacatacaagttactctcaaatttagttttaaatagctagctaccagtttgtttctatgtgacaactttaatatcctttgaaaaatacttatgaaaaactgacttcaagtgtctagttttctgtaagttacaaagatatatagtctacctacatctattgtaagcactagtaataattcaaaatgaaattctctaaaagatgttaaatgaataaagtaagatttattcccaaaatcagaatctcagagacaaggtaatgttaatgttgcctctttgaaatgctagtttcttcgctctgtggtccagtttggatatcccagaagtcataaagtataacgtcttaatacctccaagtatccattatctacctatataatttattaatgggccgtgcataaatgagacacttctcagtggattatgaatatatattgcttctcagatgtcttaggttgatttcctttttaaataaccagtacatttgaatttaaccacgtcttttgttcacaaacatcatcaaattcttaaatcttacattcaaatccaaactttagaaacttttcaaccttttacaaagtataataaagactgctcactgcatcagtgaaatgtgttttaagtccaggatgtattaaattaaagttcaagctttgtccttaactgtttattttttagaactctcttaatatcggagagtagttctcctgttgtattctaaaaagactcgctgaatttgaaataaaaattattttaattacagcaacaaaaaagtcaatattttcagcagttttttctgtatgagtttattcaagaagtgagtttttattggacataacttatatgcacattgtacagttttaatatataaatgactgtttaaatcctaacagtggcctaatttcataagtagtattttgaaacaaagtatctaggctctctgtaaatagtaagggctattaagaatagattccttttctgcatgttccctttcctggtctttttgggtactttgctttgactttttcctttcccttatgttgattatatcatttgttttaaacttttcttcccgaaatacttatctccaaaggcagatattgagatggggacaaaaaatgttgttggactggtagctaaagaacaaactatagttcagagaatatacttgaaatctcacaagataggtacattttgtttagtaactttgttatttagtaacttttacagcattatcactttgatcttaacaataactcttcgaaaaatacactaaaactatgccctgcatccagcaaatgagaaaacaaatttggataagataaacatctaagatggcagttgataagagacatagaattagaacacagatctgtcttaaatttcatgctctgattttcctgaaattaataaatggcatgaatctaaagctttagattacctaaaatttatttaaatttggctttagaatgttaatttattctctactggaccactattaaaattaatatgcattctctgaacatgtagcaaatgatgatgaaagactctgaagataattgagccgatgagaataaaaacctgtgcaaacttttaaaaattattgataagccccatttcagtatatcattatagataattgaaagttcattctcaaagtgtaagaaagttctgttcaatgtggtagttgtgagataaactctgtaaatcttactagtaatgagatgttatgtttagcaatgattaagaattgttattggcaaattctggaaaagaaattattttcatgatatgtttgtatctgtagattaatatatataagctatttacacagtactcagtatgtgaaattgtaatgtaattgacaaatacacaaaaaggttactaataccactagtcatttctacacttttatgtcttcccatcagtggcaaactaaatccttatgctttcaacatttttctacttagcatcaatatatccttcacacacaaaacattctgccttcaaaaaatacgccaatcctttaattagaaattacagacaattttctgtttgttcattcttgttcatatttctgacacttggtgatacggtctggatctttgtcaccacctaaatctcatgatcagttgtaatcctcagtgttagaggtggggcctggtgggaggtgattagatcatgagggtggatctttcatgaatggtttagcaccatcccctcagtgctgttctcatgttggtgagttctcacgagatctggttgtttaaaagtgtgtagcatctttcccctctgtcttgctcctactctagccacataaaacgtacctgcttttccttcaccttccacagtgattttaagtttcctgaggactccgcagaagcagaagccactatgctttctgtacagcctgcagaaccatgagccagatagcctctattcattataaattacccagcctcaagtgtttctttatagcagtgaaagaatggactaatacactttgtattccagatcatgaattgtgttttgaaggaaaaaagtcacataattataagaattttggaggatacgatatatcttaataaaacatctaatctattcaactccccccaaaatggttaaaaatttttattacagatctttcgtgggattctcaaatatttttgcatttttatttatatattatagtaatttaatttccataaaatttgcccattttaattctacaatgtaaggatttttagtaagtttacagaattgtgcaactatcttctcaacctaattttactctattgccattacccccgaaaaaagtccatacctattctgactttcaaccccaggaaacatctaatctactttctatctctctatatttgtctcttctggacatttaatgtaaataatttgtgttttttaatgtctgaattatttcattgagcataacgtcttcaaagttcattcacgttgtaacatttatcagtacttcatttctttttatgactgaataatattccattctatggatatacagtcatgtgccacctaatactttggtaaaggacagactgtatgtaggatgatgatcccataatattataatagagctgaaaattttccattgcttagtgatgtcatagctgtccttaagttgtagcacaatgcattacttatgtgttagtggtgatgctggtgtcaacaaacctgctgcacttctaatcataaaaaagtatagcacataaaattatgtacaatacataatacttgataataaataaagttactggtttatatatttactgtattatttattattattttaagtgtacttctacttattaaaaaaaagttaactataaaatagtctcaggcaggtccttcaggaggaatttcagaagaagatatggttattatgggtgatgacagctgcatgcatgttatttctcctaaagaccttttagtgagagaagatgtggatgtggaagaaagtgatattgatgatcctgacacgctgtgtaggcctgagctaatgtgtacatcttaagtttttaacaaaaaaattaaaattaaaaaaaaaaacattaaaatagaatcaaccttatagaataagaatataaggaaaatattttgtacagctgtacaatgtatgttttaagctaactgttaatataagacatccgtaaagttaaaaaattaaacagtttataaagtaaaaatgttacagtaagctaaggttaatttatcattgaacaaaattttttaaaaagaaaatttagtttagcctaagtatatagtatttataaagtctacagtaatgtacagtagtgtcctaggccttcacattcactcaccactgactcactgtctcacccagggcaacttacaatcctgtagttttcattcatagtgccgagaaaatgtgtatcatttttatctttatgctggatttttagcattacttttctatgtttagatatgtttagacacacaaataccattgtgttacaatgcctatagtatacaagacaataacatattgtacatatttgtagcctagaagcaataggctagaccatataacctaggtgtgtagtaagctataccatctaggtttgtgtaagtacactctattgatatactcacagtgacaaaactgtccaaggacacgtttctcagatcatattcccatcattaaacaatgaatggctgtgtaccacattttgtttattcattcactaattgttgaggaattgggcttttcccagtttgggggcattgtgaataagctgctgtgagcatttatgtacaagtctttgtgtagacatctgctttcatttctcttgggtagataactaggagtagagctgctgtcttatagggttaactgtgtttagcatatgagaaactggcagacagttttcaaactgcctatagcattttgcattcctttcagcaatgtatgagtgttccaccttctctcattctcatcaacatttgctgtctttcttttgattatatttcaatagatgtgaacggggcatggcattgtggccattacttgcattcccctaatgactactcctgagtaccttctcatgtgcttattgcccagtcatatatcttctttggaaaaatgttcaattcccttaaccatttgttgaattatttactcttttgttattgacttgtaagcgttctttatatattttagatataaatcccttatcagacttatgacttgcaaatattttctcccattctatggcattttttgtttgtttgtttgttttgagatgaagtctcactgttgcccaggctggaatgcagtggcacaatcttggctcactacaacctctgcctcccaggttcaagtgattctcctgcctcagcctcgctagtagctgggattacaggtgcccatcaccacacctggctaatttttgtttttttttatagagatggggtttcaccatgatgggcaggctggtcttgaacttctgatctcaagtgatcctcccaccttggcctcccagaatgttggtattaacagatgtgagccactgcacccggcctctgtggaatgttttgaagcataaaacttttaaattctgatgaagcctagtgtattgtttatttatcacttgtacttttaatacaatctaatgagtcagggagtgacccaagattatgaaaatttactccaatgttttctgttttataaccttacctcttatgtttaggtccgtgatccatttttatttaattttcctgtatgctgtgaaataagggtagaaatttatatttttacaatggatgcccaattgtctcagcaccatttcttaaaaagactattcctttcctattaaaatttcctagcatatttgttaaaaaatcaatagatcataaatgtaagagtttattactgggttcttaattatattccatttatttacatgtctgtcatcatgccagtaccctattccttactgtaggtttgtaataagttttgaaatggggaaatgtaattcctccaaatttgttattttttaaggtttctttggcaatttggcatctttgtatttatgtagacattttaggatcagcttgtaagtttttgcaaaaccaaaaaagcagagattttgatagagattccattgaatctatagaccaatttgtagagtattgccatcttaacaatattaagtcttctgatacatgaacataggatgctattccatgtatttaggtcttgtttaatttctttcagcaatgttttatagtttcgagtataaatttttcacttattttattaaatttattcctaaatattttattcttctggaatctattgtggatggaattattttcctaatttcattttcagtctgttcattgctaatgtataaaaatgcaatttatttttacatgttgattttaatcctatgacattgctgaatcaaatattttatgagagtttagaaaagcccaccctaaatacataatgataacattacagaaaacttagggggaaatctgtgagccaaccatcttgttaaaataattctgacattctgatgtaatttttttattttaacaaatttttgcacaactttgtaggatacatgtataacacaatacaatgtgccttctgtttttacatttattattgtattttatgtgtttttctataacagttttatagaaaatataacataaatgattacttgtcagagaagtaaacttgttataggacttatcagaatccataattgaggatatcaagccaaattgttttgtataaaagtgtttcagaataaatatatgggttccggggtcagaaatatggaagtcaatatcaataggaaacatataactactataacaacaacaaaatcagcaatgctattgtgaatagtgctgcgataaacatgcatgtgcagtgtctacccaaatgcccatcagtgatagactggattgaaaaaaaaaaaaaaaagaaaaaactgttttcagctctcacactgtctgttttactgtcttttaaaagttctttagttcacctatggctttcttaaattatgatgttgacagaatactttgacctgtataaagtatgggagactattgacctccttgttctggagattcattattttatttgctgcaatcttagcttctatgcagcaatattacagtctcagtttatacttattttgtgatcacctaatatcctggtttttatactcattaaatgttgttaaatcatgcttctgccatatttcttgtgtactttccttcatcttgtctccctatatttccctccctttctccttccctccctccctccctccctctctccctctctccctctctccctctctccctctctccctttcttcttttctttcttttgtctcactcttttgtccaggctggagtgtgggggcacaatcatagctcactgtaatctcaaactcctgggtttgagcgatcctcccaccttagcctccttgagtatctaggactacacgtgcacaccaccatgctcgtttgttttgattttttaaaaatttttatatggacagggactcactaagttgccgaggctggcatttattcttcctatgttttattgtgttgactttatcccacagtagtgtattctttaaaaatatctcttgacttatataaactaaaattaaataataaaaatagtcttggaagcaaaccagcctacaggtatactacatccaaaaatttctaaatctcataccaaatttgtagtgatgctttgtataaacataacgtcccaattctgcttgaactgttactacacttccacataatacagtagagtacgctgtgccaatattatgctatgctttctaccaagtgtcatgtgttttgccgcagcagaaaagattttagtcaaatcaaaaagcaatgaaactcaagaactttaccattatatttctagctttattctctcattgatgctatatttttgaaactttgatatcccatcattatcaccaatagcataaaaacaataatgccaatactacaaataataaaaatgtattattgaaatgtatatggattaaaacaaatgtgcaacatttgtaagtgttcatatgtcttcagatcttttctggcagacctggaaaatagttattgtcaaatcaacaatgaaaacaataataaactattaaatagaggagtgaggaaggagctttgcgtgtgtgtgtgcgtgcgcgcgtgcccacatgtgtttttggtggaataaatactttctctatttcctaatttatgattctactaatcaggtgtcttcaaaacaataatgtattccttggcaatacaaatctgaaagctgtcagtaaattctgtcatttatttccattgttttcaccacgtactaaaagatagaaagaacaagactataggagattgacagattgtccaggcatatgccacattagttccacagtcaaatatatattttgcaaatcataaggcacacagtcttttcaggattacacaatgaggcacagatctttacacactgtccaaacaaatgtcttccaagccaagtagacctatgtgctaaggttgatttcaaaaagagtacggtaaagaaaataagccaagataggagatcacaggagaaaatggaggttgacagatgaagcacaatggtaggaacagagactctgagatggaactttgagaatgctgaattttcaatctcaaactcatttacttatggtcataagccactgaatttacgtgtcaatatgagaagggatgaaagtattccaagcttggaaaaataactaagtttctgacgattgttgtgggaaccaattgtataatgtgaataagaattagtttatttgataagtttgagtttgctctattcatttataaaatcaggatgaaacactttataaacgccaagtcacattataagttatatataagacataggcatttacttaatcatagtgtcatttgaggcaaattacctacaacattttcaggtcaccatcacacaaataatgtctgaaaagaacctgagaaaagcccacttttttgtttgaatttattttctgttacaaggaaaagcttgagattatacagttgtttttaagttacttgagatggttttgaagaaatggacttgatgagagatgataaggggaggaatgttttagttcttgccatgtccctctctgattatctcctctgtggtcagaagatagggactggggtgaagatggcaatctggccaaagaggaggtgttagagactcattgcccttctttaccattttgcctaaaaccagccctccatctgattaacagaatatctgagaaagcaaatgtttacttaaaacccaaatgattcatgtctctatctatctatctatctatctatctatctatctatctatctatctatctacacatacctggagttcagtgtcttatcatgatctgattgtataacccaataattttctgagatagccaactattttttccagagacaatgtgagaaagaatagtttcttttgagaaaagttaaaaaaagcacctaccctaattctgaagacaaagaccataataaatgcttttaatattgtaccaaatgaaccaacatctgattccctaagaggaataacattaagagtattcatgatttaaaaaaggaacaaaggtgttaagaagaataaaatatataaactgtgattactcagagtttaatttgtacatttttgtgtggtgaattattcaaactctaacttctgtctctctctttttttaatcttaatgtcttcctttcaccacttgttatcacttccagaaaaaaaaagtagactaaaattgcaaaatagaagaaaatatagaaattatcaggggctgaagttactatagaagaagataaaaattattctgggcagctaccataactgaataggtagtaattggtctcatctggattatacttcagggcagtgtacgtaggaatcttttggagttttttttttgtataacctatatctgtctatgaagtagatatatctttataatatctgtgtgagtagaaataagtgaataacagaaaatttgagtaagccaggtaattccaagaaatgtatgtatcctacaagtaggacaatggacagataacctttaatagtcaattatagacatgagatagaaagtcccctggaatatggcaagatgacagattggacataatttgtaaaaggcagagatgtcccattccttgagagtgcataactcaagattaccctactaaaatgtaatgagagaataatgaggcatcataaatagaggagtgagacaaaatatcttgtgacaaagatttgatgttctttatcctaagggggaaaatacagaggtgagaagggagtgagagacagattttaccttggaattgtatcataagctagacttcccattgtctttctgtctcttctgagagactataagtaagctcaaaaatcaaagcctccagatagatttttttaaaagaaaaaaacgtttgaaaaaagaaggaaaacaaaacaaagcaaaatatatgaatagttccagggctcccaatccagagccgcgaggtgttcactaggttcttacctccaatttttgtcttctagcaccaaaagactactgaaaattttactctgtttttcagtggctttctctttaactttttttaaaaatgtattatgtatgtatatatttagaggaaggatctcgctctgtcacccaggctggagcacggtggtgccatcctagctcactgcagcctcaaactcctgggctccagggatcctcccacctcagtatatacaaaaataaacaaacaaatcagccagacttcatggcacaggccttgagtctctaactttttagctttgatcctttgcatctcagaattagaaaattccttgaggggagatccactgctaaatactaaattcatatccctgggcttttcctctttccagcctctccaactcttaatttttagtttctttgtcagtattgaattacaatttatatgatataaatgtttattgatgacctattatagatcaagtagtgggccacgtactaggggaaaattgggcacaaaaaaacagatgaggtcttggccctcatacaatttaaaatctgctagaggactcagacatagtcaagtaattacacaaacaaaagaagccgaatgagtggaaggaagtacatggtgccacaaacccatgccttaggtgattttaacttggttggggaggtaggcagaagattctcttaggaaataattctttatctctgactaaggatgggcaaggggtaagtaaggaaggagggctactaaagaacattataagggccgggcactgtggctggcgcctgtaatcccagcactttgggaggccgaggcgggcagatcacaaggtcaagagatcgagaccgtcctggctaacacggtgaaaccctgtctctactaaaaatacaaaaaattagttgggcgtggtggcaggcgcctgtagtcccagctacccgggaggctgaggcaggagaatggcgtgaaccctggaggcggagcttgcagtgagccgagatcgcgccactgcagtccagcttgggcgacagagcgagactccgtctcaactaactaactaactaactaactaactaactaactaactaactaactaagattacgagacaggaagcacagaagcataagccctgtgcgggatggtgagaataagaaaccaagagaagacggatgtgcctgaaaggagagagctctgggaaatttgacacgtgatgaggccagataggatgctggaggccaattcacgtcgtgcctcttaagccaaactaagaagcgttatcttcatcctcagagcaacggaagccattcaaagactttaagaagggaagaacataatgagaatggcttattggaaattttagctggctgtaatgtagctaatgggctgtagctcattacatattataataccaatgttactgttgaggagtataaatgtcaaagagattgtcaaatgtatttatggccacagagctaataagtaatggagttggaactcaagctcagaattctacttcctgacctggggcttctccctttaatcagagttgtctgatatgaaagaagaagagcacacatagaaagggctcccaggtaaacaccagcagtttgatttgattgtcagatgacaccaagaaaggagaggccagtcttggggtctatattttcaaactgggagaaaaagagagaaagaccagattggtggagaaactgatgtggcatgtgaggaatagaatactaggtatgtctaccctaaaggaaagaatatgtgggcggtgaaaacatggcaactgtcttcaaatagtgaagaatatgaatttatttgacagggcttcagagaaccaaccaaggccaatagagataagatacagggaagtaccttttaggtttttagaagagttatctgaggaggggtgttgtcgaaactgtagcagagttttcctattattgaaattatataagcagagctggataaccacttataataatagtgtagaaaatattcatcttttgggcagagaaacaaaccttctgatgtctgagagcccttccaactcctccattctgtgattctctgacacataattacacataacctttcaaatttcttaaagagaagatcccaatataaaaatacagtaaaatgtctataatgcaaataaacttgctcagagttcaaactatttttaaattttaaaatattttcatatagcaatggttgttataatgcctaaggcatggtaaaaagccaagttgtaggcagtgtagcaaattataaataccaggttgtatagtaaaacgtcattccttttaaaagcttactttagatataatggttattaattcttgaaaattagatatgctggaaatcgctttatatgtagcatatatggataaaattattattaggttttatgtataacttgattgctgatataaaattgatggtttctttgtcagcatgcaacattattaatgtgctcagcacacacatatcaatgttccaataaatactagagagcatcatcccactaaaacaaaaacaaaaacacctgtaaatgtttaagtttttcaagtgaaagatgatacttgcaatgtgggagattattttagaattgcttagtgaggcctggtttacaggcttgataagaattatgaatataacttttaattctgccaccagatggcagaagtagccattacttaggtaaatgtttacagttaaagtgctttaatatgttttacattattagattaaaccaaaacaaacaatttggatatttgtaatagcgtgtaacatgttttgtaatggtaaagatggaaaatattagcttaaatgagattttggaattaaattaatcataatgtttatgtatcccctgagaatagtatttttctttaataaaaaaactctcacaaggaattcccactgatatgttttaatgaatgcagtaaatatcttaattaattatttatacattaataattcctatatcttcctaaaggtagtcattggactcaatattggggtaaatttaaaagcattatgcacatgctgagtacaaaccaaagactaaagatattatatagttattgagttaaggcatggatgattttttaaaaagattacaaatgttacaaacgaaatacaatcacatgtacctaatacaaagttatttgcctttaataagttaaaaaataaaattaatttgtctagtctctagacaattttaaaacatcaatccaaagggatacatgtgtttctttactaaacagtaaatgccatggctaattaatgcgtgttttcaaagatcacggatacattagctgttttccatatcaattcacatttttgttgtgttgttttgttcagtcctttaaaaaaatctacttccttacatcccactgactctttaaccttctacatctggcttatcctaactatgacaaagaaaatagttttatccagtaaatttgactcttctttaccaactaacacactattttggtcctaaactctcagtattatgtgacaaagattactgtgtttttcttcttaaaacaggatctttccttgactcatttgcttccatactccttcatgtttttctttgcactgctttttagtctatttggagggggagattcttgtcctcgactccacctgcagatgtcagaaatcataggaccacttgttttcttttttttttcccctcaacatttccctacatagtgccattcattctgtcacctcccaatgttatctctatgatgaagcttcccaagtgcctatcccagcccacttctctctactgacctctagacttgtacatccaattgcctccttgaacaaagtctcttttattctagtacattccctttcttcatgagactgacttgatgaatgggctaggcacaatgttttaccttccagcaaaagtgtcgaaaatgtgctaaagtaaaaaccacacaacctattttcttgtcaagtgggaaaaagtaattgtacaggagaatggccacactatcatcagtttcatccagaagcaagatatttataaagggctttgaaaacttctgcttagggcagtaataactatatagttaaggtgtgccttaatttacagagtagacatattaggactaaagataagcttgagctaaattgtgttaattcataatgcattaattcataaagttctttgcagtgaagattcttggtttacactggttgttttatactgaaagacctgtcaacttaaatatgactgtgatgtatattttctatttattgtttcacctagctagtgacctatgataggccttggtgccaaatattctgcccaaatgaaaacaagatgcaatacagactcactttaaattagaatcaagaaacacggaaagaatgagacactggacaatgagatctacccatgtaaagttatggattaaattactgaagaggccatgagtaaagccacgtatgaatgaggctgttctataaggaagaatagtgtttgttaaaatgagtacctgctatgtgctgagtattgttctgagcacttgtttgcaggtaaacaagaacatttaccaagtaaggtgcatgttaacaagtaaacacattcaaaattttgtggaagaacattttaggcagcataaacaacaaatgcaaagatcctaaggcagaaactaaaaaacgaaagaacagccactcgtttacaagcaaacgagaacatttactggaaaacacaccttaaagaggaaagaatggtatagctatagtttagtgagtgagaggttatcagagaccgggggtataggaggatgagctcaatttctaaatcaaaaccagtaaagatttttaagaagaagttcatgtgatgtgatatgtgactactttggctgttgtatggaccatgggttgcaagcctaaggctaggaggatatctcagtgggaaacaaaagaaagcaatatgtattttttgcctcaaatatggcaaataggaaagattatgagtaggccaagtagatgacaggatccatgtagtactgttttgcttttgtttatattttttagaactgaggtatctttcatgtatatgtaggctaaaataaaggagaattagataaggagagttaaagaagcagagatagaagagtaaagatacagaaaagtgtctaatgatctaagatccttgttgaggtgtctacaattaaatttaagaagtgctggctcttgtcaggccccatgttctattggagttgtctcaagttgggctagaaattggaaaaaaaatgcacatcatagattaatggtagagttttattgaaaaaaggagaatctggcatgactgggatcagcaagacaaagatgtaaaagggcctcttgactcattatcattctacagtgcagcatgccaggagcagggcatctgctggacatgcatgttttcattttggtgaaagaatacctcacctctgtgtgtctccccattaacagagcaagcatgagaagtggccttgacagtaagggaatacattggatttatgtcatcgggaaatctggattttgtgtgcttgccaattattaggaattctctggggaagctagatattctctatctaaggaaataggaatctgaaaggtctgagagattctctgattcaccctggctaagagaagaagtctttggttctgtggaaaggtggacttgggtatgtactgtaagttggaaaaaggaaaaactcacccaggtcctagcaagctcattgtccatgcaacccacaggaaacatctaaggtcatttttagatatttctgctaataacacagtagctctaaatgaaaaaagaggtactacatccaatactagagaaaataattatataacaattaaggtatttgtggtgagaaggtgacaggagaggaggaatgtaaataactgatgttctcaattttcccaatgaaaacaagcagcaaggttacttgctgagaatgggagaggttgtgtgggaatattgtggaagtttaaaattacaattaaaaagagaagctaagaaaaagtgaaaagattgatgaacaattccaagggcccacatgatgcacttttatttagggggagacatggtttatcaatgttaatggtattgacatgcatgtgtttatatgtagatgtgcatgttttcctttaacaacattaactctgtttctagaaatcaggtgggaggctatataattgatttatatttggaatttttctagttgtatgtggtagaaggatgggattcatggtattcataattgaggaagctggtgagaggttagtttagatgataaaccatacaccatggcacccacgcatcgtacgaaaaggatagaagccctaagggggctgacaggtcaagaggaaagtattcatcaaaaagataatattctctctgtttaagaagttccatggatcagaagagtaagagagaaggatagttagaggcttttgtcagactatggaatgctggtatttacattgttttaaatagagccatttaaggtgataaatagaatataacattattattttgttgccaaagtagactgagaatagcatggacattaagaaggtccaggattttctggtttaagagtattggataattcatttacatgaatcctgaagccttctaaaattatagtgggagttctgatggaaagaaagagtatgaggtctcccaaattttggcaagtttaagtaatttattgaaaattcaaatgattgtagtggcaaggaagtagactcatatgacattatggcatgactcttcagagaagataagacattataagagatgacagttatccaagagaatgcagtcacccctcttccaccatatccaagtggtacaaatgtgaggacaggtgtcacctccttaaagaaagaaaaatctgctcagctaatacataagataatttgaagatatagaggacaattcagaagagtttgagggaaggaagtcaatacagcaggaggaacaagcagcaaagtgtatcaaaagaatgagagctctggggaaagactggtctttagtttcgtggtgcggaagtactagggtggggagcagaactaactacctagctcaaatattttgatattggtctaagttatttggttgcagaactggctgagggtctcaggtaatatctggctgtgttaaaatgtgtaatagataatatttcaaagttgtggcaattgtctgttttgcagaaagaccattccgatttggaacagtgaataggctcctggtgaagccaggactactgtgaggattgtggtgtagctgtttgatccttcttctgggttgtgtggaatgtggaaaacaagggtgtagtagtgatgaagggagggtctcctggaaaatttgttttcatattgacttttattaaattttaaaaggaagcaatagttaatatatacacttttacaaataattaaaatatacattaatattcagtttttacacttctgcttatttttaaacaaagatttctctctttgtttaacagtaagaacattaaggttggtgtctaatgtagctcttggaaatacaaaatctctttcatttattaatgactataattaaggtacacatttgctaagaccaataattaggttccataatgaacatactacagtaatcgttagctgtgacataaaacatgacaagatgagggtttgcttccctttctctttccctccagtttatattctctctaataaaactcttaaatcttctgtgtctgtgtatgtgtgtgttttgcacctaatatggaagactggtgtgctggcaggatggtgaggagagccaatggtctcatttaatgaaattggaagcttctctcttcttttgtttttcttctctattcctcaccatgtttcttctatacccctgtacatttcactgccaaccgacaaggcaatgagatgaaaaatacaacagagactagccagaaagagaataaggagcattgtcccaaccgtctgctgagaaagaaatgcattcttcccagctacggcattcagtcaggttagtggttgagaactgaaattatttttgctggtataatttatatattttctttatgatcctaacataaaatcagcactatggataagattgctgagacagatagctttaatatggtaagaaaaggaaaggcaagcagtgaggggtcaatcctggaaactgcaccaaggtggctggatgacacgggtacactcagctgcaggcgacctgagggagttcaggcaagcagagaacacagaaagagataatacataatcacagtttcaggggtaggaaatcttcaacaagagctaaaatgggcctagcaacaggagttagaagcatggtaaagaggaggtggagaacagagatggtgagattcaggctgccaggaagacagttttcagttgttacaggaacctgataagtgaactctggtcttacagaaaactgttaggacaaagtagaatcacagaatgagaggaacttaggtgcttgaaatcatgtcaaggcaaagtaccagagaaaaagagaaggaccaggatactggaataagtatggaataacttaagaagaactgggactcaggagtagagcaaagttttaagggcctatattatactgaattgcttttgcaaatgaaaccagagtgtggcagaggaagctatttgtctctgacctgatgcaggtctaagttagtagttggaggctaagagactcagctttaggttaatcggcaaagataaggacaggaaatctaataggttattacaaccaaaatatctttttaaaaagtgattagaattgagtttgaaataaaggtgattggatgattacctggtagcagatgtatgtttatttgtgggaggagggtgcagggcagtgcattagttcatgagagaagagactgcaacttacagtgttttggttccagaacatgctaggattttttttctctcctggtatctggaacatttggtatccaaataattttaattctgtttaacttaatagctaactttgggtttattcattcatacaacaaatatttagcattttttgttttattacatgtaactaggcaagtcctatcatctctaggaaactgggacgagtacttaaaactaaacatgttttgtttctttgctttgatgcattgtttcatatgttatcttttttttttgagtttcagataacctgaaagaaggttatgaggtttgtatgtgaaaaaataaagaataggatttttaaaagattaagaaacagccttcaattcatagtctaaatttgggtaagaaaagaaatgaaagttataaaattgacttcattccatgacttaaaatttcctttgagaagttctgcttcacttaaaaaatgagaagccttataagaatgtcactctaacccctaatgaagagagcaaagaagaacagtgacacgataactttttctgaacccctcagagaactgaagtcacaaaaaaatagatgaactgaattccaaaggggccataaacaccttcaaagagaggcagggcacacctttagcagagcaatggagaaagagatggaaaccattaaaatgggtaagaagcaaagaataaacattttaatgaaatctcaaaggtcaaatgtaggctagtgtagcagaatagaatccctaggagtactggacataaggcacaaaagcacctccaccctccacaccagataatttccacagatttccaccatgtgctcaaaagaaaagatggagggcaggcgggagaccacagaggacaggcaagatactccacatgcttgtcacacccacctctcattgaagcaaaagctatcttctgctagaggaggacaggaagcactcctgtgccctggtccaggggaaaggtctgctgctattgggggacaggtagaagcaaaaattgtctgccaatgaaagaggagcaagaaacatgcccagttcagattcctgtgctgatacagaagcagaggcggtctgctgctactggagaaggaacttaaagggaaaaattcctttgagttcaaattctccagttttggaaattttatgcaaatggactcccatgagataaaacaaacaaaaaacacaaactctctccccaccatggcaagaagcacccacaacacacacacatcaaaaaatacaaaacagagtttagctgacatgaagaggcaggaaagaaattctgagaagcccatactctgaggttcagatgcacaggcctgtctaggatcggggctttgaaaagcagcagtcacaagcctgagacacagagggagaaagtgggtaggaggagacggaggtagggagagagagagatcggtagggtgagagagagactgaaagagagatgaattgattgattttaagaaatttactgacatttttatgggaacagtcctaaatttgcagatcaggctgacggggtagaaattcagggaaaagttcatgttacagtcttcagtacaaaatctgcaggctggaaacacaggcatggtttctaattctgcagtgttgaggaagaattgctgctgctttgggaaacctcagtctttactcttaagacattcagctggttggctgaggcccacctaattatggagggtgatctgctttactcaatgtctaccaatttaaatgttaattacatctaaaaatatacctttataacaacatctagatctgtatttcaccaaacaattgggcactatagtctagacaagttaacatgtaaaattaaccatcacaatggtcagtatcagaaaggatacttcagaaaaattattaagaataatagcccaagtgaagtggctcatgcctataatcccagtactttgggaagccaaggcgggcggatcatgaggtcaggagtttgagaacagcctggccaacatagtaaaaccctgcctctactaaaaatacaaaaattacctgggcatagtggcacacgcctgtaatcccagctactcaggaggctgaggcaggagaattgcttgaacctgggaggcggaggttgcagtgagccgagatcgcaccactgcactccagcctggtgacacaatgaggctctgtctcaaaacaataataataataataataaagagggacattacatgaagataagggggttaacttttcaagagaacataacagccttaaatatatatatatatatatccatagcttctaaatacatgaagcaaaaaccaatagaactgaaaggagaaatccataaatatacaattatagtaggagactttaacaattctcacccaataatcagcagaatatataaacagacgattcaaaaaatataaaaaacctgaatagaactatcaaccaacttaacctaattagcatttatagtacactccaacctacaataacagaataaataatcaagatattctgggcaatcaagtttcaataaatttaaaaagattgaaacaactgaaacatgcatgaatatgtttgcatcctgagagcattttattaagttaaagaagacagcaacaaatggctacatactatatgatttcattaatatgacattctagaaaaggaaaatctactgggacagaaaggttgccaggagccagatttgcagggaaggtaattgactgaaaagaacacaagggaatttggggaatgatggaaatgtcctatactatgattctagggtagttacaggactgtgtgaatttgtccaaacttactaagctatacatttataaagtatgaattttgttcaggtaaattacatctcaataaatgtgatttcttaagataaattcctttgagttcaaattctccaattgtggaaattttatacaattagactcccatgagattttttaataaaacaaaaccacaatagtgggttatcaaatacccaggtggtactcagggccaaagggtatccctttgggcccctttgtatgaaagccttgtccttcctttaactaccataatggcacatgttcactaactagatcaatttttatctcaaagtaaccacaaatgaaatgttttttaaaatattagatatgttcattaatttttacttattatacgtataacaattatttataatttggttctcattacctagagcacatttgtaacttttttcaatagtagaaataaatttacatgatattgactcataattgagggctataccttattttcatcaaaaatatacttagttggactgtaggctaattggaacaaagaattaggcagctcacatactcattaaatattctattgaagattaatatgcagaaatacacacaaaatattcaagctagatagattttcatgaagtaaacctagatcaagaaacaaaacattgtcatctcctggaatccttattttgcctccttgcagtagctaccaactccccatatcaaaggttcctgctgtttttgaaactttcataaatggaatcatacagtatatacttttttgtatgtgatttttaaaatagtattttgtgtgagttacatccatatcattacatgccgttgtagtttggtcactgtcttggctgtataagaatgcttttatatgaatgactacaatcattttcccattctgttgatgaccctattgattttgttttcagtttgcactagttcacagcttatagctatgaacattcttgaatatttcttttggttaaaatgcataggcatttctgatgggcgtgcttctaagaatgtaatagctagatcgtaggacatgcacatatatttagctttactctgtaatttttttcaaataaaatttatttttctaaatatgtcatttgtaataaagtgctaaattttcggcattaaaagatgataaattattacaaacaataccactatctatctgcttgacatcttatgagatacttatgccaatatccagaacatattttatatcttggtgtgataaaaagatagcctttacacatgtctcttatgcacatgattcctaaggcatattgttttctaggcctccagtgacacataactttgacagtgcatgataacaatgctatgttcatggattaaaaatatgcataatttcatattttattccccttaggaaatgttatcactgaacttacagtgaatgtagttgtcagtattccacctgtgaagcccaatattactgtaataaatgctctagaaatatgataattgacttctctgagtgccaagaagaatcagtagtcaaactagggcctgcaagaatgagcttcccctacagcaatgtaataaaattttccagggtcttagatggagtattttcttatagagcctgatattttaaaaggcaaacttataaaacagataaaaggaattatttttgtttatttaataggtaaaattacacagtacactataataatagttatataatgttccaaaaataatttgtcagtacatataatagtttttatttatttcttgatatttaacttactactttgtacaaagcatgcatatatatatatatatgcttatatatatatacttatatatatgatatatatatatatatatcacagtcagaatggctactattaaaaagttaaaaaacagcagatgctggtgagactaacagagaaaagatgctggtgagactaacagagaaacactatatacactgttagtgggaaagtaaattagtttagccaccgtggacagaagtttggagatttctcaaataatttcaaactaccatttgatgcagtaatctcactactgggtatatgcccaaaggaaaataaactgttctacccaaaagatatatatatacttttatgtttattgcagcactatttacaataggaaagacatagaatcaacctaggtgcccatcaacagtggattgaataaagaaaatatggtacatatataccatagaatactatacagccatgaaaaagaatgaaatcgtgtcctttgcaactggaggccattattccaagtgaattaacacaggaacagaaaaccaaataccacatgttctcacttataagtggtagctgaacactgggtactcaggggcataaagatggcaacaatagactgggaactactagagatgggaaagagggaggtgggtaagtgttgaaaaactactgggtactatataggctgactacctgggtggtgtgatcagttgtaccctgatcctcagcatcacacaatatacccatgtaataaacttgtacatgttctccctgaccctaaaataaaagttgaaattattaaaaagtaaaggaactggaaggcgttaaatgctgcctaactttgtaagcttctcttgtttcttccccatccccaagcataaagaaggactctctctgcaatttccttatctaagtaaacttctttccatgagaaatgcagtcctttaaagatcccctccataggaatctcatcaaattagcaggaaagtttaatcactggaaaagagaaaactaaaagctgttaccttgcgcagtagatctttcatcagttctttactcctggatattacctggtagagtttatctcataatatgacaaccattgttcacagtaaagttccacccctcaccttcctgccacctccctgggacctcagaggaactttatctcaggtcattgttttcttggctcattcatttctcctaaaaatcatttacttcccctgtaatgtttcctgaagtctctcactttcctgtcccctatgaagagtgtatatgagcctcaaacatctggctctgccttgggtctcatatttgcaggactgccaagtccatgtatatatgaataaactttgtatgccctttttttactactcatctattgttggttcattccagtgaaccctcagagatggtgaaaaggaagcattccctttcctacaaaggcatgcataaataaacatacattatatggtttggttctgtgttcccactcaaatctcatctacaattgtaatccccatgctttaagggaggaacctagtgggaggtgattgtaccatgggggtggttttcctgctgccattctcgtgatagtgagttctcatgagatctgatggtttaaaagtggcagtttcccctgtgctctctctctcctgccaccatgtgaagaaggtgcctgcttcccctttgccttctgccatgattgtaagttttctgaagcctcccccgccatgtgaaattgtgagtcaattaaacctcttctgtttataaattacccagtctcagatagtaacttcatagcagtgtgaaacctgactaagtattaaaagtgtacattcattcatctgtatgtttactcttttaagaaatactagttatgacttttatttcagtgaagtttctcttgaaggagtggaacatttctttataaaatagagctccaaaatgtgtagagatattgaataacattgttattttattcccatgattccttatttaagcaggccctacaaagtatagtatctgaacgcccaattccaatcagagagttttgcatttcttactattttcttcaaatgatattcaagctattttatttcctggaaaatgccaacatgaaaaacgtttggaagtttgaaagacttctctgataaaattctaagctcaaaagtggcactaattactagccaacattttatgtgtccatttgttaacttgtttatttgattattatctgtcttccttttcagaaggtagatgggaactattttatgttcactcttatattctcagttaatatcacaggtgttcaattaatatttgttgtgagagtaaaggaataaatgcacattctttgaaaactttttttttttcccagaagcgtctacttctgtcacccaggctaaagtgcaatggcacaattatagctcactgcagctttgttctcctgggctcaaggaatcttcttgtctcagcctcccaagtagctgggacataggcgtgcaccaccacactcagctaaatttgtttggtcttgttgttttttgtttgattgtttgtttggttggttggttggttttttttttgagacagagtcttgccctgtcactcaggctggagtgcaatggcacaatctcggctcactgcaacctctgcctcccgggttcaaacaattctcctgtttcagtcttccatgtagctgggattacaggtgcctgccaccacacccggctaatttttctaatttttcgtgtttttttttttttttttagtagagacgggttttgccatgttggccaggatggtctcaaactcctgacctcaggtgatccacctgcctcggcctcccaaagtgctgggattacaggcgtgagccaccgttgtttttgcttttatttatttttgagataggatctcactgttttgcccaggctgaagtgcagtagcttgattacagctcattgcagcttcaacttcctgggatccagggacctcctacttccagcctcccaagcagctgagattcctggcgcatggcaccacacccagctaatttttgtattttttgcagagattgggttttgccacgttgcccataaatagatatcaatgcctgtaaatagatgtaaatttatgtttgtatttctttattgatttttggtaaccttttttttgtgtgtgggaaactctttttattttgtcgtagcttacagattcttcagtaaacttgtattctttggtgatgggctccaagtattcaaattaggactggggtgatttttggcagactgcacaggaatagatgcttaaaaagtgctttttcagtttttataagcacaaaaaaggtagaaccttgatttgctgagaatgaagtgtgaaaaactttctaagaacatcatattatttaaattattttatgtctgcatttgtttttgtctacttaatctgttagtgactgcaataaagacttctaaataaattttaaatttgctatatatattttattctatcccatcagagatatatagatttatgatttaatatcataattatgattgtatctttcattaatagtaaatgacatttgtgaccatttttatctttttaatgtaattactaattgtataaaattagtactatcaacctaactttattttgtttacttatatgtataatgcttttatttatttttgcatgtaaataattattaaatgtgtactaagtttgcccattgggcaaggatctgggcataaaatgctccaaaaatataaacaactataagaaattcctttctgaaattctcataaatatttacttatctttttttcctccttaaaattcctgtattgcagttttttaataattaaaatacagacaaattttgttctgccggctattttcttttcctcagtctgtgaattcttgtcttttataggttgattaaatcttgtaggttcattcttctgtcatattgttttctatttttatgaatttgtgaaaagtattaaatttattttctaacttgtccttataaagtgttttcttgccttttattcttctccagtaaattgacaagcttatagcctctaattcttctggcagtttacgttgacaaaatattctttaacctatgttatttcatcaaaagttgaaagcaaaatgatgcaattttaaaattttattttttcataataaacagggattaggttgttattaagttcttttttaaatttttaattgtgtgtatagtaggtatacatatttatagggtacatgggatattttgatacataaatgcataagtaataatcacatcaaagtaaatggggtatccattctttcaagccttcatcttttgtgttacaatcaatttatgtatactattttagttactttaaaaagtacaattaaattctaattgactgtagtcaccatgttgtgttatcaaatatgaaatcctattctttataactaatttttgtaaccattaaacattaacctcttcccccacaaccacactacccttcctagcatctggtaaccatttttctactatctgtctacaagagttcaattattttaacttttagctctcacaaataagtgagaatgtaagaagtttgtctatacctgtcttatttcacttaacataatgacatctgggtccatccatgttgttgcaagtgatgggatctcatttttttgtagctaaatagtactccattttttatatgtaccacattatctttatctattggtctattggtggacacttaggttgcttccaaatcttggctattgtgaacagtgctgcacaaacatgggagtgcagatattttttccatatactgctttcctttgttttgggtatatccctagtagtgggattgctggatcatatggtagttctatctttagcttttaaggaacctccaaactgttctccatagtggttgtactactttacattcccaccaacagtgtatgaggggtcccccttcttcatatccttgccaccatttgttattgtctgtctttttgatataagccattttaactggggtgaaattatatctcattgtagttttgatgtgcatttcatcgatctttttatatgccagtttgccatttgtatatcttcttttgagaaatgtctattcaaatattttgcccatttttttgagtggattattagatttttcctatagagttgtttgagctccttctgtattctggttatttatcctttatcagatacagagtttgcaaatattttctcctattctgttagttgactcttcactgtgttgattgtttcctttactgtgttgaaacctttaatttgatgtgatctgatttgtttacttttgctttgattgcctgtgcttgtggaatattactttagacatctcttttttcctttatttcttctaaaaaaatgagatacatgtacagaacgtgcaggtttgttacgtaagtacacgtgtgccatggtggtttgctgaacctattgacccgtcctctaagttccctctcctcaacccccagcccccaacaggccctggtgtgtattgttccctctctatgcccatgtgttctcaaggttcaactcccacttatgagtgagaatatgcagtgtttcgttttctgttcctgtgttagtttgctgaggatgatggcttccagcttcatccatgtccctgcaaaggacatgatctggttcctttttatggctgcatagtattccatggtgtataagtatcacatttctttatccagtctatcattgatgggaatttgggttgattccatgtctttgctattgtaagtagtgctgcaataaacgtaagtgtgcatgtgtcttatagtagaatgatttatattcctttgagtatatactcagcaatgggttgctgggtcaaatggtatttctggttctagatccttgaggaattgccatactgtcttccacaatggttgaactaatttacattcccaccaaaagtgtaaaagtgttcctatttctccacagccttgccaacatctattgtttccagacttgttaataattgccattctgactggcatgagatggtatctcagggtggttttgatttgcatttctctgatgatcagtgatgttgagttttttgttttgtttttatttgctttgttttgttttgttttttgagacagagttttgctcttgttgcccaggctggagtgcagtggcgtgatctcggctcaccacaatctctgcctcccaagttcaagcgattctcctgcctcagcctcctgagtagctgggattccaggcatgtgccaccatgcccgactaattttgtatttttagtagagatagggtttctccatgtttgtcaggctggtctcagactccagacctcaggtgatctgcccacctgggcctcccaaagtgctcagattacaggtgtgagtcaccacaccacacccggcctgttgagctttttttcatatatttcttggctgtgtaaatgtcttctttcgagaaatgtctgtttatatcatttgcctactttttgatggagttgtttggttttattttgtgtaaacatgtttaagttccttgtaaattacggatgttaggcctttgtcagataggtagattgcaaaaattttctcccattttgtaggctgcttgttcactctaatgatagtttcttttgctgtgcagaagctcttttgtttaattagatccaatttgtcaattttggcttttgttgcaattgcttttggcattttttcatgaagtctttgcccatgcctatgtcctgaatggtattgcctaggttttctactagggtttttatagttttgggttttacatataagtctttaatccatcttgagttaatttttgtatgaagtgtaaggaaggggtccagtttcagttttctgcatctggctagccagttttcccagcaccatttactgaataggagatcctttccccattgtttgtttttgtcaggtttgttgaagatcagatcattatagatgtgtggtgttatttctgaggtctctgttcagctatactacaaggctatggtactggtaccaaaatggacgtaccttagacatctttgcccaatgcaatgacctggagagcttccccaatgttttcttttagcagtttcatagtttgaggtcttaggtttaagtctttaacccatttatattgatttttatttatggcaagagatagtggcctagtttcattgttctgcatatggatattcagttttcccagcactatttatggaagagattttcctttcgcctttgtgtgttcttagcacttgttttcaaaaatgagttcactgtagatatatgtatttgtttctgcattctctattctgttccattggcctatatatctttttatgccagtaccatgctgttttggttactttaggtctgtagtatagtttgaagtcaggtaatgtgattcctctaattttgttcttttagctcagggtagtcttggctattctgggtcttttgtggctgcacataaattttagaattgctttttctttctgggaaagtcattggtattttgatagggattgtataaaatccatagatttctttgggtaatatggacactttaacaatattcttccaatctatgaatatggaatattctttcattttttgtctcctcttcagtttcttgaatcagtgttctagttttcattgtatatgtttcacttctctggttaattcttagatatttaattttatttataactattgtaaatgagattactttcttgatttttttttcaaattctatactgttggcatgtagaaatgtagaaatgctacagatttttgcctgttgattttgtttcctgcaactctactgaatgtatcagttctaatggtgttttggtggagtcttggatttctccaaatataagattatattatctgcaaacaagtataatttgaattctttctttccaattttgaagcactttatttctttatcttgtctgattgctttagctgggacttccagcactatgttgaataacagtggtggcagtgggcatctgtgtcatattctagatctttgagaaaaagctttcagttgttcctcatttagtatactactagctgtgagtctgttgtatatggctttaatatgttgaggtatgttccttctattcccagtttttttaagatttttgtcatgaagagatgttgaattttatcaaatactttttcagcatcaattgaaatgatcatatggtttttttccttcattctgttggtaaaatgcattgcatcgattgatttgcatatgttaaaccatccttgcatccttgggataaatcccacttggtcatgatgagtcatctttgtaatgtattgttgaatttggtttgctagtattttattgaggatttttgcatcagtgttcatcaggaatattagcctgtagttttctttctttctttctttcttttttttttttttttttttttgatgtgtctttgtttcgtttaggtatcatggttaacagtggactcatataatgggttcggaaaaattccctcctcccctatttcttgggatagttttagagggattggtattaggtcttctttaaatgtttggtaacattcagcagtgaagccatcagttcctggcttttctttgctgggagagtttttattatggctttgacctcattacttactattggtctgttcaggttttggatttctttatgggttaatcttggtaggttgtatgtatctaggaacttatccatttcttctaagtttttgaatgtattggcatatagttgttcatagtatcctgtaataatccttttaatttctgtggtattagttgaaataactcttttttcatccctgattttatttatttgggtcttctctcttttttcacagtctggtttaaagtttgttaacttcgtttatctttcaaaaaccaactttttgtttcattaatcttttgtatttttttcctttcaatttcatttatttcttctatgatctttattatttattttattattctaactttgggtttggtttgctcttttgtagttctttaagatacatcatgaggttgtttatgtgtagtttttcttttttgatgtaggcacttatagctataaactttcctcttagtactgttttcactatattccatacattttggtaagtttagtttcaattatcctttgtttcaagaaatttttcaatttccttcttaatcacttccttgacccactgatcattcaggagcatattgtttaatttccatgtgtttgtatagtttccaatattcttcttgttattgaattgtagttttattccattgtgttcagataagatgcttaatattatttcaactttttgaatgtcttaagacttgttttgtgacctaatatatggtctatccttgagaatgatccatatgctgatgaaagaatgtgtattctgcagctgttgcatgaaaagttctgttaatatctgttaggtccatttgttctatagtatggattatcaaatgtttctttgttgattttctgtctgggagatctctctagtgctcaaagtgaggcattgaagtctctagctatttttatattggagtctatctttttatctctaataatatttactttatatagctgggtgctttggtgttgggtgcatatatatcatcatactgaattgatccctttatcattatatgatgactttctttgtcttttcttatggtttttttatgaaatctattagtctggtttctgtcggcatggaataactttttccatccctttattttcttcttatgtgtatctttataggtaaagtgtgtttcttataggcaacagattactgggtcttattttctcatcaatttagccactctatgtcttttaattggagagtttagtccatttatatttaatgttattaatgacctactctggccattttgttttttgttgtctagttgtttcatgtttttctcttctttccttcctctcttccttttattgaaggtgattttctatggtgatttgttttaatttcttgcatcttattttttgtgtactcattgtatgtttttagatttgaggttaccatgaggcttgaaaatatctgataatctattattttaaactaatgacaacttgacactctttgcataaataaactaacaaaaagaaaacttgtataagttctacatatactatgtcttgaaaagttattgtagttattatttttgattagttcatttttctgtttttctacttaacatatgagtaatctacacaccacaattacaatgtgataatattctgtgttttcctgattctttactattaccagtgacctttgtatcttcagatgatttcttattgctcattaacacatttctttctgattgaatgactccctttagcatttcttgtaggacaggtctggtgttgaaattccagagcttttctttgtctgggaaagtctttatttttccttcatgtttggaagggcctggctatactattctaggatattttttttttccttcagcactttaaatatgtcatgccattctcttggtcagtgaggtttccactgaaaagtctgctgccagaggtattggagctccattgcatattatttgtttcttttctcttgctgcttttaggatcttctctttatccttgatctttggaagtttgactattaaatgcactgaggtagtcttctttgggttaaatctccttggtgttgtataactttcttgttcttgaatattggtatttctctctagatttgagaagttcattgttattacccttttgaataaattttctaccccgtctctctctttctctctactacctcttttttaaagccagtgacttagatttgcccttttgagcctattttctaggtcttgtaggtgtgcttattcttttttattctttcttcttttgtctcctctgactgatgttttcaaatagcctgtctttaggctcactaatgctttcttctgttttatccattctgctattaagagactctgatgcattctttcgtatgtcagttgcatttttcaactccagaatttcttcttgatttttctttattatttcaatttctttgttaaatgtatttgataggattctgaattactttctgtgttattttaaatttcttgagtttcatcacaactattttgaattctctttctgaaagaccacatatctctgtctctctgggattgttccatggtgctgtatttagttcctttggtgaggttatgtttttctggattgtcctgatgcttgtggatatacttcagtgtctgggcattgaagagttaggtatttattatcgttttcacagtctgggttggtttgtacctgtccttgttcagaaggcttttcaggtatttgaagaggctttggtgttttggtccaagtttttggtcactagagccatatctgcattagggagtacccaaagccccgtaaagctgtggttcttgaagacttgtaagggtatcaccttggtggtcttggataagattcaaaagaatgatctggattgccaggtagagactcttgttccctttgcttactttctcctgaatagagtccctctctctgtgctgagctgtccacagctggaggatgggtgacacaatcacccctgtggctaccaccactgagactgcactggcttaaacctaaagccagcatagtactggttctcacccaaggcccactgtaaccactacctggctaatgcctacattcagcaaggccctgggctctaacaatcagcagatagcaaagccagccaaattcgcatccttcccttaagagaaacaagttctcctgggctctaactgggtccagagttgctgtctgggagccagggcctagagtcagaaaccttagaaatttccctgaaaccgtaagacaaagttcttcccacttttttcttttgtgaccccagaaagatgagctggtgtcatccaccaccagctcaggcccacagggagtaccaccagggcattgccaatgtgcacataaggctcaagtgtctcatcggtaagcctgtggtgaatgctgctaggcctaggactcgctcttcagggatgtgggctccctgttgcccctggtaggcccagaaaagccatctaagagtcaaggcctgaaattaaggaccctcagagcccacttggtgcccttccccactatggccaagcaagtacctaaggtgtaagtcaaagtcccctttactcttccctctgcttttctcaaacagaaagaatctttctttctagccaccacagctgtgaatgtgctggatcacacctgaaggcagtgcatctcagaatctcacccaagtcccacagtgcatactacttaattactgctgctgaatatttagggcccagggactatttcatcagtaggtaatgaatccttcaaggaccgggtccttcccttcaaggcagcaggttcccttctggcccaagatgtatctagaaatgtcatgcaggaatgacggcctagaataagggcctcatgactttacccagtgcattatcctactgcggctgagatggtatccaagttgcaaaacaatgtcccctttactcttccttctcctctcatgaagtggaaggaaggggtctcttttggagctgtgagctgcactgtctggggttgtaggaggggtggcacaaggactctcttagccaccatggcttgtgtctttactaggtcacacgaccccaagtccactggctccattgccagcacagcactagaactttcctaggagtttcagtctttgtggcctagactgcctttcaagtttatttggaaccccagagccgtttagccctctgtagcaaggcttgccgaaactgaagttccaaccagtgggatggcaatttctctgtggctagggctggtctaaattctccctccatggacatcaactgagttcttcctggtgttggcagcactgagttccaatgcaaaatcccaccactgtgtggtccctccctaaagcacacagattctctatctgggtcactcattcactactgtgggatgggtgaggggtagtgttggcaaatcaagactgtctaccctcttcaatggtctttagtgcctctttcagtgatatgaaattaaaaacaggtactgtaatttcccacctgatttttggttcttataaaggtggtttttttgtgtagttagttgttaaatttggtgttcctgcaggaaggataattggtagaggtttctatttggccatcttgctctgcctttctccagtaagttgttcttttattagtaaattattattttcatgtaaaatgtgtaattcattgtgaaaaattatgagttaatttttgtcttctattttggttccacatttacaccaactacttgacattatcctgtattggattttgctcagtactccctgaatctcatttacttctttcgaaggcccactttcagtccttttccatcacaaatttcccaaatctgaattcttttatgattcctattttgttgactgacaaatatttttatgcatttgtctttcgggacatttgtattataagtgctgtgttttctgaggttttgaatagcttatgacctatacatatcaatgatatatggtagaataagggtctgatttataactctttctcaaaattccttagttgttgctttattttattttaatttattgttgaaaagtgaaacatgactttttttttttttttttttttttgagatggagtcttgctctgtcccccaggttggagtgcagtggcccaatctcagctcactgcaaccttagcctcctgagttcaagcgattctcctgcctcagcctcccgagtagctgggattacaagcactcaccactgcatccagctgatttttgtatttttagtagagacggggtttcaccatcttggccaggctggtctcgaactcctgacctcgtgatccacccacctcggcctcccaaagtgctgggattacaggcatgagccaccacacccggctgaaccatgactttttatctttgattgcagctgatatttctccctgccaaaatgcttttcaattcataattcaggtgtttttttttttttaacctcatattttcagaggattcctttcttacatttgtgtcaaattagatgaagtcctgttaactaacattcaaagttcttcatggttgtcgttgttgtgttggtagtttttgttttattttacattcatttgtttgcttgtttgtattcagctcaggaaaattttcttcatttgtgtcatggattttcatttgtcttcaattctgcatgttcgtttttacaaaagttataacactaaagcctgcaaatccccttcccttatctccttgaactgtctcttcatcctaggagagcttatgtatgccacatcacctgtttggtattgtaatcataaatgacatttagcattttaaaactttacaatattaattaatttaatcctcttaatcatatgttgaatatgtgatgattcttaccccattttataaacagagacataaccaggttttataatttgctcactataatgtgactagtaagagaaaacgcagtcttgctccaaaccccatgctgttgaacactgggctatattgcctctgaaaaggaaatttttgcttttaattctctttatttttttaattttttatttttttgagcactcactctgtcacccaggatggagtgcagtggcacaatcttggctcactgcaacctccttccccccgggttcaagtggttctcctgcctcagcctcgtgagtagctgggattacaggcacttgccacggcgcctggctaatttttgtatttttagtagagatggggtttcatcatcttggccaggctgatcttgaactcctgacctcgtgatccacctcccctgtcctcccaaagtgctgggattacaggcatgagccaccatgcctggcacttttaattcttgttggggctcagaacacgataccccgaagtatggcaccttggcatgctgaatactttgaactgaaggacatcagaaggctttggaatcaatgtctttctgactttctcccgtcttcctgtctctcatccctctttctcccctgaagcaagtgacaaaaacctgaattcctccttctcactatgggtcatagaaagtacagtccctctccctcaaaggaagacataaaacctagaaaggtcactctcttccttctcccttcttccttgaagacctttattccagaggagtccagccctatacctaggagagaggaatcctacacagagaggccaagaagaattggaacagacagtccttgctaggttttcccctcagtctattaccaagagatcaaactattttgtccaatcacatttttacacaactgtccattcttcatcaacctaagcttaaagatagacagttttctttgggcctttggatcttcatttctgaaggccctcacgtatgtaaatcttcgattaaataaatttgccatgcttttctcttggtcacctgacttttaagagagtcagcatgaccaagtgataggcgaggaaaggtatcaaaccattccacctctacactatctctacactatctacaatgcaaattttaattctgctatgaaatttgtatatatgtttcatataatactttttgattcaaatttcctttgaatttcagtcttcaattactgtgctgccttctctttttcatatcgctgtgttcttccttcattttaattattctttctggaaaccacacttttaatatatttttgtatcctaagcattattctaatttctataatatattctcctggctctgtcctccagatattatccttcctcgcttcaaatactgttttctttgtcttgtagactgtaaatgctattgttgcagcaggtgttttctctctgctcattttcaaatgagtagagatccaccagactgtttcctaacatatatagtgtatgaattgtattaaccctggtataaccatattttatacctacaagtggagagcagaggcatgaggcatgtgtgtgaatgtgtgtgtatgtatgtatgtatctatgtatgtgtgtgtgtatatatatatattatatatatattatatataataatatatatattatatataatatatatattatatataatatatataatatatatattatatataatatatataatatatataatatatataatatatatataatatatatattatatatatataaaatctccttgacctaacttgttcagatgtcattttatgtgctcctgttgcactgagataggatcttctacccacgtggctatttctcagaaatgtaaactgatagaccacgtaaaacaaactattttcttttttttccaacttaaatgctcttacttctatatacatctcccatgataaatgtatcacagccatttcctctgtctcttcatagtaattcagacccattagttatatggggaagaaaaggcaataccttttcctctcccatcacagggtcatggcagacactcataacaaaagacagatgatatggtttggctgtgtctgcacccaaatctcaacttgaattttatctcccagaattcccacgtgttgtggaaggggcccagggagaggaaatcgaatcgtgggggctggtccttcctgtgctattcttgtggtagtgaataagtctcatgagctctgatgggtctatcaggggtttctgcttttgcttcttccttgttttctcttgccactgccacgtagaaagtgcctttcaccttccaccatgactctgaggcctccccagccatgtgcagctgtaagtccaattaaacctctttttcttcccattctcaggtatgtccttatcagcagaattaaaacagactaatacaacagtttagcaggagaaaagcataaaaattttatttagcaaagctctacatgacatgggagccttcagaaatgaaaatatgtagacccagggaaaatggtgtgtttttatgctaagtctgatgaaaaaagtagatagttgtgaagaagtggattaaacaaagagggtatgatctaatagtattaaactaagtggagtttagcaagctcagattcttcttatcctgtgtagcatttcttcctccctggtatgggccaagacccatctggaatgaggattgtatgactcactttcaggacagatgagtaagagagtgacctttctaggttttatggcttgctttgtgggaggggagttctagtttctatgattcccctcaggagagaggaattctggggtctatgacatatcttttgggagaaaatgaagtggaaagaggtcagagaaaccttgcttcttaggccctctcaatatcatgtaccgtactttggggtatcattttctgagtcctgacatttacagaatctgaagtaatgcagaaaaaattgttatttaaataacaaaggaatcatattctgtttgccttcagaaatagtaccctttcagaggaagaaggactgatagcttttgtcatctgtttctattcttgtggggttgggcagattaaaatatcttcccagattctttcggtcctaggttcttttattgggtaacattttaggttgcaaaatatatttgaactctatcccagtttcctgatctctggttgtaggttactgttagatttacaatagaatatttgggggagtttctttttctttactttgatagacattttagtgggaaatttaggaaacccaagtccaaagaaattttatcaacacacagacacaaagcttagagattttacataacttgctgcaagtcctaatgctgaaccaagattggaatctagaaatgtctgattctagtgccaggctgtctcctctcttgtatccatgttcgttatgccatttatagcctaaatatcattttcctttttgaaaaacagagttccatgtaagttacagagaattatctttgttttataatctaatataataaatgttaaatcacaatcccacactgcgagcttgtctcataattattctttttgagtggaatagagcttcaagaattgcacaaactactcaaccattgcttttgaatctaataacacttattgtgaactttatgccctggtcacatttctctagaatccatgctaacacattatggtctccctggttggatgtcctgtgtttaatctccctccttctaaggtttcattgtgtactataatcttttttcctatttgtcaagtgattacataatgaaaataatcccaatgggagatttatgctctaaaattttaacctccataattatataataatatgtactgatttggcatgttaatattgtacattctcactggaaaaatactctccaatttggagtttatagaataacaacccataactatgtgaatagttttccagttttcatattttccaatttgtactttattttaatatcaaaaggttatgatttcttattaaaagcagagtaagaatggaagtttgggcatgtatgtgacattttgacagattccattattctgtggtttaaataaaggaaattgaacctatacccatgtttactaaattctttgaaagtaactgtttgtatatgttgataagtggtttctttatatgagacaaattcagtggaaattgagttacccagtgataacattatctgttacctgtcactaaccgtatctagaagcttgagtggacacaatcaactggtaatactaattttatctctaataaccaattcaaactaaaaacttaaggaattttcattattcgcccccccccccatttcctatgtctgagagaataaaaacagttttgtggatatcagatgttataattacttcttataattttttttcctttagaggaatatccaggaatatgttaaactaaaaggaaaagtaaattttacaaagttttaaactaaatacatgagaaatatgctttagtggaaatttttagttctattgtctaagagaggtattgacaaattttcaattaatattttttatcaaactcaactatcaaaaacattgctgttattattttgcatttgcattggttgttatgatgctttagggttactttttattagtcttttatggtggcaaacagctatccaaatgctctttataaaatttttctttgccttttagcaaccctgatttttttaatgagacctttttccaaatcttaatacttttttattttttatttttttatttttttagatagtcttgctcttgttgcccaggctggagtgcaacgatgagatcttggctcctgcaacctctgcctcccaggttcaagcaattctcctgcctcagcacccactgagtagctaggattgcaggcatgtaccaatacacctggctaatttttgtattttcagtagagatggggttttgccatgttggccaggctggtctcaaactcctgacctcaggtgatcccccggtctcagcctcccaaagtgttgggattacaggcatgagccaccaggcccagcccaaatcttagtatctttatgcctccaacagtgccttctctctctctctctctcataaaaataaaacaaaacaaacatgcattgtttctctgggtcagcttcagggacatccctgctatctttgaatttatcagagactcctcattttaattccgcctgctcttgttgccaccatcaattcttttcttttatcatcctgaagattcctagtggcttccctcttttatgaataccatattataggaatgaaccatgaaatatatttatgtatccatataatactcctgtctttctggaggatcaccatgccagataatggttcagtgatgtgctagggcactaaataggagaaaattagaatctatttactatataggccttataccaagtataaaaggaattctttttgttatgtcccaacacatgttaaaagaaacatcatttacagcctgacaacctctatgctcttcataaatgaaaattacaaatgactcccaattatgccaaatggtccttgtgctatgcaagaatcacttttaaacatgcaaaagtcacttttaactcccagaatattttatacaattttaaaatgtattctttcttacagccccggtaaaatgttgctattttgcaactaagacatcgggctattttcatagcagtttaaattaccagcattttattttgcatttttgctgaaggtaaaaaagaatattgtattaggcagaataatgcaccccagcaaatgtccatgccccaaaacccggaatccataaatatgttaccttatatagcaaaaggcacttggtagatgcgattaagttgggaatattaagataaggaggttttcctggattatctgagtaaacccaatgtaatcacaagagtccatataagagaaagagagaggtagacgagtctaggaggtgtgatggcagaagcagggccagagccagagagaaactggaagaagatgctatgccactggctttgaagatgaaggaagggaccatgagccaagaaatgtagttcagaataattaagatgccaaagaggcatattttagggtgaaatattcctgtctccaacgtcatattttggggtggtatgtcctgagcctcatcagtgttttgctgccgttcttacggttgtaagatgtggtactgcatttctaggcatcatattcatgatcagcaaaggaaaaaaaaaagaaagagacaaatgacaaaaataaaaggccaaagagttttgtccttatctctgatttctttttttttgagacagagcctcagtctgttgcccaggctgcagtgcagtggtgtaatcttgactcaccgcaacctctgcctcctgggttcaagcgattctcctgcctcagcttcccaagtagctgggattataggcatgcgccaccactcccagctatttttttgtatttttagtagagacagggtttcaccatgttggccaggctggtcctgaactcctgacctcaggtaatccatccgcctcggccttccaaagtgctgggattacaggcgtgagccactgcgctgggccatctctgactttatatgcaggaaagaatgtacttccccaaaattgtagcctatacctcattgagcagaactctgtcacatcaagagacaaagttataacagatttaaagatcttaattagcttttatttatgattctagaattgggcaatacctttttctataaaataggatgaatgttccgatgaggtgatcagaggttttatagacagagaagactgaggaaagcagaaacagagcacaagaagctgattggctgtttcaaaattactttccttgtaaaggttaaagcaaaggaaattttcttatgccagctacaacaggctcatttgggggattggctattatctctcgctttcctgattttttgaaagatcagataacccacttagttttggcttggcaacatggaacagaagcatgaataactccattgtggtttgatcagttgcacctagtgtagaagctcagtccaaaccactgccctcttataaattttatttaacagtcacgtggttaccgttaccgtcaagacaatatagaaaggtgttttagctttccaaggtttgtcatagaaaaaaataaaggaagtgagattgtagatgattggaaaagccaatcctcagagactgtgaactacacatttaaatgcatgatttctgtaagatggatttgttaactcttttgtaaatatcaccattcttcaactgtcaatactatttaaaatattgagctgctgagtgcttctatgcagacagttatagtggaggatcaccacacttattaattattaattattagttgaatcttttgctctttgtattctttgattcaaaagaaaatacttgcattgtagaattttaatgaagttattaaaaatgtattttttcctctctacatatatgagaaaacatttttttatgattttttccatctcttccaaaaataccatgttagaatcacaaataaatcctatgaaactgtctaccatatcaatagactttccttatcacaagatcttaggagtgactgatttaaaataagtgatccttattatataggctaatcaagttgcaaactttgaaaacattttgagaagtctctcacatatattatgtagccaaaaacaacaattctaaaatgacatttttttttaaattatggaatgatagttttcttaaaagtgaacatatttcacagcctggaatgtgacattattgttgtacagcagtaaagttgacatgtacagtatgcagcatgcatactaccatgtaacccattgatgaaatttcagggtttttattatgctacagtacaatcctatagtggggaattactcacattttcatgagctaccgtttaaaataactttttgaaatgagatttatgacttcctgctaacagctgtagaaaggagatgaggagggggaaataaggggaaggctcttcctattacgaaaagaagaaacattaaaaaggtaggaaaagaacatttatattggcattctctggaaagagaaagccatgtgctcagcaagctttcagcattccagctttataattactcttgaatatcctgagggcttctaaagcaggccatttctgaaaagcagatgtatactttttgccattgtttcaagtctggataatcttttcatacttggaaattaggaatgcatgttaaaatgttgataggaaataaagagaaggaatttgtatttttaatcgttgactttaataataaccatatataggccaaatctctattaacctactgaagaaaagaactgtggcaattacattgataattgagacaaaaccatccagaagacattatactgttcagttagctggataagaggcttgaaattgatgatgctttctcagaaggcactcagccactcaaaattgaatagaaactttccccctcccacaatctcagacaaactctgacattagtttcccttgctatagaaatcatttaaaaagcaaatgagaaataaacaaaatatttgttaaactttggaaaattaccttgaattttagaaagttcgatcactgctaaatagtttgggaagaaaaaaaaatcctttcaaggtagagtaaggtaaattccataactgtctacatcaacagttcaaatctggaggttgaaatgtgggagacgaccagttagagaaaagtaggaagggcttcttggaagaggtcatctttgagacaggatttctaaatctcaaaaagggctaggattggttagtgagatgggggtggcatgggtcttctggaggaacaacctgtcactaggtagtcctagtgacaatggaagcagaacaaggaagtggaaaattatagtgtgtgttagtgtccttgtttgtgaactggggagtaatgcagtttcgtggaagaatactggaaactaagaccataagctaaaataataagcattataaatgaataaagccatgctgaggcctaagcacattgtaggtctttaactatttctccacacacagcctctgctggtgtctgaaatagacttcatggctctggagaagttcatttactgtcaactaatttatttaggcatatagcatttctattcctgcaatacacacaaaggacatttgttgttattatagtgcttttttggtttttgttttttgattggtttcccttaaaaaaatgagagggggaaagaaagagtatgttcatttgtatgtcacaacccacccctaaaaaaatagtcatgagcatgagagtagtgggttggtgcaatgaacacatagaaagacttaagttggcaagatcattttttcacttggtacaaaaccagtggggcatgacataagggtagtttgtacatggtagtgccaggaaaataagggtttcatattcatgttagacccttggtctacttaattgcttttgcattttcctaatgcatcttaatgtcacttttttttccagaaaaattctctaacttagtagaatgagtaaaagaatcactttaagggaaatagagttaaaaattgaaagtcacttaactgtaacaataatttacatagcgttagcattgttcttttcatgcttataattttgacttacttgttgatgtattttaaaggtttcattatttttctggtttaagatagatttatattgttaggttaatgtagtacaattagcacctttgataattaaggacatatttgtaagtacagggaagtctttcttgtagaccaattatagctgtgtttatagtatcaaattatacatgcattattagaccttcaaaacccataataaatactgtatatcaatgttttggggcttacacctagtggcacaaatattaatataactaaaatctaagttatatgtataagaatttttttttctgaatctctacattctttaggatctacatttcccttaattgtaagaagcagaatattttaacggcaaaaatgagataggatatatctaggggttgaaatcttcctactaaatgatttttaaatttgtaactaagcatttatgttcatttccacagtcttgtgaaacaggtgtgcatcatgtaaaccttgttagggttgacaaaataggaaagcattataacacttcatatgatcaatgaattaagaattgtgtattttgaattttttttccaaaggcaaaattttctttcctgaattcacaaagcttttacaatctagatctttcacatagagaagcatctactggattagtaatacaggcaaggaactaaaaacttaagtctaataacatatcgtagcagatatattgtgcacttttatttgtatattttgaacataggttattttcttggcagtttcctcagaaaaatttggtgtttatcttctgttttattttcacggttttaacagtaagaaccaggagtagtaagaaatagaatgtgtatatgttttataaaaatttatatacatatatacaattcatatataagtagttgattctattggatataccttggcacttatataagtttactaagaagtgaatttttttaaaaaaataggaaatgattatattagatttaatttattttttgccaaactaacattttgtttgttttgttcatatcatcttaaactagttattgtggctatcagtgcattgaaaaatgaattactagtgtaatatgttcatctccttctgcatatgaattgtccttggatgtaagttttctgtatttccagagtcagctaaaagttaaaactaatttacctggaaaaactatgttttaggtgctattattatttttatcatttagagacaggatcctgctctgtcacccaggatggagtgtagtggcagcatcatagctcaatgtaacttccagctcctagactcaaacttcctcctgcctcagtctcctgagtggctaggctacaggcatatgccaccacactcagctaatattttcactttttgttttgtagaagcaaggtctcagtatgttgcccaggctggttttgaacacctatactcaaatgatcctcccactttggcttcccaaaatgctgattacactacttcccaaaaggattgcagaggtgagccaccgtgcctggcctttaggtgccattattgtagacatcttttttttttttaattatactttaagttttagggtacatgtgcacaatgtgcaggttagttacatatgtgccatgtgtaaaaagtaaaatcttaacttcttatatattttaagcaagtttattttttaaataagcagtaccagaggaatgctgatttttgtaatttaatgtttcatatagtttgagaaatggtctcatgaagccagtcatacagaaccgtacaatccacagtgactaatctatgcacttggttcatgttattcacaactttctacaatcctataaaagaagcagctaacccaaaagtacaagacacatcaggagctaccaaaaaataccaagatcaaatccagccccaagattatgaaagccatattattttagtctttcaaatgccagtgtttgtcttttttctcaagtttttctaatgcagagagtcaataaacacccttctaggccgggcgaggtggctcatgcctgtaatcccagcactttgggaggctgaagcgggtcgatcacctgaggccagaagtttgaaactggccttgccaacatggtgcaaacgcgtctctactaaaaatacaaaaattagctaggtgtggtggcgtgtgtctgtagttccagctacttgggaggctgaggcaggagaatctctagaacccaggaggcggaggttgcagtaagccgagatcatgccactgcactccagcctgggcgacagagtgagactccatctcaaaaaacaaacaaacaaaaagaaccccttcttttttggtcaagagctcactatgacctaagttaggattattgtcattatagtaatataatataaaacttataaaaattttaattatttaggaccatttgcaaaagctgtagattgtttatagttcagattggcaagtatgggtggcagtaatgttagaaataagaaagctaaaacctaaaggtcaaaaacctagttgccttctcattattgtcctcatgtcttcagattgtcagaggacagagggttagaaccaagaacactcagcttgcgtaaaggttttctacttcacttgacatttccagtaacttagcagcatgaccaatgaaacctgaagtaatgaatgggaaaagttagcggggaaggaatatccaacacaaaagttttatctcagcctaattaacattcagagatcagatggaaaagatggagtcaagaaggaggagaaaagttactgggaaaatatcataattggtaaaaagggactataattgatagaaaggaagaaaaacagtgatttcggttatctagcagactgaaggatgttaagcaaatgattagggaatttctaacaggtaacagatgattaggtcaataaattaattcatgtgtaatttgaaaaatataacatttcacataatattcataatattcaccatttttcagaaggcaaaattaaatacttcagattataaatctaacgacacagaaaagacattttatgttcttgttttttgatttacgaggacttggacttataatagtcaataaatgctaactgattattaataaggtgtagggtctaaggagcataaatttttttaaattagttttaaatattcatagttatagccagttttttactgtctttaccaatgaaaggaaacaatgtcataaagtaactatttttaatgtttttagtcattcgtctttatgtaacattactttttgaaattgatttgctttccaaattaaaggttgtcgtaggataatggtaaaattattttgcatacatagcaatacaaataaattggaaactgaggatatgatctaaaaatacactaagtggcagtgaagagtgaatctggaattcaacatttttcacaatgcatatgtaacatggtatatttggatgaaacattattcaaatgggcaatctcttctggctccattgtcttgtgactgtgattctaaatgctgtcatttctaaagtaacttaaatactttctcctgagaaaattgtcattaaaaacaagtgcatataatatctaataaaaagtttttatattattactattttgttttatatatctagtgttcttttttttttttttttgagacagagtctcgctctgttgcccaggctggagtgcagtggcacagtctcggctcactgcaacctccatctcctgggttcaaatgattctcctgcctcagcctcccgagtagctgggactgcaggcatccgctaccacgcccagctaatttttgtatttttagaggagacgaggtttcaccatgttggccaggatcgtctcggtatcttgacctcgtgatccaccctcttcggcctcccaaagtgctgggattacaggtgtgagccactgcaagcggcccttgttcttaatcgtaatgaacatgaacagtattaataagttcaaagcaatatgtacacgaagaatttcttctttcaacagcaataaatgggtaaaataagtacagaacaacttttatgatacagtgttataaaatgcatgtgtatcagttacctttcatcaccttaattctttgttaaaaacaaaaacaaaatgccataaaacctcagtggcacacaatagtaaggatttgaatgaagctcaggcatctgatacaatcagctgggccattctgctgtttgtagctgggctcaactggttggttattctcttcttaactgaactcactcagatgtgtggatcagctggtttggtttgaggtgaaaatcaggacatttttactctgctccatgtctctcaacctccatcagactgggacaggtagatatcttctcatgatgaaagtggggttggggtagcagtgggaaagggcaagcctaattatacaaatacttttcaagtctcttgagtgtgatacatttactagcatctcattggctagtgcaagtcacttatcagtcagataatttgagataaattcatgtgccttaattatttttataacttaaaacataccaacaatgatccaaaatattttttaaactactgtgatttttaagattgttgaaaattgttttgaaaattagtttcacatttatcttttagggaaaaagagtttaccattgataatccaaaaatctgataaaatcagttgaagcctgtttagaaagattgagaacttataagtacatacataagtataaattatatataatgtagtatattatatacatgtgtatgtatatatccctgctgaaattacctgccagtagtacctgaagaaactcctcttagaataagatgtattttaacatttcattgtaatggaagtagcttattttactcaccttttttgactacagtttttccgactcaattacagtgttcctgtgtggttcaaaaccaataaaaatgtcattagtaaaaccagtccatgtcataaaattgtattccatctagttaatttgacacaaaataatataattataaataaaataataatggagttatttttataggcaacattctaatacagtgagacccctttatcttatatttaaaatattagaagctataatttcatattccatgtaatatatgtcttttaatttaaatttaatttcctttgttactcactgctagactgtatctgttttctattgctgctataagaaatttgcaccaatttagtgacttaaacactaatttatcgcttcacagttatgtaggtcagaaatctgtgcaggctcaatggcttctgctgcttagaatctcagcaaaatcaaagggtcagcaggtctagtctcttatctggaggctatgaggtagagtgtgcttcccatctcgtccaggctgtgggcagacttcaggtttagtggttgtagaactgagcttcctgcttccttgctggctgtcaggtggagtacttgtcaatttccagaggacatcctgtttcatgactcttgccaacattccttcatcttcaaaataggctaggcagattaagtttcctcatgctttgagtctctctgacctaccctctgtctcatttaatttcccttgctcatagggactgctgtaattagactagacccacccctcaggataattttcctattttaagcatattcacaggttccagaggttttggcatggacattgtgttatgccattattgcactgctatgaagaaatacctgggtattttataaagaaaagaggtttaattggttcattcttctgcaggttttatgggaagcatcgtgctggcatctgttcagcttctgctgaaacctcagggagcttttaatcagggtggaaggcaaagaggggctggcatatcatatggcaaaagcaagagcaagagagaaagactgaaggagggaggtgtcacacactttgaaacaaccagatctcatgtgaactaagagggagagctcacttagcaccaaagggacggtccaagccattcctgatggacctagctccgtgatccaaacaccctacaccaggccccaccttcagtattgggattacatttcaacatgagatttgggtggggacaaatatccaaaccatttgattcttgtgcattcttatgcctacataagttaggtagtgagaggacaacaggatccaggcagagtttaaacaagcagattaaggagagagaaacactacagcaaacacggacctctccttgttactcttgcagtgagattctctctccttgataaggataacaaaatgttgtaatataaacaaatgacacacacacacacacacacacagacatataatacaaaaagtaactggaggcagtgccgtatgttatagaggaagctttgggtaattttgagaggggtatgtgctgcagacattcagcactgaaataaggcaagtaatttgagttatttattaaaggacaggtgattaagctgtgtgattgagagacttgggaatggtgcataccttttatttatttccctgaatttggtaaaactcagtgtagataataaattatgcaactgaatacctgtggagtcactcctgtttggcttgtaaaaatggaagctctacgtcttgtctggattgtagcaagttgctgtttagatgctccctctgtgctcttttcctacccacagtgagtagatgggagtcaatagattatctctttatttttgcttggtttcacgtgaattagaagaaaaaagatgtcagcagaatttaagatgcagagataactgcatggaagtaagagacatctgaagtggtgtcctactgcatcacagattatcaggactcatttcaggtctgttgcttggttttcttaatttgtcattgtttgaacccatttctggatactaagcttccttttttggatttatgtctcacagccttatatgttcattaattttcaccttggctgaattggccgcccaatccttccccttaaacatgtacttttcattccatttatccattgtagttatatctatctggttgccacccctgaattcaagttatttgtgttcatggagtaatttttaacaactttatcaaagcgtttttataatgccagtttatacccctgttcccttcgtcccatccctatatcctttctcccatctaatggaaactgatgcaagttatcgccccttgcagctcttcagcttccccttgccagcatctcaaattacatatagtgagtgccaaacccagacatttgatctattcctcttgttcacaacagtttctgcttgtggcctatgacgcaactgaaatatgataatagaaacttattcagtcttaggaatttttttagtgtagaaattgagactcagattgacatatatatataacttttgttaatttcaatatgtgcctcaaattccaaaccttatgggtttgtgttgctataaagcaatacctgagggtgggtaatttatgaagaaaaaaagatgtatttttctcacaattctggatggttggaaagttcaagattgtacatctgcatctggcgaggacctcaggctgctgtcactcttggcatagggtgacagagagccagcttatgcacagatcacacggcaggagatgaaacgagaaagagtggggaggtaccaggctctttttaagaactagcccatgcaggaactaatagagttagaactaacacatcaccgtgagaatggcaccacgacatccatgaaggatccacccccatggcccaaacacctcctacttaggccccacctcccgacaccaccaaactggggataaaatttcaacatgagatttgttggaaacaaaacatgtccaaaccatagcagtttattttgtgaaagtgctgaagtttgatgagtatacttcaatgataaaaaaattaatattggctttctaatttatttataaaatagatacaaaaaagtcattatttatatgtcattacaataatcacattggcttggtggtatctaataaattggagccacattgaagtgaattctatactatacctcagcatgtaaatttacctgaattttatgtcttcagttgtaattcttccagttatttctagactatatgtagtttatatttctagatattctcctagaaaagagatttttcatgttaaagtccttaccataaggaagtttgactgtcattccaaagaatctactctctgtcattaatataataaggagatatgaaatggaacattttacattcataacaacacaaaattcttataaattgctgaaacatgaaataaccaaataaactttattattgaaatgggtttctttagaacataaatgtgtaatgtatcttctcaaacttgttaaatcataaagaagtgcggtgatttagtaacatgaagcacagtatatataaaactatgtagcataaaatgttcagctgctaaggtagcaggaaggttccaggagatattttcataaatctggaagtagttcacctgtttcattgattgtcctcatttcatttacctaaatagtgggtcgtgattctcctgtctttggagtttacaaatttcctttagttgaatctgtgtgttttgaaatggtatttctttcacgtattagaaagttgaataactttgaagaaaatggaaatgacattgtgtggattgtcggaaaactagaaagatgtgatacctttctttataagggtcaggaccagcactactataacaaaggcatgttaataagagaaaagcaaaacaaatttgtttaatccaagttttacatgacacagaaaacttcaaaaatgaaaagctaaaatccagggaaaactgtctatgtttagatttgatgaagaatggacagtcgagtagaaatgtgattggacaaaaggctgtgctgtagtggtaataaactggaaggggaaacacagagaggcctgatggttcagattcttctggcctgcctgtatggcatttcttctttcgagtacagggcaggacctctctggaatgaaggtctttaaggaaaagaagagaaggttttatggcttgctttgtagcagatgggttctagtttctaagactcaccttcgagaagagaaattctgtttttttttttatgattttcttctgggtagaaaatgcgatgggagacaggagggcaagagaatgtgtgtcgatgaggtttggtcagtggtgacttaggaaacattattaggctgcttatttgcttatatgttgactttccataaatgatttttgagttgaatgttataaaatgtaaatctttatatttttattttcactttggattttttttctcataacataccagtctactaattttcaaggaacattcttattagtatatttaaaaggccaaaatagtattactcttatttaataattaatttaatcacagttagctaaaatttgactttatccaacctgaagacttttcctagagaagtgcttatattcataattaaactaaaattttagttcagaagtataaaatgttgctgtctaatttaagaataaaatacaagtttttagaaagttgtgtggaaagttttacattggacgagaaagaccaaagaattgatacgatgtttaaaaagatttgggttgaatctataaactaataatatgggccagcgtggtggctcacacctgtaatcccagcactttggcaggccgaggcagattatttgaggtcaggagttcgagaccagcctgaccaacatgatgaaaccccatctctactaaaatacaaaaatgaggcgtggtggcggtgggtgcctgtaatctcagctacttgagagtccgaggcaggagaatcactttaacccagtaggcggaggttgcagtgagccaagattgcgccactgcactccagcctgggtgacagagcgagactccctcttaaaataaaagtaaactgataatttggatgaatgttacaatgttctataacatgggtgaattttaatcgcagtaccattgagtatctattaggtctaagtcactacataaggcctttccctgcatttgagccagagtagatattccagtctcggctgcctcttaccttgccaatgattgggattagcactaccagccaggtggcaaggcatatacaatatgtataaggttggaagaacattgaacaagaaaagaaaactgaagctttagcttttatgactaccctctagggcattattaataagtccacaaactgtgaaaaaactgtaagaatgctccactctagtaaaaaatgaaaggacagtgctactttccagatcctaatgatgtaagtcctgctctgctttgaagaaaacctataatttcacaatatttaaaacttaaagtgctagggaagtattaagatttcatctttttcacatttacttagctgtcttctgaaaatgaataagatccactatcttattttgacagattttaaattattgtgttttgtatacacatttgttttgtgacttttattgcatttgcatttcaccttggcactttttaagtacacttaataaatatgttttaatgatgaggacaactgtgagttgacctttcctgaaggtagtggtgaaaataccaatatacaaaagcggcatctgccatgatgatgaggagccgtagtttaaatagatctgggttgctactgtactctccaagttagtgtcctagtttcttctcttgtttcttactttccattttccacagagcagctacagatatctttttaaaatatattaatcatatataattctcctacttaaaaccgtgaaatgatcttaggagaaatttagtcgtctttcttcagtctaaaagccctatatgactttggtactcgccttcctctcgctccctatccatcctcaacacagtcctccttgcttgttctcttcagtcacctcggctttccttctgtcccttgagtgcaccacctccttgcagccttagcacttttgcacttgcagtcacctgtgactgaaaccatctgcccttagaccatcctaaaggtacttcttgcttgtcattctggtctcagctaggaggtcatgttttcaatgtgggctcccctgaccacctcatcaaaaataacattctcccccaaattattatatcactttactacattttctttatagctgacttattttcttcagttattttgtgatctgttctcccctacacataagtaagtttcctgagggtgatgcctctgtattgcatgctacatcataggctataaacacatatttgctggaataataaaaaaattccatgtgaaagtactttatataaatgctaatgcacatcacgatataagatgcagttactagctaagcaacagtcagacaactcctttttatgtatttgttctggcaacctgaataaaagcatatgtaatctgtgagtgtgtattgtctttaaggacaggtaggtaagtggtcatctaatgttcacggggcacacattttgatacggatttattttccacccactgtgcatcttctgctgtggcaataattagagcctgtgaactgaagtgaaggaaacatttacaatgttgaataacctaaagggaagacaagggtatctaattagtctttcttgtgacaatctttttttggattaatattcttttcttttgaaaagtctaacagtggattcttatgtcactgactctactgataattaatagtgttcaccatacacctacacacactccctccaaaatatcctctcgtaatgccactactggaaagaacaatttcaattagaaaggagagcttttgaagtatatatcatgtggtctattataagaaatgtgtcctattataaacgaaaaaaatctctgccagaacataatattttatgtaacatgcctggtatattgtttaacaaaacattttatggatacttcattagggcatgacttgattaagaagcaggactagcattcacccacattgtcttttcttgaatctgtaagatgtgttcctgtacgattttcaccctacttataagcttattaacttaggaatgttgtgacagagcctttatttttgaatcttgtaattataattaatagtaagttaaagggaagtagaaagcttatattcaaagtttgaagtaaaatgactttgtggcacttagggcaggtgccaggaagaaattaagcaaaagcttattattcttatttattagaactttgggatgacatctttgaggatgatagtcattttatggttacaagagggagacctatttgtggacaaagcttgaggaggggtatcctgctatcttcagctccgcatgcccagggtctaaaatgagcttttcccccaagattagcaactactttgtgctagttgcatatgtgcaagtaaggataggagtgaatgtgtacatactctccactacttccctcagtgtgttcctgaaatccctatcatgaaagaaacaaccacaaaatttccttatattaacttgtgaaagtgttatttatgatggctacatttttgccagagagtgacttaacatcatataaaacacagtaatgtacgatgtttatcaaaactaagagaaaacatcgtttaattgtaaatatctacagttttaagtagggaatgtcctacccatggtctttaaaagaaaaaagtatgaatgatagatgttaactatatgaagggccaaattacaaggaagttcaataatgttgaataatagtaataatagttgacatttgtggaaagctgacaaatgttcagataattgttctaagtactttacatatatcaacttattttatactcaaatgccctgatggatcagtatttttaccctgttttcacaaataaaaaagctgggctgtacaacataatcagctagtaattaagttgtgggccattcttcaaatctaggcaggcaggccccagataccctgtctctctgtgctgtgacaatgttcactaaattttcactatgtgtctagcaccattctaagtcctgtacaagtattaactttaaaaattcccataataagcttatgtgatcaatcctacagtagtcccatttcttcaggtgaggtacctgacaaaattcttgataaggaatttatccaagaatgtctagctagctaacactggaacaagaattcaaactcacatcttacttcagagccaacacttttaaacattagtctaccccatgtcatgcaaatgtttagggatcagcaaactatggcccacaggccaaacctagcccacaaactggttttgtaactaaagttttgttggaacacatccttaatcattcgtttatgttttgtctatgtctgctttcatgctacaagagcagagctgaaaagttacaacagataacatatggcccatagcctaaattatttactctctggtccttttcagaaaacgtttgccaacctctgctttagaccatgagtgtttctttagcaattatctttgcttgatccatcccaccaccaccctgaatctagacaattttcagaaaatagcaagtgacaatagttttaactttttacacatggttagaaaatgacaaaaaagaccagttctttagaaacttcaaaatgcatctgaataagtaccctagacacacataaaacaacattctctgctcttgctttcatctaaaaaaggaaaagtcaacagaggtgttgagctaactctacttaaagatatggacttgagacagttcactcaagttcatgtattctggctttaccacttcctagctttgtgacctcgggtggatcacttaacctctatgtatcccagttcctccacctggaaaaatggggatagtggtaaacgtaactcataggagaacaggaatatctcattttatcgcatttcactttgttgcatttcatagttactactttttttttctaactgaagtgtattggttaatatgctgttataaagacatacctgagactgggaaatttatgaagaaaagagatttaattgtctcacagttctgcatggctggggagaccgcaggaaattcacaatcatggcagaaggcaccccttcacagggcatcaggagagggaatgagagcagagtggagggggaagccccatatgaaaccatcagatctcataagaactcacttactgtcatcagaacaacatgggggaaaccacccccaggattcaattttctccacctggtcctgcccttgacatgtggggattattataattcaaggtgagatttgggtgggtacacagagccaaaccatatcattttactcctggtccctcccaaatctcataacctcaaatttcaaaacacaatcatgtccttcccagtcccccaaagtctcaactcatttcatcattaactcaaaagtccaagtccaaattctcgtctgagacaagttccttctgcctatgagcctgtaaaatcaaaagcaagttagttacttcctagacacactggggatacaggcagttggtaaatatacccattccaaatgggagaaattggccaaaacaaaggggctacaggtgccagacaagtccaaaatccagtagggcagtcattaaacgttaaaattccaaaatgttctctttgactccatgtctcacatccaggtcacattgatgcaagaggtggactcccatagccttgggcagctccacccctgtggctttgcaggatacagccccctcccagctgctttcatgggtattgagtgtctgtagcttttccaggtgcacagtgcaagctgtcagtaaacctaccattctggggtctgaaggacagtggccctcttcttacagctccgttaggcaatgccccagttgggactgtttgtgggggctccaaacccacatttcccttccacactgctctagcagaggttctccatgaggaagccaccctacagcagacttctgcctggacatccaggcatgtctatacatcttcggaaaccttggcagaggttcccaaacctcaattcttgacttctgatcccccacaggcccaacacatgtaagctgccaatgtttgggccttgcaccctctgaagcaaaggcctgagctgtatgtttgcccctgttagtcattgctgggatgcagggcaccgagtcccaagactgcacaaagcagcaagtacctgggcctggctcatgaaaccattttttcattttaagttttgaggaaagaagctatctccataacataaaagtatggtgaagcaacaagtgctgaagtagaagctataacgagttatccagaagacatagctaagataatgaatgaaggtggctaaactaaaaaatcatcagcataggatgggtggctcacacctgtaatcccagcactttgggaggccaaggaggatgggtcacctaaagtcaggaattagagaccagcctggccaacatggcgaaaccctatctctatcaaaaatacaaaaactagccaggcatggtggcgggcgcctgaaatcccagctactcaggaggctgaagctggaaaattgcttgaacccgggaggcggaggttgcagtgagccgagatcactccactgaactccagcctgggtgacagagagagactgcatctcaaaaaaaattattcagcataaacagccctttattggaagaacatattatttaaaactcttaaatctagagaggtaaagtcaatgcttggcttcaacaactccacctgacaggctgactttcttgttaggggctaatgcagctggtaactttaagttgaagccaatgctcattgaccatgttgaaaatcctaggatctttaagattatgctaaatctattttgcctatgatttataaatgtaacaacaaagcctagatgacagcccatctgtttacaacatggtttaatgaatattctaagcccacctttgagacctactgttcagaaaaaaaaatgattctttacaaaatattacttcccatttaaaattcacctggtcactcaagaactgtgatgaagatgtacaaggagacaaatgttattttcatgcctgctgacagaacatcaattctgcttcccgtgggtcaatgagtaatttcaactttcaattcttattttttaaaaactatattttgtaaggctatagctgccatagacagtgattcctctgatggatctgggcaaagtaaactgaaaaccttctggaaagagactttcatgatttataggaagagatcaaaatataaacattaacagaagtttgaaagaagttgatgcaaactctcatggatgactttgagaggttcaagacttccctggaggaagtcacatcagatgtgatagaaatagcaaaagaaccataattagaagtgcatcctgaaaatgcgattcaattgctacaattttatgataaaacttgaatggataaagagttgcttcttattgatgagcaaagaaagtagtttcttgggatggaatctactcctgggtgaagatgctgtgaacattgttgaaataacaatgaaggatttaaaatatttcataaacatatttgataaagatgtttgagagggttgactccaattttgaaagaagttccactgtgggtaaaatgctatcaaacaatatcacatgccacagagaaatctttttgaaatgaaaagtacatcaatgtggcaaacttcattgttgtcttattttcagaatttgctacaaccatctagccttcaggaaccacaactctgattggtcagcagccatcaacatcaaggcaagaccctccaccagcagaaagattatgactggatgaatgttaagatcagccccattttttagcaataaagtattttttcattgtcagtttagacataatactattatatacttaatatactatagtatagggtaaacataacttttatatgtactgggaaaccaaaaagtttatatgatttgctttattgtgatattcactttgttgagattgtctgaaaccaagattgcctgatacctggagtatctccaaggtatgcctgtattatagccattgaatgaatttatgtatgcaatgttgggaagaggaactgaatcctataaagtattagttattactcctattcttcagcttcttcaaaagactgattcagaggtaaacagaatggtcgaaggtgagccctaagtataactgggtaaatttttaatgaatgaaaagcctgtggaatcaatgattattaagtattgttctacatttatttttagagacctctatgaaaataaaaaataaaaagtccgccaggtgcagtggctcacgcctgtaatcccagcactttgggaggccgaggtgggcggatcatgaggtcaaaagtttgagaccagcctgataaacatggtgaaattccatctgtactaaaaatacaaacattagccagacatggtggcacgcacctgtaatcccagctactcaagaggctaaggcaggataattgcttgaacttgggagggggaggttgtagtgagccgagatcacaccactgctctccagtctgggcaacagagcgacactccgtctcaaaaaaaaaaaaaaaaaaaaaaaaaaaaaaaaaaaaaactcaatgtcctctgacaacttgatgtataataccggacttctactattagcacaagaaaatgaattaaagatcttaaagatcttggtaagtgcagcatgtacatctgcacaaaaacttatgtagacagattgtgggagaggctctcctcccttggtttctctggcagtaccagagcatattaactgtaaagaacaggttcttctaacccctctaacactattgtgtctggtggtacccagctctgatacaatacactggcaatttctaaattggttctttacctcagggcttaataatgactaaatgacttaagcatttactgggaatgataatagttacatccaagctctgtaacaggaattattgatatttatagtacacatagaaataataaatgattgaagattcatactaagctggagtagctaaaattatgagtcttaaagccaagccatcctgggttcaaagttggcttccgttcactaccaaatgtaagcttgggcaatttatgtggtatctctactaactctgtttacaatggcataaaataataatactgatagtaccaacatcagtcactaagtcatgtatttgatgaatgtttattgaatagctactatgtgccagctactattggggttgagcatacagcaaataatacagatatgaaccccagctcttttgagctttcatttcacttgtgagaactaagcatttagtaccaggtatggggcacattaaattttcaaacaatgttaaatatcattaccattagttgatgatgatgatgatgatgatgatgacagttatgtctcattatggagttgagaataacacaatttctgtacgtgggaaatatttctggtccatagcccttaaactgcttccctcccacaggagtgatttgaactgagatttggaactcctccctgggggtctttatcgctatgtcccagtatttgctgatgcacttattccataataattcaaaaccaggtatttattaatatattatcaaagcattaaattcctttctatatatgctgaaaatatttctattcagctaaagaacattgtatgccttgctgaaatgtgtgtagaattacccacaaaagtcatttacagatatatatatatatatatatatgtgtgtgtgtgtatatctataaatagacagatatttatacatatataaatatatgtgtgtatatctatatatttatagatatatgtatatatatacagatatatctatctatatatatatatacacacatatgtgtgtgtacatgtatgtatctatgccagtgttagaaaaggaatatatggacaaatcagagtgtgattaggaggatcagttcatgtggaataggagtccaagttgtttaaggtgtcacagaggaggccacatagtggaggggatgagaagagtcagaaaaaagtacttccaaatctgattagctatcagtgggtttgtatttatatttttgccttaacttctacaaataattcctctcacaaaagtcattttggaaacttatctttcaaagttcgtaaaaacatcaatgattttagttatcttcacttaaagagggtaatttatcatctggtcaagggtgcatgtgtctgccaggaaagctgtgagccaacatacatcatactcagtagcttcaaggattcagtttgccttcttgtgtgtatttgaatacagaattcattttaatctgacattttttacctctcatcatatttttcttctaattaagttctataaatgtatcttctatccggtttgagctgtaataaattctttacttgaattggccttctgaaagtcacaaaccaacattatgatgaattgcaaaatgaataatttcccttccactgtgtttattttgagcagcaaaatgctggagaaaaatgaaacaatgtttcactagaaagaaggccatgcccatagtggttacatggctttgacctgaatgctgctaatgctgaagccagtagattcccaaaactgtgtaggtctaatttaaaaataatttttcagttgataattttagagtttaatgatattaatgtaagatataaataatgagaaatgttttgctctcatataagcctggagttagctagccatgttggtgtggactagagccatggtttctttgggaaatgtgtttcttaaaatccatattgcagaagaaaagaacaaggccatttatagaatagactaagggaaaaatgaacatgtgatcgctgttttttaaatcatcatatgtcttaccgcaccacattggcaagtaaatgtattattgtctttgaatttagatggccaaattgaaattgaacaatttgttactaatatttaggttggaattttaataggtgcttaacattggacacatctgttcccattacattgtaaggcatagatgaaactttatacaaataagattaaagcattgccatagctaaaatatcaggcattaaccttgtagacttttgattttaaaatagttgagctccagtattaaaatagccacagtgatcagagtccagttcaaataatagtgcttaatgtgttaatcattaatcttacatacttctttctcatttccctctatgcctttatagagtgggaattgccttatatcttgaattcattactgtaatttgtgtactgtgcattgactgaagccaatttaagtggtaatgtaggatagaattttagttccttcactttgtgtagatagtgggccatggagttaatgtttcatttatagtatttattacagaactatgataatgtggttatgattcatgatcttttcctggataatggctgatttaagacatattatagtttgaaaacaatgttgatgttctatagtaaccatgaccactggtccaaatatcccaacataaaaataccattggcataatttttcttcccttaaagaaaaaccataattactcttttcaaaccagaattagatatgcacaatcacctaaaccaactactttgtcttgcaaatgaggaatccgagatccagtgaagctgactagattgatggagatcagaaagctactagtgttagagctatagcagggatgcagaacctgcttcctcttattttggggccagtactctcaaaactatcctgccttgctaaaatcggataatcactgccatttcatttattcatattctgaaaacatttgctattatctccccataactcttttttctttctcctcgcgcagtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccaggtcagtgcacaggacccctagaaatagcctaatctctctaggaatgtgctcctttactctgtctgctcactctgctgtctttgatgatgtttttctttctgcaacaacacaccctgcactgaatttcaaagtgtatagacaaattcccctttggttttcagtatattgacttctgattgtttttgatatttggtacatgtaaaacttagtccacatgcttatgcatttaaccaaagtaataagcttctcaggacaagcattattaaaattccttgtgctcacgagccctgacaaggcacagagatttctagtcaataatgcatgccagaatttacctttgttaatctttggagttttccttttagaattaatttatgtaccaaaaaggatcagatagctgcgatcaatttctctaaaaattcagtgacacacaagatattaaaaagaacaaagcaatactgagaacactgggccctgtaatttctgaaattcactgaacctaaattcatttgtacctaaaagaccaagggcacagaagggagatcattcttaaagacacagatggaaaactgcccatagttccttgtggcccattgctactgccaatcctgttttctgctcatcatacttcttggatctgcttcgttctaaaactctctggcctgattacttttttaacccatagttcttggtgcttttctaaaccattcttttggaaattttgttcttgggaagatttcttatgatttattttcatgttttcactaaactccttttttaaatcagtttttattttatctttgctatgaatgtctatgaaattagataaaaaaattttatttaaatttagaaatttgtaagttaatgacaagggtaaactaagtttgtttttaacttttgaaaatctttccaaaatataatttatctttagtactagatgtttgaccctactttatgaacatgcagtgtattccgtatccagtatataaattaaacagagccttgccaccctctcacctcttaggaacataaaacccatgttgcaagcagagacaatacaattagaagaatagccaatcgcttatgtagctactgggcatactaatcagattttgataatgccctgttaccatgacagccagtgactcagagattttctcattagtgtttgaccagcaatggtccttttaatagatcttcctgttttcccattcaattactgaaattaatatgaggtgagatacatcattattcactcataatatgaatttacatttagcactttcttacggcagaattgtagtaaaatactgctatactgtttgctttttttcagtgcatgagacaaatataaggggagaaaataaatataaccataagtgtttttaaatgagagatattgaatagcaaatgttctttttgtagaattaataaaaaagaaaaaatgatcattagaaacaacaacaaaaaaagctctattttggtttatttgtggtgaaacacattctgaaagagtttatatctcagaccacaaacattttataatccttgtatgcaaaccaacactaaatagcaaatgaatatgaaaaaatatatatgtacctacagatagtgttgatagattaaaagttgttggaatttatgtttcctggaatttaaatttgtaatatttgacttttgctttggcttatgtgatttggtaagaaaagatagttaattaatgaagataatatatttcctatctcatggtatacttcatctataatttaaaatcaaacctaaaataagtttgatttaaatatgatactctaatctgtagttgattttttaatgaatacagttatagtcttcagagtccagctctgggctctggttgattctgctttcttgggagaggcctagggtggacacagtatatactaacatttactgtcctcctatgctcttcacacaagacacatatactttttcttatttttttctttcctttgcttttaacatttcctttatttttaatttcagttgcttctagttgaatattttctctaactgttagctggatgtattcctgactacaatggtagctgacactgtcaggcactctatcttctgcaatgatgacatatccaaattttgtttgggggtcaattattcttgacatgattgtggtttaccttgactgaccccaatcaatcttctttgtcctatttctcgtatcatagcagacatctcaagtgcctaaataataaatacaatagacatagtaatactcatatcagacaaaagaagattaataggtaaaaaaataaactgaggggataactaacacttgagaatccagctaatatgatgtcgaaatatataaaacaaaaaatctcgtaaaacaagatgatagtaaaaaaatgtaataatcagaatcaaagacttcaaggtatctctctcaacttttaatctgtcaagtaaacaaaatttgtagtggaattagaagaattaacatggtagtataattaacagtatatatttacctctgtacaaggagagaatataaattttttgagttcatttatggttcaattttcaaaaaggcataaattctttacccaaaatctagcataaattcctcatagtataaattatacaatccataatttatgaccaagattcaatgataaaaggaagtgatatgaaattaataaccatgaatgagattaatcacaaatttttaagacacatgtaaatgaatactgagtcaaagaggaactataaactttcattacatagttggtaaacagttaacaactacaacacttacgaagtttatgagatgtatccaaagccgtattcagagtaaaattcatagctttaaattctttatcattaaataagaaaaaaagaaaataagtggattatgaattcaaattgaaaaaacaatgaaataaaaaatgcaaaagaataaatcaatgaaaattagaaattaataatgagaatagaaaaaggatgtatatttatgtatgttatatacctatgaaaacttctgaacttatatatatataaaatatataaacatttgtatataaattttttatatatttatatacatataaataatatacatatatacatgcacatatatgtgtaaattcagaatttgtctgtcctcaaggggaaaaataatgaggaggtacaatacattagatatcctggaaaactgctgaaaatatattaataagtaagaaaacagtaatatacatagcaacttggaaggagatagtactatatacacagaaacttatattatatatatatactatatatatatgtgcttaaattttttaggaaataataaatctctgtgaaagtaaacattctcaatgctaaatcaagatggaagaaaaacctggactagattaaaaactgttgaagaaactgagttttaaagttttaccttgcatgcccatctttagcagttttatgagtgagtttttagaaacttaccaaaaagaaagaaagaaagaaaaaaaagtgttagaataaaacaggtaatttttagtttcattacctagcccaaggacagaaaaaataaaagggaaattcattactggttttaaaaataaagcataaacataattttaaacctaacggatacagtactcacatggtaacagagacccatttcactattttgaatgcaaaactttaaaaaatgatatagaaaatgaaagcagttgtatgtttaaaaagagcaatataccatgaccaagtaagaattgtactaggaaagcatgaaatatataaatgatccgactatgaggacatcatataataaattatacttatagatattggaagttactttaaaaagtggcataaatctagcaactatacctgttaacacacgtttgcatatattgttaggtcccatgtgttgaaattgattaggggaatggattttggaacagctaaaactcttaataagatctgccaggtgaatgtcaaacctggatgccatgaagcttaatgagtcaaaagcagaatggtgcttacaggaaatagttcaagaggggaacataaaaccaaccaggtaaaaatgtagacaatccccaaagtcaaaacaggagcaagggtccaagctaacatctgtctatggaagcttaattacttctccagttggtgtttactctctttaaatgttgactacatattttatttttttcccttaataataatgactactttttgttgaacactaacaccgtctaacatatttataactcaaaaaatgaatgtggaaatcctttaagttttatacaaatataatgcagactatacaaacagaaggcatttaaaaattgcaagtcttcaaaatactgcattgcctcaaaataataactatacacataactgattatttctatctattgtttacagtggaattggttctgtttttatctaagtttttaatttcctcagtaggacttgtctgtccagatcttttttaaggacatggataactttcgtcacagtgtaactcatcattattacatatttaccactagattaaggtcatatattggtaagataaagcactctttgcatttacttggtagactgatggaaatgttggtagctgttgaaagtgattcatcaatcattgaaaatggtaaatgaatggatcaatgcagggaatgtgcattagcactatctttgtactactgaaagaagaaaatgtacattgccaaaaagtgggagcataaacatacccttgtgcaaggtagaggtcatacgagtggctcgttttagaatgctagcctcaccattgccagtcttttcaggtttctcttctgcaaaatagaaagaataatgatgcctactttatagtttgattgtgaagactagtgttataatatctgaaaaacacaaatacggttgctaggcacacatatgttcaataaatgttagctatcatcatatttttcattgatagaaattttgagaacttaaaaagatagctcggccgtgttcagtggctcacgcctgtaatcccagcactttgggaggccgaggcgggcggatcatgaggtcaggagatcaagaccatcctggctaacacggtgaatccccgtctccactaaaaatacaaaaaaaaatagccgggcgtggtggcgggcacctgtagtcccagctactcgggaggctgaggcaggagaatggcatgaacctgggaggtggagcgtgcagtgagctgagatcgcgccactgcactccagcttgggtgacagagcaagactctgtctcaacaaaaaaaaaaaaaaaaaaaaaaaagatagctcaaacgttgttataaaactgtcagccacacagtgggctacgaagggaagaggcaattgtgttttctggattataccaaactctgttggaaaaatgatatgcaaccatcaacattagttggtaaaatcatgtctaaaattcatacccagtaaatgattaagatagttataaactgaaaaccaaattcaattgcttcaaaatgtatgttatctaactcttctcagctcataaaatgtaaatgttactttaaaattgtgccaaactcatcctatttttttttataaaaatgagaattttttttttattttagattttagattatgttttagaaagaaaacaaacttggccagaaacatcaacagaattccattttaaaatcatctttttgatttgtttttttgcacaatataaaaaatacagtggttgaacttccttatccacaggcaggttctatttttgtcccatttagaccagctttgggcaacaaaaacacagagttacataatcaatattcaggttaataatgttatatcagtaaaactcatgctacattacttaataatatattaattggtctttacctacaccagacgactgcttcataatagtaacataattttgaatgtaaatacaatgtccagttcaccagtgcttggagttgcattttcttctgtatgaccacagcttattatgtgaaacagcatgtaactcctcacatatctctataagtgaaagcagtgggattagtggtttaaacaatttcacagtgccacattttatcctgagttccctgcctgaggcagaaatagagctgacagcatcctgttaaacagaacttctacccttaggagctgattcatgaattgtgaataaatggacctctccaaaatacctcatgttctctcttcactgtacaggctacctattcacatatttatgtagtgcctaaaaccatagtatgaaaaccccttgacgagtacattatttagatttttaaaaatatatatacatgggactgggcatggtggctcacacctgtaatcccagcactttgggaggctgaggcaggcggatcacctgaggtcaggatttcgagaccagcctgaccaacatggtgaaacctcatctctactaaaaataccaaaaattagccgggtgtagtgacaggcacctgtaatcccagctactcgggaggctgagacaggagaatcacttgaacccgggaggcggaggttgcagtgagttgagatcgcgccattgaactctagcctgggcaacaagagctaaagtccatgtcaaaaaaaaaaaatatatatatatatatgtatatatatatgtatatatatatataatatgtatacacacacacatgcaaaactttttatttggtgtaagctggaagttaagagtacaaatttcaaattatttttaataatacagatattgatatactgtctctctaaaaattatgatgtcctctttcttcctgagctgcagaagtagctgttttcataatctggaaaacatagtagacttttattaagacaattttgacatgcctctgttaagtaataatattcaactttatattctttgcagaggtgtatattatgcttctgttcttaatatagttatcacctttatgtgaaagggctaagcattaaaaataacagcatactgctttgagtagtttttttttttttttgtctaattccaaaagtaatacaggatcatcatagagaaaagtgttaaaaagaaaataaatatttctcacagtcctacaactcaatgaaaaccacattttctttgtaaaaccaaccttgcaagtattaattttagctttatacacatttacaaatgcccttataataatgtccgtacgtatagtagttacctgcttaatatttaatcaactaatgttaaggagggaaatttggaatggagaggatctttagacatatctgtattggggaaggcctggtttgaatgttgatggcagttaccttttaaacagcaactaccatatgtcaagtattgcaattgtacgtagcaattataatgctatgtatatttatgatgctgctttctcttcctcagtttatagaaatactacatcctctgtgtcgtttgtattcatagttaaattgaggccatataactgatctctggccagcgaaatgtgaatgaaagtcacattttcagctgttgcacattgaagagcaaagtttacctccttcaggctctcttcccttctcttcagaaccacatagctttatacaaagacatagctttataatggcataagactgcttgctttctgttgaaatgggattataaccaagacaaatcaagatatctttgttatattaagccttataagactggacggcttgtctattgtggcttgctagtgttaactatcctctgaatttatgtattatgtattatagataaatttatgtattatagataaataaataaatttcaaggcactgcccaagcgctttcctccacgaagtggcagaatctggttatacacaagatgcgacttttaaaatcagacttattttccagtatgggtgtggaagagtatttgctctgttattttacttaaactcccagcacctcagttgctcatttgaaaaggatggtaatatatatcaaaaggttttcatgaatgttccacgagaaaatatatataaagcattcagcacagttctgatctcagaatcagcatttggtaaaaatagcattattatggttgttgttgtttggcagaagtaggattctaacctaggtctggtttgctgtaaaactagtattgcctctaagtctattggcctgtctctctttttgtagaaagaaaataatttttaaaaaacccataggaatgctataagctctttaagggcaaggtctagatctcacccatctttgtatccctgggacacagaaggtaaactgaaacattatagagaatgagaaaatatttgttgaattagaataaacagaattgaagatgcgagaccagaaatgtagtcactttctttcatgctcccagaaggtattatgtaattttagggacatactcacaaatatacacatacacaaacacacacacataccattcattatttctgaaatcactttatcagaagaacctacaacctagtattagtcctgcattggacaaaaaatcctaaaatacaaaatcttctatgaataatattacaccaagaataaatttcagtcaaaacccaataatagaagcacttccagaatggcagaataaggacgttcaaaaatatattccttcataaaagcagagagaatatggggggagaggagggaatgttaaaatccacttttttggaacacaggaacttaaccaaaggcttacatcaactcaaggagcacttattcaagaaaaattgctgaaacttactaagaagagtgaactcttttatgttttaactttctccagtcctaaatagaaaagctggagagtgaaatgtccaaaggggatttgaagcacactgacatatttctaagactatggaaggacacatacatgcaagcggagggctgtgcacatgcataggaaagacttgagaagggtctaatctcttgcatctggttgacctcaaggacttgcacaagcaggaggtaaaggctaaggctaagttgtaaacttccagaatgttaaagatgtgtcctaacatgcacacagagacacttgccaaagattgggtgacttactggttcaaagcatttaatgaccagttgaccaatcattatttggctattaagctaatctagaagaaacttctgtgaccacaccaaacatggaatacagactttactgaattacctcaggaaattcacacacacacacacacacacacacacacacacacacacacagagagagagagagagagagcaaacagcagtaaaaacaaaccttagaaggaagcctgattttcagaaatttcaaattatttaaaatgtcaggttttaaacaatgtcaaaaaatagaaaacatgaaaaggatcaggacaaagaacaaaacttatgaatatgtcatgttatatgacaaagtgccattaaagttgcaggtgtgatggaaatctgtaatcagctgactttaagataaggagattatctttgattatctaggttgacccactgtaatcacaaagttcccttaagtgtggaagatgaaggcagaatggtcagagtaagagtgatgtgacatgaaaaagggattctcccctagagagacaagagagaaccagctcttataacaccttgacttcaatccaatgaaacttattttgtacttatggcctccagaactgtaagagagtaacttcatgttatgttatccactaagtttgtggtaatttgtcacagcacaaaaagaaaacaaatacactattcttccacaactatagttgagttttctatactaacctcctgtcaatatacaactttgatgagctcatttattaatttaaaaaattttagtatattttttagacttctctatatacaagatcatatcatctctgaagagagatcattttactttttcctttctcatctagatacctttgattgtttttttgttatcaaattgctctggctcgaacctccagtgcaatgttgaaaagaagtgacaaatgaagacatccttgtcttatttttgattttaggtaaaacgtgatcagtctttcaccgttaagtatgatgttagttgtgggatttttgtagatgcttttattaggttgaagaagtttatttctatttctagtcgaatatgttgatcatgagaggatgttggattttgttaaatgctgcttctgcatctgttgaaatgatcatttggtttttatcttttattctatcagtgtggcctattacattgatttttgtatgttgaaccaaccttgcattcctgaaataaatgctagttgcttatgatatacagtcatttatatatgttgctggatttggtgtattagtattttcttgatgacatttttatctgtattaataagagacatgggtgatgcctttttcaggttttggtattagaacaatactggcctcacagaataagttaggcagtgttccctcctgtcctattttttggaagaatttgtgaagtagtagtgttaattcttcttaaatatttgggaaaattcatcagtgaagccatctggtcttgggcttttctttgtggaaaggttttgattactgattcaagtacaagaatttgtctactctatccaggttatctaatttgctgccatttttttctcatatttgttgccatgttgttaacaatttcccttataaatcctttataattctgtaaatctggtaatgatgcctttatataattattgattttaataatttgagtcctctctatttttttgttgctcagtagagctaaagtcaattttgttgctcttttcaaaaaatcaacttttattgttgaattttctatatatttttaaattcttttatttatttacattcaatattattttcttctgcttgatttggatttatttttctcttctttttctacttgcttaagatagaaggtttggttatgatttgagatatttgttctttttaaatgtaccatttacatctgtgaattttctttcaagcaatgctagaattatcctataagttttcatatgttgtgtttttgttttcattcatatcaaaatattttcagatttcccttataatttcttttttggccgattggctattttaaagtgtgctgttccatttccatatatatgtcatgtgctgcttaatggtgaggatacatttgataaatgcatcattaggcaatttcatcactatgcaaacattggagcgtgtacttacacaaacctagatggtatagcctactgctcttccaggctatataccatagactatacagactatagcatattgccattgctattgctcctatataacaaacttatatagttactgtactgaataccatatacaattgtaatataacaatattttatatagaaacacagaaagatatagtaaaaatacagtataaaagataaaaagtggtatacttgtttagggcatttaccatgaatggagctttcaggaatggaagctgctctgggtaagtcagtgagtgagtggtgagtgaatgagaaggcctaggacattactctacactactgtagactataaacactgtacacttaggctatactgaatttgttttaaaatcatttttcttcaataataaatcaaccttagcttacgtaaccttttactttataaactatttaattttttaactttttgattattttgttaacagtttgaaacacaaactgtacagctgtacaaaaatattttgtgctttttctataaatttttctctattttttattttcaaactttttgttaaacacaaagacacacacattagcctaggcctacacagggtcaggatcattaatatcactttggcccacttccacattttgtcccactggaagttcttcaggggcataataatatgtaatatacccttaaacaactagcagtgcagtagatttgtttacaataacatcaccacaaacacatgagtaatgtgtagccatatggcattatgaaggttatcatgtcactaggccataggaatttttcagctccattataatcttatgaaaccatatcatatatgcagtccatcactgactgcaatgactttatatggcacatgactgtgccttattccattggccaaagctcagagggagggattgtggggactatgaagctacagggttaagggcttggatgcaggaagaagtggagaattaggaccatttttgaactctgtcatttatatgcatgggatgaccatacatctaggtttgcccagaaaagtcccagtttattcctgtcatccttatagaaatattattttttaagaaagagaatcttgctctgttgccctggttggagtgcagtggtgcatcatagctcactgcagcctagaactcctgggctgaagcaattttcctgccttactctccatacgacctgggactacaggcacatactaccacatcaaactaattttttttttttttgagacagggtctcactttattgcccacgctggtctcaaactcctggcctcatgggatcctcccactttgaatcacccccttgttactctaaaaagtgtcccaattttaatgataaattatatgggaactctacatttggagggttttaaatagaatggatgcactcattgaaaaaatctgtgaagtaagcagaagaattaagataagtttagagtccatcaaagaggttccaggaagcaagagatgagccaaaacagaatgggtctgaagaagcgaaaagggatacatgaaagagggctaaatgagaaggtcaacagcatcaaggcatagactatcaaatgaatgtgtctgttgtgtttgtcaactagaaagttttttactgactatgatgagaggcttcataggagtggttgcagtgaattaaagagtcaactaattcttgctctcacactgatttaaaaataaaactttaatttcactcttttgggtcttacatttaaaacaaaagggaccagactctgcggaattgagatcctctgagtgttaacattttcaggatctgaatactaaatacagatgccagactaaaaccaaatgtgtaagaaccaagacctgtagcttacatttattctctatccatcatttttgacactaaataaaaatgatctggtgtgtattcattgggaattattctgattttattttattacggctgtaaattcattttccttcacgtatttgatgtctttgattgatgcaaaactcaataagacttactgtagttacattaaatattaaccagaacattattttgaaacatttgggaagctgtgacatctcaacctgatccaaaaccttagtatatatattaaacacagcaactaaaagacttgccaagatatgtttgacaattgtcctaactttgatgaagaaaataagaaaataccagtttccccagtagagagtttactgtgaaaagcattgcagatttgacattgcgtgaaagtttccaactataagcaaatgcagacttaatggcagtaaatgacattaaattttttaaatgacaaaacctgcatttgaaatgtaggtacataacttttagttatttgaaacttcaaggatagctaattggctaatacataaggggacagaaaatctgactagtattaactttgaaccaaaaaaaaaaaaaaaagaagaagaaaagaaaagaaaaagaatctttgtgtagttgaatccttatcttggctgttacttacacattgcaaacctattttgtatgagtgcacatcaaattccctttgggattctcaatttcatttattttatcaataaaaagagcctccttgtggagaaaggaataagtcacatataaatgaagtagaagagattacaccagtacctgagcttttactttgactaatccaatagctttggccaaatatctcaatgtcaaaagcattataagtattctacgacgtaagtctggaaaagagaaattaataagaaagtattggattgattaaaatgtttacttttcccctccatccttccccttctcaagcttaatggctctttctcataccaatctgatctttgttatggttattggctggccttgtttcttgttataactccacatctagaactcatttctgcatcatatacttttctgtctctccataatttcagtattagggtcctcgctcagatgcatgtcctttgtcactgaacttgacgacaggctttaaagagattttacaagtcccatttacacaaattatttattttggtcttcaacaatgttaaaatgcatgatgtaatttttatagaagagaaaacatgcttagcaagataattctgccaaagatttctctgcttaactatatagttaagtcttttcaactattttgctcatcaaagatcttgtacatcatagaagattctagaaaagtgaccttgatatttatcttgcacctcagtgcctttaacatgtactttttctgcttagaatataccccaaactcttttcttcatcctttttaatgtgtcttcagggctgagctttcaaatccacttattaaggatatctttccccaacccttaaattattatttaagataatttcccagataagtttttctgtttatatgtctttatcagaattatgatacatgggtttttttgtttgtttttatttttgagacaaggtctcactttgctgtgtagtcaggagtgtggtggtgtgatcttggctcactacagcctcaacctcccaacatcaagtgattcttccacctcagctccccaaaaagctgggaccacagtcacacgctaccacacccaactaattaaaaaatcatattttttgttgagatgagatctcactatattgtgcaagctaatcccaaactcttgagttcaagtgatcctgctgtcttagcctcccaaaattctgggattataggcatgtgccaccactcccatccacataaggcattttttatgaatgcctgtgttctctactgggttgtgaacttagggagaggatgaggataccataatatccacttatgtatttccaacaccttatggcactgaaaaactattgtcatctgactaatggtctagttgccattttagggcctcatgatctcatttatgaatcatgacacaaactgccttattttccatgtgccaatctcaattccatattgtccaggcctgactgatttgtgatcttaaaacatggattttatcatgttacattctgcaaccacactgtcactatctgttatttatggaaagacaaaagtgatactcagtgtatcattcatgaccctccatagattgacctagatcaaatttctgaccttgtcataccctcttctctccaacacaagcactttgtctttgccatagtagctgatagaatggattcagaatacttcttcctgttcatctttattttgactttctacttgtgttcttactcattttgaattctctctaccttcttactagtttatattattgatataataatttcttttcatttgggtagatacctagtagtgagattgccggattgaatggcagttctatttttagttctctgagaaatcatcatattgttttccaaagaggttggactaatttacattcccaccaatagtgtataagcatttcttttccttcttatcattgccaatatttattttttgacttttaaataacagaccttctaactagtttaagatgctttctccttgtgtttttaacttgtatttgtcaatatgctttttggccacttgtctgtcttcttttggaaaatatctattcattttctttgcccactttttattggggctattgggaatttttgttattgcggagttttttgagttccttgtaaattctggatatcattaccctgtcagatacatagtttgcaaatattttctcccatcctgcaggttgcctgtatactctgttgattatttatgtttctgtgcagaagcttttcagtttaattaagtctatttgtctagtttggtttttgttgcttgtgcttctgaggtcttagtcataaattctttgcctaaaccaccatccagaagagttttctctgttttcatcattttaatagtttcgagtgttacatttaaattcttaatccatcttaagttgatttttgtatatggtgggagataggggtccagctttattcttctgcatatagcaatccagttttcccagcaccatttttgaaaagggtgccctttccccagtgcatgtttttgacaacaactttgtcaaagatcaggtggatgtggatgtgtgatttaatttctgggttctctattctgttctgtcaatctgttgtctattttgataccagtacaatgctgttttggttgctgtagctttgtagtataatttgaggtcaggtaatgtgatgcctccaaatttgttctttttgcttaggattgctttgtctatttgagctctttttttgattccatatgaattttaggatttttttttctaattctgtgaaaaatgacattggtattttgatagagattgcacttaaactgtagattgctttggatagtatagtcattgatattcattcttccaattcatgcgcatgagatggttttccatttgcccgtgttatctataatttctttcatcggtgttttgtagttttctttgtagagatgttttacctccttggttaaatatatccatgggggtgtgtgtgtgtatatacatatacacacacacacacatatttgtagctattgtaaatgagattgctttcttgatttaattctcagcttgatgattatcagtatatagaaatgctactgatttatttttaatttcagcttttattttatacatagggagtacatgtgcaaggttattgcatgggttcattgtaactaggttgtgagtgtagtacagaacaggttgtttttcaaaccatgaccttctccctccctccccctccttgtagtctgccatgtctattgttcccatttttatagcagagtgtgctcaatctttagttcctacttataagtgagaatgtgtggtatttggttttccattcttgcattggttcactttggattatgacctccagcttcatgcatatagttgcaaagaacatgatttcattcctttatatggctgtgtagtattccatagtgtgtgtgtaccatgttttatttatccaatccaccgttggtgggcatctaggttgattccttttctttgctattgtgaaaagtgcagcaatgaacatatgagtgcatctgtctttttggtataatgatctcttttcctttgggtatatacccagtaataagatagctaggtcaaatggtagctctgttttaagtttttgagaaatctccaaactgatttctacagtggctgaactaatttatattcccacagtgtataagcattcccttttctccacaacctagcaatagctgttatttttttacttttagtaatagccattctgaatggtatgaaatagtatttaattgtagttttaatttgtatttctctgatgattagtgatgatgagcattttttcatgtgtattggctccttgtatgtcctcttttgagaagtgtctgttcatggcctttgcccactttttaatgaggttacctgttatttgcttgttgatttgtttaagttccttgtagattctgtatattaaacttttgccagatgcattgtttgagaatattttctcccatttctgcagattgcctgtttactctgttgatactttcttttgctgtgcagatctttagtttaattaggtctcacttgtcaatttctgtgtttattgcaattgtttttggcaacttagccaaaaattatttgccaaagctgatgtcaagaatggtatttcctaggttttcttctaggatttttatagtttgaggtcttaacatttaattctttaacacattttgagttaatttttatatatgatgaaaggtaagggtccagtttcattcttgtgcatataactagccagctattgcagcaccatttattacatagagagtcctttccccatcgcatatttttgtcagctttgttgaaaatcagatggcagtaggtgtgtgactttatttctgggttctctattttgatgcattagtctatgtctctttttgtagcagtgccatgccatttggttactgtagctgttcagtatagtttgaagtcagataatgtgatgcctcaggctttgctcttctttgtttgaatgacctgttaaggctcttttttggttccgcatgaatttttgaatagttttttcctaattctgtgaagaatgatgtttgtagtttgataggaatggcattgaatctgtaaattgctttgggcagtatggtcattttaatgatattgactctcccaatccatgagcatggaatgttactttgtgttgtctgtgatttgtttcagcattgttttgtagttctctttatagagatatctcatctccttggttagctgtattttcctaagtatttcattttctttgtggctattgtaaatgagattgtgttcctgatttgactctcagcttgcacattattggtgtataggaatgctactgatttttacatattgattttgtattctaaaaccttactaaagttgttttatctatcagttctagcagccttttgacagtcttcagattttcctatatgtaggatcatatagtcagtgaagagagatactttgacttcttctttttctctttggatgctatatgtgtctgtttttatactgctataaagaactgcctgagactgggtaatttataaaggaaagagatttaattgactcacagttcagcatggctggggaggcctcaggaaacttacaatcgtggcagaaggtgaagaggggaacaaggcaccttctccacaaggcggcaggaaggagaagtgccaaggcagggggaacaaccccttataaaaccatcagatctcttgtgagaactcaccatcccaagaacaacatgggagaaactgcccccatgattcaattatctccacctgatctcttccttgacacatggggattatggggattacaatttaagatgtgatttgggtggagacacaaagcctaactatatcagatgccttttatttctttctcttgcctgttttcagtactatgttgaataggagtgatgagcataggcatacttgtcatattccagttctcaagggcaatggatccattttttgtctattcagtatgaggttggctgttggttcatcatagatgattcattattttgaggtatgttcctttgatgccttgtcttttgagagtttttattataaagggatgttggattttatcaaaagctttttatgaatccattgaggtgattgtgtgatttttattttaattctgtttatgtgttaaattatatttattgatttgcacatgttgaatcagccttgcattacaggaataaagcctactacatcatggtttgttaatgttttgatgtgctgctggattcagtttgctagtattttgttgggaatttttgtgtctatattcatcagggatactgacccaaagatcctttttttatttttgtttctctgccatgttttcatattaggctaatgctagcttcatggaatgagttagggagcagcacctggtcctcaatttttggaatagtacctgttcttctttctatatctgttagaattcagctgtaaatataacttatccatggctttttgggtttttttctgtattcaatttcagattttgatatttacctattcaggattttaatctgttcctggttcaatcttgggagattatttggttctagtaagatatatttcctctaaattttctaatttgtggaacagaattactcacagtattttctgaggatcttttgtatttctgtgggatcagttgtaatctcatatttgttatacctgattgtactgatttgtatcttctctttttttgttaatctagctagtggtctattcatctaattttttcaaagaacaaacttttggtttcattggtcttttgtttgcatttttgctttgcaatattatccagttcttctctaattttaattgtttcttttcttctgctagctttgtggttggttgtttctttgtttttgtttttctttttgtttttgtttttttgagacggagtctcgctcctcttctcccaggctggagtgcagtggcgcgatctcggctcactgcaagctccgcctcccaggccattctcctcctcagcctcccgagtagctgggactacaggcacccaccaccacacccggctaatttttttgtatttttagtagagacggggtttcaccgtgttagccagttcctttaggtgcaaaggtagattgttaatttgagatctctctaacttcttgatcaaggtgtttagcaatataaactctcctcttaacagactgcattagttacatcccagagattttggtatttgtttgcctattttaattaatttcaatacttttttatttttgccttaatttcagtgtccacccaggagttattgaggaccaagttgttaaatttccatatatttgtgtagttttaagagatctttttgatattgatttctatttttattgctctgttgtctgagagtgtgcttgactcccagatgattttaatctttttttaattgagacttgcttcatgaccaattatgtggttgatcttagagtatattccatgtgcagatgaaaaagaatgtgtatgttgtggttgttcggtagaatgttcagtagatgtttattaggtccatttgcttaagtgtcaagtttaaggccagagttcctttgttagtattctgccttgatgatctctctaatgcagtcagtacagttttgaagtctcccactattatagtgtggttgtctagaccttttgatatgccaagaagaacttgttttatgaatctggatgctccagtgttgggtgcatatatatttggggtaggcaagtctgcttgttggattgcaccctttatcattatgtaatgccttccattgcccttttaaatttttattggcttaaagtctattttatcaggtatgagaatagtgactcctgtacttttatgctttctgtttttatagtagatctttctctgtccatttactttgagcctgagtccttacatgtgtgatatatctcttgaagacagcagatggttgggtcttctctttttatccagcccaccactctctgccttttaagtggggtgtttagcccatttacattcgggattagtatggatatgtgagatttttattctgtcatcatgttgttagctggttgtcatgtagatttttattgtgtgattgtttcctagtgcctatgggctatgtgcctaagtgtgtttttgtggtagcaggtgtcattcttttgattccacatttagctttcccttaagaacctcttacaaggctgatgtagttgaaatgaatccctcagagtttgcttgtctgagaaagattttatttctccttcccttatgaagattagtttggtggaatataaaattcttggttggaatgtctttcctttaaggatgctaaaaattgtcccagaatctcttcttgcttttatggtttctgctgataggtctggtgctagtttcttccatatgtgatttgacccttctctctagctgcctttaagatgtttttctttttcattgaccttgatgaacctgatggctatatcttagtgatggttgtcttgtgtagtatctacgctgttctccatatttcttgggtttgcatgtcaacctctttagtgaaattagggagattttcatggactgtatactcaaatataatttccaagttgtttattctctctccttctctctcaggaatgccaatgagttatagactctgtctcattatataaacccatatttctcagaggttttgttcatgttttaaaattgtttatttttatcttactgtgttgatttgaaaaactgatctttgagctctgagcttctttccttagcttggtctaatcttctgttagtacttccaattgtattatgaaattcttgtagagaatttttcagctttagaagttcagtttggttatttcttaaaatggctatttcatctatcatttcttggatcattttactggattccttggattgagttttacctttctcttgaatatcaatgaccttccttgccatccagattctgaattccttgtttgtcacttcagtcatttccaactggttaagaatcattgctggggaggaactggtagactcctttggaggtaaggagaccctctgtctttatgaattaccagagttcttgtgctgatttttgtacccttaactgtagtttaaatatagtcagttggtttcatttctggatgtttttagacagccaatatgctctctgtagggtctttatctgtggctgatttcttgcctttgtttcacagaagggtatattagcaaagtatttttggtgttgtagtttgggctttcatccagaagatagcatttattagtaatgaccagtagatatggttatactcaactgcatggctcctttatatttcctagtatttgtagccatgaactatagtgtgttgggaagagagttcacctcctcaccaggtccattcttgggcctttgaggagcctctgctactgatttgtgcacattgattttgtttccttaaactttactgaatttatttatcatatctactagtttatcagttacaaaaattaattagttacagttggtgttcttttccgtgagacttttctttcatttataactggttttcatttcctttctaatttaaaggagcatatttaacattccatcttaaggcaatgtgatagccatgaggtctttgtgtgataatggtaaaaaggaagttaatctataatggaagtcaacagtagataaggaaggagtattccttggtacccttccatcatttacaacgtttcacaaaacaattcaggtaagaaaaatggcttaatctatgagataaaccttacagtatccatagttacacatacctgtcatgtgattcagaccctgtaattcacattcccttgacgctcaaaataattcagagatccaacagctgagattctgaattacatatttttacaggattatagttttacatgacctggaagtcttcagaatgaagaccaaaatatacaggagaaactctatttttatgcttagcttcaataaattatagacagccatgtaaaaatatgattggataaaaagggtatgatctagtgctaattttctaagtagggaaacccagcaaagcatgcctgttttggtttttcgtgacctctctgtgcagcatttcccctttctgggtatggtagaagattctgtcaggattggaatcttatgacctacagtcaaacaaggtaggtcagataatttctctgtggccaatttttacacagaaaggctaggagaaaattagagtaatatttttaggttttgtggttggcttttgagaaaagacgttctggtttctatgtcctgcctccatggggaacggatattcagaaactagaatccctttggcctgggcaggaggagagtggtggcgggtagaatgagcagctagagaaagaggggcattaagcaggaataggtcagagaggactattgattctgaggctgtatttgaggactgcattttaaggtgtcactttctgatccccaacactggccttgttgaaaaaacaaccacagcaacagtagcagcagcagcagcaaaaacatgagaataaaatccacccaaacaaatgatgaattgagatgcagtgacgaaaggattggtgtaatgcttaatgccaaaaaatatgagaggagtgccaacaaacttctgaggggaaacaagcaactatcacagcaacaagtagatctcaaatgtattagaacttgagggcatatgacttataaaccgtttatgaaaaaaaaaacttggaaatcaaatttttccaaccaaaaaaaatgaatcaaaataacacaggtgaaagaaactgtggataaaggactcatgaagatgactaaaaccatttaaaattagaacaatggacactatgctggtatatatcataacagttggagagaaatattaaaattatcaaaatctggtaaggagtagaagtttaacaattctgatttttatgtgctttcagagctgggagttggaagaaatgttataaaagtgaaatataagattttttttctatttttaaaactttaaaattttgttaatattttagacctacataagagttgtaaatatagtacagagagttctgatattgtcttcagtctgtcttaccctaatgttgacatattacataaccacaatacaattaacagaataagaaattaacactggcatcatacttttaactaaactatagacttcaatcagagttctccagtttttccattcatgttgtttctctgttcctgaatcctatcaagcatctattgttgcatttaatagtcatgtttctttcatctccaatctgtgacagttcctccattgttttttcgttttgttttgttttgtttttgacaatgttgacatttttgtagactactggttatgtatttcgtaaaatgactctcatatcgtattcgtctgatgttttctcctgattaaaattagagatttctgagatgaataacataaagatgatgtgtcttcaatacatcctatcaggtgatgaaacatgtaatttaaaaaatattaactactaaatgttttcataatttaaaactggaggggaagaaaaatgcacttgttcaaaactttctgcagtttaatttaccttttttcaggtgaattcagatcatagtaatttttagcaaaatattgtaaaataatatagagtatgactaattttaataaaaatttttaaaattatatatatatgttttctatgtatatatctacatctatttccagctgccaacatgtaaagaaacaattctaagatccattttaggaaatattgattatagatattaacggatggtagagtttgttatgtattattaaattgtactttatcttttccactttttctatttaggttgttgcaaaggtaattgcgacagttacttttgcaccaacctaatatgtacttttctgttctgatttattttaatttgcttttagaaagatagagttattgtttaaacaaaaattcaatgtttttgagcatatattatttattttgcatttttatttagtttgtatttctttcagaaacacaattctggaaagatacaacagtgtttaccttgaaggagcaagaactgtggatgctttgaatagacttatgttttcttatttgtgatgtgaacttttctacaagggaattatattacctttcaaataagctacatatgttactgtttcataatttctttatttttccatggaaattatttaacattttattttctgacaaagctcctgtttataagttatattttctgacaaagctcctgtttataagttagagcattcagagatttacttagaactatcctcagcttggccacttctatatggttttgagaaaagttaggtacattattatctcttaaaaaacttaaattagaccacaagctagttttgaaataactcaactgaggttattctttgatgactgacagtacaagagaattgtcatacactcagttattagttctttagacaaataaatatttaataaataaatatgttatatattatacatattaataggacaatgtaagtacacatgaaagttggtggtggaaaaattgccattgttactaatgctgtctcatgtctaataatgatagagctggaaaacagatgtttttctaaggcaaagaatttactcctaaccttttcttttatattgacatcatattgccattgtatgtcaggtaactgagtggaaagagagaatagagctgagggcacatacaattcatttagaattattctagtgagatgctcattagactagaaaataaaaacatatttggaggaaaacatttcttccctcactcctacaagggataaaaatgctaatatagttctcaatgcacagaacgtaatcaaatctacttcatagaactgatatactactggtatgaatgacctgtgatgatatactgaatttttgctttaatatttgttcttttcattgtttactagttttaaaacaccataaaatatttattaaaaaacctttaagggatttttttaaaggccatattgtaaatgtctttgcattaaacatttcataaggtatatttccaaatcttaaacaactttgctgtttgagtacaatatcagtaaatggcactttaagaagatagaaagccatctgcatccaaaatataaattaaaattatatgtaaaataaatcattttaactttagatagaaagtaacaacttaaatcaccttctatatagtgtataaatatatcatctaaaagatacctaaattttgatgtaaaaatgttctcaatatattttaccaggctgagaaaatcttacaagaattatctaggtatgtaatcattatattaaaatgccaaagacatattagacttgtggttatatttccttgggcaacaaaatagattttttttttaaatctatgtgtcttttaaggtaggggaaatagtaatgctgacaacaaagttttctcactaaatatatctgttcttctttgttaatatttacagtcaaagggggctgttctctggccaacctgcacccaggtgaaataaacagccttgttgctcacacacacacacacaaaatatatatatacatatacatatacacacacacatatatacatatacatatatacacacatatatatacatatacatatatatacacatatatatacatatgcatatatatatacatatatatatacatattttttaaccgcccacctatgtaaagtactctaccacatctgacaagttgagaaaaatgatgacatcaaatgttgcctatgggaagcctctaatcaactaaatatctcgacttcaacactcaaatatactgctacagcattgtaaagtgttttgtaccctctgaatataatactgtaaaatgttctacattattatttgaagaaaattgttgaggaataattttacagtgtgtaaggtggtagatgcagatgaaataattataatatgaaaatattgagatcataaagtaatttcccttgtagttacctttatgaaagttgtacgattgagtttaatttcaataaagcaacatcagccataatttagtgtcctttaagtgaattaagcaatttcaagccttataaacatgttcaagttcagtgagaaggacactttttagaaaatttctaagctaatgactttagtggcattggtaaatatccagagactgtgtgaggaaaacacccgaatatagaactgtaaaatctaaatagagaaaccattgtgttaaatctgaaaacatattagtaagtgacattttcctttaagtaatcttattgtatttttcgtgacattcaattatttatttgcaccaagaaatattgttcaggacttgaagactgagtaaatgtgcgtgagctacacaaaatatattttgttattagtaaatcatctattataaaactgagaagtctcaaaagtaggtaatgggaaaaaagtgtttccattgtttgctttcttatttcaaatatctttatgaaaaattcagcattttaataataaagagcaataattaaagatgactgttatttattattttggtagacagaaaggatggtttcatttatatttgttcaattattttctttaactcttattctatatataggccagttgtattttttgttttgttaattagctgcctattaagttttcttgcataattatattcagtttgtatgaactagttataaatcaaatatatttctttttatttataaaatagcagggtgttgctttgctcatctatcttttcattagttaaattttgatgtgttaaagtttggcatttgatgtagtttaattgacatcattttgaggaggtggggaatgaagagatttttctctatgagcatacagcttagaaagtcatcattccaacttaacacttgattaatattcaatcacttttttaatgttattttaaaatcatgttttctttgaagactttctgaactttgaaatacaatttttaatttagaaatcattggtatttttctttttgttttaatttttacactttattaaacatcattttataaacacagaatatacattaaaaagcataataacaattttactatggttatttctgtcattaatgggtcgctattaagagtttcaggtagtgctaatataattacaattcttaagtcaattgatggacactttgaatagagatttaaatgaagaagtttatcattggcatgcatgctgtatagtcccaaatatctcaatcctattatattaaggatgagtattatattggagtaatattttatggctttcaaaatatgttttaaattgttacttttagagataccaaccataatacctaatacctaagtaggcagagctgtagatacaatcattctgaggtgatctgaccctacactgacaataacagttgtcagtagagatcattgaaattcatatttttctactttagatgaaatgtattttgaatgtcttagctggtattcaaagaaaaaagaaaagatgattaaaagcaatacaatcataggaggcttccagttccaaaattgtgatgtagatggaacctggcttcacttcccctaacagaaagccgaaaacaaatatacaatgccaagattatcaccagaaatatcccagaactcaaataaggaaatgagaattcctggggccacaaagaagtgtaatattaataactctaaggagatggtaagataataggacttccacatctgcaatatctgtcccctcattctgcctgcctccaggtgaagagaaaaatttttcccaattcactgtttctgcactggcaaaactgagatcaagatggacaaccatcttccccatcatattgggtagcctggcaggagacatgtttctgtttttactcacagaaagcattacaagtacttaaagggataaatatcactgagaatagccagtgacaaaggatggaggtagaattatcatccccagacctggaaaatgtaatctgtaatttggagatgtaatttgccaaaggagatgccaaatcagaatgactgtatagcagcaccacacgaaaggaggttcatctaataggtccctagaacacaaaaccctagacagccttcctccctgccaggacatcccctttaggaccttctccacttgggaaaggcagcactttgagcttttactagagccaaggcaaacctgggctgaaggctaccacccagagctgaaaaggaggtgatgacctagcagtaaaaatctgtgaggaaatgtatccaataaaaatcaaaacaagcaagacagagaagactgaaataaatacctaatctttcaatgcaaagacacacatatgtgtctacaagaaataatagcaaacaggaaaccatgatttccccaaacataaaaaacaaggaattaataagtgactccaatgagatggcaatatgtgagctctctgacaaagaattcaaaatggtagttttaagaaagctcagtgatctgcaagataacacagaaaagaaattcagaaatatatcagaaaaatttaataaagagattaaaataattaaaaatcacacagaaatcgtagagctgagaaatacataagctgaagtaaaaaattcatcgaagactctcgatagcagaatgaccacgcagatgaaagagtcagtggactcaaacacagcctacttaaaaatatacagaggagaaaaaagtctaaagaccaaaaaagatcacctaaaagatatagaagagtacctcagaagactaaatttaagaattattagtgttcatgagaaagttgaacaatagcaagtggcagaaagcttactaaaacaaaccagcatatttttccaaacttgtgtggagaaaacacatgcatgtaagttacatccaagcacacataggcgaacaacatcatacagatttgacaaacaagactacccaagacctatgataatcaaactctcaaaagtcaaggaccaagagtgaatcccaaaaacagaaaaagaaaagaaggaaaataaaaaggagttccagttcacctggaaacagacatctcaacagaaaccatacaagccaggaaagagtagaatgacatttctactaaagtgctgaaagaaaaagaaaatcaccatacaagaatactgtattcaacaaagctgtccttcagctatgaaacagaaaaattctttcccagacaaacaagagcttaaaagagttgatcaccaccagatatgtcttacaaaaaataccaaagagagttcttccatctgaaagaaaaaaaaatgtgaaggaaacaaacaaaaacatctgaaggtataaaacccactgttataattaagtgcatggccaaacccagaatactgtaatgccgtaattgtggtgtgcaattcactcataactctagtatgaagcccaaaagacagttctatcaaaaacaataatagttacaggaacctgttaagagatatgtaatataaaatatgtaaactaacacaacaaagagccaaaatgtatgtgtgtgttgtggggatggagttaaaatgcagatttttcctgttttttttctttgtttccattttttctttgtgatctaagataacttgtcatatctgtaaaataactttattatatctataagatatttttgtaagactcatggtgaccacatacaaaagcctataatagataaagtaaaaataaaaagcaacaaattaaaccatactagcagagaaaatcaaaatcttttaactacaaaagaatacaacaagaaagaaaggaagagatgaattacaaacaactaaaaaacaagcaacgaaatggcagtagtaagtccttatttacagtaataacactgaatgtaaatgaacttaattatccaattaaaaggcatagaatagctgaatgagtaaagaaacaagactttatgctgcctacaagaaacttcatctgtgaagacatatatagcctgaaagtgaaaagattggaaaatgatattctatgcaactgaaaactaaaaaagagcagaagtagctatacttatatcagataaaataaactacagattaaaggctataaaggaggccaaaagtgcccactgtataatattagtgaacagggtcacaaaaattctcaagaaaatattagaaaacttttgtcaagaacacattaaaaagatcattcactatatttaagtgggattcatctcaggagtgcaaggatggttcagcatacacaaatcaataaatatgtacatcatattaacataacccagaacaaaaaccatatgattattttaataggtgcccataaaagcacttgataaaatttaaatcactttataatgaaaaccctcatcaaaatggatgtagaaggaacatgcctcaaaataataaaggctgcatatgacaagcccatagctaacactttactgaatgggggaaaattgaagacctttcctctagatttggagaaaaagacaaggatgcccacttaccactttaccactcttattcaaaacagtactggaaaccctggccagagcaattaggtaagaaaaggaaatttaaaagtatccaaattggaatggaataagtcaaattagccttgttcacagaagacaagattctatacttagaaaaacctaaagacggcctggcgcagtggctcacacctgtaatcccagcattttgggaggctgaggcaggaagatcacgaggtcaggagattgagaccatcctggctaacatggtgaaaccacatctctactaaaaatacaaaaaattagccaggcttggtggcatgtgcctgtagtcccagatacttgggaggctgaggcaggaaaatcactgaacctaggaggcagaagttgcagtgagctgagatcgtgccattgcactccagcgtggcaacagaacaaggctccatctcaaaaaaaaaaaaaaaaaaaaaaaaaaaaaaaactgaaagactctaccaaaaaacagtaagaattgataaatgaattcagtaaagttacaggccacaaaatcaacatacaaaaatcaatagtatttatatacactgacagtgaagaatctaaaaaagaaatcaagaattcaattccattaacaatagctacaataatataaaatacttagcaatcagtttaaccaaataagttaaatgtctgtacaaagacaactataaagcattaatgaaagaaatcaaagaggacagaaacaaatgaaaagatatttcatgctcacggattggaagaattaatacttttaaaatgacaatactacccaaagtgatctacagattcaatgcaatccctatcaaaataccaatgccattttcacagaaatagaaaaagcaatcataaaattcctatggaactaaaaaaggccctgaatagccaaagcaatcctgagcaaaaagaacagagctggagtcacactacctgacttcaaaatttattacaaagacatagtaaccaaattattgtggtaaaaatagactcataaaccaatggaacagaatagaagacccagatataaatccgtgcatttgcatccaactcatctttggctaaggtgctaagaacataatggggaaaggatattctacatatgttctcactcatgtggaagctatatttaataaatggtactgggaaaactatataattatgtagaagaataaaactggatccccatcttttaccacacacaaaaataaaaatggactaaagacttaaatctcagacctgaaactatgaaactgctagaagaaagcattgggtaagcaccccaggacattggtctggacaaagattttgtgtttcatactgtaaaagcacaggcaactaaagcaaaaaataaaaaataaaaaaaaatgaaaagaaaaaccaggattatatcaaggtaaaatcttctgcacaataaatggaattatcaacaaagtgaagagacaacccatagaatggaagaaaatatttgcaaattatccatctgatggaattaataaccagaatatataaggagctcaaacaactcaatagcaaatgaataaattgtccagtaaaatggcaaacagacctgaatagacgtttatcaaaagaagacatacatatggccaaaaggtatatgaaaaaaatactcatcactaatcatcagagaaacacaaatcaaaactataatatatcaatcctgcacctgctaaaatggcttttattaaaaggacattataaaaaagacagatgctggtgatgatgcagagaaaagggaactttcttatactgttggtgggaatgtaaatttgcatagctactatggagaacagcatggagatacctaaaaaaaaatagaactacatatgatccagcaattccactactgggtatataatcaaaagaaaggaaatcagtatatcgaagagacattacactctcatgtttactgcaacactattcacagtagccaaaatgtggaagcaacctaagtgtccatcaatggttaaatggataaaatgtgatatatacacacacacacgcacacacacacacacacacacacatagatatgtacatatatatgatattctattatgtgtgtgtttatatatacaattcaccatatatacatatatatgatagaatatcatttagctataccaaaatgaaattctgtcatttgcagcaacatggatggaactggtggctcattatgttaagtgaaataagcctggtacatgttctcacatgttctcactgtcttatgttaaagccaaacacatgttcttactcatatggaagctaaaaaagtgaatctcataattaaagggagtagattggtcattaccagagagtggtgagaaggggaggggtaaagggaggatgaagagaagttgattaatgggtacaaatacatagtttgatagaagtaataagacctagtgatagatagacttgtacagtgactatattgtacaacaatctattgtatatttcaaaatagctagaagagaagaatttgaatagttccagcagaaagacaagacaaatattaggtgatggatatcctaagtacactgatttgatctttaccaattatatgagtgtattaaattattatttgtaccctgaaactatgtacatatgttatgcatcaataaaaggtaataccatcatgtataatttgatgtattgaacagaaaatcaacattgatgcatctttggctatgacttacaagtatgagtttattttggaatatcaataccccttcaaccttcaataagtatattataataattctataatgagatactagtctttatgctgcttattgtgcagactgggtttcttcatgtttttctttgaatgttgcaatatattttaaacttcattactttcttgacactttatgattttgtatctatgactttattgttttcttggatatattttaaaatgtgttttttctttatgtttctacatccacccatatgcatttccttatggtttcatctttaagctatcttattttctagagattgtaccctcctcatctgcctatattggtctcagggcatttcttgtgcatagctcgagtgggtagcatccccagtcactgagctcatcacacgcggtgctaatctataccttcagatgatgtgcatctaatttctaattccagcttctgctatagctaactgttccatagccagtaatttagtccttacttagagtgattgcccagtggggttcacatttattctgctcataaaatcccatcttttctgcaagaaaggactgacttcctggaagatgaaaacaatagcaatcatcctcctataaaaaggatttcctatctttgggttacttcttttgtaaaatttcttcaaagcattgggctccaggcaagtgacaatttttaaaaaactattatatgaagatggacaaattttatctcttagtacccacaactgtgttgtaggttatattttggcaaacggccttagtttgatctaccctatagaatcacagtaaggagatctcattttttccttttattgatgagaatactgaaaaactaagtgtgtttcacaaacaacagaaaggtccagaaagactatgtatgtttcagaaacaaagcttttaaatggcaaagatgtgataagaacatgaacgttctgatttttcctgatgttctaatttatcttatttccagaacaactaagagccattgggcacttgatttgtatacctaaaatatcttatttacttaatcttgtaaaactttgggtaaggaattcacacagaaaactaaatgcttacctgagggttatcaattccttggtgaatagtacagtcctggtgaagtatatctgatctatagagacatgtgaaattcagatgaaaactgtgatcttttctggagtttattagaaacgtgatggagaatctgctggggtcatgactgttgctcccccactgaatttatggtggaacagatggttctcccagaaagaccaacaaagttttaatgattataaaatctttgtcagaaaattcacggacttggttatgcatgcattgttatcactgcttctttcttttatttatactttaaggatgaagagcctgatttacacagctggattttaaacatggtttaaatgaataaatttggatttctgaaaagtgacttaataaactgaaatactcagttggattcttgagtaggaatacagtatagctcaaaatattagagacggtcttacttgtcctgaaataaactgatcttatcaatagaaattcaacctgaatgtgagtctggttattaggaaaatagtatctctcatggaaaggaaaatagcaatttggaaatgaaacatgagaggtaattagtcaaaggataagaaagagtatctgttgccgcagggaatgaaaactaagtaaagtgaatctcatatttcagtgtgtgaaaatacatatgatcatatattttcttaccaagacttgaagggataggataccagattagaatagaataatggaaatatatgccttattcaatataaataggccagttgtgagttaggatagtgtggatgtgagctgcttagaacttggtgtacttgtaaagtggaaatggcctgaagaataatatttgggtgataaaggagatgaacggagtgtctttgtaggacatgatagctttcctcctgtactctaaaggctactgagtgaaagaggaattatttgaattctgaataatgccaaggatgatatcccttatatagaagaaaaacatatcaataaaaggaagactttctaacagagctacttgcaaccaaatgaactgtgttccctcttactagaagttttatatagagactgcatgataaaattataaaatcaatagaatattagtagaaaaaattaaaatgagagatccgtgattagattaaatggatttaaagcctcttccaggcttgggattctagaattctgtgatacatgacacatgaattcagtttcaccatgctagatttaaatgttttcaaattgtcactataatattctataatatgaccattgatggaaaacaaccacgtttatatgagaaacagaggcactattgcttccagaaccatagagctatcctgctcttcctcatcctagggccttcaaatagtgtggctttgtcaggtgtgcaataactgaaaaaatctgagccttaatattgaatgcttcttctcaaatatgcaataaagaggtttttttctatttttaccttccaaatgttatctagagaataattatttaaaaaatattgacctgagttttacttagaaccttcacaagtttgtgaaaaacaattctcttcactatccttgtcttgatgcagctttgtacaactcttagtaccaaagcagagattgcgaagaaagtattgcattccatatttagtcagagactacagatgatgacaaatatattctgcctttgttgacctagaatgcatcaacaaatcaatcctccttagacttgaactcagcatcacactcacatattttggttaccatgtattcctaaaatgcagaaatgggtacactgacaaattttgcaattcaagatttttaccagttcagctcagaggtcaaaagaagacagagaagcagatgcatcacaggggggatttttcactgcaagaatggcgtgtctccatttgttacaagttagacttggaaaaatcctttagttaaatgaaaaagacaaatgtgagacagactgcctcgagaatcatttaccaatatctcggaacgactgtgattatacaaaacaccgatattaaaataattaagttcaaaaactaagtgcaaggttgtaagataaattgttagcaattctttaacataatttctgtcctctccctgcaacaaaccgggtcttcatcatgcccctggagttattctaaaattaatacacgattatttttctaactccgcttaaaattctttcatctctcctcttggcctacagattaaaacttctcaggactgcctttcctaagcccttttattatttgactattgcttatctatttagactaattgttctgttactcttctcttcctgaatgcaaattacttaaaaatttctgaatgtaatgtccacatcctggacattcatcatttttcctctcctatttttacattgtgaacacctactcatatgtatagattttgttcagatgtgttcatcattttaaaggccatagccttcataaccaccttttaggcctagagaattgattacattctgctctgtcccataactatatcctgtgttttcatatattaaaatacacatgaaaatattacaattaattcattctaaggcagagtttattcaatcatctgtatatttctagaacattgtacaacttctaaattttaaatattttgtatcattcattttccaaagaaatttagaaggcttgatagcatgtatgttttttaaagaaataattgctgtagaggataacataggacatgtaaaataagataaagctaggagtcagattaatatttaaaatgcatgtaatatgccttaaatattttctactttatggatattcattaattaataaaagccaagagttttctaaattaccagaggagggcttcagtttgggcctaagtatcgtagcagcctacaaaaagaaggaggcttagtcagctatgtgattttcattgtcattgaaagaaatggtctcagactgtcagcagctaaataattatttttgctagtaaggcctgaacgcatttcaccctggtccattttaagagtagatgatactcttatttaaaacctattgagcaatagcctcaacaacaacctttcagtaatgcccataagaccatgtcttataacttttgttattgtagtgaaaaggaataataccactggtaattcagtaaaagtaattctatgctggtgaaggtgaggaggaaaaaatgatctctgaatgtactgccttctaattctcaatatttagtccaaagaaaacatgtaaacttgtacaggaatgtatgtatttttatatttgtcccacttattgtagtgaatattaaggaatggaataaattcataaattaaaaaatacaataatctatagcacagcatctattggaagatacatacccaagcagcagacaagaagttgagttgtagaattttctcagttgtataagcagactcagtgatgtgcagggccaaggttgagtgtaaagaatgcctggagtatatggttaaaaaatcattctgaatagagtggctttcttgtcctatagaaccatgtgaacacagggtgagaaacagacaaggggtttgtaaatggagagctcttgcctctggagctatcacaagctctggatcctggtctgaatgaaaatgaggcatctcctagagtctcgtgaaaaacaggtataacagctgggttttcatatttaggcccagagatctggtaatttaagactttgcaagaggataagattgaagctttcaataaaaaatatttttctgtaagaactggattcaggcagaaaatggagcctaagttaaaggcatttattttctgtggatataccaaagaataaagaagtaggtaaagcagaggcccacaaaactgtgggagcttgaggaaagcaaataaacaagaaaaatcagtaaaatacatagtacatttatgtattagtctgttttcacactgctgataaagacatacctgagactgggaagaaaaagaggtttaattggacttacagttccacatggctgaggaggcctcagaatcatggtgggtgctgaaaggcacttcttacttagcagtggcaagagaaaatgaggaaggtgccaaagcagaaacccctaataaaaccatcagatctcatgagacttattcactaccattagaacagtatgggggaaccacccccatgatgcaaattatctcccaccaggtctctcctagaacatgtgggaattatgggagtacaattcaagatgagatttgggtggggacacacagccaaaccatatcactctacccctggctcctccaaatctcacgtcctcacatttcaaaaccaatcatgccttctcaacagtcccccaaagtcttaactcatctcagcattaacccaaaagtccacagtccaaagtctcatctgagacaagcaaagtcccttctgcctatgagcctgtaaaatcaaaagcaagctacttcttagatacagtgggggtacaggtattggctaaatactgctgttccaaatgggagaaattcgtcaaaacaaagtggttattgggcccatgccagtctgaattccagtgaggaagtcaaattttaaaatgtcaagatgatctcctttgactccaagtctcacattcaggtcatgctgatataagaggtgggttcccatggtcttgggcagctccacccctgtggctttgcagggtacagcctccctcctggctgctttcacaggctagcattgagtatctatggtttttccaggggcacagtgcaagctgtcagtggatctaccatgctggggtctggaggacggtggccctcctctcacaactccactaggcagtgcccccgtagggactctgcatgggggctcagaccccacatttcccttctgcactgccctagtagaggttttccatgggcatcccacccctgcagcaaacttctgcctggacatccaggtgtttctatacatcttctgaaatctaggcagaggttcccaaactccaattcttgatttcccttcactcacagctcaacaccacatggaaactgccaaggcttggagcttgcaccctctgcaagccatggcccaagctctacgttggcccctttcatccgcagctggaacagctgggatgcagggcaccgagtccctagactgcaaacagcatggggaccctggccctggtccacgaaaccattttctcctaggcctctgggtctgtgatgggaggggctgccatgaaaacctctgacatgccctggacatattgtcctcattgtcttggggattaattccgctccttgttacttatgcaaatctctgcagctggcttgactctctccccagaaaatggatttttcttttctatcacattgtcattttttgaacgtttatgctctgcttcccttataaaactgaatgttttttaacagcacccaagtcacctgctgaatgtttcgctgcttagaaatttcttgctccatatactctaaatcatctctctcaagttcaaagttccacacatctctagggcaggggcaaagtgtctttgctaaaacataatagcctctttgctaaaacataacaagagtcacctttgttccagttccccacaagttcctcatctccacctgagaccacctcagcctgaaccttattgtccatatcactatcaggcttttggtcaaagccattcaagtctctgggaagttctaaattttcccacatgttcctgtcttcatcttagccctccaaactgttccaacctctgcctgttacccagttccaaagtcggttccacatttttggttaccttgtcagcaacgtcccactctactgataccaatttactgtatcagtctgttttaaagctactgataaagacatactggagactgggaagaaaaagaggtttaattggacttacatagttccacatggctggggaggcctcagaatcatggcaagaggagaggggaacttcttacatagtggcagcaagagaaaatgaggaagatgcaaaagcggaaacccataatgagaccatcagatatcaagagacttattcactaccattagaatagtatgggggaaaccatccccatgatgcaaattatctcccacttggtccctcccacaacatgtgggaattatggaagtacaattcaagatgagatttgggtggggacacagagccaaaccatatcaattaataaggataaattttgcaaaaaaaaaaaaaaaaaaaaacaaagtaggtaaagggcatagtgttagggatgagactggaatttagataggcctctcttctctgatgtgtctttctgtaaaggtctaaatgaagggaaggggccttgtcattggttttctgggaaagaacatttcaggaagaaagatagcaagagcaagtccttatgtggctagagtagaaggaaatgagatgagtagaaggagaagaagtcagagtggtaactcggtgggtggtaggcagattgggcagtgctttatttcgttgttagggtcttgttgttagggtttttaggtcttactgtgagaaatgagaaaccattggagagttttgagcagacaagtggcataaaaaggattcttcaggtttctgtattgaaaatagattatagaaagcaaaagcattagaatgaagaccagtctggaagctacttgtacaattcagatttaatgcttggaatttggtccactaacatgattttgtgaaatatcctattgtgatgatcaaaagactcgatggatttgacatttcactggtaaaagaagataagacatatgatttttacagtttattttatgggagcaaattgtttattcattaaattcatttatgtcatgcatctatccaaaaaaaaattatgtggttggggatatgctatttctcaaggttatgtgataatatcttccagcatagtcagatattttatacgtataataactcgggcaaaattcaaaagcaaatagtttaccatgttatgaaataaagcttctgtaagaaaatattcaaattaaatgtccagtggcaaatggcacatacaatccactggcatacatctttcttaatatttataaaacttgaagaagtgtttgaattatctacttaaaacaggattttagggaattcaatattgtgtttcattcatcaaatcattgattcaacagctgtttattgggagtctctgtgtgcaaagcagcatgctaggctttggggaaatagcagcaaatttaaaaatttcctgccccctatgtattacattctattggcagggagagagacaataaataagtgctatataattccttagatggtagtaagtactatgaagaaaaataaagcagggaaggatggcagggagagggcaaatgttgggaagataaattttaaaggggttataagcgatgcccaccctccaagataaggtgaagttagagaaaatgtcttcactgaagtcatgggcaagccatgggaatatcctagtagcagaggcagagaatgtgcctagatgttctgaaggaagcatgcttggtgtgtttgagaaacacaggaagatgctgggttgagttgtctagcacattgtaatcaactttgagatgaataaataaatttcctgtcttgaaatatcttagcacctacgctaaattccaaatatcttaccagcaacagacaggaaggtcttatgtgctttggcctctcatacttcagagacctttatttttaaccttccccactctatgtcccacccccacctccctgccacattcacccttagctccttgagcaagtcatgtccacctcagcagcctttctatgcaccaataatgaaccagctggaaaagaaatcacgaaagcaatcgcatatacaatagaaacaaaataataaataaatggataagatacctaagaataaccaatgaggtaaaaaatttttacaatagaaacctcaaaacactgatgaaagaaattgaacaggacacaaaaaatggaaagacatctcatgctcatggatgggaagaattaatattgttaaaatggccgtaatacccaaagtgacctacagatttaatgcagtctctatcaaaataccaattacattattcacagaaatagaaaaaataatcctaaaattgcagagaacacaaaagagcctaaatagccaaaataattctgaccaaaaagaacaaagctgaaggcatcatactacctgactgcaaaatatactacaaagctatagtaacaatgacagcttgatattggtataaaaccagacacattagaaaaatgaaacagcttagagagcctggaaattaatccacatatttacagccaactgattttcaacaaaggcacccagaacatacaatagggaaagggcatcctcttcaataaacagtgctgggcaaataatatccatttgtgaagaataaaactagacttctatctcaccacatataaaaatcaactcaaaatggattaaaggcttaaatataagacttaaatctataaaactactagaagaaacataagagaaatgcttcaggacattattctagacaaagattttgtgggtaagacttaaaaagcgcagatgacaataacaaaagtagacagatgggtctatatcaaactaaaaagctttggcacagcaaaggaaacaatcaacagaatgaagagataacctgttgaatggaagaaaatattttcaaactattcattcaacaatggactgatatctggaacatacaagggattcaaaggactcaacagcaaaaacaacggcaatgacaaaacctacaagcaatcccattaaaaagtgggcaaagatataaatagacatattttaaaagaagatgtacaaatggcctgatagcatatgaaaagattctcaacatcactaatcctcagggaaatgcaaatcaaaactacaaagagatattgtctcaccctagttagaatggctattatcaaagagaacaaaataaaaatgctggtgagaatgcagagaaaaggaaatttatacatgatcaatgtgaatgtaaattagtacagccattttggaaaacagcgtggaggtttctcaaaaaaaaaaaaatctaaaaatagaactgccatataactcagcaatcccactactggttatttattcaaaggaagtaaaagcagtatatcaaagtgataactgtactcctatgtttaatgcatcactattcacaataaatcaacctaaatgtccatcaatagatgaatggataaagaaaatgtatatatacacaatggaatactattcagccataaaaaagaatgaaatcctattattcacagcaacatgtatgagcctggaggacgttatgtaaagtgaaataaataagtcaggcacagaaagacaaatggtgcacattctctctcatgtgggagctaaaaaaacgttgagcacatagaaatagggagcagaattatggttattacaggctgagaaggggagggagaggatagaaagaaatggtacaaattacagctagaagaggaataagttcttgtgctccatagcactgcagaatgaatataattaacaataatttgctgtaagtttcaaaaatctagaagataggattttgaatattcccaacacaaagaaatgataaatgcttgacgtggtgaatatgctaattaccctgatttgctcacttactgtatacttatatattgcagtatcactctgtagcacataaatatgtacaattattatgaatcaactaaagataaaagagaaaataattcagttgaagatgagtaagcaactgacccaggtgaccatggagctctacacaatgcatccatccaagaagaggtaatagttctggcacaaggcatgggagaccttagtctggaggttcactctttttctgtgctgttctgcacatcattctccttttgaactccacctgccctgtttggggcatttaaaggagacatctagagtccctctgcaagaaaactcattgcaaagttattacaaatattcttagagctttcttggccatcgtgcaaatatttttcaggtttgtgtgtttctctatttctttcttgggttcagtctccctctgtgatctcactgaacttctttaaactactcaggcagtggctattctttccttaacgctgaaatctacctctctcattcgacgagaattcataatacctatatatagtgctgtcctctcagctccttttgtttgtgattcttggttgattctagattgctaaacaaaggaagagtatagtattttggagtgaaggcaggaacacttggatatagtcactgattacttcaggaaaccaaccaagatcattctttttttttgtctttttttttcctttttttaattattattatactttaagttttagggtacatgtgcacaatgtgcaggttagttacatatgtatacatgtgccatgctggtgtgctgcacccattaactcatcatttagcattaggtatatctcctaatgctatccctccctcctcccccccaccacacaacagtccccagagtgtgatgttccccttcctatgtccatgtgttctcattgttcaattcccatctatgagtgagaacatgcggtgtttgtttttttatccaaaatcaatgtacaaaaatcacaagcattcttatacaccaaaaacagacaaacagagagccaaatcatgagtgaactcacattcacaattgcttcaaagagaataaaatacttaggaatccaacttacaagggaagtgaaggacctcttcaaggacaactacaaaccactgctcaatgaaataaaagaggatacaaagaaatggaagaacattccatgctcatgggtaggaagaatcaatatcgtgaaaatggccatactgcccaaggtaatttatagattcaatgccatcccatcaagctaccaatgactttcttcacagaattggaaaaaactactttaaagttcatatggagccaaaaaagagcccgcatcgccaagtcaatcctaagccaaaagaataaagctggaggcatcacgctacctgacttcaaactatactacaaggctacagtaaccaaaacagcatggtactggtatcaaaacagagacatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagttgaaactggatcccttccttacaccttatacaaaaattaattcaagatggattaaagacttaaacgttagaccaagatcattcttgatgtgggcttgtacttactttactttgtgcgagtgccctcactttctaccctcaaaccctcatacagccagaagtgctgtatcaaggctaagggtttaaagaaacttgcatgaaaacaggccttttatttcaactcataaagattggagggttttcacaaactgtacattaaaggtatctcaaatatgccttaatatttttatgtaatctaaattctaagtgtttttctaatataataattttatgactcagtgaaaccaaaatcataccttttacttatacaaatacaatgcaagaagatatttgagcttaattttattagattttggttgtatgtaattctgctgcatgaaattaatacatacatattctatggtaacagaacattgtgactaatagcctttttatgaattcaaatagttctattgaatagatagacacaggtcaatgagactacaatataacgatagtaatttattttattccactagttacggaaatagtgataaactattctacataagaacttatattctgacttctcttcagatcatataaatctattactttttactgaagattttctaggagaggaacaactcatttcagcaaacaaaacaaaacaaaagtcttaactagagataacaagagaatttttacaaaataatcccaaatttgaaaggtggaaataattaaaaatttgcttttgtaagaattcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtagttttagtagagacagggtttcaccgtgttagccagaatggtctcgatctcctgacctcgtgatccgcccgcctcggcctcccaaagtgctgggattacaggcgtgagccaccacgcccggccaagaattcttttactagatctacaaaacaatcattaaaagtatatcaaccagaatttattatccatatttccaaataaagacagtaagtttcagagatggtaaatgtaaatattaaataaactgtccaagatcatgtggggacatttatgcagagccagaatgagaagccaaccaagtcttcttgcttctacactttccacttcctacttagtgatgtaagaactattgagtcctcctgttccaccccctctcataaaaacacttcagtacatttctttaaaaaaaaagtgattaccatcaatctggcacctgtaatatatttgattttcaaaactaaagtcattttcaatagaaacaagtttttgttttgttttgtttgagacagagtctcactctgcccaggctggaatgcagtggcacgatcacagctcactgcaacttccacctcccgggctcaagtaatcctcccaccttggcctcccagtagctatgactacaggcacacaccacttcactaggctaatttttgtattttttctagagacgaggtttcacagtgttgcccaggatagtcttgaactcctgagctcaagcaatctccctgccttggcctcccaaaatgctgggattacaggcatgtgccacggtgccctgccaatagttacaagctcttatgtttctatagttatgtaaagtctgaaaaatgccaagaatgcacatgaagagcatgtaatacgtgtaatgaaaccattataggaaatactatgtgttgctaaatataatgcttattatttgcaaattataattttggttgtcccaaacttgatgattatttgtatatttttcataaactgcaaaaagaattttcagaggacttagtgacaaacaaaaggtatgatataaagcacacaaaaacatattctccatggaaagaaaagttggaattgagaggcctaggagaggcagcctccatgtattgatgaaattacagttaaattagaaagcagagaacaattgagtaggtttgaaaaatgagaaacagttagcaaaaaaaaaaaaaaaaatacacacacgcacacatatatgtatgataagaagttttaaaaatgattaaaagaggtatccatgaagagatgaacacaatttgaatatgcacttagcacataaggatgtacaatcaatatgcaacatagtgttttgaatcctaactgataataaaataactacaaaatcctgcaaactcataatatttagctaggttattctgtaaactgtattttactgataattaaaagtaattttagtgagaataatagtgtgtattttatattatcaataatttgttttccttgcttatttctctttgctgcaaaatgggttagtaaaatactttgggcgtcagttaatgtacacttgaaaatgcttttagttttattctgaaaaagaaatgatatcaatatacatttataaatgttatgaatagttatacactttctgattaaacaataaaatccaacatctttagctttctaaatggtgctttttcttgtacgtatctatatttaatttttgtaagaaatatttgctatataagagagaaactatgagacatttatgtaatttataaataataaaaattaaacaaatagctgagaaactctgcctataattagatcaaaattatttttgtaaattatatggctcttcaaaatatttcttcctcgcttccttactttcctggaaatagtgtgctttcccacccctagaatttctgtttgtgcatttgacttgttttggccagtggatattaaccaatatcaagcattccaaggcttgctatgtgcattcggtgtagagcttgctgtcctgtgtttcctcaatgttaaaaatagccattgagtagttactgtgccttcagactcagccccagaatgtacctgtgtaggacagagttgctctagcagacctgaattgagaagcaattctaccccgactaccacagcctgaagctaagtggcccagctgacctacaaatcataaacaatacccccaaaaaacaaattatcatgttaaatcactgaaatttgaagtcatttgttcacaatagacttcaaatttcaaatagctaatcaatagatttaatcatttataggatagaaatcacctacctatttgacccattcccctacttagcacctagagacaatcaatcaacctgaacattttgaatggcactatctgtttttctaaacataattttatgtcacatacatgtattcacatatataatgatatatatagtatatctgaatattttatttttacttcattaagatatgtcagaatgtatatggtcatctgagtcttattttttcctcaatatagtgtctctacattttatccacattgttatgtgcagctgtagtatattcattttcactgctctataatatccattatgtgacttttcccacatattatttatccatgtttgttactaacatgttatttcgatgattttcattgtttgctaatacaaacaatgctccaaggagcattctgcatatctggagattgtatatgttgaagcacatgtgtaaacgtttctctagggcatcagttctcaaacttttggcctgaggatctgtatttgttaaggtttgccagagaaatataatagaacgaatatgtgtgtgtgtgtctgtgtgtctgtgtgtgtgtgtgtgtctgtatgttgatgtgtatatatacatatgtattgtgtgtatctctctgtgtgtgtatatatatgtacatgtacatatatgtatatgtacatgtacatatatgtatatgtacatgtacatatatgtatatgtacatgtacatatatgtatatgtacatatggatatatatgcatacacatacatgtgtgtatgcatatatatacaaagagatacatgcagagacagagataaagagagagagaacagactctctttggctcacatgattgtggggactgttaagtccaaaatttgtagggcaggtgagcaggctggggatccagggaagagtagatgtctgattttgcagcttaaatctgaaggaattccatcttatttggggaccttagtgtttcccttttaaggccttcaactgattggaagaagcccactcatgttgtagagaataatcagctttactcaacatctactgatttatgtgtttatttcacctaaaacatacctccacagagatatttagactgatgtttgaccaaacattgtggtagcatagcttagtaaaactgacgcataaaattagctatcaccatacccctttattaccttaaagattattaagtaccctaaagagatttggttaggggcttatatctattgatgcttattgtattataaattaaaacttagaaatcttaaagatatttattaatttaaataactatagaaagttcattgcatgttaactaaacattttaatgcaaaatcaatataatgcctaaaacaaaaaaattaatgaaaagtgtgacattattttatacttctgtaaaaatctttgtggcacctggctcaataaattgccagtagaggaaaatttttctgttcttgtcaaccttagcagaaatttatttattttattactcttcaaagaaccattttggtctttgttgatcttccattctattattctatcatatatatagtatacgctttctaacctcaaaatatatgcacagcacaatgattttaagtctgttctcttttcattataaccagttaaaattaaattcccttcaaaatactgatttgacttcatgtcagagttttgatgtgttgccattcagttctattttaaaacatttcttctcttatgtatgttatttaaaactgttttaaaatttgcacaaatatactttatcagcatatttgtatactgatcgatgagtgatattgatctttatttcataagcttgttggccacatgtatgtcttcttttggaaagagtctgttcttgttatttgcccattttaatggagttgtttgttttttgcttgtaaatttgtttattttccttacagatgctggatattagaactttgtcaaacacatagtttgtaaatattttgtcctattctgtagtgtattagcctattctcacactgctgataaagaaatacccgagactaggtattttataaaggaaagaggtttaatgactcacagttccacatggctggggaggcctcataatcacggcagaaggtgaatgagaatcaaagtcacgtcttacatggtggaggccaagagggcatgtgcaggggaactccccccacctcttttttttttttaattatactttaatttctgggatacatgtgcagaatgtgcaggtttattacataggtatacatgtgccatggtggtttgctgcacccatcaacccatcatctacattaggtatttcttctaatgctatccctcccctagtcccccacccctcagcaggccccagtgtgtgatcttcccctccctgcgtccatgtgttctcattgttcacctcccacttatgagtgagaacatgcggtgtttggttttctgttcctgttttagtgtgctgagaatgatggtttccagcttcatccttgtccttgcaaaggacatgaactcatactttttatggctgcatagtattccatggtgtatatgtgccacattttctttatctagtctctcattgactggtatttgggttggttccaagtctttgctattgtgaatagtgctgcaataaacatacatgtgcatgtatctttatagtaaaatgatttataatcctttgggtatatgcccagtaacgggattgctgagtcaaatggtatttctggttctgaggaatcgccacactgtctttcacaatggttgaactaatttacacacccatcaacagtgtaaaagccttcctatttcttcacatcctctccagcatctgttgtttcctgactttttaatgatccccattctaactggcatgagatggtatctcatagtggtttagatttgcatttctctaatgaccagtgatgacgagctttttttcatgtttgttggctgcataaatatcttcttttgagaaatgtctgttcatattcttcacctactttttgatggggttgttttgttttcttgtaaatttaagttccttgtagattctggatattaatcctttgtcagatggatagattgcaaaaattttctcccattctgtaggttgcctgttcactctgatgatagtttcttttgttgtgcagaagctctttagtttaattagatcctattagtctattttggcttttgttgccattgcttttggtgttttagtcatgaagtctttgcccatgcctgtgtcctggatggtattgcctaggttttcttctagggtttttatggttttaggttttacgtttaagtctttaatccatcatgagttaatttttgtataaggtgtaaggaagggatccagtttcacttctctgcatatggctagccagttttcccaacatcatttattaaatagggaattctttccccattgcctgtttttctcaggtttgtcaaagatcagatggttgtagacgtgtggcattatttctgaggcctctgttctgttccattggtctgtatatctgttttgataacagtaccatgctctttgggttactgtagccttgtagtatattttgaagtcaggtagtgtgatgcctccagctttgaaattccctttataaaaccttcagatcttgtgagacattcactatcttgagaacagcacaagaaaaacctgcaaccatgatttaattacttcccacctgctccccccatgacacatggggattatcacaattcaatgtgagatttgggtggacacacagccaaaccatatcatataggttgtctgattactctgctgacagtttcttttgctgttgagaagctcttaagtttaattaggtcacacttgtcaatttttgtttttgttacaattgcttttggcatttttgtcacgaaatctgtgctaaatcctacatccagagtgatatttcctaggttatcttccagggtgtttagaattttatgtttcacatttaagcctttaatccaccttgagtttatttttgtatgtggtataagggaggggtccagtgtcaatcttttgcatctggctagcacattttattgaatagggaatactttccccattgcttgtttttgttaggattgttgaaaatcaagttgaacatgtgtggcattatttctgggctccctattctgttccattggtctgtgtgtctgtttttgcaccagtaccatgctgttttggttactgtagtctagtagtacagtttagtcaagtaatgtgatgcctccagctttgctattttttcttaagattgccttagctatttgggctctttttttggttctataggaattttaaaatattttctaattctgtgaagaatatcattggtactttgatagaaatagcattgaatctataaactgctttgggcagtatggccattttaataatattgattcttcctatccatgagcatggaagatttttccagttgtctgtgtcacctctgatttctttgagcagtgttttgtagttcttgttgtagagacgtttcatttcctgggttggctgtattcctaggtattttattctttttgtggcaattgtgaatgtgactgtattcgtgatttcactctcagcttagatgttgttggtatatagaaatgctagtgatttttgtacatcgattttgtatcctgagactttgctgaagttgtttgtcagatcagggaacttttgggccaagattatggggttttcaagatatagaaatacatcatctggaaacagggatagtttgacttcctctcttcttatatggatgccttttctttctttttctttcctgattgctatggctggaactttgaatattttgtagagtagggatggtgaagaaggcatacttgactggtgctggttttcaaagggaagacttccagcttttgcccattcagtatgatgttggttgtgggtttgtcatagatggctcttattattttgaagtgtgttcttttgatgcctaatttattgagggttgttaatgtgaagatgtattttatcaaaagacttttctgcatctattgagataatcatctggtttttctttttagttctgtttatgtgatgaatcatatttattgatttgtgtatgttcaaccgagcttacatcccagggataaagcctacttggtcatgatggattagttttttgatgtgctgctggaattgattggcaattattttgttgaggttttttgtatcagtgttcatcaaagatattggcctgaaattttattttttgttgtatctctgacatgtttttgtgtcaggaaaatagtggcctcataaaatgagttgagaaggaatctctcctcctcaattttttggaacagtttcagtaagagtgataggagctcttcattgtatacatatggtagaatttggctatgaatctatctggtcctgggtttttttctggttgataggctgatatggtttggctgtgtcctcatccaaatctcatcttgaattatagctcccataatttccatgtgttgtgggagggacctggtgggaggtaattgaattaaggcaggacttgcctgtgctgttcttttgttagtgaataagtctcatgagatctgatggttttataaaggggagtttccctgcacaaattctctcttgtctcctgccatgtaagacatgccttttaccttccaccatgactgtgaggcctccccagccatgtggaactgtgagtctattaaatctctttttctttataaatacccagtctcaagtatgtctttatcagcagcatgaaaatggactaatacatagactttttattactgattcagttttgtaactcattttttttgtctgtgcagggattcattttttttcctgggttcagtcttgggagggtgtatgtgtccaggaatttttccatttttttctagattttttagtttgtgcatagaagtattcgtaatagtctctgatggttatttgtatttctgtgggttcagtggtaatgtcaggatcagtgtaatgccctttgtaatttctaattgtttttatttggatcttctttcttctttatcattctagctagcagtctctcttatttactttttcaaataaccattgattatttggattaattaatcttttgagtgatttttcatatctcaatgtccttagttcatctctgattttggttatttcttttgtgagttttggggtcagtttaatcttggttttgtatcttattaagttttttaaattaccattgattatttggattcattgatttttttcagtggttttttcatatctcaatctccttagttcatctctgattttgcttatttcttctgttagtttttgggttcagtttactcttggttctctagtccatttagttgtgatgttaggttgataaattgagatctttctaactttttgatgtgggcatttagtgctataaattttcctgttaacactgccttagctgtgtcccagaaattttggtatgttgtgtcttggttctcattagtttcaaataacttcttacttcttgatttctgctttaatttcattatttactcaaaagccattcaagtgcagctattcaatttccatgtaattgtatgtttttcagtgattatttcagtcttgatatgtaattttattgtgctgtgatgcaagagagtagttgatatgattatagttctcttgcatttgctgaggattgttctgtgtctcattatgtggtagagtttagagtatgtgcatgtggcaatgagaagagtgtatattctatttgttttgggaggggagagttctgtagatatctatcaggtccttttgatccagtgctcagttcaggtcctgaatatttttgttaattttctgactcaatgatctaatactgtcagtagggtgttgcagtctccactattattttgtaggagtctaagtctctttgaaggtctttaagaacttgctttatgactctggttgcttctgtgttgaatgcatatatatttagaatagttaggtcttctcatcgaattgaaatctttgccagtatgtaatgctccccttttttcgtctctatctgtttaaagtctattttgtctaaaattaggatagtaacccctgcttttctctgttttccatatgcttggtagatttttctccatccttttatttttgagcctctgagtgttactgcatatgaaacaggtctcttgaagacagcataccaatgaatcttggttctttatccaatttgccactctgtgccttttaattagggcatttagcccatttacatttaaagttattgttgatatgtgtgaatgtgatcctgtcatcatgatgttagcttgttatgcaagcttgtttgtgcggttgctttatagtgtcactggtctgtatactggcaggttaggatgcatgcacacacacgttggcatgggggaaggtaaaacccacccacgtacacacatgttggcaatgtgatatatgtggtggctctgggcctggaggaagctgcagtgggggtagggaataggcaggctggtgtgtggccatgggggctgccccattggacctctctgccagtcaggcacagttcaccactgcaggagctattatgtgggctcccagagcacctgcttgttctacaagcaggcatggccaggctggggccctggaagaggccagcagaccaaggggtgctcaagtcagactagccccatctgatgggcaagaccaccatgcagagttcaagtctgagagtttccctagggataatgtctcctgtggtagcatgtcgagcctacagggatggacatctcttgtcatactctgccacgagtgcttaggcaccaaatccttttggctctgcatcagctggcatgctgcccctaccaattctctaagcagctctttgttccaactcaagtatccgtcatagtttaggggtctcctcctgccaagattccagaggcctgtggcaagagtaggttgatccttgtcagttcaattcacccattcctttggagttgttggagggtaggaattagtcccctgcctggtagcctcctgtagggttcccagcttcctcccacttgagcacagcttttgtatcttccctccatccactctcacaggcttccctctgaagctctgtcaggagtgtgccaattttcttggtcccttggtggcagttgttccacctggttgtgtcaagttggccatcttctacttaatcaggtcttcttgttgaattgaaactattgccattatatagtgctcttctttagcttatttggtctttgttggtttaaagtctgttttgtctaaaactaggattgcaacccctgcatttttgtgtttgttgttgttgttgttgtggtggtggtttacttggttgatttttccccattcctttattttgagcctatggatgtcattgtatgtgagatgggtctcttgaagacagcatactattgggtcttccttctttgttcagcttgccattctgtgtattttaattgggggattaagctgtttacattcaaggttactattcatatgtacgaatttgatcctgtcatcatattgttagctggttattatgcagacttgtctgtgtggttgctttatagtgtcactggtttgtgtacttaagtgtatttttgtagtggctgataatgatctttctttttcacatttagcactcctttcaggaccacttgtaaggcagttctggtggtaatgaattcattcagcatttgcttgtttgaaaatgatcttatttctccttcacttatgaagcttggttgggctggatatgaaattcttgtttcaaatattattttaagaatcctgaatataagcactcaatgtcttctggcttgaagagtttctgctgaaaagtccagcctgatgggattccttttgtatgtgacctgtctcttctctctaattgccttttacattttttcattcatttggaccttggagaatctgatgattatgtgtcttggagatggtcttcatgtataatatctcacaggagttatatgcatttcatggatttgaatgttggtctctctagcaatgttagaaagttttcatgtacaatatcctgatatatgttttccaagttgcttactttccccctgtctctttcagggacaccaatgagtcatagttttcatctatttacataatcctatatcttttggagattttgctccttccttttaaattcttttttctttatttttgtctgactgagttatttcagagagccagaatttgagctcttagattctatcctcagtttcttctatcctgctgtttatacttgtgatttaattatgcaattcttgtagtatgtttcttatctctattagatgagtttggttccttttttataatggctattttgactatcagctcctgtatcattttactgtgattcttagcttccttggattgggttttgctgtttccctgtatcttgatgatccttgttcctgttcatattctgaattctatttctctcatttcagatatttcagcctggttaagaactcttgctggggaaatagtatgattatttagaggaaagaaggtactctggcttttcaagttgtcagagttctttcactggctttttctaatttgtgtgggctgatgttccttcagtctttaaagtttctgtcctttcaattgatttttttgtttttttcttcattgatgcccttggggattttattatgttataattgagtttggttgactggctttgattctagtacactactgggtcttggtggcaccctctatgattactgtctgcatgcccgcatttcttctgttgggctttctgatctattgagtttcctcaggcaagggctgcggttgacagacaagctgtattcttgccaggttggccttaatttgatgtccatgtgctccctggggaaacatggggttgcacttgcctgcagagttcaggcagaagtgggacctctgggttggaagctctagcaggtgtggtccatctggctatgggaggcaggggtgagtggagttgcctaccctgacctcctggtgtttccagggcaacaggagcctgcctgcacccctcagcaaattcagggaaaactaggactgttgggccagcagccctatcagatgtggctcacctgtccaccagtggcaggggttggtggggatgcttgtcctgctttctgggagcttcctaggacaataggagtctacccactggttgagttcccacagaagtggaactgctgggccaaaagctccagcaggcattgcctacctggctgccagtggcagtgtcaggcagcgtcgtgtgccctgctgtctgggtgtttcctgggacaacagaaagctgccccctctagatcagtccaaacagaagccagactgctgggccagaagccccagcaagtgttgcctgccttgcagggtcagtgggatcacatgccttactgtccaggtgtttcctgggacaacaggaggcttgtgctcctcagctgagttccctctgaagcaggaccactgagccagaaactctatcatgtgtcgcttgcctggctatgagtagcagggatggatggggttgtctgccctaccagctgggtgttttcagggcagcaagaggctgtgccctccagctgagttcaacaaaagtaggactgctgggcgggaagctctagcacacattgatcacctggcaaccagtgatgagggcaggtgaggtcacatggtgctgtgctctctgggtgtttcccagggcaacaggaagctgcaccttccagctgagctcacatagaggtgggatgactgggctggaggctctagcagttgttgcccacctggctgtccatggcaaaagtgggtggggtcatgtgcagcctcctgccacctgagtgtttcccgggacatcaggaggctgtatcctgcagctgaatttacacagaagtggaacaactgggctggaagctctagtaagcattgcctgcctgcctagcagtggtgggggtgggtggagtggcaggccaaattcaggctgaagtgggactgatgggctagaagctggtgctgagccccatctggcaagggggtgggtggagcaatcttactgctcccaggcactgcaactatgcctttattcaggtgatggcactggtgctggtctgctctggggttaaaggcttgtagtccccttggacttgatagttgcccctgcaaaatgtctggatggctctctccctcagtttggaagcacagctgggggccaggcagattttcctactcccagtcttgtacaggtctctgcagagagcatgaatctcctggggagctctcactctctcaccctttcccatttttgtagaggttcttctgcgccacattgatcccagacagatagctttgctcctctctgttctctgtgttctcctgctgccttcatggatcccagcatggtttctcagatgattggcctgcagggtcagtgttgactagccttttagttcctctctgtgagagcagcacatacaagctgcttctcgtctgccatcttggccctatccctcatctttattttcatttcctttggcctaggtaactttttttggtactttttcattttgctttgctttgctttgctttgtttactctcaatctttgtatctccttagaagtttagtgtgcctcgtgtaaaaatcatatagctgaatttgtttctttttagccaaactgaaaaatctttgtcttttatgtcttttagcttccactttagtctatttgtgtttgttggatttgttcatatgtttgtatttctatctaaaaacttatttttaaaattcattttctatttgtatcatttattctagtgcttttttcctcctttcctattttcttttagatatattagatgtttataattgtaagtttttcttacccatttctttttttcttatactggtttggaagtcatatgctctattactattcttatagtgctcactcttaacattttaccatgctgactgaatttagtaaagcctaaattgatcaaggttttacttctcttcttaatagcacatgaactttattaatactatatcattattgtttttttttatttttacaagcatttttgttttatttttgcaagcattttatttatctacacaaatatttctatatacttacatgtttaccaaattgtttgctcactatttcttccctttcagatcttctgtccctaaaatatatccttagtaatttctgtaggagaggactgctttgtttagttggaacattaatacttgttcttgtttcttttcttccttttttttttttttgaggtggagtcttgctgtgttgcctaggctggagtgcagtgtcacaatcttggctcactgcaacctctgcctcctgggttcaggcaattctcctgcctcagccttccaagtagctggggctacatgtgtccactaccctatccggctaatttttgtatttttagtagggatatggtttcaccatgttggccaggctggtctcgaactcctgacctcaagtaatctgtctgccttggcctccgaaggttctggaattacagacatgggcctctatgcccagccttgttcttgttttgagagagatttttgataattccagagtaacattattttctattagctctttgaagaaatttcacccctgtgacttattttctctgtgatgttgtttaagtgttttagagataatgtagtcatcttatgagtcatagtgaagatcaaatatatataaagagcttattagtgtttctaacacatatttatcactatataaataaataaccttatttttcttttttccctcctttttttcttataattcttattattgccaatgctgctcagcaattcactaaaatgcatctaagtaaaaatttctttttattgacaccactgtttatcctgtttggtatacatttttctttccaaacatgtggttctaggtcttaaattttctagtttctgtacattctcaacccttaattctttgaatgttacatctatcttttatttccattctcttctggaattttgattaggaaaatatacttttttattgtatcctttataattttaaccacctatactgtgttcagttcctcatctgtctatagttgggataattttttcaaatatgtactttatttatttttattttttatttccataggtttttgcggaacaggtggtgtttggttacatgagtaagttctttagtggtgatttctgagattttggtgcacccatcacccaagcagtatgcactttacccaatctgtagtcttttacccctcgccccacttccattccaccctttcctccaagtccccaaagtccattgtatcattcttatgcctttgcagcctcgtagcttaactcccacctgtgagtgagaacatatcatgtttttcattttttttccggatttatttcccaattcatttactctgaattttgctgtttctcatatgctatttaacccatccattgatttcttaatttcaataattttatttttaaaatttctaaatatatatttttttcagatttgcagattcatgttataaccttacgtcgtttgatctttttattgtagctgttatttccttatatactttacttatagttatattttgtaccctttaattataacaactagtgtccttcagggtatttgttaattttattagctcatcctcagtcatggcttcttatttcccattatgtgtttgagaataattttgtaagctcatacttggttgaattttatttgcagaattttgagtagctaatttctaataacttgggctgtataccaacagcgtggatctacattattagtcagctcagtctgccataacaaaataacagagactgggtagctcaaataacagaaattaatttctcacactcctggagcctagaagtctaagaccagagtgccagcctgatcaggttctggtgagggcccccttcttgccttgtaaatggctgccttcttgctgtgtcctcacaatgcagggagcgagttaactccagtctctttctctgattataaaggcactaatcgtattacagggttcccgtgctcatgaccttgtctaaacctagttatttctcagaggccctacctccgaatactgccacattggaattagggcatcaatgtacggatctgggaaaggagtggcacagtcagtcagtccataacattcacttgtgctctttttgagagctttggttccttctatttgtgtggagcccagggaaactctgatcttttgcatctcttaaaacacacttttttgattttagtgtaccattctttttctctctcttgatttctctcagccctcagaaatggcctttattttttcatgaaccaaagttatacagttttccatatttcaggccatgtttttgaaaggcaaaaccatttcaaaagaatgttcagaaatttatatttgatatattttggatttagtatatgagctctgactctatatattaaaaacttatgggaatattgtttatatttattgttgactaaatatcagttacagcactcacaaagaaataatactgcttcattctagttgtaattattccagtgtgatttgttttttttgcctggcacatggtttaaaacacaaaataagcatataaaacttatatgagagggtttttcagccacaggcagaaacataccacaataatttttatcctatgctaagattttggtccataataacatgatacccattggaaagatagatttgagaaagaagcatgcttaaataatttttaaatttttttacatgcatgtttttggataagtgtattgttcaatctttaatattaaaaactaaaattctgaatgacaaacatatgtgcaaaccaactattgtggcaaaaacagtttttgttggtgaagggactagctgccatttggtgatttttcagatagtcaaatttgaaaaatcaattggatcttctcttctcttctcttttctctttttgagatggagtcgcagtcccccaggctggagtgcagtggcatgatctcggctcactgcaacctctgccttccgggttcaagtgatttcctgcctcagcctcccgagtagctgggattacaggcacacgccaccatgcctggctaattttttttttttttgtatttttagtagagacggggtttcaccatgttagccaggatggtctctatctcctgacctcatgatctgcccccctcgacctcccaaagtgctgggattacaggtgtgagccatcacacctggccccttggatattcttttctaactcaaatgagaatatcctcattatataatccaccttctctccagaaacttcaagctctttctctctaatggtggctgtttctacgctgcagatagaaattacatttccctcttagctgaaaaatacccaagcctatgagcaagaaaacaaaatattttttgattctactattccctctgtcagagatgccagaaactttttcttcttcatttatagcataatttcattcatgcttgcatgcatttctatatttacttactctaaagcatttactaagcactttaattggtcagtcatgaggcttggtgccgtagaaacagagatgaaatgcaattctccatcataaaacagtctggcagggaggaggaggataaataagtggtatattacaattcggtgagagaaagtacctaagagaacacatttaaaaagcatgcaatgcagaaggatgtgtagaagatgatggaagtaaaattttcttgcagctgatgttacacacacacacacacacacacacacacacacacacacaaaaccaactagatgtttctgttggtgtcattgacacctacccatttcttttcttttctttttttttttttttttttttttttttttttaagactgagtcttactctgttgcccaggctgcagtgcagtggtgcgatctgggctcactgaaacctctgtccccggggttcaagcaactctcctgcctcagcctctcgagtagctgggattacaggcgcacgccaccatgcccggctagtttttgtatttttagtagagacggggtttcaccttgttggccaggtttttctacaactcctgacctcaggcgattcgcctgcctcggccacccaaagtgctgggattacaggtgtgagccaccgtgcccgagcctgacgcctacccatttcttaaactagcttttgtgtccaccacttggaagccactgctttaagatctactgattaccgaaatgcaaaattgaatgagtcatgctcaaccacccagcacttaaacatctctttgatctctcatgatctaactcaaaggtatctcattcctgattcacttcttccttcatccaaactgcactcctgaagcatttaattaatctaaacataagcaatgctgacttactgtttcatattgtattatgtttttgaaactgatttagcccatgtctgaatctttattgttctgaagcccgatcatccagagcctaatatatacaacgctgaaccaaacaaacacatgataacaaaaacactaatttagtgaattaatctagaagaatctagcagaattaatctagaaactgcacagcagcagtttctctcttcagcttgaattactaagcaattcaagttagcaattgtgtagacccaaataagataataatatttagtcatttagatatgccactacaagtaaaaataaatcagatacatacacatacacacaaattactcatagaatgcagtattcataaaaattatgttactttttaaacaagctgtctttttatgtttttgcaaatagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaataggtaagaagtactttaaacattactaatcctctgtgctgatacatatacgtgggtaaagtggtaaagttcttttttttttttccttgatgctaccccagggaaacattaaaagaaactgttagttgataagattatagagagctacttaaataatctttgtgaaatccatttctaactccattaatctttgttgattaataatttctttctaaatgtaagtatcaagatcaagcctatgtaataagattagaattgcttcattggaaagctgtttgtttcaagcaggatagaaacaaatacttcttttaaagagttggatttttagttccgctttccacaggcttgttattgctctgtactattaaatgtaatagttcaacgaacgtaaatataacagaaataattattttctttatgcttaatttgttatgtcgtgatattcttgattaaatgtttcttgtcgattcacaaattgtaggaaatagtatactgtattgtatgtaaaatcctatacatatcatgtggatttggaagttttatgttttgattttaattcaaggtagacaaattcattatgtttcaaatattgaaattactatcacccatatatttttggatgctcattaccttctgttaggtttgcagatatgatacaaagaggtaaatttagctactatcaaatatgctaattccttcagctaaggggttatatatcatccatcaaactttctcagtagtctgtggtcctagctctggaaggacctccatccaccagaggaacacccataacagcagagaagtgccctctcctcggaggactgaggttccgttttgaaggtcctcccttcaagggtctaagttttaatattctaccttattccctgtgttcgctcagtcctaggggtggtagctctttcttgaagttgttatctccatgatattttaatgttcttttcccttttttagttacttagttagcaactttattcagtttttaccatcctgcatgtgaaattattattgttacaatgataggtgcaagttccgtttcctgacaagtccttgaaagatccagggcattagtggataaggagcataacccacctgagttataaagctatagctaaataaaattagcctgccccataggagaaaacatgactgtgaataacatattttagacctatgtctatctgaaatagtgacaatttcagatagcttttaattctcagatgggtacttactatttatctggaatatccaatcatttataattctttattatatttctataatgtgtgactggatttcataaatatttttataatagattaatggaattttagcactagtatttaatttgaattttgtatcacttttgacttggttgaggatcgtaatagaaaacagtgatcttttctaaaatgtaatatgtctttagaactcttaactacccagggtgtttaaaagcaaactatggttaaaaaactcagtagtctcagccctacttggaatgatttcaaacactttgacttgacaacttttctttatgaccctggtatctaaatactgacttccaattggtgcccagtaaatcttgatattacagatcaaaattgcttctgattgatgccaaaattctttaaacttcaagtttcccatcactgtcaagagttcactttcatcatcaaggacaaaataaattgtactaattttggcattgaggtggtggataagtattgacaaataaagtagaaattgattgtttctatagtggctattgatatacctttcagagtcacaatcaaagtaccaagctctaatttataattactctcagatcaatacaatatagatatgtctaaaactagtgtctttcttcaaaatttcatagattacttgaactggcttagttacttaaggcaagagattatttgccttggtaagatggatggtgctggagctatgtatgctgtgtcatatattcttggcttgatactgcatatatatatatatatatatatatatatatatatatatatatatatatatatttgttgttgttgttgttgttgttgtttttaagactgaatcttgttctgtcacccaggctagagtgcagtggcacaatctcagctcactgctctgcaacctctgctttctgggttcaagcagttaacctgcctcagcctcccgagtagctgggactataggcacgtgccaccacacctggctaatttttgtatttttagtagagacggggtttcaccatgttggccaggctggtctcaagcttctaagtgtttgagaaactcccaaagtgctggggttacaggcgtgaaccactgcgcctggccatgctgcatagttcttaataaataccaaatttatattggtagacagtattagtcaccagagaaggaagagtttagaatacattcttctcttttcacacccgtcctttccttcaagcttctggctcagtcttgaacagccttgattggtgttctatctctagctctgcagctgtttctgaattgggcaatacttggtaagaccatccatttagttcctcaccaaaaagttggatcactgtgaagcatcaacaatatagaaaatttcagatcaagattcatatttactgagtgctaatcagaatctatgaacaattatctatgacactcagtctgaataattccatactctacaaggtttctgtgaataattaacagtagcttttttattatcttctgaatgatcaggtatataaattgttatgtatttcacttaatggttgtttgaaaacacacacacacacacacacacacacacacacacacacacaccagtgtaacccagagagtgcttggcacatggtggtttacttacataaatgaataaagagtgattcaacaagtaaatatggcaaaagtattctaaatattctccctgacccatccacatttaaactacaatataattatgctgtcttatcctacacaaatcaataaaatgatgaaaatggggtagaaaaatcagaaaatagctataaaaaataatttgtatttctttagaggcatttagaggcatttgtatataacattaagcagtaagtattcatgaaatgacttaacaatgttggtctgtgttatagatctaagacaattctcatactcaaccattgccttcaatgagattacaagtaatttaaaatgcagcaattttaaagcaataagggaatatgcaatgcatctaccatttatatttataatatcagatcaggtattctagttgactcctggctgcttttcttccaaggtagctgggtatttgactgagcagttatatcacactgttactctgatatttggaaggcagaccatgtgcctgcttagcttgtagctcgaaggagaaggggtcggaaacagccaaaatgttactgaatgttgctattccagctgttttaacaaggtgttacacagacaagaattgggtggtttgtaccaaggatagtaggaaacagagggacttgcaaaattcaacagcttcttgacccctaatgttgggagataaatctgtggcccttatttctaagtgtattgtgtccaatactcttgtaattacatgggaagaggaaaataaagaaggtttaagaactgtgtttactttaatttgtggttactgtggcattgcgttgcctggaagcaactatattagaaacctaccaagtttttgagagaattgtattgacaaggaaactatgagcctatccttaaatcccgttgactcttcaaacagtgaaacagtcctcagagccccaaacttgcatccaaaaaaagtggacttgtatttttgcacagttcagaaggaaggcagagaccatagcaccaatctcaatatggccacagaggataatgaacaagaaggaacctacagtggaactaagccagaagctacaaagaacaatggggaaaggtgctcctctgggggacagccatggtccaatcaaggaactttcttcagtaccacggcaaagttcctcatgatgcctgcctagtttttcactatttggactagtgatgcttatatgtttcccatgtttccgttttctgtattacagtttatactgcagttattctgtccttacttcacaattgtgcattgtgttcatggtggtgatggtggtgggaagcagaaaacttgtattttgttttgttggttaccataatgcaagtgacactgctgaaccaaatgatgcagattgtgtgtcagccacagatcatgaactgtgagacatgcagtaactgaagaagagatctggggatgtttctttttttggttgtggagagaagaaagtcagtgaatattctaagtgtggaagaaaggatgacagatatttggtgagaaaaaggccaaactgtggcagagactgttagcttttcactagaatccactttttcctccttccatattagttaggcacttggctatatatctaaatgatatttattagcctcaattagttaagtatgtctgcatcactaagttctatacaatagaatattagttaaagtagcaggtactatttcctcattcttgcccccttgtggtggaatggaataccagtgacaatgaccacaataatcttagaagcctattattgaaactgaaagaacaattgtcaagctgcttgaagtaaagccacccctgttttgtaacttcagttaggctgcaacattctctggactctccagcaataagaaaatacacttccaggcctggtgcggtggctcatgcctgtaatcccagcagtttgggaggctgaggcaggccgatcacgaggtcaggagatcgagaccatcctggctaacacggtgaaaccctgtctctactgaaaatacaaaaaattacctgggcgtggtggcaggtgcctgtagtcccagctacttgggaggctgaggcagaaggatggcatgaacccagtgggcggagcttgcagtgagccgagatagcgccactgcactccagcctgggcaacagagtgagactccatctcaaaaaaaaaaaaaaaaaaaagacacttctatttggtttgagacattatatttccagtatatttgttacagtatttttgcttgcctagtctactataggcacccatgaatacttttcaggtgatatgtttttccctcatgacatattattaaggcaaccaagacaagctctgaagtgttctcaaattatttgaaggagtagtaatggaaattttctgctgataatagatggctagtctactccctcttttttcttcccttgccccttctttcttcccatctttattgtctatcgcaatgctgttggagtccatgaaatcctgcttgccaatagcaacatatgcaagttagtttgcatggaggtaatgcttgtaagactagttataaattataaaaacatgcaactgttgtaagtgtctccattagtaggacactgtttcaataatgaggatttcactgaaataatgaaaaacgccaaggatttaaattttatgttagcattgaccacatttactgataggaatgagttttgctcattgtagttaagctgatggaataaaaacagtaccttccacatggttgacctcacaggtttatttatttgcttatagatccaacaaatatgcattgagcacttacttcgttctatgccttattctagttactaagctataatagtgaaaaacttctgcccttatgtcattggcattctttcaggaggcagaaaataagccaaatgaaaaatgataataattaataattacatataatatttagagatgacaaattttgtagaggaaaactagagcacaggtgaaaagggatagcaggcattggaaagggttgcaattttaaacaggaaggtcgagaaaattcttgttataaagttgacatttggataacctgaataaggtgaatcagcaagccaagcagatacttgggaggagaatattccaagctcttctgatcaggaagctttcctatggtggtagcatgacccatgtgactgctaagcagcaaagaggccagcatgactggaataaagtgagcagatgagagaatggtaggggtaaggtagttaaatgagtatgtacatataatagagggccttataacccctgtcaattactttgacctttattctcaatgaaatgggaaaccattagtgggttttgagcagaagagtctcaatctgttttacactctaataagatgactctggctactgttttgagattagatggtggcagaggtggggtgaaagcttaaaagcaggtaaaagcagaaagaccaattggggaactattgtagcaatccaggccaaagatgtagaaggtttcagccatgagaatagtgaaagtcataaaaattgtattctggatagatttgaaagataaagacaacaggagtttctgaagtactgtgaattgtgagagaaagaggaaacaaatgacctgttacattttcatacacctgaaaggcaaaggctcattctccttatactgggacactaatataaacattataaaaggcttttccaaccaggtgtatcagctggtgatccagaagccatgacagaatgaggaatgccttctcattgttcatctaacatttccattaaagaaaatggaatgtttcccttctgcccacttcctagcatcacttcctttttattttaataattctgtagccaatcataacccctgtgctggatgagatgacagaaacagaagtctatttgtaaagaaaacagataaattaagaaagaggaaatatgaaatgttaagattgttatgatgaattaccttctgttaatgatatatactattattttgaaggggaaggcaaataatgcatgaaagtggactctaaaataaaagaaattttcttattacaaaaccaataatgataagatagcaccaaactagtaatacaatggagtttagtatttataacacaaaatgttccgttaatatattttatgttctttatgtttcatttgcaaagttggctatgctagcaaaggaggatatattgtataatattaatgggtttaaaacacgataatgtaagaagaagtattaagactcaagggcatggattattggtacattaatacctgtcttatattgccaagatccccactttgccttcttatacttgaaagggcacccaaggtatatattaatagactgccaaagtaatgcttaaaatataattatgttacagtataagaaatggtaagatacttaaattgacctcttgtgatcaatttctcctgttacaccaggataattaattattatatcttcttggattttcaagtacattcaaatgaattgtttccccttgacatatgggcttgaaatgatgtctgagtattacggagcatagacacataaataagcacaaaaaagtgaagaaaacagaatatagcatgtatttttttattttcctttcccccccaaaagtgcataattaataagcactattcaagaaatatctaccttatgaagaaaattgtattaaagccaaagttcagatttcatttagcaagttctgtcatgtttgaaaaattgagaatctctcacacattcaatatggctttgtatgtgtgaagaatggctcaagtaagtgtccactgcaataaacttgatgtgaacgttctttgataccaatatacatggatcaataataaaaaaggtaaatgtccttaggattttaaaattcatccctattcctttccacagcaaatgctattacatatcaatgaattgtataatttggatctgacatgctgtataatgtacactttctgtttgttatctcatacaccaaaaaagctatttattagaaataattagaatgagtataaatgaaactaaagatattctgataaaagcgaatatatatatatatattttataacatgatacatttctgctttattactgccaatcaaagcaagaactttaccatgttaaatatgcaacaccttttctccaactctgcacaaaataatctggtcaatgcataagtcttagtcctcctcaatgctgatgactaaaagggtttagtatatttctacactaatgtatggtaaaataaaatgatatgtagccatagtccatctgaggtaaaaaatgaaaatcacgtttgttttatatttaagatttacttgtacatgtatgtgtgtgtgtgtattctcacacatttatgtatatatacttatttgtattgatgaagtgagtttattcagctcaaaattaattttagagtggcaaaaactgtaattatttgactatcttaaatattttaaatttcaatcaaaatatttatttatgtgttatctatgactccaaaaccaagcttgttttaaaaccatttatttcagacaacaaccactattattatatccctaaaacattgtttttggaattattaaaataattttaatttaaataaaaatttaagatttgattcaattactgtggaaacaaatcaaatgtccaaggacatcaaatcaaaataaaagaagtaaactggttactaaatataaaaaatggcaagcaatacaattttggcagcattaaactaaatattttcttattgttaaacttactgttatatggaaaatcatttctatttagataataaagatgaggtttttttttctcttaaaggactaggaaatataattttgatagaaaatttaagtaatgtttcctcccattgtctgacatgagtttatgcaaaatcctaacacttaacaaagagagcagaacttgttaacttgtgttctgggtaaaaagaccataccatcttcagtcaaggaaccatggaataatctttggtctccacacaatctagaatgagccatgagggaagaaatacctccagcagaattccaccttctagaaaaatatcccttcctgattttttccatacttttatccttcactagatttgacaactaattactaaaaatcactactacttagaaactgattatttatttatctaatatttaccaactatgtaccaagtaatatagctggagctggggatatagcactgaatggaatggtccagacccttgcccttgtggagcttacattacagaaaaaagtgtcactggttacctgtgccttataaatcattagacaagctccctgacttggtcattgatcaaaagattaattcctttctgctagagatgacaagggggtatcactgagagtgactgtctttctcagatgtcatgtgtgaatcctagttctctattaacggaaagaattaaaaaccttcagagtaataagccaccaatgaggtgaaccttaaaaatggtgccaagccttcttatctttacaaagatgatttttgttttcacttgcattaggattcttttcaggtacctgtcacacataaaccacccaattaagatcatttgaagcggttttcacatgaaaagaaaactttcctgtgatggttctatttcagtttattttggggttattgtgtcagtttgctttttgttttaagtaaggaagaaaatagtgaattttagaaaagtatacattagcaagaatcaatataaaatgctattcaagcaataacaaatagagataatatacaaagatgtgctgtatctcaacctgtttatgttcaaaatttttatctctgggtagtaaaaattatgtcttatatatgcagacaaattcagagggatccaaaaatagtgttttcttctttaatgttgaagatgtagagtgacatagttgtttttcatatttcgtttcaatacatgtcctagtaaaatttcttatctacaaattcaaggcatacacctactgttgaaaatttatggtaattacataaatatgcatttgaaaaggtacaaaattttaaactagaaacacaaaacatataattatataacagccataactaccattaaaaaagtgagcatttaactttttaaaattagctgtgctaaaatatctgacaagtttatgaaaacctgatggttccaattttagaggtgacatataatttatttcattgcatatttttctagctattttgtgaaaatgtttaaaaagtttttttagagatgacatcttgctgtgttgcctgggctggagtggtacaatcatagctcactgtagcctggaactcttggtctcaagcaatcctcctgcctcagcctcctgagtagctgagagtacaggcaggcacaactacatctggataattatatatttatttttattttttaggaatagcgttctccttatgttgcccaagctggtgtccaatcactggccccaattgatcctcctgccttattctctagagtagagagaattacaggtatgagccacctgcttctggccacaaatcaaatgcactttttagaaaatattaatgccagtatctccagaataaattaacttcactactttacatacataaattaatatagcatatgtctatgcaaaactataatcataaattatgtatctgcaccccaataatactacctatgttcctaatctttatgaattgtaaatctcttatacaaataacattttagttaacaaacacacataaattgtatatgcaataacttcttacccctaactcttatttcctcctaacttatttataaacaggctacattatgtttgacttgaggctttcagtgatatcgctaacaacaaattatctcttcattacctgagttataatgattctcattatctatgttcatattcttacaaaccactgaggaaccaatccctaaattgaaaatgattgttcaccttctcttgaggccattgggattaatctcattaaattaacagccttatttatgtgggtcaccgcaaaatgccatcccttatattctagatattgttcatatatccaccagtcagactctatctctcacttacctctgatgtccttccactgtatggtttggaattaaatacctgtcatcaacaaaatattctatgtcttcaatcccttcaaggtacaatttatcttcttgcttatactggctatccatcccctgagaatatcaatttccttttctaattgagcctgtaactccttctttttaatccttctctggagatttataacttgtaatgaatgttaagcatgtagacgctatcactgaggtacataaatataatttattttagaattttgcatacatatatattaattgacacacacacaaacacacacatacgcatacatagagagagagagagattgttcttgggatcgtgacataaatttcccctaccgctggatctgcaggtttattcactaatgggtttccagtaggcaaaacaatgagcttggaacatactgggaaagtagtaaacatttgttgaattaatatcttaactaataacttatgttccctcctactcttcacttacttctagaccactttacttcctctctcctcccacaaaattacaacttcttataagtacatgctttgtgactataccattagcttcccttccattttattcatatactggcctcttcatcactctcatcatattttgaataacatagcacttgacttgctgtcatccttgtttgcaatgtggatattgaatccaagcagaaagtccagccaacaccctagcctcacagctccttcctcccttggtcccaacaactttcaagtcttaattgtaggttttctactctgtgagcaccatttcttatctctccagcttgtatattctaatcactcactgcaacaattctttgatgccagtggtattaataattaattgtttacaccattttttttgcccttgataatagccttcctcttcttttcttcttcccctgagtagatgccaaggtcttcctcacagagtttcaatttcttgcccctctcttcttccacatttcttgcctgtcaaaaccccaactctggttaaacctaattctctgcctgctttgcctacatctgttcagctgagcatagctatggaaaaaaatcagaatcaggctgacctgtttcatttcatgtttataacctcaactcacaagttgaattcaactgaattttctctatcaattaacttactacaatgtgagatgagtatttcacaccttcctcctccatattcaaatccctaacactctccccactcactttttctctgagtgacaacatggattttcatttcactgagcaaatagaagaaatcagaagaacatttttattcttccaccaccaaatccatcaatgatttatatttcccttttctctggatgttgcctcggtatttcttctgtattgacttacctggagctgggtagtctggaatagtcattcacgtgtttgaagcttcagttgggacagctggggaaagtttctctgtgatatcttattttccacatagtggcagaaatggtccagcagcaagaaaaagcaagctccaatgaacaagaactcatttaaacctttacttactattatatcattgaccaaagcaagtcacatggccaatattagagttcatgtgggaggggaatactcaaaagtgtgcatataggaaaagaaataatggcgactgctatgaactaagtgcttgtgtccctccaaaactcatatgttaaagcctaaatctcccatgtgatgatatttgaaggtgaggcctttgggaattaattaggtcatgaaggtagagccctcgtgaatgagattagtgcccttatataggaagggacaagagaccttactttctttgttgtccaccatgtgaaaatacaatgagaagatggccatctgcaaaccagaaagtgggctttcaccaggcactggatcttctggccacctcatcttagatttcccggcctccagaactgtgagaaataaatgttcattatttaaatcaccccgtctgtggtatttttgttgtaacagcccaaactgactaagatagaaattggtacttagaagtggagtgctactatttcaaatacctgaaaatgtggaagtgtctttggaagtaggtaatgggtagagtctggaaagattttgaggtgcatgctaaaagaatataatactgctatgaggggacttttaaatgtgaatctggtaagagctcagaaagtaaagaagagagctagaaaggtctctttcttattagagaatatataagtgatcatgtaatgtcagcagaaatatggacaataaaggccgttctcatgtgatctcagacaaaaattgggaaacatgttattggacaatggagaaaaggcactccttgttatacagtggcaaggaacctgggtgaattgtattcatgttctagtattttatggaaggtagaatttgcaagcaatacatgtggatatttagctaaaaaaaatttctgtgtatagttttaaaggatcagcttggttcctcctgactgcttatagtaaagtgtgatgagcaaaaggaattgaagagaaagaaggaatcattaagcaaaaaggaaccaaaacttagagatttggaaaattcttagcctatccatgttgcaggggaacacaaggggtgtggccaggctaccatttgataagaagattagtatgagtgtgatccaagaacctaatcagacatctcaacagaagccagttatagagacggaaatacaccacagaaatactggcaccaaaatggaataaaatgaagaaaagttgttggacttcttagacactacagcactggaccatagagctattcaactgcaaaaacatgttattcttcaagacaagagaagaatgaccctcaagtcattttcagagtttatcagggctgccactctcaccaaaggtccagagtgtatgggcctgggggacagggctgcctccatctcaactttaaagggcaagaccaatatgtgaacccaccaatgggtggggtaatattcttggttccaataggccatacagaggctgccctgagccatggagtcatgacctccacttggcagagcaactggggcctgtgtttcttgcctagcagtgctgcagaggcaaaacttacatcccactggatccagaggcagagcatcatcaagtcaagaggattattgcttaggtgtaagctcttacagagtttgccttgctaggttttggagtttcttgagacctgacacatctttctttcttctgatttctccattttggaatggaaatatttatcctatgcctatcccatcactttattttggaagtacataacttaacgggtttcacacgttcacagggagagaggaattttggctcagaataaatcatacctcaagattcaaccatatataatttagataatatttagataaggctttgaactttagatttgatatgagactaggtaaaacatttctgttggcatggaattaatgtatttttattgtgagaaggacatgaattgtggggggctgggaatggagtgctatgggctatatgtttgtgtccctccgaagttcatatattgaagcttaaattcccaatgtgatagtatttgaaggtggagccattgggaggcaatttggtcatgaggatggagccctcttgaatgggagttgtgcctttataaaaagagacatgagatggcgaaaccccgtgtctactaaaaatacaaaaataaattagccgggcgtgggggcgtgcacctgtaatcccagctacttgggaggctgaggcaagagaatcgcttgaacccaggaggtggatgttgcaatgagccaagatcgtgccattgccctccagcctaggcaacagagcaaaattccatctcaataaaagacaagacatgagagactttgcttctttcttctttgttctctgccatgtgaaaatactataagacagtgtattagtcagggtaccttagaggtacagaactaataggatatatatatatgtgtgtgtatatatatgtatatatatctttttatgtatatatatgcatgtatctatatatgtatctttcatatatatgtgtatatatacaagtttatacaagtatatatatatacacaaacacacacatatatatacacaagtatatatatgtgtgtgtttgtgtatatatagtatatatatatgtgggaatttattaaatattaacttacacaatcacaaggtcccacaacagactgtctgcaagcttgtggagcaaggagacccagtccgagtctcaaaactgaagaacgtggagtcagttgtttgagggcaggaagcatccagcatgggagaaagatgtaggctgggaggctaggccagtctcgacttttcatgtttttctgcctgctttatatttgctggcagttgattagatggtgctcaccagattaagggtgggtctgccttccccagcccactgacttaagtgttaatctcttttggcaacaccctcacagacacacccaggatcaatactttgcatccttcaatcccatcaagttgacactcagtactaaccatcacagatagtcatttgcaaagcaggaagtgtgcactcaccaaacattagatctgacggcaacttaatcttggatttcccagcctccagaactgtgagaaataaatgtttattattttagccacccagatcctaatatatttgttacagtagcccaaactgactaagatagcaaccgttttgcgaacaatacaccttctttttagccctttgtttctcttataatcactttcttgcaaatataaatgtagcattgttatatttttaccatattttatatgacagaattgatgcttcttcagttgagctaggtacttacatacttttcacatcatttctaggagaaaagttgacctgactttttgtcttaatttttatacgtagattgttggggaaatttttttgtgtgtgatggagtctttctctgtcacccaggctggagtgcagtggtaccatcttggctcactgcaacctctgcctcccgggttcaagcaattctcctgcatcagcctcctgagcagctggaactactggtgcatgccaccacacccatctaatttttctattttgaatagagacggggttttaccatattggccaggctggtcttgaactcctgacctcgagatctacctgcctcggcctcccagagtgctgggattacaggcgtgagccactgtgcccggcctgttggggaaatttttgcaaattgattgttagaatgatttaggctaactgtatttctctgctctgtatattttagattactcttagtactcttttatgtctctttattttgaattcgtttaaaactaagaataaattttaaaatggtagtttcagagtatccttcacccaaattttcccggtgataatattttacataaccattgcctattgtcaaaattaggaaatttgaaattggtacaatattattaactcaagctcagacctcattcatatttcaacagtttctacatgcagatttttggtatgtgtgtgtatagttctacaaaattttatcacatgtgtagattagagcaatcaatgcaaccaacaccataatcaggatacagatttgtccacaaccatttaaaaactctttcatgttaccccttaattaccatactctcccgcctactcttaactgttggcaaccactgatctgttctagatcactgtcattgtcaaatcaaaattattatattaatagaatcatatagtatgtgaccatctgaagtttgctttttttttcatttagcataatgcccttgagatttattcaactattgggtgtatcaatagttccttcctttttattgctgaataatagtctattgtatataaacatcatagtttatttattcactccttgaaggatatctggaatatttccagtttgggaatatcacagataaagctgtaatgagcatttacatataggttttgtttgaacataagtcttcatttctctaggatatgtgtccatgaatgcagttcctgggttgtatgttaaatatatgtttaacattattttaaaaagtgcaaattgtttttctagtctgtggtattttacacaatgattggcaataatgagaaatccagtttctctgcatccttatcagcatttattactatcagtatttcttatcttctctattctaacgtgtggtggtatctcataatggttttaattggtatttctaccatggctaataatgttagacatcttattatgtacatacttgccacctatatgtcttttttggtgaagtaactttaatttctggcctattttctggttgagttgtttgttttcttaactgttgagtttctgttgaaagtgccctgtgtattctggatatacatcgtttgtcctttaggtcaaggacattttttttggcttacaaatttctaatttttccaataccatatgatgaaaatttgtaagcaaaactaaaacaaataaagtacctaattttcgagaaaggcacagaaacaattcccttgaggaaagaaaaaatccatagtctatgtggatctgtttctggttctctgttctattctactgatctatgcacagtctttcacaaatatcatatagttttgattattataaccgtatagtaagtcttaaaatcagatagtgtgattccttcagcaatttttctttttctttcaaaattgttttgactgttctattttccttgtcttgccagtcttatttttcctcttatctaaaaattactttaacctgactttgctgatcatcaattgctgtattccttttctagttaatttctgcacttttttaaaatttttgactctcagtagtatctaatttattcctgttatttactcatgctaacttctcagaattagtttccctgtaggctcttctccagcaatccacctatagtttttccttcaaatttgagttggagactatcgtttcctaagaaatattcctgtctaacctcaaagtgtaatagctacactttcttttccccttattagggtcaaactgtgagtttttatgaccttaagcacacacacagataaacagacacgcaaatgcatttctgcatataattcaaaatttaaaaattaaaacaagcaataaaggaagtgtgtaacaaatcccatcaaaatttgacttctcctcatgaagaccccattgatgctactctatttgctcgtatttggaatacgaaattctttttaaaaattctctctctcactctctaattttttttgtttttatctttgcctttaaccacctccccaatttgatgcagatgctttgctggtggtttaggaatatgcattatctttttattgagtaatccaacactagcttttatgaataatttgttctatgtcattaagcattcacatttctgctctagctctctttatctttgctgtctctgccatgtgacaatcacctgatttgtctctctcttttaaattactccatggagcccctaatctgatgccatattattttattctctgcctcacattttaccttagaatttattcttaaatcttcatcccttttcaaaataaatgtattttacacatattcctgtatatatttctgttacattttttgccaaagattgcaaacagttaaattacttctctaatactcttctcttttttaaaaggtatatttccctcagtgcttgaacttaactaaatagtccctcagaacttcttttcataattaaattatttgatagggtctcttgggccttgtgtttgcacagccatactgaatgtgaactaaataattctgagtactttttgaaactttctttttacaaacagtaatgtattatttagaagacagagcaataggattgttcatattgaatgaaaataatgtctacagttatttatcattttaaggagcagagacactacttaattacaacagttttttttttttttttttttttttgaggtagagtctctgtcaccaggctggagtgcagtggtgtgatctcggctcactgtaagctccacctcccaggttcaagcgattctcgtgcctcagccgcctaagtatctgggactacaggtgtgccaccacgcccagctaatttttgtatttttagtagagatggcatttcaccattgttggccagatggtcttgatgtcttgacctcgtgatctacccgcctcggcctcccaaagtgctgggattacaggcatgagccaccgcgctcggcctacaatagttctttttaatgtgcgttttttactcatccaacatggctaatctctaatgaattaaaaacattttgccaaacagatcacaacccttcaccttcaaatgtacatttgttggtattgtgaggtctttggtactcaaccttggtcatcaaagcaaataagttttgactgaggactgacagaatattctcactgaatatttaactcctaaattatttaccatgcctacttaggccttcatttttattgcataatgaggcgtatgaaagcacattttagtctgacaaaataaaatccacacagaaactatgtacaaagatgcttgtgaacctacatgctggtaaggaattgtgaagcagaatattcaggttattttataaaattaacattaattgaaatgacttctttctgctcctttggcaaatctttcctgaataagtatacttcagtgagtacaattcttacacgtgtgaacaaaatgtagcctttgttcagatgacagaaaaatctataatgtaggatcagaagtaactgcagcttccttcactgcatatatctgtagttaggtgacatgaactgacacatatttcttattcatgagttctacagtgtgagaaggaggattcacctgaatattaaactgttataaactgttaatatattctagctagaattaattaagctggtcacattatttcaaagaaaaggttcgtgtagtgtctgcttcatacatatcaatgcttctcatttggattccagttcctgtggcccgcagcagtctttgcaaatgtatctttatttttctttattcttctaagaattaagaaaaacgagatttggaaaaaaaacctcaaactttcaagtgaccttttcttctgttcacatagttacagacattttgctgtaacatgtatgagctttttgaggggcacatatgcacagtctcacatctcatgtttaagccctttcctcttctttgattgtttcagttgaaataagaacacaggtcacaccgccctttaacagtggagtctgctgtttaaaaggtgtgtggggcattgtactaacatcagtagcttctaaattgcctttgtactttaagattattttacagatattatttagaacagccatagtttgtttgcttgcttccttccttccttgcttcctccctctctccttccctccctccctccctccctccttccttctctctcttttcttttttctttctttttttttttttttttttttccctcaagacggtcttgctctgtcgcccagactggagtgcagtggcatgatcacggctcactgcagcctcaaattcccaggctcaagtgatcctcccatattaaccttctgagtagctgggaccacaggcttgtgccaacatgccctgctaattttgggggaccttgaaggtagagacagtgtctctctatgttgcccaggctggccttgaattcctgtgcttaagtgatcttctgccttggcctcccaaagtgttgggattacaggtgtaagccaccacgcctagcctgacatagtttttttttttttaataatacatttagcataaattgattaatatttttcctctgaagcacttttagtttgataagcaagatatttaaaataccaccccaatatacaaaccttcaagccttaggagtcaagttctcctatttgaaattcaggatttcataatttaggaatgatgtaaatcctgattaagtaaggaaattgaggaaaattttaggaagtataaaatgtactttccttcatatttataaaagcttgtagcatttaaaatttggttgtcataatgatacaaaataaacattcaaatagaaatgtcaattataaactaaattttaaaattcatctaagaatagcaaaagtaatagaatatacatggattcagagtcataatagtaacatatctcttaaaggtagagaaacattcaagatcaagacaacaacatagcagagcctgccatgatttctcctgttctcaatttaaatagttatacaatatgcaaaagacaaaagcacataaaagagaaaatatgaataagaggcaaaagaatgactgagccagacttcattcccacttcatttgatttatttatattctcttctttcaagaaaagatttaaaccagtttacaaggataaacaaaatatgacaaaagagtataaattaaagttggaagaaataagaaaggataaacattgaggagataaatggagccaggaatatgccaaaatgcatgctataataactcactggctgacgttgagtcacacattcatatttaagctttcaaatagccaagcaaaagacatagttattttcatttgtataactgaggatgttttgagattcgctaaaaccaaatattaaaaacaaagacacacaactatattggtactaaggaaggattttaactgatggagcgcatcaaagaacataggcaggtgcattaaatgatgttataaagaatatccttgtaatggtaagtttcatagagtggctttcatgataaattaatatattctaagaatattacttatggacaatcactgagggatgatctaaaggattaccagttggaggtacaatgattctctacagaaaattgttttgaatcatctttagactatagataatttaaggaaacctaaatatgagaagaatacaaaaatgcatcgaaaacaaatgaagagtgtaactgatactgaagaaaattgaaatagtgatatggagaacacattttaaagggcatggtagaatgcagaaatacataaaaatgtaattaataaagaaaatagaggatagagcatcaagcttcagaaaacaaggagacgtttatagagatttttggtcataaaagacagttgtaaccattcatagaatgctatgccttccatattttctattaaaataaaaacatataaataaaagaataaaattagatcaacattgaaaaataagatgctgaaaatgtacatgctaaaaaataatggctatccaatttataaatcttcacatgcaaaattaaatttgtctgaagagaacatagaaaagagtcttcactgggccaacacacagacatactcaaatttgaaagagtcagaactaaattaaagataggctctggaatagtttttcttagatcagcccctaatgctaatttgggaaccatagaatgatagatcatggaacccattctaaccgtggatggagggctaagaaatgtaaggaatactgtccatcgtagatccccttaaggataatttggacttcaaagaaataaccaatagctgaaatatgggtgtcaagtctttaccagaatgagaaagctccctgtcaaaagacaaagttagctgtagcttcattctcatttcttatgtgtaagtagaattttaaaataacaagtttcaatcaccagatatcttaaaatctcctcagcccttttggaataaaactaacaaactggacaggtaaacacataattgtagaaaccttcccaaagaaaatgatatagaacacatataattgctttctactagtcatgaaaaaagtgagaaatattacatatatgatgaaaaggactagtagttcaaaagaaggacactatgaagaatcagcataaaggtctttctgtgaatattttttcaacaaagcaatgtttaaaactatatttttaatcccccaaaacttagaaaatatacttaatacttcaaatgggaacaatctgaaataaagattactttaaataaaaatcaaaatgtctgaatattcagagaaaacaagaaacaacatactgaaaacaagcagaacaaaaaatattttaacatccaaaggaaaattttaaagaataaataggttgggggccatttaggaaaaggagaaaaacttacagaagaaaaagtatataaaaaagtaatatgtcaaaagaaattcccagagctaaagaaacatttaggtcttggaacacaaatgtatcccagaatacttagaaaaattaaggtaaaaatctttatacacacagagacacatacacgtgacacatacatcatggtgaatttggaaatttttaaaaaatgaaattgagaaatcaatttaaggaaaaattaaaaagaaaaaaatttttaaattattagcattctgaaatgaattttttcataaagtttaccagatttttttactatgtaaagtattaacagaaacgttcaagtagaagtttaagaaggaagaaattataattcaagaattccatatccatacaaactgacccaaattatcaggataaaaaggcatcctttacataaaaaaatgaaaaagtactcaaagcaattcattaaatgaaccaaaagattgtatgcaatgatgaagaaaaggcgatgtaatgaaaatggtgaattgtggaaactgcaaaatagaataaatgtctaaatgaatgttgtcaggaaacacagcccatgcaatggatatagatagatataaatataatacacataccacaaaatttactcatttaaagtttacaattcagtatttttagtacattcagacaattgtgcaaccattgctataatccaatgttagaacaatcttatcacaccaaaaagaagctccactctcataaagagtcactcctattttttttttttttttgagacagagtctcactgttgccaggctgtagtgctgcggcacaatctttgctccttaaaaccactaatctactttccattttatagatttgcctattctgagcattttatataaatggaatcatataatatgcaacctttggtgactggtttcttttatattttgaaagttcatcaatgttgtagtatgtatcaatagcttatccatttttattgccaaatactgttgtgtcatatagatataccacatttgtctatctagtcatttgaaacatttctactttttggttattatgaattatgaaatatttatgtacaggtttttgtttggacatatgttttctcttttaatttttattttactttaagttctgggatacacgtatagaatgtgcaggtttgttacatagatatacatgtgtcatggtggtttgctgcacctatcaacccgtcatctaggttttaagccctgcatacattaggttggacatatgttttcattactgttgggtatataactaggagctgaattgctggatcccacagtgactgtaggttaatgtttaaaagagctaccaaactgttttccatagtgctatttttattcctaccagcagtctatgagaaattcccaattctccacattgttgctaacacttgttattatctagttttaaaaatattatgattattatagctgtcttagtagctgtgaagtcataaaacattgtgattttaatttgcattttcctgatagtaacgttgtgttttccattcacattttattcatgtgcatgtcttctttgaataaatgtctattcatattcattgcccattttaaattcatttatgtaagttttattcagttgtaagatttctttacatatttcttttatttctttttttattaggcaaataattttcaaattttttcctattttctggctcgtctgttcactttttatggtatattttgcagcacaaatgcctttaattttggttaaatgatttatcaattcttcaaagaataaatttataatttcttcattgcttgtactttgggtgttgcatctaagaagtcattaccaaacacaagataataagcatttactcttatttttcttatgttttcttccaggagttttatgattttgacctttaaatttaggtctatgatccattttgagttaattttggtctatgttataaagaaagttcaactgtattcttttacatgtggatgttcacttgttcaaactttagttgaaaagacatttgatgaaaacgctatttcatccttgacttgttggggtacgcttgttgaaaatcatttaactataaatatagtagtttattattagactcttaattctgtcagattgatctacatgtctatccttataatagtaccacactgtcttaattactgtagctttatagtaagttttgaagtcaggattttccaactttgttcttttttaagatcactttaatctggatctcttggatttctgtattattagctataagtctactcagatgttctatttcatgattaattatggtaggttttgtgtttctaggaatttgttcatttcatccacactatccaatacattggcatataattattcacactacttttttataatcattgttatttctgtacaatcaacagtaatatccctattttcatttctgattttagtaatttgagttttttctcttttttcttagttcatctagataaaagtttgtcaattttgttgaacttttcaaagaaccaatttttggtttttatttattatttatttatttatttatttattttttgagatggagtttcgctcttgtctcccaggcaacaatctcggctcactgcaatctccgcctcccaggttcaagcaattctcctgcctcagcttcctgagtagttgggattacgcattcaccaccatgcctggctaatttttgtattattagtagagatggggtttcaccattttggccagactggtcttgaactcctgacctcaggtgatctgcccgcctcggcctcccaaaaggctgtgattacaggcataagccaccatgccaggcctttattgattttttaaattgtttttctattctcttttttgtttatctctgctctcatctgtattatttctttccttctgttagatttaggcttagtttgttcttatagttccttagtttgttcttatagttccttaagttccttaagtaaaggcaggttgatgatttgagactttactccattttttttcctttttttttttttttttttgaggcagggtctcactctgtcacccaggctggagtgcagtggtgtaatctcggctcactgcaaccgccgcctcccagattcaagcgattctcctgcctcagcctcccgagtaactgggattacaggtgcatgccacgacgcctggctaatttttgtatttttagtagagatggggtttcaccatgttggccatgctggtgtcaaactcctgaccccaagtgatctgtcgtctaccttggcctcccaaattgctgggattacaggtgtgagccaccacgcctggacttacttgatttttaatgtatgcatgtatataatttttccccttagcatggctttcattgcattccataagttttggtatgttgcatttctgttttcattcatctctaagtatgtttaaattttccttgtaatttcttctttgatccattgattgttaattatgttgtttaatttccaatgatttctaaattttccagtttttctctgttattaatttctaacttcatctcgttgtactcagagaagatactttgtatcttttaaatctattgagatttaatttgtggcctaaaatatggtctatcctggaaaatgtaccatgtctacttaagaagaatgtgtatgtagctgctggtatgttgagtgctctgtgtttgttggatcaagttgctttattatgatgtttatgttctcttctcatacttatcttttctctggtggttctgtccattattgaaatgcaggacactgaagtctccaactattacagaactatttctccattcaattttgttagtttttgctggtcagaccattgatggtctgttattcattgtgtaaatgtttacaattattatatcttcttgcaatattgaaacttttactaatatatggggacctgctttggctctgattaacttttaaaattaatgtatattttgtctgctggtatagccatcgttgctttattatttgcatgaactttttttttttcactttcaatctacttgagattttggatctaaactgaatcggttgcaaacaggatatagttagatcatggtttttaatccattctgctaatctgtcttttcattggagagtttaatccatttaatttaaattaattactgatgaagaagcacttctgttttattgctatttcttttccatataccttataaatattcttttctttatttccagcattactgtcttcttttgtgtttagttgacttttttagtagtgaaatgtttcaattacttcctttgtgtgtattttatagctattttctttgtggttaccatagagattacatttaacatcctaaagttatagcactataatttgaatttataccagcttaacttctgttgtgattttctaattttttgtcttaaagtctctttctggtaagtggccataagccaagacagccactctctagaaaagccccgactgggaggagtattagattgagattgccagtaaggaaagacacagaggaggcagcacaacaaagcccattagataaccagaagcagttttattatttgcccaagaacagggaacagcatgtcttgctgagccaaccagaagaggaaagccatccaggacacatgctcacctagtgggaggggagcaaaagagagagcaaaatacctgtgagccaaagcccttattggggtccagagtgtgacccagtttggtttcctgcagggaattctaactgatgggtttagagcaagcaggcacaagttccgtggagtctgtgactgagaggtggttgccttggcatgtcttggcagtccatgtggtatatgggagtcagtgggtcaggtaggttatatctagctgtcccatgggcaggtggttgtcaggaggtagttgtataaactcctcccagttcctcaagctggatcaaccaccttgaggacttgggaggaggtagagaactggaaactatgcaaagtgtgactaagccccgcttctggtatgataaaattaaacctatattcaaaatggatgccaaagcaacataaaattatgagctcacaactttgaatagtatacaaaaactgcccctttacaggtcagttcccactgaccaactttttcagttgctgatgttccaaaattatatctttacatataatgtgccaaaaacataaactaacaattattttaaatggattagcctcttacattattcagaaaacataatgtggagttacaaactgaagttaaaataagactagctttttgacttttttttaatgtgttagtatcttaaattatgtagaaaacagtgaattataaactattgctactataacattagcttttgtaattgcccatatacttaccagtaatgaaatctttatttcttaatgtggctttgagtgactgtccagcatcttgtcattttacgctgcaggactttctcgtacatttctttcagggcagttctactggtaacaaaccaccttaatgtttgtatatctgggaatgtcatactttttcctcattttgaagggtatttttgggatatataagaaagttcgttgacggtttttgtttttccttttagctctttgaatattttgcatcactgccttctggcttccatagtttttgatgagaatctgatggtaatcttattgagcatcacttgcatgaaacaagttgcttatttcttagaattttcaaggttctgtctttggctttgaaaaatttgaatgtaatatgtctcagtgtggtctctttgatttcatcttacttgaaggtctttgtacttctcgggtgtttatattcctgtctttcactacatgtggtgtcataaatttgtgtaatatagtcaccacttaatatccaccttcaggcttgatgtaagttgtttgaaaccagttgtatccagtcacctttcacctagttaaaacttcctttccctgaatggttgtttagatatagcctgtttgttcctcatcccagtgacccaaaccctaacacacctcatagttggttactattataagacccaatggtgaacaacagagtcatctaaataagtttattcatttatatgtgttttctaagctagaaaatctacaaccttcacaggaaaccctaaggaataataccatggactttactgaaggcataattacacaggtactcttcctctctcctgctcctcaccctctggttgagctccctgatgcctttggaattccagtcagcctcccatcagtacctgtaacctctctgaaacctgtgagttatgaatttcttgtttcatgcactttggtttcacttcctctttgtctcacctgacacgcacacacacctaaacctaaccttcctcccattcaggtcttttctagaagagtggctgttttggtttatgagtgctctccaaaaaaagacaataccaaattaaaagaaactgtaataatggaaatctcatgtggaaagttttcagccattatttctttaaatatctctcttaccctttctctctctcttttccttacagtattcccacaatacttgtctgcttgttgacgttcagagatctcataggctctgtttaatattttcttcaatctttttctatttcaagttttataatttccaataccctatcttcaaatttgtttcctctgcctgctcaaatatgcctttgaatccctttagttaatttttcctttcagttgttatatgtttcagctccacatttcttttcggattttctctttttattgatatttccattgtgttcaacattgttttttgtttattctttttttgctttctccacttcttcttttagttatttgacagtctttaatacagttattttaaagtgcttgtctagtagatctgacagcaagtcttttttagggacaatttctgtttgtttgtttttttttctttgaatggaccatacttttctgtttctttctaggctttgtgattttttgttgttgagaactagatagttgaatctaataatgtggtaactctggcaatcagatttttctttcttccccagggtttgctgtggttttttaaaaattattttggtttattgtttttgttttcctattgttgtaggcagtctgtgtgccaggagttagcctgaggtgtaaatttaaggtctcttctggtctgttttgaccctgcacctttcaattgacatgtgtggtcactttctaattttcctcacatacgcagttgcttttgaatgttctaaatgtctttaatgtctgatgcccaagaggggaaaaagagaaaaatgaagtgataggaaaatgatactggccttttaaatgccctagaagttattgtggctggtgggggagcgcttgcaataatgcgggaggtacaaaaacaatagtcagccacttctttctctgcacttctgtgattggaagcagcaatcagtaatcagagcacaaatctctggtatttggggaatacgcttcttttttcccactctggctcccataagctacggacaagctgctccaggaacatgtgcacagccatctgcgatggggacaaggataggtagctactattatgttaagagccgaaattgaccaaaattaagtgcagtttattatccaagctctccagagttccaaaatagttatattggtcagattcttctagtgcgattacaattgttgtttaggtgggaagaaagattcctggtgcttcttattctgccatctctccaaaattttctctccaattgatatttgtatattgctcatgtatcctgtaaccttgctgaatttgtttattagtttttacagttttatgtatattcgagttttctacatacaagatcatggaatctgcaaatagagaattttacttcttccttttctatctggataccttttatttctttttcttgatcgttttccccagctaaaacatgtagtgcaatgttgaatagaagtgattagatcggccatctttgtcttgctccttattttaggatgaaaactttcatctttcattattaaatatgttgttagctattttttttttgtagctgcctgccttttatcagattaagaaagctgtcttctaaccctagtttttttttttttttgctggattttgataaatgttttttcagggtcaattaaaattattgtgtggtattattcttcattttcttaagtgttttattatattaatttttaattattaacacatccttgcatttctagtgaaaatctcactgttcattgtgtataatccattttacatgttgctggatttagtttgctaatattttgttgagaattttaaaatctctgatatttatcagcagttttgatctatggttttttttcttgttatgtatttgtctggttttgatataagtgtaatatcaacctcatagaatgagttgggaagtattccttcctcttgtattttttggaaagtttctgaagtattgatattaattcttctttgaatgtttggtagaattcaccagtgaaacattttgggcctgtccttttctttgtgtagggtttttaaattactaattgttatggactgaactgtatcccctcaaagttcatgtgttgaagccctaagccccaagtaattctatttggagataaggcatttaaagcggtaattatggttaaataagggtaaagccctaatccaatagaactggtatcctttttttatgttttttttttttttgagatggagtctcactctgttgcccaggctggagtgcagtggcgtgatctcggctcactgcaagctcgcctcctgggttcacgccattctcctgcctcagcctcctgagtagctgggactacaggcgcccgccaccaagcccggctaattttttcgcatttttagtagagatggggtttcaccgtgttaaccaggatggtctccatctcctgatctgcctgccttggcctcccgaagtgctgggattacaggcatgagccaccgcgcccagccagaactggtatccttttaaagagagaaagacggcaagggtatgtgtgtatacagagaaaaacctgtgtgaggacagcaagaatatggccatctgcaaataaaggagagaagtctcagcagagattaaacctgatattttgatctgggtcttccagcctccagaaatgtgagaaataaatttctgttgtttaagccacccagtctgtggagtttgttatggcaacattagctaactaattcaatcgctttactcattgtaagtttattaaaattttctgtttcttctagagtcagtttcagaggtcatgtcttcctagaaatgtatccatttaatctaagttgtctatcatagtactttgtcttttaaaaaaatttctgtaagattggcagtgaggtcctctctcttgtttctgattttggtaattttagtcttctctgttttttttcctctggtcagtgttactaaagatttgtcaattttgttcatcttttctatgaacctacttattattttattgattttttctattgtttttataatcactatttcattatttcctactgttattttgtttcctttcttttgctttctgaatgcttagtttgctctttttttttttttttaatgtctaaagatagaagctatggttattggttagagctcttcctttaaaaaataagcaccaacattcataaacttctatctgagcactactttagctgcatccagtaaatattggtatgtcgtgttttcattttcatttatctcagagtatgtgctaatattcctgtgatttcttacttgatacattattcaggagtatattgctaaattttctatattttttaaaatttctcaaatttcattaagtgattgatttataagttcatttccttgtggtcagagaacacgatttctacgatttctacgatttaatttctttaaactttactaaggattattttatggcccactatacgatttatcttggaaaatgatctgttgtactttgtactctgctactgcaaagtggagtcttctatagatatgttagttctagatagtttataatgttgctcaagtcttctatatccttcttgcgcttctgcctagttaatttatccattaggaaagtgtgatattgaaatttcagactgcttttgttgaattgtttatttcttccttcaaattatcagctcttgtttcaggtctttcaggtttattttatgtacctattattagtgttatattgtactgatgaatttacccttttaccattttaggacatccctgtttaacttccttttacatttttggtttataggtttattttgcctgatattagtatagttactccaactctcttatgcttactgttactgtttaatggtgtttcctttccctattcttttcaatctatttgtatctttgaatctaaagtgtgtattcgacagacaacatatagttggatcttgttaatttatcctttctgacaatctctgccttatgattgaattgtacaattcatttcaatttaaatggaagtacatataaaacaaggttatgcattgattggttgataaaaatattgtggccagagactcacaggaaccaaattctgtttttccactacatgaaatggctcagtatttgcctatttgaaattgttggtgactttataaaacataactacatatgaataataaaaattgatggtatatacatgtagtatatgcatactattttatatagttgctttctatgtcaggtaagagatgaaaggacaataaatatgcaattatactaccttttataatcatctctatttatatttatttgtattttatgtgtggatccaaatatttgcctgatgtcacttgttttcagcctgaagaacacctttagtattccttgaaaggcaggttagctagcaataaattctcttaatattgatttatttgggaatatttttatttcaccttttttgaaatatagtttttctggacacagttttcttggttaaaaattcttcttttttttctgtcagcactttgactatgccatatattgccttctgaactccattgtttcagataagaggtcagctgttaatcttttgggatcccctgtacatgataagtctgctcttttgctacttacaagattttctctcttaattaatctacacatccagaaagcccaaagaactcaaaatagaataaaaatgaagagatccacacctagatcaatcagagtcaaaatgttccaacccacttttaaaccctctgtttaatattttcactctaattattgtactttcaaccctggacttttcattaattcttcttctataacatctagctctttattgacattctctacttaataagacaatgccatcatacctttgtttaattatttaagtgtgactttgtttagtttttatttataatatctcctttgcagtctttggctgataagtacaatatttgggtcctttctcttgccattttctttgcctgtgtatggctgtgaattggacattttagaaaatacaatgcaatgttcagtattgattctccttcccctaccctggacttgtttgtttatttgtttagtggcttggctgactgttccaatgcagtctgttttctccacagtgtgtagcctctgaagtcactgagcagacaatggcagctttaggcatagagtgcagtccccctgacaatctctcccccaaatgacagtggtttcagcttggctgtcttttactgtggactcagagtccctggggttcaacttttgattttttgacttcacaatgggtttatcaggatgcaacctcatcgtaagtcgagaagcatctgtatttctcacatcttccttttaattttctggttggtctgtctctcttgctatcacactcagctattagactccattaatttgtagctgattgctctattattttagagaatacctcagggcataagttgctccacagtttgctccaattaacatctcagtccctttgcagatgtagtctttgaggacagttagtgagctttggtgtgaccagaggtgttctctttttagcagcctttttccttgattctctctgttaagcgtttcaatttttactatcgtatggctataaacctccacttaattgcttacgaccaaagtcaccattgttttctatagcactgttatgcttttttctccatactttgttctaaacatctccatgatttattctaaataaagtcagcctccttggggacagctacaaagctctctgttcttggtctgcctctgtccctgggcagaatgtctgcactacttctccgaagaacagcttccacttatcttggaataacatagctactctatgagtggagtgctgggttgggatgacagcctctggttctgtaggaatactttcattctataagtgagatggatcaaaatgatgggacccagaataataagctcactgcattcagagtataggttctgtcctacaattaaggttagatggagaaaggaagcctgagatctgttagcattagaatagagtttctgcaacatatacctagggcagaggaaaattgctagtttgggatcttcccttcctgagaagaaaccatagcactagactgggctctgggagaagatggagacacatcttcttggttgtacttggacagagtagagcttctcttccactgagcctgaggggtctgagaacaattgtaactcaattgtcatggtctcttactgttcttactgagatttaatatattttcttaaaaattgtttcttcatttggagtattccctttgtataattttctaactctactatataaaccaaaattttcagtgaattaaagagttaaaagtatatatctcataaaacgttaatgtaatttgtaataagaaatgcttctaatattagatgttagaagaggagaagcaaactttatatgctgtataatccctttaaaaatattaatacaaacattgctgatgacatgataaagtgaaagaaatttttaaaaaacatctgccaaggtgttgaaaataatatttctaagcaaggtgattaagggtgacttgtattttctttgacacatccttgcatattttccaaatcttctatggtatacatatatgtctataataattagagcaataatccttattaaaaatagtgatgccttttttagaccttacaccgtgtttaaacaaattttactaattgcttggtggctgctagcatgatcattttttccacagtcttctgactctacttttgctgactctgccctgatatttcatcttgattgatacagtatgtgatctactccagtcacctttgttcctccattcattaagggaagcatgaggggaagatgaaattcacacctaggcagttattttcttctgctttattctgactccaaactgctgcagctcttgcaggtcacatgcagctctgagagagattcagtcagctcaccttttaagcccagaggttctcagactgtatcaacttttgaataacttagttcaatctaattctatttttttcctgtaaattcaagtagtcatcatgatttctatgatttcttccatgagaaactgttatattcaatataccttatatagttattgttatttacattccactataggaacataaaaactgtagtaggtcctaccactatttcaccttaaattgtattctgtcggacaaaatcttccatcagcaccttctttatgttgaactcataaaatatggcagtctacaaatctatttatctcttcttaggtatccattagagaattggttttctatcactttgaattttgctcaataacacccctcaaattcaacaaagctaaatcttaaaggtaaatgaaagtaaagagagaccaaaagagagacatgtttaactcacaaatgaaatatctaaaaagattttcaaaaaaccagatactactatatacagctaattggagaaaaaaggaatagactctctttatttgtgagtctaaagtcaattttaaagagctcaatacagaaaaatttgtatatagatgtaaatatttaaatataaaattttgtcaaataactaagatgaaaattatgtcttaacccctgctatgattattaaatagcaaagtaaggtaattatagatgatgttgtcaccatgttttatgtttattaaaggtagcattttaattttaggttaaatatacaatgtaggagtatagtagtttatgggctttaatgcacattttatgaaatgttgagtctgtttgcatagtcactgtgtatgctacatttaggccaattttatgggacttgaagaaccatagcactattttaaatgataatgctggtttatagggattgtgcttccttttacgatatcagtgattgatatatttaatggctaatttttgatgtacttcaatgtgtaaaggtagaatacttatataatgtccaacatactgtgtggaattattcacacagctgccgcaatttgtttatttaactacaaattcaaaattactttcctttcctttcttctttccttcttttttcttttcttttcctccctccctctctctttctctctgtctctcttctcttctctcctcttctcttctcatctcttttcttttcttttcctttcctccagagtctcactccatcacccaggctggagtgtaacggcgagatctcatctcactgcaatctccgcctcccaagttcaagtatttctcctgcctcagcctcccaagcagctgggattacaggcacctgccaccacacccacacctgccaccacacctgccaccacacctgtatttttagtggagacagggtttgccatgttggccagcctggtcttgaactcctgacctcaagtgatctgcccaccttggcctcccaaagtgctgggattataggtgtgagccaccgtgcccggcctcaactacttcttttaagcctatagtatcaggcttctgctgatggaatgaagaattcattgggcttagattcaggagaactgaattaaaatcctgtatgtttgggcaatgattaactagacttttttatttcagttcttttctcttagtgagacaaagctgcaaatttgacgtaaaaagtccaagctgtaaattctggctctatcaggtgttaatgggtatttgacattggaatcatttcttgatttctatgaatatcagattcagtttgtaaaatgtgaatcataatatatatcaccttgataaaaacatgaagtaatgaatgtcaaagtgttttgtaaatggcagagcattattctaacttttgtacatagcacatatatatttagtgcttatttttatgctgagttcccattctcaagtgtgacatcttactggaggaggcaaatacaaataatatccatacaaagagtcagataacatacagatgtacaagtattatagacagcttgcagagctaagcaagcatagaagacttgagtaaacaaatggcatttgaggtgggatttaaaaagggaagaaaaatgggagcaagaactacaacagttgtgtagtggtgtgaaattaactttggctaaagtagataacagtaagatataggcaaagacatggtagaaaatgaggtttgcaaagcattttgaggcagacagagagctattaataggagtttggacctttttccttggtttagtggggagctgttagagctctttaataattctccatccagattatggctggttgatacctatgacttacatatttttgacttaatatcaaatggcaataggaggtgccgggtggttaatcctgatatggtttgaatgttggtgttccctccaaaattcctgaaattgatattgaaacgtagtcccaaatatcaacagtgttaagaagtgaggtatttgggaggtgattaagtcatggaggctcctctcgcagtgggatttaggcctttataaacgaagcttcacatagcatttggctttttcttccccttccttgccttctgctgtgtgaggacacagtgttcaagacaccatcttggaagcagatactaggacctcatcaaatactgaatttactggcaccttgatcttggatttcacaaactctgtaactatgagaaatacatttatctttttttataaatcatataatcccaggtattttgttacagtatcacaaacagactaagacaatttctaaaatctggcaccctgagctcaggtgtcagtttaataaaccgagtgtgtgtaaaatgtggaagaaaaaaaaacaccctttagccactatgcttataattatttaacagttaaaaaaaaggcacagtagttgtctcactccgtttgggctattataagaaaatgccttagactgagtaacttgtgaaaaacaaatttatttttcacatttttggagcctggaaagtctaagatcaagacaccagcagatttggtgtttggtgagggcttgctgcctgcttcaaatatggtatcttcttgctgtgacctcacatggcagaaggagcaaaaatgttccctcagactttgtttataagggtactaatctcattcagggttttgccctcatgacctaatcatctcctaaagatgccatatcttaatactcttgcattggagattaggtttcagcctgtaaattttgggggaacacaaacatttagaccgtagctgtagtgaaatattgtcagtcaagtaatgctaaaagttttgctttttttttttttgtttatttttaaaaacatttttatagatagcatcttattgtgttacccaggctggagtgcaatggcacaatcttgctgcaacgtctgcctcccaaactcaagtgatctgcccacctcagcctcctgtgtagctgggactacaggcgcccaccacaacacctggctaatttttgtatgtttttgtagagacaggtttcaccatgttgcccaggctggcctcgagctcctgaacacaagcaatctgcccaatttggcctcccaaagcactggtttacaggtgtgaaccaccacatctggcgaagtaatgctaaaagtttataacagcacactattggtgaacatgactgggcatatgttctgtaggcatacctttttagatgaaagtacatcctggcctcattggagtattttgtagatgtccttccaaggatatgcatgaacataaacaattcacataatatgtacatatatatgtttatcataaagagtgaatgcaaaataaaaatgtatggagtgaatatttggcagagtacatttacttatttagtttacataattatacctcttgctcataaccctgacagaacaggtctaattttcattaagcatgactacagttttcctacactaatcatattaatgttatacttgttttgataccaaataaagtaattaggttgtttttgatggtagtgaatataatatgtatattaacaaattggcatctgttttatttcatttttcatttcaatttaaatgtaatcaaccaataatgaccctagtaagctagttaataattaagataagcattcttccactaaagttatatagtttatttcaaaacttatgtttaatacatttcaaaagatattaatcagaaatgttcaagagaaatggatattctgagccaattgttgacattctaaatccaagtacattaacagcaccttttcaatcataactattgcatcattagtgcacagctacatagtgctaattactttatttacctctacattgaatgaatgctgttaaacctttttaaataattgataatttattaaatactaatatatgcaaaactgaactatacaagtttttccaaattatatctgccatcttttgattatataaatacaacatatactacctgaatgcaaaattaacatattatatttttattatgttaaaacatatgtaacacacagttttccattttaaccattttaaacgtagagttttcagtggcattaattatattcacaatattatgcaaccattaccagaatctatttcagaattttttatcaccccaaacagaaactatgttccttaaaaagttaagcatacaattaccatatgatccagcaactctgcttctaaaaatatactgcaaagacttgacagcagatactcaaacagatgctggtacacatacatatgtttaactttttgagaaacagtgtaagtgttttccacagtggctatatcattttatattcctgccagcaataaatgaggattccactttctccacatccatgacatgctaacatgtgctattttcttgttttttggtttttttttttagtacagtcatcctgttaagtgtcaagtgatatctaattgtgtgtgtgtgtgtgttttcaattttagtttttgtgggtgcatagccatatatatttatggggcatataagatattttgatacaggcatacaatgtataattatcacattagggtaaatgggctattcataacctccaggatttattctctgtgttacaaataatccacttatactctttcagttaccattgtgattttgaattgcattttcctaatgatgaaaaatgttgagctacttttcatatgcttattggccatttttaaatctcctttggagaaatgtctattcaagtctgtattcatcagagaaaaagaacccataggagatatatatttattatacaaattatacatataaatatatataatataaatctataaaaagagatttattgtgagggactaacttatacaattatggaggctgagcagtcccatgacttctgtctgcaagttataggcacagaaaagatgttggtgtagttggccagttcaaacctgaaggcctgagaacgaggtgcactgatacctgatgcaggagaaggtggatgtcccagctcaagcagagagcacattcagcctttctcatttttgctctatttgtgtcttcagtgagttgggtggtgcccacctgcaatggtgaggatgatcttctttattcagtctaccagttcaaacactactctcttgaggaaaccccctcacagatgcacccagaaataacgttttgtcagctatctgggtatctcataatgcagtcaagtttacacttaaaattaaccatcacagagtcttttatttacttttaatttgctttttgtcttcttgttgttggcttgcataagttctttatatattctggatatatattttaaatataaccatatactttttcccttatcaggtatatgatttataaatgttttcctccactctgtgggttgtgttttcactcttctgatggcatctattttgattcccttatttcctttagtttgtgttcagctagtgttttgatatagattttcttgaattccaagtgcttggaaacaaaacaaaacaaaacaaaaaaacacctctcagtgtttgacgattaattctgtgctgggtcactcttttaagatttagccagcccagttaaagctctggcccaacctttacttcctacttgtgctgagtgtggacatcagccaatgatgaaagcttaaggttttcttgggtcttttttgagcatgcatcctatcctagtcatgttcttggtttccaaattccccagtatatacaggcacttttgagtgttctcatttcccaaagaaattaccttcctggctttttctcccaagatttaggcagtcagttgtgtgtcttaatggtaatctctcttttacctcagttggctgcaggttcttcatttgccttccctttttgaatagcaccttctgtctcctctgctcttggtgggatccaagatatgaaacagaaacaagaacattatgtcagccctcaggtagcacccaaacaggttagaacaaagaaacaattatttttcaataaaccctgctctgctccttccagaaccagaggccagggttccatgctgagaacaccggttaacatcttcaggactgcagcaaagccatggagaggtgtggataagggcgagtaagaatgccacaatttttggctaccatttttaaattgcccccttttttttttttttgattcggcattcatttggttactgtatacttttgactgtttctggagttctgacaaagttggttttgacagttctgcttgttttaaatgatttttgtgaaggcacagatgtttggagctgcctaatctggtgttttgtggatattgctctcctttactgtaattttatattccaatttaagttaatggaattaataagtaaacctgtgaattataagacttgcattacacaaagtactgtaggacgtatgctggtggaagacggaccctcaagaatttgagaggtagatatgacctgcatatacatatctattacagcaggtagtttatgacctgtagtaaatcaggggagtcaggaaaagattaataaggataacttttaaggtggactttgtagcttaactaggatttttatagttagtgataatagggagaaaaagtttagctggaagaactgaatagaatcctgttttatgagtatgtaggctatttgtagagttttggtggaagatagagccagatgatcataattagttctgtctcttatttaaaagacaatgaaaataaaagcttttaagcaaagaaatgctacgatttaagctcctgcttcagaagattagtttggcagtgatgggtagaatgcattgagcctacaaaatgtatattacatacataaaattatatatacaataaatgtgattatattaagacttttgaaatctaggaactcttagtttaagtcaataaataaaagatttgcttattttaaaacccatctaaccattatgacacctaagatttttaaaatactaggcaaatgcagttaaaaaacaaattatgttaaatttagcttcagagtatgtttcaatgaaatatgataaatactaccagaaagttacttattaaaataccatttagaatccgcaatacaaataatcatgctacaagccaatgcttattggatgcttcctatatgccaggaaatatatgatgttaatttatatatgctttctataagtatatttttctaagtgctttatcagtggctgctcatgtaactctctgttacacgtctgccagcctgtcagttaagtaccatttttatcatatcattttatgaatgaggaatctgagacttctataaattagggaacttggcttgccacataaccagcaaatggtagagctgggatttgaatccattcactcaggctcacagattttgaccttaactgtcacatagcactttctccctttttaacagttatcaagaatctagtattgaagtaagatgtcgttaaaaaaaaaaaaaaaaacacaaaatgtgtaaaaagagacattaagaaaactaccatagtagtgagaaattacaatagtctttttgctaagtcctcaatagattagataaaataaataaaaatttatagactttaaatataattaatagtagcaagatattcatacaatagtagatatctatcataggtctgtaatagatgtagatgtatttgtatattaaacagattatatatttatagaatatatatcccaaactttctattcatatatttaaataaataatatagtttattttcaagtgcctatagaatatttacaacgtgaaaaagtgataatatcctagggtgaaatgttagtatcaaaattttaaaaataatattaatatgcataccacattctcaattttcactaacacaaaactagaaattaatagcaaaatgttaaccaaaatacttaataaaatgacaatttattaacatgttcctaaagtaggtctaagataattttaatatgtaattatatagtttttgattaaaggaaatggcaatattacattccaaactgcaaatgatgatgagaaaagagttctcaaataaataccctaaaggcttttataattaagtaaaatagaaaagaaataaatagagtcatatcaataataatgtagcggggaaaacagaaaattcacctgttaatacattagaaaaaaaatgatgaatctaagaataattatttgatagggagaggaaaaattctaccaaaataggtgagaaaaactctggaatgtctaagaaataaatacatggaaagagaaaaattgaaaacacactgtgtttatcaattgctttataactatttactccaagagttagcagcttgcaacaaccatgttttttttcacatggtttctgaaggttaggaatctggtggcagctcggctgggtggttctggttaacgggttcttgtgaagttgccatcagtgttgtttatggttgcacatccaaaagcttgactggagattgaagatctattttcaagcttacatggcttgcaaacttcttcagtatcatgtgggtctcctcttcatacagcttcatacagcttctcatgatatggcatctggctttcctaagagtgagtgatctaagacagtgagggagatatatatatatatatatatatatatacacacacacacacacacacgtatgtatatacatatatatacatgtatgtgcgtatgtgtatatatacacatacatatgtacgcatatacatatatacacgtgtgtatacatacgtgtatatacacacatatacatatgcgtacacatgtgtgcacatatgcatacacatgtgtgcgcatatgtgtacgcatgtgtgcacatatatatatatcagatgatatatatacagaaagtgagagagcagatacatataaatcttcaaaaccagtccttaactaacaggtctcctctcacacacaaatatatcctattggacctttcaagtatattaacttatgtagcaaaaaggacttgcagatataattaaggttaataatcagtgactataaaatagggatattaacctagattatataagagtattggtgggatgtagggtatgatcatgtgcatggagaaattttcttctgctggagtcaggagaggtatagcagaaaaagctagaaaaattccaatgtgagaaaaatttgtgtgccatttggggcccatatgaaaggcttgaagagaggactctaggagttcagggtggcctctggctgacagacaggaaggaaagagaaccttcattcttcagccacaagaaacagcattctgccaacaacttgaatgagtttggaagtggttttgtttgtttgtttgtttgtttgttttttcctaaaacctcactataaaaacccagctggctgacaccttcatttcagccttgacaaacccacagcaaggacacagttagctgagcctaacaggacttctgacttttagaactgtgatataataactgggtgttgttttaagtcgctaaatttgtgagaagtggttacagtagcaatggaaattgaataccatagcatatacttactctcaaagtgatatgccctctcttttgctatattatgttggtcagagaccaagcagggggatatgggagggaaccatacaaagatgtgaataaaactgaggtgagatcatcaaggactgtattggaggttactactatcctctgacctccacaatacaaattccctcacatatgaaaaatacacacactgccccccaggattccccaaaatctcatcccattttagcatcagcttgaggttcatatgctgttatctaggtccaggcatggatgagattcctggagtgtaggcacttaaatacagttccttggataaaattacttaaatacagctccttgaggatatttcctctctatctagagatagaggcaggttactgccccccccatacccaatatcctggcagacaacagaggataatagttgtagacattcctgttcataaaggcaaaaaataaaaggcacaaaggagacataggtccacagcaattttaacatccaactaggcaaatattggcagttcttaattgttgccaactctgattcctgcccccaaatgctctctgtatctttttgtttaagattctgggtttttggtttctccctttgagttaccctttcttttcatgaatggtagtgcatgttcacactgagtaatttttatagcctgccttcttatttatagatttaagggtccaaggacctctttttattttgtactgtcactgttcttttcaattaaaactggcgattctggtgacataatctgcatacaactttgtagatcttctgtggatcttgttaaggatcactccattgacaaaatttatgtccctgcatcttttctatataagcctcttctctaccctcttccactgagatggctgagatactatactctttaccttcttggaatctctctctacttttttttgttgagaggatttatgatgcgcacccttaaattctttatagggctttttttttttcaccacagagtactatgagacaccccttttaacttttctggagtcttaacaaaggcttttagagtcacgtcattggattctactaattctatccttgtttcccgtcttgggacactggaaatcttcaaaaccagtccttaactgataagtctcctctcacattttactctaaacagagtatattcaacatttttaatggaaatttcctcagctggatcaccccatttgttaggtacattttccatcttccacatcactgcaagtaacaggtttgttggacattttgccactaagtaacaagaatattctttcctcaaatttccaataaaattttcctttctttcccttaactgttcacaggcagcctcctcaacgtcaaaacttttgctaacagtctgttcgaggttttcctaaaactcttcttaaaacccttctacctacttcctattgcctggtttcaaaatgattccacatattaggtatttattgtggcaccacactacttccaatttctaaattttgtgttatttgtcaattgctgcataataaatcatccccaaattttgtggttttgaacagcaaacatttactgtctcacatagtttttgggtactaggaatctttgagtagctgagctaggtgctgctggctcagaatctcttgtgatgctataggcacattgttttctggtgctgcagtattctgaatgtgtgattggggcaggaagatctgttttcaagctcggtcctgtgactgttggcattaggcttttcactatgtggacttctccacagtgttgtttatgtgactctgaatagtcacaatgggggttagtgcttcaattcacaggacttcctataagaaaaaaacgatagggcatttatgctaggggagctggctttcctcgggaagtaataacagagagagagaaagagaaagggagggagagagagaaagagaggagaaataaggacggaaaataatatctcttataagctgtctcagaaatgaacataccatcacttctgatatgttctattggtgacatattctattggttacagtgaccaaatctggtacaatgtagacagggtgtacagaagggtagaaatagtaggaggtggggactcctaggagtctcttggaggctgactactacactacaacttctggcctccaattagtcatgtctctctttttaaattaaaaaaaaagaaatgttggggggtatggaattatactttataattcaggaatgtttgtctcagggaaattaagactcttatccaagacattaccaagacaattgaaacctaacccacctgtattgttccttttcctactgctataaagaactgcccgtgactgggtaatttataaaggaaagatgtttaattgactcacagttctgcattgctggggaggcctcaggaaactttcaatcatggcagaagtcaaaggagaagcaggaaccttcttctcagggcagcaggatggagtgagtgcaagcatgggaaatgccagacacttataaaaccatcagatcttgtgaaaactcactatcatgagaacagcatgggggaaaccgcctccctgatccaattgcctctacctggtccctcccttgacacgtggggataatggagattacaattcaagctgagatttgggtggagtcacagacctgaaccatatcgccacctaaacctcatgcctcacctaaaatcttatgccttttctcttgcaataaaataggataccctggagatctgctatgtatagtactgttttccatagtacataatattcctatactgcttgagcttttgaaattgtctatctttgccagtttttctttatctcagccttcaatttctatcttacctcactggaataagtgttccagatggataaattttctctccacccttccagattactatgtttttgtttgcaataaacatgtatggcattgcctatagcatcatgaaagaaccagacttactgaaatcgcatgaaaactaagtgtaggccaggtgtggtggcctgtaatcccagcactttgggaggctgaggtgggtagatcacgaggtcaagagattgagtctggccaacatggtgaaaccccgtctctactaaaaatacaaattttatatatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctatatatatatagaatatatgtgtgtatatatattctatatatatatagaatatatgtgtgtatatatataatatatatagaatatatgtgtatatataatatatatagaatatatgtgtatatataatatatatagaatatatgtgtatatatagagagtatatgtatatatagaatatatgtatatatggagtatatgtatatatatagaatatatgtgtgtatatatatagaatatatgtatatgtatatagaatatatgtgtgtatatatagaatatatgtgtgtgtgtgtgtgtatatatatatatagagagagagagagagagagagagagagagagagtaagctgggtgtgatggtgtgtgcctgtaatcccagctacttgggaggctgaggcaggagaattgcttgaacccgggaggcggaggttgcagtgagccgagatcacaccactgcactacagtctaggtgacagagcaagactctgtctcaaaaaaaaagaataagagtaaatacgttctgagtaaaaatctatgtgggtcttcctgtattagactgtttaggttgtcataacaaaatactacaaactgagtggcttcaacaacagaaatttgtttctcacagttctaaaggctgggaagttcgagatcaagatgccagctgactcacttcttgttgatagctctgttcctgttgtgtagatggctgccttctcactgtgtcctcacttggcaaagaaagtgagagagccttcgggtttgaatgctgctataagaatacaaatcctttcagatcagtgcttcacccttaagaactcatttaactctaatcaattccttattctaaatcatgcttgaatgtatgagtttgtgggggaatcaattcaattcataggacttcctataaggaaaaaatatagtgctttgactttgggatattatagtattcaaggagctctttttttccaatgggggttttgtttctttacattatttttctcagtatcaatccagacagtgagtttttcatatatttatgttcccaataattaagttactgattataatatggagtttcattattgctgctattttagaaatatgtatttcctgagtttcaggttcaaaacgtttttaaaggaaaacaaaatacactcattaaagagattaatagcaatggaagaaaatgaaaatagcgtacctataggtggacttgagtttgttttcattcacttaagtagcttcttattagagggtcagattggttttatattaatgtgaagagcgcaacaaacccattatatataatagatttatattatacaaagccactgatatattgtggtagattatatgaagctattctcatcattccccttctagacatacatacacacatgcttatatataataatcaaatgagttagttgacaaaaggttttaaagtccgaatttaattcatgaaggtatccattttcttggattaaaattctagtttctgatttttttacatttcaaaaacactatacctttttctaaattatgtatatttttctgtttgtaaggaaagtgtagagcttacaacagagacatagagaaaatattgactatactaaagttagcaactgatatatgttatagatgaactgtaacaaatatgtccttagtgaaatataaaatgatgttgttataataacgttagagttctagttagtactacattcaatttgtattcaatttgcgacaatttaaaagttattaacctatattctaaagttagtaaattattttacaacagtaatttcaacaatggaggctcccatgtgcccatgtatttggatacatttgtctgaaatcattttaatgagcaattaaaaaactcacaaaatagtctttctaatatttgctctcaaaacaactctgagaggtcaactgtttaatatgtttaatgtaatatctattatattctcaattttaccgttcttactaatgaattatgttatgattttattgcctttggaattgaaagcaagataaaatatgctttttgtgttttatacttacatacaacaaagttttgaagtattttttagctctgaaaaggaatgataacaatgactatttggaaataaaatatatcttctactatagaaaacataagcaaatacaacttgttaccaaggtatagtttctggtgtgtgtgtgtgtgtgtgtgtgtgtgtgtgtgtgtgtgaaagacagagtggtggtgtctatgacatactacggtatatttgagattataaactaacaaagcaactcaaacacttgacaacataagagtaaaagataactgaacatgagatgacaattggaaagttaaccttgaagtggtctggaaaattatattatttgctttgtttttgatttgtcaatggagaccaacataaattttccatgtaatggtaagtcattaaaaagtcataaaatatagtttaatagcattgcaattattattttaataaatgttacaattactataatttaaaatacttgcctgaaattaattctaatcatccaaaatacaacttctaatgaaattttcactcttgaatgtttactttaaatcacattgtcttccatatattcaatacttttgggagcaatgctgtggaatgtagaataaatatcagttgttgctattgaaaattgtgaactttaaaaaattttaataaagggataagattataactttttgcttatgatttgtaaaaaagaactgcagtaccctgttttacaaatatatgattgataacattatttggaaatgctatatataccaatcattttcaggtcatttgaaaatttcatgttttaccttaaaataagagaacaaatttaaagtgagccaactcaagtttattaagaaaaagtttgaggcagtttgtttttcagaataataataataatagtattatagtctcagattatgctttatgccaaactgtggtattgtcatctttggtttctggataagattttactgatgccttaggtattattttaataaatgtcataatttattataactgcttaatgcactcaaaattttgcaaagcttcttatactgtataattcagactaaaatttaacataattgtgatggtactttgaaaggcctacaatgttccatgaaagaagaatctgggggcaccaatcactgcattatctacaaacaatatgagtttttgtatcaataatttcacactttccccaaagaaagtcattttttcttgagtatcaacaaaattttatagtgttcatttagcttgcttgtcatttcaacattatgtattgtgtaccatcacaatagggggtgttgaagaagcccattacctactattcttgtcctccattgttcagagcataatgtagatagaaaatgataaaaacaataccttagattcctaagcatagggcatgatagtaatatcatagtagtgacattggaacccgcatgcaagtcattataaattcctgcccttatcatatacatcatacatgaaaatagaagagataatgagtgcaaataaagaagtggaactgagtggcattaatctcagtattgagagattttgtgagtagtacagcattcttttcatgtgctagctgaagttcccaatggcaaattgaatgctgcttatatcattatatgcatgaatgaatatgattgaaataatgcatatgttattatatcaaatccaatttcacgaatattatcaaccaactaaaaagtctaattgctgattagagaacttattatggaggttcttcttaatatgcttcaaattgacattgcatactggactatgtctcatttatgatttagggaacaaaatgtttgacagtgtgcacacacacagccatagtacacacatatgtctatatacatccataagtgcaaccaaatatatacaatatacaaaatgctatgcagtatatcagagccttctctgtgctcttcaaacttggaagaatggatagcaaagctcacataactctccaggaccacattttctcacttcctctaccttagtaaaacaattccacgcatggtccttgtctctgttgtacaatgttgtgtctccaaaacccagcacaaggcatgggacatgggaagcagtcagtggatcaccttagttcaagaatcctctgcttcagtcatgctttatggggccacaggtgttttgagaagatgctttagttatagctttaatgaagcaaagggtgcagcagagaaaagccaacatccttaccatgatcctaaggcagatgccctccctcacctacaactccttctccaaccatatatgccatcactgtccccatccctctctctagtgctgacgccactagcctctgcagctcttccaaataagcttatgcctcagtgacgttactgtacctggaaatcccttccacagatatctacatggcttattccctcacttcattcaaatctctctttatgaatcatcttattagagaaaacttccctgactacctacttaagtggtaccttccaatacctttttttatttattgaactttggtaagtttaagcatgtcttaaatatgtatttgcctattgtctgaaaaacacaagcacaataatgtaagctctaggagaggagtagtttgtcagaattgtactctgtcttactgcttagaattgagtgtagaaaatagaagttcctcaagaagtatctattaaaagaatgaataaattaagaagtgggtccctaacatccatgtcaagaaatttttggtgttgtttcattttgtttaacacaattgacttctaggtaaaatttcttttgtaataaattttctgtgtctaaaaatagtttgaatttttaaagtttgatttattaaaacctgtattacttggtagcacaaattctatgtatttttgatgatactgaggataattctatattaaataagcttacaaaagcaaaaggaaaatagtttgtaaaaccattctgacattcaaatactgacaaatctatttgcaaagataaatctaactttttgttgtagcagtagggtcttgataaaaatttatattattttgccagtaggctcatataaacctgaatctgatactttaaagcactttctccaaataaaattctacatagatctttgcacaaaagcatcaaagtcaagtggacagaatttagaagctgaaacaatgaaaacttctggctgaatgcaaactgggacgataatcagcactcttagggtgtgtgggcaaagagagagggaataaaaggatggagtacgcaaatggtaatcattctcctaatcaattctatcatatggagaaaaatagaaagacagacaaggaaatagcagaggctattgaagaccggccatatcttcatgaactcagagaaagagcagagttatgcaaggaatggccctccaacatgccatagcctgcacactagtgaatttgctatattctatgtcatggatactgataaatccaattgacaactcctctttctatatgaaggaatgagaaaaaggagttgttttttgcactgtgatgaatatgcactcgatatgtaaattaacccaatgattaatacaaagcagggagtagtagacgcttaaagaatagggaggcttagtattcctatgggaatacagacaaagagactttgacttttctagggttatatggaaagatttcaaagagaaagtgagatttgaggtagacagtgaaagttgggcacaatttgaattgcccagcgtccaggaaggcattttaagatgaggaaatattatgaactctagaggagaaatagtcaaagaacccatgagtatgtaagattggctggactatatttttcccaccgtttatttcagtttttttctatgtcatgtattgtatttagttataattaactattcaattctctcttatatatttgtcaatataaatatttgtttaacatacatttaaatataattattctaaggggctgtattttagattatgtttatgtttatacattagcttagaaaaatactgaaatccacaaaaaatagtatattttaagtaaaaggaaattaaaaccatataaaatgtcttattgttaaacttatgaaatactagaacagttacaaagaaacaattaaaatgatttgttagaaaacatcagtgacagaaataacatatgctgtctggtagaaactttacctccaaacagctattttcatatcgtactttcgtatttccttaggagacataataggttttaaactatgccttattactacgttgtgaagttgggaaaaaagaaaatagactgtgtatgtaactatagcactttaataaaacatagtgtaagtatttgtctaatttaataatgccaattaactgaaaacagtttctagtcaatttgtctgcctctggtatagcaaaaaaaaaaaaaaaaaaaaaaaaaaatctaagaaactatcatatgtgtttttaaaataaagtttatattttatgttaaaagagggaaaaaacaaaatgctacaaagcatttatttttattgatcttgagatctgagcaaatttatactttatgggaatcccagtagggaaaatagaaggacatctaaagttcatttcctcaaggtgggggaagtcttcttaatttgtcttgcattatatttattcacatactcatcagctatttattaattcatacatgtatttgttcattcattcagtttagtctaaactttgactccttttcacctggccctgtccttggtctaactcgggcatgacactttccaatttcttctgcaatacctactgcctgcctacctcattctgcctttctcattagatccgaattaggacctcagaagctcactaacctgcaggatatagacagtctgaattttggatctagcaatcgtgtaatttagatcttgtttaatggtccatgctacctatgctttcaatctcagactgattttctgataaatcaagttaaaattaaacaagtttgacaaattaagttagactgtatcttttatttccaaattcagctccctaaatactcattcataaactaatataccactattcatatttccatttttagctttctggcttctgcctgagcctagaatcctaaactcggacaattgtagctttgtccacttggccgatatttaatttctcaattaagtatatatttggcactgtgatgaagggactgtactgggatctgcacacattttcaaaaggtatgcatgcctttaattcctaagggcttaaattctaataaatggcataaaagcaatacataacagaaaaactatataattataaaatataaaatatatatatacatatttatattataaaaatataaaattttaatataaatataaaaataatagtgtaaatataaacatatttgtataaatgttatatatttataaaatagataaaatgtaattagagtgcgttataacaaactttgttgagtggaaggagataatgtattttaaatacatacatcttatacttgcaaaaactaaccagctgaagtgggagaaaaaagggattgaaaatctggggatctgaaatgattgtactgtaagatagataaataattagtgagataactgcctaaactgttccaagagagtgtttttaacccctttaaataaaccaagattattcatacaaatgcatgctatgagcacttgataaagctaacagacagaaagtcagtaaagatatagaacttgaacagcactatcagccaaatttccctaatggagatttatagtatactccacccaacaacagtagaatatactttcttcttaagtatacgtggagcatcatcgagatagactgtatcttgggccataaaacaagatcaataaaattaagatgatttaaatcttacagagtatgtttcctgaacaaaactgaattaaattagaaatcgataaagatatctggaaagtctccaggtgcttttaaattaaacaacacattttaaatagctcaaaggttaaagaggaattcacaggagaattagaaataatctgaccagaatgaaagcataacatatcaaaatttgtgggatagtgttcagcaaggttacagaattcaaagtcaacacacagaaatcagtcttgtttctatatactagccatgcacaattgtaccaacattttagatttttttaaattaaaaaaaaaaacattcaaaatagctcccaaaatataaatacacaggtataactctaacaagacatacaggatctgtatgttgaaaactacaaaacacttaagaaatctgagaagacctcaaaacatgaaagacatacagggtttgtggtttgcaagtcacaatatggttaaagatgaaaattctccccaaattaacaagtagattcaatgtaattcctatcaaaatttcagcagtatttttgtagagatggacaaatagttcagttgtgtagaatgtggagttctactattgcagctatggaagtaggcagtgcaaggctgtgcagctaacaggccggagtttcaaggctttgaactggatctaggtttgtgctgggtcaggttgtgggatagtgtcatatgatgaaactgttctgcaatagatttaatatcaacagggaaaatatgtattctacaatggattgagactgctaggacaataagaatgattctccaattagttactgcttgttttgtgggccctgactctgtagcttgggcctggacaacactaagaacacagtatccatctttctgccttttcatttatcaagagtgagttccctaatgtttacttgcctatgatcacccttcattctatatccccattgtctgccatacagaacataaaactaactcagtttgcggaatggaaaagcaagtgccagttgcattatatctacatttatgtctacgtttgcattatcacatggtgcgttatcatggggttttcctgcttttatttttcaatttctcttgcttctaaagctctaatttgatcaatccatttgagcatgcccttactaaaaatacctattccttatgacccaaccagtcctcatggcttcaggatagaccacagccaggaacagtcatatctgaaccactatatttacgtaagatatgacttctagtggaaacaatttctgatggaataatcaaaattctacttccttaataggcaaataaagagttaatactattaatatttagccagcattttgaaaattgtataatgttcaaatcgatgtcagacattttcattttatcttgattatacataaatatagggagtatatatgatttgcctgtagttatgtaaatgacagaaatggttaatgagcccagagtccaagcctagtattctttttatgaaaccttaggaagtacaatgttattaaatagtcatagcagtatatagtgttcatattgcaaaaaaataaaaattgccttgattttagaatagccactaattttatatcatatttgcattgatttcaataatttatatattattcctgagtgatttcagaaaggatctgacatggggtgatctttatgtctactagaaaggtgtccaatctaaactgagtaccttcccctttgacatttctacatctttatttgttgcttcaaaataagggtaattagaaatgtatgtggttacaaatggcagattatataaaaataatatccctagaaatgtgttttatatttacctttgaatattaacatatctaaatatgggtgctaaacttcccttagctaaaatactagagttgtattattgtggagaaagactgtattagagctaagaaattaatcacttttttgcaatacacgtgattcttaaacaatgcaatggttaggggaaccaactgcccacacagtcagaaatctgagtataacttttgacattcccaaaccttagctactaaatgcctactgttgactggaagctttactgataagataattgacacaaataactgataagttaattgacacaaatgtatattacatgtattatatactctgttcttataataaagtaagctagagaaaagaaaaatgttactaagaaaattataaggaagagacaatatatttactattcattaagtggaaggggatcatcctaaaggtcttcatccttgttatcttcacgttgagtaggctgaggaagacgaggaacaggaggagatggtcttgttgtcttaggggtggctgaggaggaggaaaatctatgtataagtggactcatgtagtttaaacccatgttgttaaggttccagtgtatgtttgctcaatatctctaagaagccactgaaaaaagtgccccatatggaatttgtaaaacagctgtggaattttgccgcttgaaccactttgtttcctcacatgaacttgactgatggaaacagcaacagcagtagcttacagggatggcagcaggtataggtctccccagtttcttccttctccaaatccacttatttttttttcttttttttattattatactttaagttctgaggtacatgtgcagaacgtgcaggtttgctacgtaggtatacacgtgccatggtggtttgctcacccatcaacccatcatctacattaggtatgtctcctaatgctatctctcccctagcccccactccccgtcaggccctggtgtgtgatgttcccctccctgtgtccatgtgttcccattgttcaactcccacttatgagtgagaacatgtggtgtttggttttctgttcctgtattactttgttaaaaatgatggtttccagcttcatccacatttctgcaaagggcatgaactcattcctttttatggctgcatagtactccatggtgtatatgtgccacattttctttattcagtctatcactgatgggcatttgggttggttctaagtctttgctattgtgaacagtgctgcaataaacatgtgtacatgtgtctttatagtaaaatataaatccactattttatggtttggcatcctcacattccatttattcatctgaatccatgttttccattccctggtgctcctggacccccgcacttgtcccacgctgcatttctaccttgtcctgatgctctgactgctagggatgaggcaatcatgagtcatgtacctacttagagccagtctgtattttagactgatttaaaaggagagcaataattaatgcaaaattgcctttcctgggacttttaatgggtggatttccaagtctttaccaagcaacacactgagctgtaagaagaaatggcaaagtcagtgtgataattaatctagtggttcaccactctcaaggggacattttgacaattgagagtttatttatttatttatttatttatttatttattcttgtttcagtgattcacgggcactgctgtcatgtagtgggtgcagccaggtaggccaagcatgttgctgcgagtagggcagtcctgcataatgaagacttgttttgtgtcacatcggacttcaaaatgccccatgcatactcataaagaaagaaaaagcctgttaatatattttacaatttttcttacattttattttcaaattttaatttttagcctaaaacccaagtccactttgaaaataaacacaaagccccgtttataaagttttactacatactgttttccaggaatgcaactactatttgaaccaaggtgatattttactgaattttaccagaaccttaccgagaattgtttagcgttgcagaaactcttctccgtgacagtaatgccacttgaatttgaatttcctagacagtacaccttaactgtttgcatttatggtcgtcacagctataatgaatgattccatatgtaggtatgagtcactgactccatcattatgtctcttggtgtagttgggcctgagcatatattttgaaaaacacattttttgatatatattactgactacattttttacattaaagttaggttaatatatccatttttaaaattattatctgttaatttcattttgatatagtagatgggactttaaacatatttgttttctaaaggaacattctttaaatttgatgatttttttaaatcatagaattaaggattactgtttgaagaaattaagcagactagtaccgaataataggtgcaaaaattgcataataagttatttagctgaacaaaatacatgctaattacaaaagcctgatgattggtttgtaataactgacacacttatatgcatcagtcgatatttctatcatgtgtaaattgtgctacatacagatgataaaacaaagtcatataaaagttggccttataatacagatgtctaataggcatataagtcatccttaccaactttcagcctgctgaccagtcgtgtaatgaaaatggatggcacctgaatgagaaaacaattatgtggctatctgaaggagggtggtcataccaaaaggatgaacaaaatacttcaagcaaaactaacagcaacataacgagctaagaagtgacaggcacaaacacaagtggatcatgttgacttgaagcaagcagagtttgagctgtttcactgtctcattgaaacagaagagtatgctcagcgtgaaactaagagacagcttacagagaatgacaccctgcaggtagcagctgctgctgacacccaacgggcagaatatagagaaggtatatttgtttatttatgcaatttgtgaggaattgattgcctgacataattcacccttttcagacccatgcttataactaggaagcatcaaggtcaatatcccagtcacacagtgcaaaatattttgccatatgtacaggattgaatgtaatggcagaagtcatttcaacaggactgctgtcaatatatcatttgcatatgtacaaataatttgttaactatggttgttcttaacatattcacaagtaaaccccctaaggcataattacaatagcactgcctattcaatccctatttttgttctggaaattatacctacattgagcctagttctaggttcaggccaaaaaacaagggatatgcaactttaaggggaagaaatactgactccataaatatccatatagctttttaagaaagatttgcttaataggaaaacggtgttttctcacgtaaaattcaggttttgtttaacaaacatattgaatccaaagataaagtatagtataaagtaataggatgtgcttctgtattgaaatactggtagttttaaattcttgacatgaataactggatatggcatatgtaaatctaccaagaaataaaacagaggtcttaaaatgtaaagacatgataggacatatttatcaccccataaaacaaactggcattttcatatcctaagctggccactttgttgtatttgtgtatgggtcctcactacaaagttctgtccctgatttgggaacatcacacatgagaggtaaaaagcacatggtagatgagggatacaaataccattctgtttatgattctaacagatcgatttgtgatacaaaaaccatgggtagaatttgagaataattagtgtgatacgatgttataaatacaaaggaagtatgtgtgtgatttttttttcaaacttggttttctatttcttacagacagtagttttctttgaaagtattaattagttcactgtttgtgtgattttatgggcaggaggagtgactatccattgtgatggcagtaaaaggtaacgtgccctaatgtagttcatagtaatgacgagggacacatgccaggtgacatattttaatgaaatgttaaatgaattaccaagaaaaaagggaacttaattttcaatatgaaaggaagaggccattgaataaataaagtggaggtgagataacagattctcaaaggattcttaaaaatctgccatgttatatcattctggtcaacagaatgattcatatttcattaactgattatagataaaatattagatcctgttacaagttatgtgtcttacagttcagttattattcacataggtatttcagagggagaaaatgattttccatcctttttttttttttttttacaacattaggggaaaataattactattaaaccttctgtttccattcactggatctgagatgaagtggatttccttacatattcatgactgctttggttaaataccatctattctgaattttattctccatattacagctataatataaaggaaataaatatgctttccttaaatgtatcaatggagcaaaaattgtttttataataaagaacaaatccaaagacaggcaattcagttaatcatataatttaaaggttattgcaaggtcttggataaccctgaatatttatttttccaccagctcactatcttatttgcatcttttcttatgtgttctaagatccctgcaactggaataatttctcttgataaaagaataaagaaaagatttaattatggtatttattattgtattttgaaggtaaatattaaaaatatgctttgatggaatgggctcaagagaaatgggaatgaggatgctagttgagaagacttctcatgcgtcctcctcatttcataagcatagattaattaaattaactagttgctcaccaaagcctgacataagaatgatgaggtgcagaagccactaagttttaatgtgtgttaaaaacagcagcaaaaactgttaggggcttagtgagtatcatggactatctgcaggtgggtttccatggaggaggagcccaggggagccccaaggaagtataaggcggggtggggctcaggaaaagcagatttaaagcttgagagcaccatgctgtgctgatattatagcagagaaaaaaactgattttacctttcctaactcctttctcttcttgccatgaatagcatatatggaattacttttaaatatgtgatgaatacatgtatatccgtgacacatgagtctctgcctgcaaatcagttatgtaagaaatatggcatttccttgtttactagaagtcaagctaatttagacatgactctctttcttatatgtctagctagaaattctaccttagtcattcttagggcatctcttccctatggtggtgccaagttcctggagccttattctacattagtcatcaggagcccttcctagttgttggtcatctgcccactgctgaaataaatgttcagtgtcccagcttcatggtaatgtgccttactttgttgttatacatggaccatctttggatgaagggtgaaacttaggactaggatccagcctctcagatgaatcctgtggtgtttccctctgagatctggctaccttttccaggcaatgcaatagaatgatactaaattctttccttctcacagagcctgacaagcatacatacccctttcctactccaagggaatctacctcactctttctccttgtccttgaaagcttccctaaagccttctcttctttcagagataactagcatgagcttagagtttcataaaagatgagaaacacttctgactccaggtagtttctggtctctgtccatccaatattccagaggcaaggaattacaaagcctgtttccctgcttcactggaaaaaatagggggaaatcaccaggagtataaatgcaaattagtatttcaataaattatactaccattgaggaagaatctcacacatttatgtcaccaggaatactgataatgaaggaattaattccaaaatacaattttaaagcagatacctaatggctaagttctgacaaagagtatagatctgatttgtgcattatgcatgtaactatttcagagacatggaaattaaatcatatttaagacatatttgatgtattatatttactgaaaataataaaattctgtaaaatcaggactgtcaggaaaagtcagaatgtagccactgtactcagttatagaataaaagcagatatatcttggccattgaatcacagtgccttaaaataagatagtaaagtaatgaggaagctctcctactaatgctattctttttttttttttttttttttgagatggagtctctccctgtcactcaggctggagtgcaatggcgcgatctctgctcactgcaacctctgcctctcaggttcaagcgattctcctgcctcagcctcccaagtagctgagattacaggcatgtgccactgggccaggctaattttttgtgtctttagtagagacggggtttcaccatgttggccaggctggtctcgaactcctgacctcgtgatctgcccacctcggcctcccaaagtgctgggattacaggtgtgagccgccgcacccggccctactaatgctattattctaaactaattgccctttctaggtttgcctgcctggattgtgttttttaaatattttttcttatatgttatattcttgttagatggctagaatgctctagggtctggaaagagggacaacatcctttgggtaaatggaaaagttgaactaattgagaaaaatattctgtgtttaaattatgtttgccatttttagtattttcatttttagggactacatatgctgacttaggaagttcaagctaggtttaattttcttcctttgatagcttcacataacccacactttccctccaaatattcctcatctttcacctttgcttatagttgttatagaatttattaaagagtaagaagaaaagaaaataatagacataccaggggctcaggaataatactatatagaaaattacatactgttggcctttagtttttgaacatgattaaatgtgaaatattgctataaaacttttattcagctcagaagggttcggcctacataacagaaagtgggagataatggggaactaattttccaaaaacaaatttcttattttatcattttgtataaagtcatttctgacatatcatggcagcaaaaacatgataaataaagtcaacagtaatgttgtgtacttgatctactgtggcaaaactgaaggtcccctgttagtcctaatatattttcccactttctttttaacagtgaattatatcctcattcaaacattaaaaaatactcttttgctgacattttaaagaagaggtgtccaatcttttggcttccccaggccacattgaaagaagaagaattgtcttgggccacacataaaatacactagtgatagctgatgaggttataaaaaaattgccagtctcataatgttttaaaaaactttagtaatttatgttggaccacattcagagtcattctgggctgcatgcagcccatgggccatgggttggacaagcttgttttgtaacaacacagtggaaaaatggaacccttacattgataccatcaagaatggtaagcaaggtatacacatttaatactcttaaggagcttacattcttgagaacaagagtgtgaattaaagtcagaaatttcagttaactaaattatactgttagatgagaaaataaaaactaaaatactggaagtttctatagtctttactgggcaatcaattattgtgccctttttgttgatcatgtgattaaggtaattaaaatccacgtaaatctcagcaagtatatttttaaacaatagattcaaaatttcaagatgaattccaaagggaaggatactgcattgagggttaaatactgggaagtgatatggtttggctttgtgtccccacccaaatctcatcttgaattgtactcccataattcccatgtgttctgggaggaccaggtgggagataatttgaatcatgggggtggtttcccccatactgttctcatggtagtgaataagtctcacgagatctgatggttttatcaagggttttccacttttacatcttcctcattttctcttgctgcctccataagaagtgcctttcacctcctgccatgattctgaggcctccccagccatgcagaactctaagtccaataaacctttttttcttcccattcttgggtatgtctttatcagcagcatggaaacagactagtagagtaaactggtaccagtagagtgggatgttgctgaaaagttacctgaaaatgtggcagcaactttggaactggttaacaggcagaggttggaacagattgaagacaggaaaatgtgggaaagtttggaactttctatagactagttgaatggctttgaccaaaagcttgatagtgatatggacactaaggtccaggctgaggtggtctcagatggagatgaggaacttgttggaaattggagaaaggtgactcttgttatgttttagcaaagagactggtggcattttgcccctgccctagggatttgtggaactttgaacttgagagagatgatttagggtatctggtgcaagaaatttctaagcagtaaaactcaagcgatgacttgggtgctgttaaaggcattcagttttataagggaagcagagcatgaaaaattcagaaaatttgcagcctgacaatgtgataaaaaagaaaaacccattttctgaggagaaattcaagccagctgcagaaatttgcataagtaacaacgaggggaatgttaatccccaagacaatggggaaaatgtctccagggcatgtcagaggtcttcacggcagcccctcccatcacaggctaggaggcttaggagaaaatggtttcatgtgcctggcccaggatccccatgttgtatgcagcctaaggactttttgccctgcatcccagatgctccagccatggctgaaagggtccaatgtagagcttgggctgtggcttcagagggtgcaagccccagtccttggcagcttccacgtggtgttgagcctacaagtaaacagaagtcaagaactggggcttgggaacctttgcctagatttgagaacatgtatggaaatgcctggatgtccaggcagaagtttgctgcaggggcagggtgctcatgaagaacctctgctagggcagtgtggaagagaaatgtgtggctggagcccccatacacagtccttactggggcactgcctagtggggctgtgagaagagggccaccgtcttccagaccctagaatggtagatccactggaagcttgcactgtttgcctggcaaagtcacagacactcgatgccagcccatgaaaggagctgagagagaggctgtaccctgcaaagccacatgggtgaagctgcccaagaccatgggaacctacctcttgcatcagcgtgacctggatgtgagacttggagtcaaaggacattattttggagctttaaaatttgactgcctcactggatttcagacttgcatgggccctgtaaccactttgtttgtgccaatttctcccatttggaagggctgtatttacccaatacctgtacccctattgtatctaggaagtaactagcttgcttttgattttacaggctcataggtggaagggatttgccttgtctcagatgagactttggactgtggacttttgagttaatgctgaaatgagttaagactttgggggactgttgggaaggcataattggttttcaaatgtgaggacatgagatttggaggggccaggggtagaatgatatggtttggctctgtgtccccacccacatctcatcttgaattgtactcccataatttctacttgttgtgggtgggacccagtgggagatcatttgaattatcagagcggtttcccccacactgttctcagggtactgaataagtctcacgagttctgacggttttatcaggggtttccgcttttgcatcatcctcattttctgttgctgcctttcactcctgggccattattttgagggctcccctaccatatggaactgtaagtccaatgaaacctctttttcttcacagtcttgagtatgtctttatcagcagcatgaaaacagactaatataggaagtaatggtgtctcttcagagaacacgaagatttgtcgtttcattaaaaataaatatttattgagtacccactctgggctagctatgtacaactgttaagtgatggattgtgacatataaggccagagtcctcatggagtgtttaactctacacagggctgacaagtgtaagagggaacaagaacataaataaataagctaaattcagctagtgattggtgctaaaaaggaaataaacaggataatgtgatagtgatgtgtgttgtgggtccattcgggtttctagctctttatggtcagaagatactgagctttgaaggcaagctctgcgcatgaggaaacaggtgggttaaatagattttttttttctctgacaatcaagcccctggataacctaagcgttttcgccttcatttcagccaggctttttctcctttattctatgcttgctgggccctttactctctaatagccaaactactagagctagagatcttgcctttgtcattaacttttcctgttcccaatatctgctttctaagatctctttcaggaggtagatatggaaaggaaaacagacataaaatttgaatgtatcattgtggctacatgtgaacatattgcattaaattaattgatagaaagaagtttgaataaaatattttagaagaggtttttgaatttagagtttatgaggttatacttctttatcaacttacagttaacaatgaagttattcccaagcatctttaaagctaatttatttccttttgtgtttaaagttttttgaaggaaatatatgcctcaaaacaattctgttgaccttttctatctatctatttatctataaaacaaaacattaaatggttccttgatggttttaagtcatggaatttttagaagctaaaagtgatttaactgcagaacattaaaaaacagcactgtatgattgaaactatgagctttcattctttcttacccaggtctggggttcaggcacatgaaggattgactttcatagttccacatcataaggcacagattgtaaagtatatgtaaccattttacttagtctattaactttcagaaacccaaaccaagagaatcactcagcaatgtgacatttcacttttagctcttactgtcctttataatattcaggtaaaataatattttaaactagtttagactgtggcacatgcagtacataccttgatggtacggatgacaggcatcaaacctaaactctgtaaaaaatctgtgtaaataactcttattttactttacactgaaagtaaagtaaaataaggactcaatggtaaactatttctttattaatacacacattcttattttacatttcagagtaaagtaagagtttgtgcgtattagtccgttttcatgctgatgataaagacatacttgagactgggcaatttataaagaaaaagaggtttaatggactcacagttccatgtgtctgaggaggcttcacaattgtggctgaatgtgaaaggcacagcttgcatggtggcagacaagagagaatgagagccgagcgaaaggggtttccccttataaaaccatcagatgtcttgagacttattcactaccaagagaacagtatgggggaaactatctccctgattcaatcatctcccactaggtccctccacgacatgtgggaattatgggaactccaattcaagatgagatttgggtggggacacagccaaaccatatatttgtgtattaataaagaaatagtttactattgcatccttaagaattgaggcacttacatatagctcacattcattcttactcttctgagtctcagtatcaaatgggctggattaaaaataaataaaaaacaaaacaataaataaggcaaggggaactcaagtgaacacatggataaaatgattagataataaatggaattattcgagaaatattttaaaaattagtgtaattataaaaggtaaataaattctagataaacactgtattaatcagggttctccagtgaaacagaaccaataggagaaagagagagagagagatagatgcaattatggaggcaggaagtcccacgatgtgctgtctgcaagctggaggcacaggaaagccagtggtacagttccagtccaaacctgaaggtctgtgaaccaaggcagtcagtgctctaagtcctggtccaagttcaaaggcctgagaaccaggagctctgatatccgacagcaggagaatatggatgtcccagattgagcaaagagcaaactcaccattttagttatatttatgccctcaatggattgaatggtgccctcttacattggcgagggacatctcctttactcagtctactgatccaaatgttaatctcttctagaaacaccttcacagacatacccagcagtaacattttaccatctggacatacttatcctggtcaagttgacacataaaattatcgcattgagaatattaggcatccaatagtggtgtgcttgcaagcccactctcagaataataaaggcctcgatatgtagcatttgacaacttccgtagtgtaaataccctcaccataacacatttcagaggatcaacctgaagttgctgaatgtgaagttgggaagcaatgtataccattttcccgtgtgaaccagtacgagtcaactgcagtgtaccactgtattagaccagttaatatatttaaaaatgtttctaatccacagaaatggacttatctgacactgtgggagatcggttaatataaattaattttctagatagtggccatttcacctgtaagcaaatagtgtctatttattaaagataatttctatacaatgtatatgttttctgcctatagagcataatttcatcaattcttgatgatctaagttcctcagttgatattaatcttatgtgaacaatcaggaaggtagtataatggttaaaagaacatagtcttaaaccaactgtttgggataaaatcctgcctctactattgtgtaatgttgagtgttactcaggttccttctacctcagtttccttctctgttaattggggaaattataagtgttgttagttcttgttattcaaggcagttatattctataaagtcaccacaaacactgaattagtaaatactggattattgttttgaggggaaatacaggggttaatttcctggaagctgattcatcaaccaatcaatacctgcattgttttgtgtatgttcctatttaaagataatttatttaatatatatagttgaatcattaacatggaccacatagacaacagcactatcacttgtgtgtgaacaaagcttactgacaaatgtacgttctctctaagacacatcacagcctttttgcatttaggatcactagacagcacatagcgctacagccaagggctgttttaaatagggaaatcaccaacaaaaaatcacagaagcatgaaaaacatggcaataaatagactgttaaagccaccctgtttatagtatgagagttgaaacacaaaggtagggctttgcctagtttcaacacaaatgggaacatgcacatcaggtgactcaaatttttcaagcttctgcccatgcctgtgtctacaaatgagcaaaaagggctgtgagtataatttgggagttactgtcaaagatcaacaaagctggacactagttaaagtggtaagatcaggtggtaatcagtaatatactgctgcagaagggaagagggtctggcgtgacctgaattcaacttagatttgtacaaggaggactgggcattttaaagagagaattgtagaatagggagaagggtgagcagggactcagtagagtcagggtagcaaaaaattacaaagtgttggtcactgtaaatgattcaatcctccagcagagacggggaggcaagctgttcctcctgatatttacattttaagagaatggctttcaggtcctttgagaaacatactccttaattgtaggagacacataggtatctcaaagggataaaggaaggatccacaattgtaagacctttgtagtaaatgctctaaaaaaggtgtcggggcttatcatcaggtgtgggctagagtagtcgattcttttggcagccctaaaaaaggtgtccgcggcttatcatcaggtgtgggctggagtagtcaattcttttggcagccatgagcttccccaggcaggatcttaaatggggctgggtcatcctagggatgcaggcttgatctagtgcttattcaagtcttttcataggagggtgggagaatttcatgttcgctgacagcctgtagattttataggccaagcatgagacctagtcagggagttccgaggagcctggctagcatttgagcaaagagagaatatttgtgattacaaatatattttattaaataggcaaattcgcaaatatgaaatcacaaataatgagggtcgaccgtattttcacattgttgttatttaattatgtaaattgcttagaacactaagcactcaataaatgtctgcttaaattataatgtaagatgtaggaagtgttgagttataaagctgtttgttttgatctttatcagcctgcctcaggttgctattttaatatttggtcttctttttgttttatattttcggttttccagtttactgccaagcttccactttttctcactgttagtttgtgctactctggccttttaaccccagccctcctgcacccatattctttgcgaaaatgtttcagttgactatttaacaaggctgagtgaggacttgaaggcactctgagttgctagctctactatgatcattttatttgttcaccttttgcttttagacccaagatcctgcccgtgttccaggtacttgaggttgttaggggtctgccttttatgtgaggtggatttttatgaccatttgggaacaatgttcaatttattagtatatttttatcatcgagggttttggccaagaacttcttttgtttaggagctgtggcctggccatgatccaacctggctgagatgctcagaccacgtgattttcatacagacacagactgtggtgaatcttatggtagagcttgcggcagactccatggtagattttatttagatctcacgtctccactgaataaccaactgaatttcatggctacaaagaaaggaactatcacatgatgaattattttatattatttttgacaatataaaacaaataaatgttttcattataaaagtattcttgacttttgaagtaaaatttgggtgtcactcgaggactttgcctggctaaggtgcaaaattcttgtgaattttaaaaatagcttatatataaacctttacagaaaactaggaggtgaggaaaatccctcatgaacttggatgttatgaattgcagtctagggatttaaataggtttcacttatgttcatgttggattgttagagtaggtatttcatgaataattttatctcagataaactcatgatagattttatcattttattttggttcaattatataaatgctatttaaaatccagctcttactaagggttaatatggtaatgaattctagtattccctttgaaaacacggatagatattttttaatctttttttcatgttcacttaaaaaatatcttgctactgtctttatatcaatgtttcataattctattagccacattttgttgacctgcatattcctacaagcctgaattttaagttacaactttgtattcaatattagtagtattaaaacaaacatatcaaaggaaataaaaaccctaaaatttaatgtttcacaaaggaactctgtgttaaaacagtgtccttttagagttaacatatgtatgggagatgcattttaaataaagatgtatctgacctggaagagtagacaaatctgctttacagcaagttgaaagtttagagaaatatttatcattcagttaccaaaataacaaattaaagcagcaaggaaagagaaaagagaggagatgaaaggaaataaaggaaaaccaagacgtaagttaagaaagagctattgcttgtgaacttcttcctaaaaaatgatagaaaaaaaagataagaaacagaaaattgcatgagacttcagtgtttatgttttgatggaaatgtacaaatcattttcattctttgcagtgctgtcatgctccatcactttagtccattttcaccttccaaagaaattctgaatgggccttccttctctggcagctaattaatctttcacaagcctactcttgcagcctgtctgccagggatgccccacaccttaagccagtgactcacgagcagatttcttaccctcttgagcagtactttcttcccttgagctatgtgaagacctagcttttctattttgtttcggaaactatgtgagctgtaatatatcattgaagaattgctccttcccccccaccaccataagtgaatataaagtgttcctgaatcatttaattgggtaataatgacaacaaagtctgaatataaattatgaatgtgtacagcattttaccaatagtgtatatcatatagatgtaaggacacatattactagattataaattctctgtgtatatacatttgttagattatcattgtaataacacaaatgtacttatatttataataatgttgcatttgcctaaaaatactaataaaactgcaaataaaaataatttttagtctaattaatggaagatttggtatatgaatttttttttaagttagagcataattctttacagattgaaatgcctcagttaaaacaaaacaatatggccagggatggtggctcgtgcctgcaatcccagcattttgggaggccaaagctggaagatttcttgaggccacaagtttgagaccagcctggacaatatagcaagactctatctctacaaaaaaaaaaaatgtgtgaaattaaaaagtttggtatacattctttttgtatgcaaatgtttccatctgttgtcatttcaatttaatctgaataacttcttttcagcctttctggtagaaaacatctgctgtcaatgactttatcaggttttatttatctaaaaaatgttttattctcgttattgaaggaattctgggctgaatattgaattttcagccctcaaaaaagtgatctgcctccattatttctgttaaaatgtcagttgctatttgtataattgctctgcacattatgtttatctgtggctgctttagagattttgttttatgttttgcttttgacagttgactattatatacttaggtgcattctttctgttgttaagcatgtttggattttgctgagctttttcaatcttgatatgaatattgataggaatgttgacatgaaaaatatcaatgttgatagttttcattaaattgcagaagattttagccatcatttctgcaaaaatatttctacctcatctccctccctccttctcttcacccctctctgataacacaattatacttatgttagaccttgtaatatttttctactgattattgagactgtaatccatggtttttcaatattttttctgttcttcaaatcagataatttctattaatctcttttcattctcactactattttttccttcagtacccaatctgatattttgctcacccagctaacattttaatttcacatttacttatccattcttacatagacctctttttttatggtttgcagttaccttctgagattctctatctgtgcacccattataactatatgtttctttaaatctttgaacataataataataaatcatttgtagtcttggtctttgatttccaatgtttgattcagagtctgttctgttctatgtatttttttatttttcttgtgtatggattacatttttacctttccacttatgtacatatgtagcatttaaaaaaaaaaattacatgctggggctgggtgtagtggctcacgcctgtaatcccagcactttgggaggccaaagtgggtggattacttgaggtcaggagttcgacaccagcctggccgacatggtgaaaccctgtctccactaaaaatacaaaaatcagcctggtgtgctggcacaggcctgtagccccagctactccagaggctgaggtaggagaatcgcttgaaccggggagacagaggttgcagtgagccaagatcgtgccactgcactccagcctgggcaacagagcaagactccatctcaaaaaaaaaaaaaaaatacatgctagatgttgttaatgactaatttggagaaatctatattaggttttctcctggaaaaggtattgagttctgttgtaaggagcagtttaattatgggaagatcatttttgccctttcaggcatagttttattcattggtagtagaactctacttttgttttgaatttagtttatgaaccttacccgtacccctatagtggagcctttcttgaatctccaagtgagagtctgagatatgcagtaaattatctccacttcacccaggattaaactccagagtattctttctagcagtagctaatctctggtatcattgttcagcaatcaaccatagagcaggaaatctctgctagaccttgtggaatcttactctatgaaaatgccatctagacgttcgcccaaaattcatggtgaatcctcacacaaactactgccattcccagctcagctcccttttgtcagctaccctacactccaaattttaagcaactcagaagcccagacttttctcgctgcttctcaactcagtgaaacttcagttctactgggctctatttccgtatttgatagtaaaaagtgcatccaagcagaaagtcatggaggttacagagctcattttgagtttttccttctcttaaggattatattcctgtgctatgtttagttcaatgccagtaaaaatttactttagataatgtgtgtaattttacagttgcttattataagagaagtacagaaactggttactttatcacagttggaagcataaatcctaacaagccatttttattgttagataaaagagataaagcagattgccatagatgaggcagaatgagggtcgtgagggaggcaggctcattgagagttaaaatagagcctgtgatgctacgggtattgcaacatactacatacatctgtacttgaaagtaaagcaaaaaaatggagaagagatacacgtcagggattgggtcaacagcacacgaggtgaaaagattttgtaggagacaacaaatctgaatagaagtcagtgcctttctctccttctgccaattaattttcccaccttttgccattaatctttagaaaacagctatcccccaatagctgtcctcgtaagtcataataaaaagaaaccaaccagattttataaagaattgcaaaaattgaagagtaaatgaataaaactccaaatttcagtgaagaacatgaagtgcataaaggaatcacctgagtaaagatatgaaatcaataattcacacaaaagtactctgtttccaaagaaattactgaaatgctatattttaaattgtttttatataataaaatgtcaaaagagttaaaatattttattatgatttgtaagatgatagatgcaaataaaaagcagactgaaaaagatcaggaaacaagtgaactagaaaacagaaataaaagcttttgattgctcttcccctacccaacacacaaatagaataaacataattgagagttataaagaacagatattaaaaatgaaaaaaataagaattgtagagaaaatattaaacgtaaaggcaaattagacaaaaaaggacatagtgtttctaaacaaaataaatggactaaattgaggagaaagagaaaaaaaagtcacaggggaagaaactttcctggaataataaaagtctaggcataataggtggacctttccattagggtatgctgtgctaaaatttctgaacttcagtatttgggaaagaaactgtaagggctcttgggtgtaaacagcaaacgaaccccaaagaaggttggatgggagattggagagactagactgacctcagactttgcagtactctaacagtgaattgtttctccacaaacatttgaggaggtcaggtgacccaagaaattataaccagcgaaactgctgttgaagtactgaataatcattaaactgtataaaagtatggatgcagaggattaatttaaacatatattaaacactaggaagatggggaaggagggacgctgagtttgagctttgtgattacagatcaaaatatgtgatgatttttgatattctaaatttaacaataagatttttttaaatttcagaggtgagtaaaaagaaagtgggaggaacataaatacgttattttccttttttcactatactttttataaatgaaatgttattaaaataatatactttaatatttttcttaatgttatcttttagatagtgatagatcttgtcttgtagtaagaaagtatctacgtgactttcagcaatgcctttagttatacttattttattgttaaatttcatataatttaataatttaccattttaatataataggaataaaattcttaatttttatctctctctttttctctcccacctcacctctctgtctctccatagagctataactacagtaattatactaatatttaaagatgattatttcaagatagtgggctttggaatagaaacttaaaaaatgttcatacttacatttttagattcattaaaaatagcaggtaaaatttgtacataaaacagtaattttttaaaagaaaataacttattctgtaagttttggcactctcctcaaaaaagattaaatgtcataagtaaaacccaagtatactcgtaaatattctaatatattggtatacttcttgggtcagcaaacttttcttcaaagggctatgaattaaatatttttgatttgtggaccatattatctctgttgtggctatgcaactctgttactgtaatgggaaagcagcaatagacaatatgtaaacagactggcatattccaataaaactttatttacaaaaataagcagtcagttctgggtcgtggtttgttgacccctggtatacacatcatcaactttagtgattaaaatattatcagcctatctgtgaaatactgaggtaaggaaactaatacaaaatattcctgatgtattgattttatattcttgctccaaatacttattactgtaatacttagctttgatgagaaagggaagtgttgctaaataatttacatacatattcatatacatgcaaattttcatatcttttgatgtctcaaaaatgctgacatttaagaaaggaagggcatattttgcttcttacagttcatatgtgctgtactcaagctgacttcttccttcccattttacatttctaactttgatctcagaatgtaggagctggacaggatcaccgagtgcatcaggtaaataatttcattcacacaagaagaaaatttacggccactaaagttaaacggttaccatgctagttcttgccaaagtcaggactggaattcagtctcctggctcccattgcagagttttgcccactacactatattattgtacatggcttggttcaagccacagaggaactaatcaaagattaactatctgatttatacatatgtatatatatacttacttatatatatatatttttatacttacatatatatatatatatatatatatatatatttttttttttttttttttttcctcgagagggcatctcgctctgtcacccagtctggagtgcagtggtgtgatctctgctcactgcaacctctgcctcccagattcaagcgattctcctgcttcagcctcccgagtagctgggattacaggcatatgccgccacgtcaggctaatttttgtatttttagtagagatggggtttcaccatgttggtcaggctggtctcgaacacctgacttcaggtggtctcctgcctcggcctcccaaagtggttggattactgacttgagccacaatgcctgggccaactgactgattattatattaggaatgcatttatattgactcctctgttctgagtacttactagttatcctgattctatttgttctctattttaaaagtaggtttataaataaagttatttaagagcaatcagtcattacacatgaggagtggtattgctctatgtatactccgtttcattgagaaacagccttttcgtaaaatggcaaaaaaaacacagctgcagttatccctttcttctgggtcatttctaatagtttagatcagtggttctcaaactttaacatgtatcagaatcacttgaagagcttgctaaaacacagattgctggggcctcctccagagtttctgattcaataggtttgggatgacgcctgagaatttgcatttcagacacgtttccaagtgacagtgatactgctagtctgggtaaaaaattttaaaaaccactgggtttaaattctcagccctaaaggcatattataattaccaggagaggcattaatccactaattaattcccaggctccatcatcaattggcatagaatgtctagggcttgagactgggtatgagtattttgtcttttttttttttttttggtttaagtaattaatcggtgcattaataattgtacatatggggtacaatttgatgtttcaatacatatctgtggtgtagagagatccaatcagggtagtgactgtatccatcacttcatgcatttaccacttctttgtggcgagaactttcaaaagcgtttcttctagctgttttgtaatatacaatattttaatgttaaccatagtcaccctactgtgcaacaggacaccaaaatttattcctcctatctaattgtaactttgtacccactgaccagtctctccctattctcccgtctcttttccctcccccagtctctggtagccactgaagtgcctcaggtgattctaatatataaccaagtcggagaagcaattaagaaaagtaatgactgaaaaagtttattttgtctgatgaattagtgcaaaattttttaaacatattcctctattatgtggggataatttttatactgtcatttcatggtaaagtataaatgagatagtataaagatgactttaccaagtgattccataaattgaaggtaatttgagtgtagttttatgctactaatcgtataaagtgctgagaatataaggtagctatagaattttacttttaaaatgttgttattgtaaaatttttgccattaataaaattatttcatgcctcagttccttaaattatttttattagcattgtatagacagcatagatactaactcctaaaattcttaatttctctctttatagtgaaagatgcagatgtactttgtatggacatacagattctgtgaacagcattgagttttttcctttctccaatactcttctcacaagctctgcagacaagaccctgtctatatgggatgcaagaacagtaagcaaatcattcactttttttcccagcttttgataagtctgattactctcggtcattctttgggtatggaatatgacttaaaaagtgattgtgcaagggcattcagggcaaaagaacagtaaaaagttcataattacaagatcctttctatgcacttgtatccattctgccttccaaatgtgatcaggtaaaaataatatgattatctcattaagcattatttcaacaattatttattgcgatagaagctctgctggttcatgggatacaaaagggaaatacacactgtgccccctccttaaggatcttttagctaggtaaaggaagagaaacgagagattattttgatgaaatgagacatgcgttaataaaatggaagactatctaaatacagggggaaagcaaggaggaggattcatatctgctggaagagtgtggatggctttcaaaggagcctaggcttgagctaagatctggagggtaagtaggatatataggtcatctggagaggggtagatttaggagagggcaatacatgctcaaagccatagagatgtgaggctgcaatggcatgttctgacagtaatgatataaatggaaagagcttaaggaaaaagaggcatgataggcaagaatgtacagagacaaaacaagatcatgacgtatttgattaaagtcttaaactatttccgagagaattaaagagcattaagcaaacagggtgacataatcggatttaccttgtcaactgaagagtgacaaggttcataaatttggaaaataaattcctcataaggggttacagtctgcagggtggccattcggacaagctggaaagcatagcctccagccagaagccagaaatagatacttcgagggaggagcaaagggaacaggaatttatgctgagttgggtatgtgaatatttcataagcttgaggaggagtcatgactatttatgaaaggtgaatcatgcacatgcacagtatacattcatgccccttcatgggtcccatgtaccaaaaatggcagttttagcatgatccaaggctggagttttcagccgcctaacatcggaaggtgaagtggaggacatgaaaacccttactgcacatgttccatggactggccagacccacttcatggtcagtggtctcttatcaggctaaaagaggaagggcagtatcaggtggctggttgatatcagtattgaggtcttttgaaagggctggtttcggctgggtgcagtggctcacgcctgtaatcccaccactttgggaggctaaggcaggtggatcactggaggtcaggagttccagaccagcctgtccaacatggtgaaaccccatctctactgaaaatacaaaattggctgggtgcggtggtgcatgcctgtaatcccagctacttgggaggctgaggcaggagaatcgcttgtatccaggaggcggaagttgcagtgagccgaaatcatgccattgcactctagcctgggcaacaagggcaaaactccatctcagaaaaaaaaaaaaatcaaagaaagaaagggctggtttctgtttagcacttagggaagcaaggctaatggtcattttggagggagggagtatgaggaggcttgtctgaacaccatcctgtcctggctgagagctcagttttcaaggttactctggggtcctgttggctaagagatgttccattcagttggctgggggagggccttagaattttgcttttatttgtcccctttttagaagatgattttgataaggaagtaagagagtcagtcatgtgaggaatctaatataacaggctatgagtggatgagaatttgagctaggaaacagcgtagatgaaaaggagagaatgcattaagcataggaagtttatccaaatttggagagtgattggaggtgaagattatgtggggaggaggaggagttcagggtgagaaacttttccaatttgtctaggaatgagggttttcctgagtcatgagattttcagagctaaaattggacagaactggattactggtaggttcaagagtgaatttgattttaataaaagtgttttagtctgttctcaccctgctgataaagacatacccaaggctgggtaatttataaaggaagaggtttaatgaactcacagttccttatacctgtggaggcctcacagcatggtgaaaagtgaatgaggaagcaaagtcacgtcatacatggcagcatgcaagagagcatgtgccggggaactcacctttataaaaccatcagagctcgtgagacttattcactatcacgagaacagcatgggaaaaactcacccctgattcagttacttcccaccaggtccctcccatgacatgtggggattattacaattcagggtgagatttgggtggggaacaaaaagccaagccatatcacaaagtaaacaacatgtagggactacactttcaaacagtttggctgtgaagatgaataggagaaaagattgtagctctaagatcaaataaaggatcctcctttgttcagataggagacagcatgtttatttgcttatgggtaagatcggggagatgaaatgaaaatgtaggaaagagaaaagataacagagtttattgtgcacagattttcataacttgaagaatgccaatatgtgtaaaacaaggcctccatattcttcttagtgatattttataaagatcacaagagaaacaatgactacagttgactctataagaaaagaataaatattcataatttctggttcctgggtcaataagaaagagaaatgtaatttctcccattttatttcccatatacaaaacatgattgatataaataaaggaatatggtaatggacatgcagatggtgttaggagggatgcaagttcagtatgtgaagccctgtttagacctctgaggccaatttatttaggatatatgaagaacaaaatatgctcagcaccacacattatagaaaaaactaaggtagagctacccatgtcttggtgaccaacttcacatgttgcagagatttaaacttctgaggaagcagaagtcaagggggcattgtggaaagagtgcatcaggcgtgacttaaaaataaaatcaggatgattttttgttaggtacaaaggtccgacaatctcctccttgctttaaaatagcttctcagacattgatgcagtggagtttgctcctgctaatggagcgtcaatggaaaagtaagattttcaatatattttgaactaaaaacttagatgtgaagtttgtataaaagtgattggtagaggaatatccatagagaaaatattaatttagcagtgacctaaattctattgacttcaaggtttttttctctctctctcaagtgctataactgagtgttctaggaaagtctatatcttatttactttctcttatgtgaaaaacagaagcactaatgcttagaagtaaaactgctctaattttaaaaagtttcctctcatatatatctgccttgaatgcatacagctgtttattgatggtgaccttcctccctccctgaggttctgagctctttctgtgctatccttattccctgaagtatcaggagaaaaagagggattcagcacagcacagtaccttcagcatagtgcaattgcatatgcattgaatgtaaaagcatagaagggtttgcaagtcccatttgcatgactttaatcaacataaatatttttaagttgacttaatggcaaattaaaatgtatatcactacaattattattgctattttgttactattatgcatgctagctttatattaattaatactagaaaaaaggctctaaaatattttggtttaaatgaaatatgattcctaaatgtatcataaatgcatcattaattagaaataaagttcatttaatgggtttattttctaaaaatattttcaaaccaagtagaaaaaaatttaaattgatagctatgtactgtaaaaaactggcatataatgcaaaggaaactcattcaacttattaattactagataatataaattgttaacgaaaatattgatataaaattctacaagtgaaatacgataatccaaaaattaaacagaatcattccactaacattgcattaggcaactgtggcgacttcatttcagatatagctaatttattaaaaaacaaaacaaaacaaaaaaactttaaatcacccaggttttaaaaaatttatactgttatatacattgtttttaaaagacaaagacacgtgttatatgttgtctgtataatatggaattgttagttgttttttatcccagtggttcataaacaagttaaaataaatttacatttttagttaaatagtaagagattttgaaaagggtaaccagattagctaaagtttttttctatgttgtaatgataagaacagtataacatattgatatggatgacattatttgatttgcaacatcaactgaatccatggtatactggcatgcttcttctttataatttttaaaatatgttaattccttgatacatgataaattgtcaggttatcctgaaggtctggacctaaaaggagattaatgactttcttctattagtgaagcagtaatggtacattttgtcacctcaatgtgatcagttactattgagacaccctctgaaatattttttgatgaaatgtgaaaatgaccagtggattatattcctataaattagttttaaacctccttctcccactctcaaacatatactcgttttaaatcattaatatgatctaacacctttattatcaaagataattaacgtggaggcctaagtcagtttccaagtcaactggacatatcagctctgaattttgtagaggatgaaaaaagggatataaatctctataattaccaaatggaggctacaaaataacttgcagtttggaaactcatgaaattgctcagttttacaggactgcatgtatttttcttcaaagttgaagactattttattaaaattgaaagataagattgctttattgtcagaaagtgatatatcacatagcaaactgaatgagaaattataaggcctacctaaaggcagtaagaaaaggctcaatgtacatacagtgatttggaagcctgtttaaaataaatgcaatgagattgttagtcatccacaaacccagtgaaaatattaaggctttttttttaaagaaaagaatgttttcaatatacagtaaaacacagaatgagaatgagatgagtaatacatctatgagttgtgtcagagctgggctggcaacagtcagagttgctgacattttgtctcttgccatgagtcagacacagagggttcatgacctggactgcctttagtggccattccttgctccttagactaactgcgggcacttgtccagcttacagcattctcctgacttagctttggccaaaagatccagtaacttgtcactgcgagtttctataaagtggataaacaaggaactcacaaaaagagttaacctgttggctcctgtttggtgccagacccatgtctgctctacagttcatcctgcaccctgcataggcctgttggttttcatagataggatctggtgaactctaagaggagcctaatattcagaatccagaatgtggaaacaaagggaagcttgtacctctctcttttatccctcagccatatttgatttagtaatgtttactggagatctatgtgctaggcaacatcctaggttctcgagaggtgactgtgacagaatccctgccctcaatgaacacacagactctcagggacaatgtataaagataaattatcttaaaataatgtagtaattgctatatattctatataactatagctttggtttttctgtgccaaagctcactgtctcaagagctgattgatggttaacacttattgaatatgtaatttgtgccatcattttacctataaaatctacatagcttactggaatctgattgggtgggtaccattattatctttatttcacaactgagaaagtggagcctgaggaagtaagttgcgcaagaacagcccagtggtcagtgacagggtgagaacgcaggctgcctctccaacctcggtcttccttcttccatgcccttggccatttccatgcctctattaatctacttagtcccttcgagtttctaccacagtagtctccaaactattttttataaaaatgttttaagcaattactactgtgctggtattttatgtatgtaatactttatatatacacctgaaataaaaataatgacagaaaggtacaattagcaatatttaaaattccatgtttcttttatagcctctaattttgtttgtttctgaccaaaaaataacaatgacacaaaaatgacagttcagtaagaaaagatgactcaatatgcttatattttcaaggaattctgatttaataattttaattaatgactgtaattcagtgattcacaagtatgatctatgattggatttagcagctatcagaactgcaaatgatcccttgacaaaaaatacaaaactcctaaaggaaaaaatgtatgatgatctgtacttaccaatgtgcaggctgaactttcaaattcatccactaattatgcaaaggaatttttgttaaaattttgttagggtttcctcttgttctgaggtcaatcagttggttttgcaaactaatcagaagttttcaaacattttaatactatgtggaaaattctttttctacatgtcttaaaggttcagatacaaggacttttaaaggttactgcccttatgtagatttggtagaggaaacactaaaaatatgtgttatcaaatgttctatatcataagtttctttcgaaaatggtgccttttttgtttattgttaaaatgtcacctttattttgataggatgattaatcatattattttcaaaattatctgcttacagttcactgttggcaaatgcctattatcacaaaaaaggtcaacaaattaggaatatttgtgttttggggagaaaaagcataacacatatttaaggtcaacttttcttttaaacactttgctaaaaaattgtgaaatttaaattttgtgggagtagaaaacatttttttggtcactctgactttttacaaaatattataaagatcctaatcatcaaaggactagtgtattaatctgttttcacgctgctgataaagacatacccaagactgggcaatgtatgaaagaatgaagtttattggactcacagtttcaggtggctgaggaggcctcacaatcatggcggaaggcaaaaagtacttcttacacagtggtggcaagaaagagacgcttgtgcagggaaactcccgtttttaaaaccatcagatctcatgagacccattcactgtcatgagagcagcacagaaaagacctgcccccataattcaatcacctcccattggttccctgccacaacacctgggaattatgggagctacaagatgagatttgggtggggacacagagccaaaccttatcaactagttaacctaaaattaaccaacttataaatatgcaaagtgcttgaaagtgcaataatacaatacaaaatttaaaataaacctcactgcattgattttatatactgtgttacaccttgctttgaacaccttggttcaaagaccttcatgttgcacaaatcctgtgtagagacttactgctttctcactaaataaacatctactaccatcagttattaaatacatgatgtcctaaccgtgtgaagttaacaaacatataacatgatctttcctctgaaaaagctttccctttactatttcatctgcctgacacaccttttcccctcatcacctaaagaatttgcatccatccttaaaggttcacttcaccttccctccaaagctccccatgcttgttcctctggattaggcatcccaagaggcaaccaagagaactttgtaccccgtagaattttgctaattatttctttgtaaagtgttttaaaatgttgaacttggcgaatgagacatttttttctccataaaaagacaagccttaccaattagctaacatttcgtgtaattactaatggcttcaggaatgggctacaagaagatatgcttgaaaaaaatcaatgtacgtaattgcatttttatagaactctggacttatatcctatattatcttgtatttacatcagaccatatagcacgataggaacatgcagccattctgcctggattcaaacccaaaatttgctgcttatttacagtgtgtccttgggcatattgtataaaatatttttcccacaatttcctcatttgtaaaatgtgcatagtagtactacttatcacataaggataaaatgggtattaaatgatcaatcatatgatgtgcctagaaaagtgacagatgagaactcagtatcttttagatattcttacagcagttgtcatgccatataattgtttagttatattttgctctcatgaaactcggagctttcttctctattttcacaatggttggataataggtgcttaacagatgttaaaggaagtgagggaacaatggagggtgaaaaagaagtgaaggagggaagggaggaaaaaaaagaatctgtcttaccatggtgtttcttctaactcaagaacttgtgtcatgttcttcagatataccctatttcacttttatttcttttcctttctttccatttatattaacaccaagccatagtacagaattgttactaaatatttaagaaatacataaattatgcaattttgtttctccaagttattgccaaattctatcctcttccttctttcctgataatgacatagccttccttctttgctactacaatttgatgacatgaatctcattagacatttcaagttatctttcaatcagtccctgacagtgcatctgacataatttaatattccccgttctcaattatcccattttattatgccttttatttcagataaaccttctcttttcccctcatgttttctctgggtatctctgtagcttgcagtaggtaatcacttatgttcaacaggcctttgttttccaagtaacttctctcacttcattaaaaatgtagtagaagctgtgttctgagaaaagtcacactgattaagatggatgttatggttttttcagagtaatattaacaacaaaagtaaaaaatactgattttccaccaaaatgactgactggtttggctttcacatctttccctagaggagtagtatttgagtggctatcaattgcttcctaaggcattcattaaaaaaaaaagaaaaaaatactttatgtgttttctaaaatgcataagattttcagaacttacagtcatatcatttacatttgtcattaacttaaggtataagtacataggttttaagttattacagactataaatcagatgttttgcttttaggtagaaaagcattttactcaaataatccaattgtttgaaaattaaaactaagtatttttaatacacagtaaaaacattgtatcttaaatagtagatcaatttaatatgctataaggctttcaaagattgttacttaactttgctaaaactattgtgtatctcatactttccatataaaacctttgcatacacatcacaaatatcattcctttcttcttttccttgcagttactataaatggtattacactggccagtagcgggaagactagatttttgtatatcggtatcagcctttgaaaaaatatcatattcaataatggcattaaataatttaattaattgaattaattataatgactatgtccattgaaaaataaatatagattagctttatgagattattttaattctgtaagaggtaaaaataatttctttatacttcatgcagtttatttagattccattcaataaagatggaatgtagagatatggtgttggatgagataaaagtaagtaaaattcccaatcaattatttagaataaaatattcttaatactcctgtcatagttgagacaccatgttgtactgtttttttatgctgaattttctgatttggaatgaattctaggattggaaggaacaagccaaaagaaaataccagatacaaaaattcatcttttgagtagaagtaatatgggctaaatcatctcaaaaacttttctccacgtgcttacccaactgatttttattcattactgaaatggcttctttgtaataattttagagtattttattaggacagagattatgatctagaagggtatgaaatttagatatagtaaatatagatgatttaattccttttgtattccttaataatatctgtagtgaacacaaaatagtttaaatgatatctaaaatgaaaattgagatcaattattttcttagggaagaataagataaatgaattgtaaaacataattacttaattcaatatttttgtaaaagttatataatacattctaaacttaaagatatttgtttattccttcttttgaataatatcagtgagtatttcttccttttattcagattgatgtgaaattatatgaatagaaggttgatagagagctaaaaccaaagattgatggaaagttgaaactaaaggaaaagcatgcatctaccttttcaggtgtggtagaatctagatctcttagaaaaactatgtttttttgacttatttgaattaaataaggaataggattgtcacatataaatattgaaggtaacttaatcatagaatatatttgaccaacaggaaaccccagtggattgcctccagtcttttctgccttgagcataataatgtagaaaaattacagattctgaagtcagatagattagagtcttgagtccaagattttttaaagttcttttacctcctggttgtgaattttgaggcacaatatttaatacctgtaaaattcagcattctcttttaaaatgggaataataataattaaatcacagtattagcactgggagtatttatttggaaatcaaaaagggtcagttacgtttttctatttttggtagctgagaatgctagagacaagtcttctcatgatttgtagttctgtctctttggttgatgggttaaatgatgcttaatgagattgaataattccattgcaaattgctttacccagtgttttgtgtgttgctgtcactttcaagaactaagtgactacaattcattgcatcagtttgtaattccacagtatgtatagtgtttatttgacctatcttacttgtagcctcttaattttacttcaacatatagaaattactaggaataagcttgtcactgttattcattcttttatacattcaacccattaaaacttcaatagtgatggcttggctgtacttcaagatagtcttaacttcaaattcactgtagtaccacatgttaattataatttttagataccgttgatgaaactagaaattaaatgcaacatttgtggcaagtgtttccggcattctgctgtggttgctattgtgatccgtgtaaggtaaaacaacacctcttgttatatagatttatagcaccagaaaattattagcaattcattaaattacatttaaattggataaccattgatgcaccatataatcatggtgactttttttcaaccatttagtatactcaggcatttcattcaataaagaaaatactgtaaaagaagacaagctgccttgcataccctactgttatgacacttgtgcattctatatataaggacaaaaaccttaaatttaatgatataacaaaattaaactgtaaacttctgtaaaagatttactaagatggtcatttgttgtttatttgactacccagcatccaagaaatattcttttgaagggaaattgacaatgtaagaaatgtggtaagaggcagggctgaagaaatatcagcaaatagaaaataataaagattaaagcataatttaacagtggaaaaaaagtagaatttgtttgtccaaaaacagtttctttagaaaagctaacagcaaaccatacttagcgttactttgccttactgttagcatcttcttataatttctacttttgcaataacatatatacatacatgcatatatatacatacacatattatattatatatacacacacacacagaaaccatgtgtatatttttattagtttagaactaataaaaatgtcataaagttagtctaggaaaattcaatggaaaaatcaatagcttcttctttgctgacaaaacaaaaacaaaagttaaaagtgcaaattaacaatatcaacaaaaatatcctatacacataaagatgtttgtgtaatgtgaaagaataaatctgcataataacagtgaagtgtgtaaataagtatggacacacgtataaggatatgccaggttctttcattgaaagagacacatttctttataaactaatatataggtttaatgaaattccaaggagatcctaataatgtttctgctttgagtgtatttggtaaataaagttattctaacctttatatctccttagataatagcaattgataaataaagctggagggaaaagattcatgagaaagactagcctaccggttattaatctataaatttactatacagtaaatattgtagaactgaagaaagattgataacccaatcaatgaaatagaagttagagcccttaaacagactcttaattatgtactatacaatataaaatcctttatttaaaaagggaactcttcttgagacttcttcagtaaatcaaagtcatcatttttttcccttcagcctttccccattttgacttgctgattctcaaatccctttctatctaaatcttgtatatcttttgactttgtatatctaaagtttcatctgtttcaaagaaactttattccactgtttgatgagattttatttttagatttttttcattatcacacaagtaaaacactattcagtgtaggaaagagtagactttaaaagtacttagaaacacacccttaaaataagtaatgataaaatattagtatgataacctttccaatttttgtatgctatagataagatgtacattcaaacccttctattcataataatagcatactataaatattatagaagttaattcttctttactgaacagcataacttgaaaattattttaaatattattgtataagcattctcattcttattatcaatgtattatacatatattatagttaatgatatagatgtatcactgtttgcttggacagtcttttcctatgaatatttggatggtttctaagtaattgatcttctaaacaagaatgcagaaacatccttgcaggtttattttttcacatttgtcagttcttttcattgagatacatttataggtggtaaaatttgcatttttaaaaagcatttaaatcatattgataaaggatctataagatgttgacaattcctagctatatactctttccagcaatccatctgtgtccactttcccccattcttaccacttaagttttagaagttagagaagataaaattatcctgtcactgttttagtatataagttttaggacagttaaaatgttttatgttatcattaagcataaggctaccattgacattaatttctatatctgtaattcatatttacattatttgacacaggattttggacagtctttttcaaattagtatggttatctggtttatttgttttgacattcaaactagttgaacattttttctgtttgtcttggaaaattgagtgcttcttggaatgtatcgtgattgtcttaaaggtataatatatgactaagtgtgttattttagctaactaattaaaatatatatttgtaaaatgagcctttattttccctaccatcttcttaactgttttctggaacttttggcatctaggatttgcaacacacatttttatgatgtgtgagattgtggggagctagcatactactgtgcctaaattactttacttgggtccccaattacactgaactagccatgccttttccgtattttctgtattccctggaatttgtgtatctgattataggaaaatggtggtgagtttgtgatgaaatgacatagaataacaaggagtagaactagtctattgtacttcttagataggctcatagagtttgaatcacactgctgtcaatgtcttagttcctaaaagccacagaactcaggatcacttggcagatagatgatggagccttttcacaattcttgactacttcatgaagcaaagctatggcttgactgaatagaattctcaactgaatagaattctcaactcagccaaattgggaatttgtttgtctgttggtattttttaatgtgtttgcatgctttagtctctggttgtatctttgtggatgatacatatatcctaatacttagttataatttcataacaaatgcctcaacccaagattttaattttacatgcatttgataaaattttaaaggatatttaagagtattattaaataagaatcttctgtatttctgatatattaacattgaaatcacttgatgtgaaatcttgaataattttactatttactatagtatctgtgaaaaaaatcatttttgttaaaaatgtatgtatgtgtgtatatatttgtgtgtgtgtgcacgcatgtgtatgtgttgaatgattttattgcattcaatactatatttggcccaaatctttactattgaatgtaatacaatcaatcattcaacacgtaagtactgaatgcctaacgtgtagcagggactattctatggatacaatttttttttaaagactaaagtctctgcctttggggagacttttagtagaaggagaaagataaaataagaaaaataatgagtatgttagatgacacatgttgtggagaagaaatcaggaatcagggaaataatgtaagaaatcttttgctggtggggaaaaatgatgttgtgattctaattaagatacagctagaaccaaggtctaaataaggtttggtggggagccttcccaatatctgggggaagagtgttccagagagagaaaactgcaagtacaaaaactcaggagtagtaatgtgcctggtatgtgtttgaggatcaagcaaggagcagcaggagtggatgagtgaggaaagaggggttggaaaatataaaatgaggccagagagtgttggtgggtaggaagagtgggacaaattctgtagtctggtagactatttggatgactggcatttactcagggtggtatgggaagatattggagggcttcgagcaaagaggtacattatctgcattaccttttatcacactagtgggcggggagaggggaaggcaatggtggaagcagaaaaatccactgtggctattctgatccatctatgcaaaagatgacaatggatgggaccagaatgatagcaaagaggaagatgtggttagagaaaattaaacacacaaaagaaaagaatgtggagaagagaagatgatcagggacttggaaaatgtggaattgccccaaaaacaaatcttactcaaacttaactctatgcctttccctactaattcagccttcaaagaagcgacaaattactcagtcactcacaaaacaaaaataaataaaacgtatgaaatttaatacattttgctcttaacagctgtatggaggtgtaattgatttggtttatttttggaattgcacttgtttaatgtatacaatttgatgaatttggacatatgcataaacctatgcataatatcaccacaatcaaggtaataaatatattcaccacctccaaaagtttccgtgtgtgtgtattttagtggtaagaacaatcaacatgagatctagtctctcaacctaattttaagtgcacaatactatgttgttaactttaggcactcttgtacagcagagctctagcccttattcatcttacataatggaaactttatattcattgactaactctctatttcccccttccgcaggtcctagcaaccactattttgttttcttcttttgtgactttgactattttagatacctcatctaagtggaatcacacagtatttgcctttctgaggttggattatttcacttagcacaatgtcttccaggttcacccatgttgtcccaaatagaatttccttctttttatggctaaaaactgttgcattgtatgtatataccatatgatccagcactcccatgttcattacagcattattcataacagccgagatgtagaaacaactcaaatgcccatcagcagataaatggataaacacacttttatttcttactttggcattgtatattgacattgtaaatagatcttgtcaattaatattttatgtatatggtataaagaggtcctggatttttagtgccatagttagaaatttgaggtccatctgaaatcaactaaaaatgcaaagatttctggtaataacatgtctttcaagttaatttaagtctatgagtctttacttaaatggctctgtgttcagagatgatgaacttacagcagatttgattccaaaataaacctaggagactgtaacagatgccattgatacctctccccctaacctcacgtttatctgcagctgtactgcaattcctgggtcccttatctacttcccacctcaagggttttcatctgcatctctctgtttctctgcctaaggcaatgccacagcttactaggctcaagtttgaggaagttaatgtccctggggacaggtagaagtcactggataaatagctcagcattgttgtccctcagtaggacagttgtgaagcatgttttatatgattcttcagggagtctttgtattagtttgttctcactttgctataaagaactacctgagtttccagtttttctgctctgttttttccccatctttgtggttttatctacttttggtctttgatgatggtgatgtacagatgggtttttggtgtggatgtcagttttccttctaacagacagaaccctcagctgcaggtctgttggagtttgctagaggtccaaccatgatagactggattaagaaaatgtggcacatatgcaccatggaatactatgcagccataaaaaatgatgagttcatgtcctttgtagggacatggatgaaattggaaatcatccttctcagtaaactatcgcaaggacaaaaaaccaaacaccgcatgttctcactcataggtgggaattgaacaatgagaacacatggacacaggaaggggaacatcacactctggggactgttgtggggtggggggaggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaacatgaaaaaaaaaagaaaaaataaaaagagctacctgagactggaagacctttacgaagaaaacaggtttaattgactcacagttttacaggctctataggaagcacagctggggaggtctcaggaaactaacaatcatgacagaaggcaaagaggaagcaggcatatcttcacagtggtgcagcaggagagagagagaaccaaggggggaagtgctacacacttttaaacaaccagatctcatgagaactcattcactatcactagaaccaagggggaaatctgcccccatgatccagtcacctcccaccaggcccctcctccaacactgagaattacaattcaacatgagaactgggtgaggacacagagacaaatcatgtcagtcttcaataagtccaagttccagttgctcatagtgttcccatagcataccctttactggcttttgcccttctttatttcccttttcccctcccttgcatgcactttctggttcacctcccaaataaatgaacttcaaagtatttgtcttagggtacacttgggggtcccacatcaagccaggcagagacactttaatgaagttgctcatgtctggttgacaaaacaaaaggttcaagaatgttcctcaggaattaagcaaaggtgattgttagctccatctactttgttttacccctctttgatcttattggtctcactgtgaccagcattaaagaaacaaagggtcttgagctggtacagctcaaaatggtgaatctgttgctgtttccataattaatcatttttgtcaatagttataagtgaacagagccatgaaatgcagaatgcataataggaagctgaaaatttatgggcatattgaagacatgtaacaattgcctgtatgaataacaaaggagcaggaatacagcttctcggaggctaggatctgagtttctgacatctagaataaagttaggaagaacttaagtgctacaataacaaaagatgccactggatttacagtttggctgaattctagggaaatcacatgttgtaaggccttggtaaagatcagattcagaaattatttttaaaaagaagaatttggaaaagataaagtaaaaccccaaattctatattaatttttgatgtagatttactttggaggcataccaagtgtttctggcttggaaaagtttaggtgcaaagactatggatgagcaaatgttcagtggtccttttctttccctcttatggcataatctaagcctcaggaacagaaatatccataatccataaaatgctttttttatgttatacaaagaatcagaaagacacgacttgtttagaaattcaaaagactgttaacagagaacacacacatctcctctgacatgaaaattttcagataaatcaggcagcagagaaagacaaagtcagaaaatgtttatcgttttcctgcaattattggaaacatgaaatatttttggtcaaagcagagggaaccaaattaaggtaataatgtgtaataactaataaaccgataaagtaggtgacaactgcagcaaatgcatgatcacttatttttccccaagattactgtcattattcttatgggtatgtgggtgtgggcaaggggaaataaggcccatgtaaataaaatgtaattctttgcttgagatatttatagttttgtggttgaaaaacatatataaacatgttatttcagtacagtgtgaaaagggcactgggtttttggcagagttagatgcagagaagtggcatgatctgattatattttcgaagaattactgtggctttcttgctgagaagagactgagagggggctggaagacaataatccaggcagaagagtttggtggactagggacaagatggtagcagtgagctgatgagaacatgacacaaaaagattatattcaaccatttattcatgccttcatgcatccatccattcactcatttagacataggtccagtcttaccaaaaagttgtaagaataacacaacagacacttcacccagatttcccaagtgttaacattttactatttttttttatatttttctctctttgtctgagagagagaaatagacttatatttctccaaaatattgactaaattgtaggcatgataccccttcacctctaaatacacctccaaatataccagggtataatatctaaaaacaacaacattctctgaaacaatcttagaaaaattatccaattcagttttaacactgatacagctatctaatctacagaactttttcaaatttgttaacctgccccaatagtgcctttataacaaaagaaaatccataatcatgtattgcattcagttagttgtcttgtctctttagttccctttaatctggaatagttcatttctctttcattgtgtttcatgatattgacattttggaaaagtacaggccagctatttatagaatgtctcccgatttgtgtttgtctaatatttcttcttgtttacattcaccttatgcaggtttcatagaaatacctcagaagtgatgctcttttcacagaattttatatcaggaggcacatgctgttgatcagtgtcattaacggtgatgttaactttgatcacttggttatggtagactctgctgtctctctactgtaaagcagaatatttaactttgtaattaaaaaatatcttattattttcacactgtgttaaatatcccatgtgttctccagatttcacctattagtgttacaggatctttggggcattgctttgccagctggaaacctccatggccagtggtgtctttgcttgagttttgcttgggcctgctgggccaactcagcaggctgctgttagctcacacctctggcctggattgcatgcctgccaagggcaagtggagcagcaaggggtgtgtgagagagacagcatggggtctagccactgtgcatagccaggcacgctggctgcagcggggtgggcagctccaggcactgacacaggtgctggctccctgtgaggctgcagccagaccagacatcctgaaagcagcttccacagctggcaccagggaatgctgcagcacctggaagctttaagatgccaggaactgcaaagccccatagaggatgtcacggccctggcttaaggagctcctaggtctgggctcccctaagggctgcagatcttctctccttctttttgcctgcaacatggcaagcaagggccatgttttagccttgctcatgttacagctctttcatccctgccattcggcaggtcctgagttcttgaacctgtgcccaggaagaatgaggtatgtggacaagtggagctgaataattctatttttcaagtggatggtgagcaaggtgaaaaggagctttattgtgtgatgtaacagctcagaggagacacgcagtggatagctactctccacagctagggtgtcacaacaagtattcagctctctgcagagaggagaccgtggggtaggtagctcctctctgcagctggtcttatcatcatctcctcaagtctggctgagtctggggcttttatgggcctcagaggggaggaagtgcacactgattaatctatgagcagcctgaataaagcacaagttcccactcgcgtccatgggcccagcagcccggcccccaggcttcaggccctccccagctcacaggtgggacttcaccagggacctgccccttatgcccaggagcctgtctgctttctgctgccattcatggcgcccaggccattcatgccaagggaaacctgtaggccaatgccaagctgccctcagcagcccctcaacccccctcacatacttgttggtgcccaaagtccagagggggctgaggcaacaggggactggcatgtcagtgctgccttgagagtgtgcacacactggcaacctgcaacagtgcccaggctcagccccaatcttgctccaagattggagtgtgcgccaggagcagggagagggcagacagtaggagcagacacttctgagcccctgggggcgggggtccttcctgtgcccccaagagtgcagagctgccaggtctgcagccatggcttgggtggctgtaactgtgctcttgcctgcttccagcctccaaaagcacaaggaagcccacatccacagccatggctggatggtcagagctgtgcccagggagcacgaagttcctgccctgtcaactcagaaggggatggcacttctgcctgttcccagatcctgccagctccatggagtgcacagccctggcatgccttccccactgcagccggtgtcatgcagtggccgctgtagattaaccaccactgccatgactagttttaatatccattgatgattctcactttcattgattactaccaagatggttgttatgataatttttaaattccatcatttatttttattaatttattttctaccaaaaggaatagcttttccttcatcctaattttcatttatatcagtggattaatgtatttctattttgtacaataggttattcttattgtcattatttatttgaatgttcaaattgtcacattcttggccaatggaaattttttcaagtaggccacagttgcccttttgacatggaccataattctttgagcactctcccaactttcagcacagaatgttgcagggtcctcttgtactttccttggcttagcactggagtcagccatttcttcaagaaactctggttcctttcagtacagaatggtattagagatcaagattagggttctatctgtaaccatcaccacaggggagtcgttgcttctaggcattgttaatattaataaacaaagccagaaatagaaagataactgtgtattacactcactcacctgtctctatttagctaactagctatattaaaaacagttgatacacactggtttctctgcttccattccaacatagcaggataattgtattttctccctttttatacttataactgtcctctctactagtgacaaacagctcccattatttataatatattcacttacatgtttaatcttacaatgtacagaaagtagggtcagtgttactaacctagacatctaagaaagaggcctactcagtagcattcagtatttatttagggttctttttgtctttagctggaaaacatatagtccaactatggttagatcttctcccattacttcttagtgttatttattcaaaatattatttatttaaagtatactgggtcatttgtttctgtttctgttcaattttagaatttttcaccttcctttttgttttattattttcttttttgtgtctgtgaaatactaatattctaaaagtgagatctatattaaatttcacttttaactaaattatttcctttcttgtgttgtcgtttagttgatttctttatatattcatgtatttttaagcagataatttaattcatttaggcatattcatttttattgatgaaatgtttgaggttatagggtttccttttatcactattttatgtgccacagattctcatataaatagagatagatagtatgtatactttaatatacacatatatgtgtatgtttttattattccttgtttagaaattctttaaatttgttttgtattttcatattcacccaacttgtttaataaaagttatttttgattatttattccaatcgtatgaccttttaccttttttattttaaaataatctgttttttgttattagagattaaattgtaatatttataattatgaaatgtacttatgtaacttagtatatgattacattttaagaatgcccaatgaatgtttgagaagaagatgtattcactattacttgagtgtaaagttctgtgtgtataatatctaccttactgattaggttttgcaggacttctatatcctgttctgtgtgcacttgattgatcttatatcaattctgatatattaacatctcctaggcttgtatgtttctatctgtgtctttttgattctccttaattttttgctttataaaagtgtctactatgttattttggtgcatagatattgatagttgtcatgcctattttgtgaattcaggcttttaacattgaaaagaataatttttcccatatttaatgcttcttagcaaagtttaatattaactttgtttgataccaatattgcctttgctctgttattattcccagaagcctggtgtgtgtgtgtgtgtgtgtgtgtgtgtgtgtgtgtgtgtgtgtgtgtgtatccaagtctttctatttagcctttctgaattattttgcatatgttttggatgcagaacatattgggttttactttgtgagtcaaattgaaaataatttccttctaatggttgtgttaatcttatccattcacattaattgacgtgctaaatgtctaatgtcagctctgttattttatgtaataattatcatgtgtactgtgttatatttgctgtgtttctctatacaaagtagagtattgacctcttttattctattttgtaatttcttttggtgtttaggaaagactgtacttttgttctagcagtcaatttttaattctttttacattttcttattcttttgcttttgttttaacatgtttctgtgttgtttgcattttgaatgacatattttaacacaaactattacctacacagcaacttccctattttctctcttctgtcaatttcagttctgttatttctactttgtcagaacatataacacacactatgtagcatataacataaaatattattactccactctcaactttatctttgttttagtcttagatttacaattacatatactaaaagcttaccatttgtaatactgctgaaatttctcaattcatttctttttttttagattttttttaatactttaagttttagggtacatgtgcacaatgtgcaggttagttacatatatatacatgtgccatgttggtgtgctgcacccagtaactggtcatttaacattaggtatatctccaaatgctatccctcccccctccccctaccccacaacaagccctggtgtgtgatgttccccttcctgtgtccatgtgttctcattgttcaattcccacctatgagtgagaacacgcagtgtttggttttttgtccttgtgatagtttgctgagaatgatggtttccagcttcatccatgtgcctacaaaggacatgaaatcattattttttatggctgcatagtattccatggtgtatatgggccacattttcttaatccagtctatcattgacggacatttgggttggttccaagtctttgctattgtgaatagtgccgcaataaacatacgtgtgcatgtgtctttatagcagcatgatttataatcctttgggtatatacctagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcttgactttttaatgatcgccattctaactggtgtgagatggtatctcactgtggttttgatttgcatttctctgatggccagtgatgatgagcattttttcatgtgtcttttggctgcataaatgtcttcttttgagaagtgtctgttcacatccttcgcccactttttaatggggttgtttggacttcatgtctaaaacaccaaaagcaatggcaacaaaagccaagattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactccaacaaatttacaagaaattcatttctttgttggattctgtggcacttaaaactgtttttccatagcattgatccttgactgaccacttaactggctataaaatttttcattcataccatcttcccttgaattatttgaaaatgctactcctctctaccttattttgctttgtttttgtatttggcaataaagataaagtttaatacacatgaagctggccataccacagtgagatagagttattactcaaacaacctctctgagactttaggggctagggtttttcaaagatagtttgggtgagcggtgggggtggttaggcttgcagcctagggttgcttgcagctgattggctaggggtacagtcatagggttgtagaaaattgtccttctgcacactcagtcatttctggtggggccacaggagtggttagtgggcccaggtggagccaatggtcgtcagacatggaaaaaacctgaaaagatatcttaaagggccaagcttagcttctgcaatagtgatgttatctgcaggagtaataggggaagttgcatagcctgggacctccagaataatggctggcaattgcttatgtctacaccttagcagaattcaggcccctctatcctcctagcctggtggtctctcatttgctttagaagtgtagttgaatttgggggaaggactgatatctctttcttccattcttttaaacttttattttaagttcaggggtgtaagtgcaggtttgttacataggtatacttgtgtcataggggtttgtttcatcacccagttattaagcctagtattcattagttgtttttcctgatcctctctccactcccaccctttaccctcccaaaatccccggtgtgtattgttcccctctatgtgtccatgtgttctcatcatttagctcccacttataagtgagaacatgtggtatttggttttctgttcctgtgttagtttactaactaaggataatggcctccagctccatccatgtccctgcagaggacatgatctcattcttttttgtggctgcatagtattccatggggtatatggagtaccttattttgtatgtagcgttttggaagtctgatgccaactatttttcttgtcattgtttttatttctttatttattggctaaagtctgcatatttttcttcttcatctgtaaaaatttggtatttttactttaacatcattttgaactgattattactaatcaattttctctgctactcattgagccctttcagcatttagattcaggacttcttttatttctgaaaggctatttgaattgtcctttaaaaattaattcttttccattattttacttatattccttggagactccagttatagtaaattggatcttctttgcctatcttccattttaagcactttctttctgagcctttttgtttattttatttttattttctttgttgtttttctattttttaaatgaacattgttatacttttatttgaatatattctttcttgggtatctcgtaatttactttttctgatatgattttgtctttttaaatccttttttttctctttttagtgtttgaatttatggtttaagttttttgttctgttttgctttgtttttgctccatacctcaaagtgtttgttcattaatttagtttggagtattgtgttaaagttttcttctttttcactgttactttttgggggttgcagaaggaggattgtatcagctgaattgtttatattctcattctctgatttctttttgtagtttttaataaacaaagactctttgcacttctacattttaatggtctaggttggtgatttgtagtagtttcttttttttttttaaatcatggctaaaaaatgtcctatgtagtcagtgtgaaaaaagcatagtttcattacaaagtgcatttttttttaggggaagattttataagggactaagttattagtcttccaattgtattgtattgtctcttatcttgctcaatctaaatttctctctcgcttctttttcacttcaccatataatttccaaagggcacttatttcttgcttttgattctcttcttgaagactgatgccaacctcttgaagactgattccttgcatactgtatgcatattctttccctgtgatcactgctctgatctacattgttgcagtattttcacacacacagggaagatgttttctgaaatatttttaaacaaaacaataacaccttgtgggaggtgttatttaatccaatttaaatatgtacatatttatatatagtctgtgtatatattatatatatcttttgtgtatatatttatatatatatagtttgtgtatatatttgtgtgtctgtgtgtgtatatatatatatatatatatatatatatacacacacacacaaatatatacacaaacatgtaataagtgtaccaaaacctatcagctggaagttttctttttctttttctttttcttttttttttgagacagagtctctctctgttgcccagactgaagtgcagtggcacgatcttgaattactgcaacctctatctcctgggttcgtgggtccaagtgattctcctgcttcagcctcccaagtagctgggattacagacgtgcatcaccatgcccagctaatttcagctggaagttttctaaaccttggataccaaattaaacttgacccggatatatattagtttggtgcaaaagttattgtggtttttgcattaaaagtaatgggaaaaactgcagttacttttgccccaaccccaaaattttatcccatgaagaagtaaaaacaaaaacaaaacaacaacaacaacaacaacaacaacaacaaaaactccttacctctattttatacatgtttgaggcttcatattcttttctgtgcccaaacaaaatttctttatttgttttccccctatctcatcataggaaaaatattatcctttggaagagattctacaagaaataaagatagttcaatgtttcctaagattgaaactttggcgaagatttgaacatactaagtgaatgatgtcttcacactttcttttccttatttctgtgcttctcattcctgatttgtgttacagagtctaaaaatcttctcattctagtacagagagcaatgcaactctcctaagagtctcctgcaaatttatctacccaagctaaagtgctcagcagtaaaaaaattccacctttgttagagggaagttttgatgaaatatagcacatttttactttgttagtatagtgggttaaaaaaggttttatggtctatatattggttgttaacagaagaatctcttgaggacagtgagctaacataaaagaatgaattttcaaatcagacttataagaatctgagatcttacctaatattcaagctttactaaataatgtcaaaaaaactcatgcaaagtagagtgaggactctggtacaccaaaggtcacatatcagatcctgtattttcaccttagtcatgcagttctgcccaaggatactagatcagatctctatatgacaaccttgagatcacctcatgcagtgggaatatttaaattatgaaacaccctcatttaataaatctaacactagtatagcctatttcacattttccagggagaagagcctgatatatcctggtttctatagtttacccttagttaggacatcttgtgaagtgcatttcagagattaagtctcttctttctagcaaatatctatagtccatttaaccaaatatctcattagcaaggaggtagaatggggtcagctgccaacatttttccccaggagcactcaaccccccaaaaggaaattaatcaatttcaggcaagctgctttaatttctttctttcattgatttgctgtgattttctcttttgtatttttttctaaaaccgtgggtattaaatacataattgtcagaaaaattgatgtaatggaaatggggaaaaaactcagtcatatattgtgatgttagaacaattcatttacctggttgcagctctggtctatctgtatataaatagcagacttcatgccttacgattcagtcacctgaagaacagtgtagtggccgaattgcttagataattgatattatatttatggtatctgagacagaatgaagattttttattaaatccctttgaagattagaaaataatgtcaatagtttgtatatttaatactatatatgtttatatattcatataacatatacacacttatatgttcatgtaatacacacaagcatatgtatacatataccatataagtcccttattattattgtagtaaatcaaagttctatatctatatactgcttaactacacataacttcctattattcttccctgttctttagtctctaattttatatagagtaagaattatatattattgtcttattttctgagcagaggtgtggtggattattccccaaaggtcttgttttctctgtttcttttatatttcatgtcaacattttcttgttgttttccaatttcttccataaaaatgtaatacaaagaatatcataatagcaatctttacatatgcattatttttaatttataaaggactaagaactgtttctgtgttctaaatactctaagtaatacattttctaagtaataaaataattttgagaaatgctataaatgtcatgttcatctttccattcataaaatactattctttctgctaccgtgctgtggtttctcccaatcaacagagttgcttatagacactctctgaagtcacgtccacccctggacaacttgatagatggcttttaagaaagaaatgaaacattatttgggggagggtggaacaatatggaagaatataaagcttcatccatcatcccacccacaagaacacaaaattaacaagtatctacaccaaaattgccttcatcagaaccaaaaatcaggtgagcattcagagtacctgcttttaacttcatactgaaagaggcactgaaaaggatagaaaagacagtcttgaattgccattgccacccctccttcatcccctggcagaggccacatgggatggagagaaaatttttgcacttaagagagggagagttcaacaattgtgaggcattgcattgaactcagtgctgccctgtcacagcacaaagcaaaactggactgaactcagctgatatctgcccttggaggaagtgtttaaaccagccctagccagagaggaattgcccatcccagtggttggaatttgagttctagcaagccttaacactgtgggcggaagtgctctggggccctaaataaacttgaaaggtaggctagaaaaccaggactgcagcacctaggcaattcctagtgctgagctgggctcagagccactgcactttggtggcacattgacctactgagacaccagtcagggtggtaagcgagtgcttatgcagcccctcccccagccccaggctgcacagcttgtgccccaaaagagaccccttccatctacttgaggagagcagagggaataataaagagaactttgtcttgcatcttaaataccagctctgccagagtaggatagggcaccgtaagagttgtgagacctcctttccaggccctagctcctggatgacgtttctagatataccctgggccagaagggaacctgttgccctgaagggaaagacccagtcctggcaggatccatcacctgttgattaaaaagctcttgggccctgaataatcagcagcaatatccaggttgtatgccattggccttggatgacaccctgagactttctggcttcagctgagactcagcacattccaagatgtggtaactatggggagagactcttgcttgagaaagcagagggaaacgtaaaggggactttgtctttcaccttagatatcacctcatccctgggggttagagcaccaagcaggctgtcctgaatattcttgggaatgatcaatgagttaatgaagtgattaagaagaaaatttaaaattttcttgaaacaaatgttaatgaaaacacatcatactaaaatgtgtgggatacagccaaagcagtactaagaggcaagtttatagctttaagtgcctacatcaaaaaaagaagaaaaacttcaaacaaataacctaacctagttcttaaagaattagaaaagcaagagcaaaccaaatgcaaaattagcagaaaagaaataataaaaatcagagcagaaataaatgaatttgaaatgaagaaaggaatacaaaagatcaatggaacaaaaagacagttttttgaaaagttaaaattgacatactttgagccagactaagtaaaaaagagagaagatgcaaataaataaaatctgaaatgaaaaagaagacactataactgataccatagaaattgaaaggattattagcagccactacaagcaattataagccaataaatttgaaaacctagaaaaaaatggataaatggctagacacatacaacctaccaagattgaaccatgaagaaatccaaaacctaaacagaccaataacaagtattgagatcatagttgtaataaaaactctcccagcaaagaaagtccaggactcaatgccttcactgataaattctacaaaactttaaaaaaaagaaataatccaaatcttactcaaactatttccaaaaatatgtgaagatggaatacttccaaactcattctgtgagaccagtattaccctgataccaaaaccagacaaagatacatcaaaaaaggaaagtacaagtcaatgtcactgatgaatattgatacaaaaatcctcaaccaaatattagcaaattgaattaaacaataccttaaaaagattattcctcatgaacaagtaggatttgttccaggaatgcaaggatggtctaacatacacaaatcaatcaatgtgatacatatcaacagaatgatactgaatggaggaaaactgaaagcttttcctctaagatgaggaacatgacaaggatgcctactttcaccgttattcaacatagtgctggaagtcctagttagagcaatcagacaagagaacgaaataaaaaatatccaaattggaaaggaagaagttaaattatcctggttcacagatgatatgatcttatatttggaaatacctaaagacttcacaagaaaactgttaaaacttataaacaaattcagtaatgttccaggataaaaaattaatatacaaaaattggtaccatttctatatgtcaaaagtaaacaatctgaaaaaaaaaaacaatttagcaatcccatttacattaggtacaaataaaataatataactaggaattaactaaaaaagtgaaagatctcttaaatgaaaactataaaaaattgatacaagaatttgaagagaatgccaaaaatggaaagatattccatgttcatggattgaaagaatcagtattgttaaaatgtccatactacccaaaacaatctacagattcaatgcaatctttataaaaataccaatgatattcttcacagaaatagaaaaaacagtcctaatattcatatggaaccacaaaagacctagaatatccaaagctatcctaagcaaaaaagaacaaaactggaggaatcacattacctgacttcaaattatgctccagagctttgattaatcataaccaaagcagcatgatactggcataaaagcaggtacatagaccaatggaacagaatagagaacccagaaacaaatccacacacctacagtgaactcacttttgacaaaagtgccgagaacacacacctgggggaaaaatatcttttcaataaatgttgctggaaaagcaggatatccatatgcagaagaatgaaactagaccctgtctcttgccatacacagaaatcaaatcaaaatggattaaagacttaaatataagacttcgaacaatgaaactactacaagaaaacattggtgaaaatccccaggacattggtctgggcaaagatttcttgagcaataccctacaagcaaaggcaagcgaagcaaacatggataaacaggaacacatcatgttaaaaagcttctacccagcaaaggaaataatcaaagtaaacagacaagtcacagaatgggagaaaatacttgcaaactacacatctgataaggtattagtaactagaatatataaggagctcaaacaactctataaaaaattctaatactctgatttaaaaaatgggcaaaatacctgaatagacatttctcaaaaggagacatacagatggcaaacaggtatatgaaaaggtgctcagcatcattgatcttcacagaagtgcaaatcaatgctacaatgagatatcatgtcaccccagttaaaatggcttttatccaaaagtcaggtaataacaaacactggtaaggatgtggagaaaaggaaccctcctcatacactgttggtggtaatgtaaattaatacaaccgctatagagaacagtttggaggttcctcaaaaaactaaaaatagagctatcataagatctagcaatcccatgcctaggtatatactccaaagaaaggaaatcagtgtatagaggagatacctgcacttccatgtttattgcagcactattcatgatagccaagatttggaagcaacctaagtgcccatcgacacttaggttatcaacagatgactggacaaagaaaatgtggtacatttacagaatggaatattattcagctattaaaaaaatgtcatcttctcacttgcaacaacatggatgaaactggaggtcattatgttaagtgaagtatgccaggcacacaaagacaaactgcatgttctcacttacttgtggaagctaaaaattaaaacaattgaacctatggagatagagagtaggatgattaccagagactaggaagggggtagtagacgggtggcggggggaagtaggaatgattaatagacacaaaatatagaaagaatgaataagacctagtatttgctaacacaacagggtgactataataaaaattatttaattgtacactgtaaaataactgaaggagtataattggattgtttataacacaaagaataaatgcttgatgtgatggataccctaatgtgattattacacattgcatgcctgtattaaaatatctcatgtaacccataaatatatacacctatgtacctacacaaattaaaaaagaaacaaaaaaatcttattattccatattggtgaaatataaggagaatttagtagtttagactccctccctccctcccttctttcctttcttccttctctccttcccaacagggtctctctgttgcccaggctggagtgaaattgtacaagcatagctgactgcagccttgaactcctgggctcaagcaatcctcctgcctcagcctcccaagtagctaggactacaggcatgcaccatcatgcctagctaaattttaaacattttctagagatgaggtctactatgttgcccaggctgatctcaaagagtttagacattttcaaaggagaaaatgtgcttatagcaatctgaaaaagcttatctcaattgactgaaaaggaacagttaagaaattaaatggagctttgttgtattaaaggaagtcttgatcttgatcacatgaaccgaagcacctctccttttccgtcaatatttgacttttaaaatctggattacccagactataaacatgaaagttgcttttttaaaactcctgtcatgctctctgacttgcaataatctcttgagctttctttcagaagtgacagtgctagtttggagaaaattttattttctggtaaagtgaattaatttttctagttacatatatttcattgtaaatatatttctagtgctagttgatggcaggagtttctgttgatataaattgtgaacttcaaaatacatgtttttaaataaatgttttccatcataccatatagtattatttttctaatgtgtctcaaaatcacatttgtggttgtgcattcagtgggctccatggcagagctggggaccagcggggctgccccacagccattgtaagtttattgtgagaaagttggacgcagccctggggactcctgtgagcagtatctcaggatggcagcactaggccaacctgaaattaatttttgaagggaagttatatttacgtcacaaattaaaaggttaaacttttttaaaaaaataccttcttatacattttatagaaacgtcatttgaaaaataaaaaagagatataacatatgttctgaaacagagtttctggaaatagtttctggaaaagaagaatgtgtaacagattttattggtatatttcattcctttcagtgagagcttttatttgaaaggtgtcttgatttctacacctttggagacaatcaacacggctggtgtggtcccattagaggtcatattaagaatacccatgagtgagctcctcttagtgggaagaggcgagaagtgaagccatatggaaaaaactacctctcttagggacacggtggtaatctcaatcatgaagatcaagaagtgaaggcaagtctagcccaactattctttagctgaagaatcagctaatgaagttatgtttaaatccacagtcctgggccccagctaaaaaaaaaaaaaaaaattcagtttatcttgcggatcccaggactgcatattttaacaagcatcctgagtcaattaagctgattctctgaacacactttgagaaacattcatctggccctttctgtatcagcatcaatatctgagtggtctgatctgagcaactgaggcagaacacagcagaagagcttcaagtcgctatattcttgtccaagaacttaacgtaattcatattacttaagtaattaatgttattaatgacatagaacagaattgggactctttttaagtctcatagaaaattagaaagcaatgtatgtactccatatatgtgtatatatacatataaaagtattatgtattttaaaaagcccatatgtttgcctcattatcattgcaacaaatcaaaattccagatctatatacagtcagccctttgtgtccataggttccccatcctcccatcttctttttctccctctctgtcaccagactatttcttctcctgagttatcagactaaattattttcctaccaaaatcatttcagcttttgtaaaaaaagatcaacctgcaaaagagattatagggtgtgagccaaaccatgacagtccctggtagaacactcttgcacatgttttactctccaacattatcgttgagtagactcagaatgcagaaggatgagctctgccaggaacgtggggttgcttgtttccctgaagactagttatgactgtcttttttgaaccatgcaatcatagcagtgtcttgacctttaatattgatgacataatggtttgttatgttttaattaagctctaagaatatttctggcaatttagtattacctctcctgtggcctacacccagaagttaccctttcaaggacgacgtaaaatatgattctgctaatgctagtgttttacatgccagtcttttattcagctcatggtgttttcttttctcctaaaaatactttatagcaaaggaatcacatctcaaaaagaaaaggcatttattaaactaagggtagaaataagaagaccaaaaggaattgccaagaaaagcttttactaatgcttcacattaggaatctgcagaagcctgtgaatgaggaaatggccagatttagggaacttgaataattgcctttggagagcaaagttgtattaatctcattggctttttgatttgctattttcctccccatcttattcacttcaatttttgtattttcttttttcttagagtgctaactttcatgttgcttttctaaattatgcactacccctgctgtctgtcccattctaattaggccttttctatttatacttacaatagtgtaaaatctcaagacacaacttttcttgctcctagagtaggtgagccacaaatgagaagttcagatagatgcagtttaacagagtcagcaagaatactgacatacccatgagaaatctgccttccaggtctgacaggtgacacctttgcaatgatcagccttaatggttgatctgcattactaacatttccttggtaatctgatgtcacattgcaagcagctcaatattatagggtttttatcctacatcattagacgtacttcataaattttgcccaagaggcagacttggcttttacatatttctgtttatttaatgaaaaatagatttcccttttttcttcctatgtgatttgtaatactgcatattaatagatattgaatagaaaatacttgtatcatattctcaaacatttgaatgtgctatataagctctattcatgtcaagtaggacaatgattttatttactttttcaattattatgacatcatttttattggtaggactatttttgcatggagtagaaaagggcagccaatttaaaaagcttcttacgatagaagcattgtcattgttctccacctagtacctattgcagtttttcctaaagtaaattgaattaactggacaaggagcttggtgacccaaattttacttcagctatcaggcgaccttctttgtagcaaaagtgaatcccttagaagtcttttgacctttgttcacagttacacagctttcaacgttttctggtttaactcagagcgcagcacagagttacaaacgaaagagacaccttgcccctggggcacaaccaattcatttccagataattcatacctgcaaaactctgacttgcctgcaccagccacagactccactgttgattgcagtgttgcagctaaattatctggaatcaaggtccagtctatatatcccagatatagttttggagaaatcttttctctttatatcgtatattataagaataataatataaactcaatcaagaaaagctatttttaaaatactaaactgaaaaatttatctgccaattttaattgcactttggttccccctgtatatgctgatacccaatctcaatgtgagactgatttttcttctcatacttcccctctgtttgctccttacagcaaagttccatcaaaaaaatgaatattaactaaaaagagacgaaaaaagggaaacttcataacttactgactttctataaaacatcctttatttcctagcaatgtggttgaggtgcgttagaggaagacaagaaggcaaaaactgaaaacgtcttctctagaaatgacagagttttttctgcctacattcaacttgaataggccttaatgtttttgatctgtttgagaccactactcaaatattctgtagagttcacatgggaccaaaaattgatttaagacatgaaaattagacctgttgacaaaagctaagggaagtgaggttatttcacctggaggagaaagacaaggaaggcatgcaattcgagcatggaaagggtattgcataaaatacggatgacagctattccatttgaacctgagtttcacatttaattccatttgagcaaaaatgcagttcagttttaatttataagaggagaaatttggaatctatattaaatcttcttaactagaacaaaaaaaaatgaaaattaaacattcttcagttataattagaaccaagattgtctttgcttaataaggcctgaaagcaaagacgttttttagatgagaatgggtatgactgtgtgcttagtacttaccatatctcagaccctttgaagcaggagtaggcctctagaaaattatgaggacttctgtgtagtctcactgctttttatgtatggcagagaagtacaaagcaaaagaaacctttccccagaaaaacccctggaatacaaccaattcactcaacaggtaattcatacctagaaaaatggtttggtagcaccaaagactccaatgctaatttcaacgttgtacacaaattatcaggagtcaaggtccaggctaacacagcttcgccaatgtaatgatcacaacagtacaagtgatgaaacagaggcagaaagaagtagcttgaccagactcacacagccagtaagtgacaaggttagctgagaatcagtctattcatgccaaagcttatattctttccattattttacaatatatacctaagtgaagtttaaaagtcctttgcaaactctggattctaccaatacatgtcattaatgatagataagaatattttagttttgttttatgtgctaagtagaattcaaggttaataataggacaatgaaataactttctcactcacccccactccctttttttttaaaaacggagtctccctcttgttgccctgtacggagcctcccttttgttggagggcagtggcacaatctcggctcactgaaacctccgcctcccgggttcaagcaattctcctgcctcagcctctgaagtagctgggattacaggtgcccgcccccatacccggctaatttttgtatctttagtatagacggggttttgccgtattggccaggctggtctcgaactcctgacctcaggtgatccgcctgccttggcctcccaaagtgctgggattacaggtgtgagccactgtgcccagccctcacttccccgttttaaaattctaaaaccctatatctccttatggctaaatataaagtaacaattaaaatctcagagagcgttcataattcaagcttttatttatccaattgttcttatcagaagttcttaaactgttttttatagagcagtaaagagtataaaagagaatatgtgagaataaaatacttcctttgcaaaattcaatatatttctgaggcctaacagaccccaatgaagaaaatatccaccaaattattaacttcaatgagaatgagagttgaggcatatagtataatatttctataattttttttgctgaacatagcatggtttaatgaacaataacctttgacttcttacagagaatccatatctctaaatcaaaatgtatttgtgttcctctctgcttatatagttacatatatcatctcagcccaaagatatattttttgttgcaaatttaaggtgattaaatggtttttaatggtagcaatgttgcagttttaattacagtgtttattatcatgaagaatttaatgtaaatatatgacaattagcagtattctattggggaaagctgaaaataatttgtcccaatctggagatttgctgagacccataatatgcatacactaattcctttgccctaacaccaccactgtataaaatatctctagggattttaaaaggtaaaagtgatattcacagcaggagtgacacagcatataagggaaacttaaatttggcaggcttttagcaggattttcccccattaaatcacagtagcataaaataagatatgtaaaatcacctcattacatttattttttaactaggatttgtttgtttttaaagatccaggaaaaactcaccaaattcctcttctcataccctactctacttgaaatcctgtaagaattaccaactacatattgatgatttccatttttgatagataatttgagtatgtaactttaaaaacatgaatcctataaactaatgagcaagatttcattatcgaatagcccattttgcattactaaatggactacttttcttaactaacttggcacttttaagtatataaagaagcaaacaataatgatttttaaaaatatttccactttccaagcctttattccatttcctgaattttaacctgtcaaaaatgaaacgcatgcctatggaaaaggtaattacttttctccttctttaacttcttcttaattaacttttaatctatgctgttacagagggagcatgtcttaatactaaatgtgtctaaaatgtaggagacagagatttaaatcatttagataaacatctgcctagcacagaggcataaaaattacaaaattaggatatgggtggctgagtgccaacagtagctgccagcaaaagcaagatattgccttcatttaaaaaaaatcttttgcttacaaacaaaccaacttaataaatgacttctaaccatacactcttatattggagcacatttcttgttttatactacataaaattctaaaaacatgtgaatgagaaattgaagggaaataaccatgcaatcatttatgaaaggcatgttttaatagagaaaaaatcaataaattggaaaatttttaccatgaagtgaagcactattgctttgtttagttggagtggattctgtcaacagtaatttaaagtaatcagttcaatgatatgatccctggttggtgttcagataattactatacttatgtctagtaattttcagctattaaatggaatatagagtggcaagtaaagacaggaagctttgacccttaataccccctttactatatgtgtgtaatttgtcttctaataactgaaataacgtgacagtaaagtccatacacacaaaatggaaataatcctgcatcctttattcaagcctggttaatcaaaatgtcttgaatttttttttgcacaagatgtagtagaaatacacacacacacacacacacacacacacacacacgcatagagagagagagagagggagagaagtcatttataagcataccttggagatactgcagtttctgttccagactaccacaataaagcaagtcacacaatttttttttgtttctctgtccatataaaagttatgatactgtagtctattaagtgtgcaatgaaattatttttttaaaaaatgagcattccttaatttaaaaatacttattggtaaaaaaaaaaaattctcacaatcaactgagccttcagcaagttgtaatgttttcactggtagacagtcttgccttgatgttgatgactgctgactgatcaggttggtgactgtggaaggctggggtggctgtggcaatttttaaaaataagacaataaagtttgccacatagactgactctttgataaatgatttctctgtagcatgtgatgctgtttgataacattttacccacagtagaaattctttaaaaattggagtcaatcctctcaaacccttctactgctttatcagttaagtttatggaatgttctaaatcctttgttgtaatttcagcaatgttcacagcatcttccccaggagtagattccatctccagagaccactttctttgctcatccataagaagcaacttctcatccattaaaattttatcatgagcttatagcaatttagtcacatcctcaggcttcacttctggttctcctattttcaccacatttgcagttaattcctccactggagttttgaacttctcaaagacatccatgaaagttggaataaattccttccaaactcctgttaatctttatatttcgatcccctcccatgaatcttgaatgttcctttccagaaggttttcagtttacttttttttttttttttttaccttttcaagatccatcagaggaattattagctatggcagctataccttataaaggtatttctcatataataagacttaaaagtcaaaattgcttcttgatccatgggctgcaggatggatgttgtgttatcaggcatcaaaacaacactaatctccaatatctttatcagagctcctgggtgacctggttcattgtcaatgaacagtaatattattaatcttttttttggagcagtaggtcttaacggtgggcttagaatatttagtaaaccatgctgttaagagatgtgccatcatctaggctttattgttccattcattaagcatagatggactatatttagcataattttcaaaggccctaggattttttgaatggttaatgagcattggcttcaacttaaagtcaccaactgcatttgccactaacaagagtcagcctgtcctctgaagctttgaagccagacatcgacttctcctctctagctaagaaagtcctagatggcatcttcttccaatagaaggctttttcatctgtactgaaaatctgttttttagtgtggccaacttcatcaattatcttagctagctagatcttctagataacttgctgcaacttctacatcagcactggcgcttcaccttgcactttatgttatggagatggcttctttccttaaacttcatgaaccaacttctgctagtttccaacttttcttctgaaggtttttttttttcctctctcagccttcatagaactgaagagagttaaggccttgccctggattaagctttggcttaaaaaaaatgttgtggctggtttgatcttctatccagaccaccaaaactgtctccataacagcaataaggctgtgtcactatcatttgtgtgttcacaggagcagcactgttaatttccttcaggaacttttccattgcattcataacttggctgtttagcataagacacctagctttcaccctgtgtaagtgtacatgccttcctcctccagcttaatcatttctagctttttatttgaagtgaaagatgtgtgactcttccttttaacttgaacacttcgaggccattgtagtgttattaaatggcctaatttcaatgccgttgtctctcagtgaatagaaagtcccaaggagagggaagagagatgggggagtggctgttccatggagcaagcagaacacatacagcatttattaattatgtttgctgtcttatatgtattcagatcatggtgcttcaaaacaattgcaatggtaacatcaaaggtcactaatcatagaccatcataacagatataataataatgaaaaagtttgagatactgtgagaattaccaaaatgtgacacagagacaaaaagtgagcacatgcagacggcaaaatattgctgacagacactgtctacacagggctgccacaaacctccaatttgtaaaaagcacaatatctgtgaagctcaataaagcaaagtacaataaaatgagatatgcatgtatctcctctccctctccatatccaaatgtagtaaaggaaggaaaacaaacaatatatttattaaaatactgtattgagaaagggaggtagaggcattacaaaccagaaatttccattagcttctgagattcaaaaggtggatgaagggtattaaatgtataacacaagttaagggaaccccaggaaactgctacagtggtgctgaaaggttaatgaattcttgacttgttgcaggacatggggatcacagtccttttctctaaatagtttgtgttccactgtcttcttgcttccagtagcaaatgtaaaatctgaccagtcagtacaatggttttacctttcaaaatatcttgctcgggaggctgaggcaagagaatctcttgaacccaggaggcagaggttgcagtgagccaagatcatgccactgcactccagcctgggtaacagagcaagactctgtctctctctctgtctatatatatatatatatatatatatatatgtatgtgtatatatatatatatatatgtatgtatatatatgtatgtatatatatatatataatcaagaatttttgtaaaaaatttcatcctcagacttctgaatggttgtcttttttttcagttagtggattattatttgtttgttatttcaactccatttgttacccttttcttcttctgaaatactgttggcatgttagatctctgggatctgtttcttatgattatcatattcttgtggggtttttggtctttgttctaagttatttcttccatgtgatcttattacaaatacaagtctgagccatacctggccttttctaatttaaattccagtgttttattttataatttatgaatcacaatcattatagattttctgactatatccgtttgatggtcctcattcattttatgttactgttttctttgagttcttcatcagttctagtaataatttattgggaactatcacttaaagaattttggatcactcaccattcctcaggttacttataccctttaaggttatttttttttttgccatattttcattatatgtgcccccagccttcacacatggggatattatgggttctgagctaaggcagactttcagtggaggatggtgaaataaaatggaaggcacagtcatttttgctcccgtggtcaggttatgttatctgtcaaatgtgttattctctcttgaagcatctgggtactgcatccccagtcccctctttttttcaccctgagtataagtaagagccctgtatcactcacaggacctgcgggcaatgcagcccagtaatgcaggtgagtgcaaggtgactgatttcctccaagcctaagagagtaactgggatcaagcaacctttgaaagactacacaaagccagtgtgccctctcatcagggagatttgtagatttcagttgattctccttaggaaaaaaatttttccctataccatctgcagaatattagattcatcctccggctctacccagatgcctccagcttgcatgcaccatattctaaatgactccaaagagagttgggaggaagaaggagccagggatgaaaaccttagttcccaaacattccttattttgaaaaggagacaaaaatattgtttattttgaataatgtgactatatatctctaaaacctaaaggataaaatgaaatgctttttaaacataagataattcagtaagattatgggttactataatgaatgtccaaaaataaaacagaaaacatagcaaaataaaaatcgaaagaaaaaggataatgtataataacaatacaaccataaatctcttggaatggaattaataagcaatgtgtaatacttataatgataaaactataacactctcttagaaaacaaaatgacatgtaaagagagaggttttctttgttcttgattggaatatttagcactgtaaagagggtagatatcttaaaaatgtcttcatgaaatcagaacaaatattcagaattccaataggattgcttttctcgggcatgggagtgggacagagagttggaatgctacaacacaaataaatctcaagtacctgatacattacatatgagaggattcagaaaattccttcccaaaataaaatatattataaaactagaattaaaatatgatgtaaatgaagaaatacattacagaagcaatgattttcaagacatcagacatcaggctatgaagaactatgctacttgagtgatgggaacaatttagggaagtcccataaggagtcttcagctaaaaccttgagatagcttttgggaaatggcatatggcagactctctaagaggagaagttgaaaagtgactcaagtttgtgagacagagtactaagagaggtaagtccttcatagagaaactcgaatatcttcaaacggatctcctgaagcatttagcagagtactaatcaacacatatttatgaggaaagtacataaagcttggaaagaacatgtgaaaggattagaggaagggaagcagtgccaaaagctgagatatggtgctgggaattatgcgtgttataaccagacagattggaaaaactcataatccacagggcactaggttagtactcaggaaagtctcataatttcatttggtgtattagtatgagttttccagagatatagaaccaatggaatgtatgcatgcgtgtgtatacatatactttaagaattgattgtggaggctggctagtccaaaatctccagggcagaccagtaggctggagactcacagaagggttgatattgcagttcaagtctgaaggcagtcttgatgcagaattttctcttacatgggggtcctcagtttttttctcttaatgctttcaactaattggatgtgacccacctgcattatggaaggtaatctgctttacttacagctactgattgcatctaaaatataccttcatagaaacatctaggcctatgtttgaccaaaaactggatactatagtttaacaaagttgacacataaaattaatcaccatactcagtattttacagtactcagaagttgcttcagtagtgaggagtaagcagccctaggttgagcactgctctggacccatttaacaagttagaaggcaagactcaaaaggatggagctataggaggaattttaaaaataatttaacacccaacaagataaagttcccagtgtttgttatccaataaaaaagcaggaaaatagcatacataatgaataaaagcatgcacacacacacacacacacacacacacacacacacacacgcagtgtgtagtattcagaagaaagactgctacagtgatatgttaaaatgtattatcagcatttctattgtgatctttaatagacatcttaaagttacatcaaaaaccaacctcctgggccaggcagagtggctcatgcctgtaatcccagcactttgggaggccgaagtgggcagatcccttgaggtcaggagttcgagaccagcctggacaacatgatgaaaccacatctctattaaaaatacaaaaattagttaggtgtggtggcacatgccttaatcccagctactcaggaggctgaggcaggagaatctcttgaacccagtaggcagaggttgcagtgagctgagatcgtgccactgcactccagcctgggcggcagagcacgactctgactcaaaaaaaaaaaaaaaaaaaaaaaaaagaaaccaaaaccaaccgcctgacctcactacaacattaccacatccccaaacatgcatttcccactacacaacccatttcaattgatggcaacacaatcttttcagatggtgagaacaaaaaccttgaagttattattttactcctctctttctctccagttccacatctaattcatcacaatatcttgttggcaccaccgcacctgttgtaatagcctcctcttttttttttttttttttttagtctctgctctcttatagtttaatctcgacatggtaaaacagagtgattcttgcaacatgtgactctgatcagtcactcctatggccagtctcaagaaaggattttcattttattcaaatagaagctaatgtccttccagtgacctacatgatctgctcctccgcttttcttctgacaacatctcctatgattctcctagctcagcactgtctaatgatgaaatgtaatgtgagtcacatatgcaattttaaagtttttagtagcacattaaaatgttgaaaataagtgaaattaatttaataacattatatttaacccaacatttcaaaaacatcatttcaacaacatgaaaccagtataaaaattcaacaagtaatcaatataaaaatgatttttggtatttttttcatgcacagccttaaaaatcagaaatgtatgttatactaatagcacatcttaaattggtttagctcaatagccatgtgtgataaatgggtactatatcaaacagcacagtgccagctcttgcctctccaggcacattggtttcctttatattcctggaacatgccacccatacttttgcttcacaacctctcttatctaatgtgctgaaatgccataataccacatactgggtaatttataaacaatgaaaatttatttttcatggttctggaggctggaaagtccaagatcaaggtgctggtgaaggcttccctgtctgcttccaagatggcgcccttttggtgcatcctatggagaggaggagcactgtgtcttcacatggcaggagaaacaggtcaacaatggggcaattactagttccctccagcttttttatcaggtcactaattccattcatgaaggctccacccttatgacttaatcacttcctaaagccccacctctaatactatcacatgagcaattaggtttcaacatatgaattttggggacattcagacagtaacacagcctttgcatcagttgtttcctcttccaggaactgcttcctccatatataaacatggattgttttcttacctccttccagtctttttcaaatgtcaccatttccatgaggccatgccagattactttatttaatgtatcatttattatgttttaataatacataaattacttatttataatgtttattatctatctctcctctcactgtaaactctcctatgagggcaggaattttcgactgttttgttaatttatatactcccaacttctcataatctctattccatagaagttcaataaatacctgctgaatgaatgagaagaattaatgcagtcggatattatgctctcattccaacaacctagagtcatgtactgattttgagagatattcaggatattttggcaaagaacaaaatagacatattgaataattgtggaaacatatatccttttattatttcaaaacgtgtctttggatatgagtatagctgtgattgagatgacatatcatgtttataaagaaagcataatatctagttgctataattaattgcgtctgtctagagagtagaaatctgtggagagaggacactttcatagtttttaattatacttatatatatttagctttttaaataataagtatgctccttgtgataatttaaaaatacttataggtttaaaaactggtaatgtcataaaatattgggagcaattattctcttgttctaaaaattaactcatttagggtgctaaaatctatttcttggaggtcccctttgtaaaaccctgtaggtatttttccagaaatattcggagacctctacattgtatgtgtattattctgacctccttttgtatagggctatctgcgtttcatcattttaattccaaggagtgattttataaactgttcctcagttcatagtctttgcaattaaattgtaagttgacccactaactgaattacagaaatcagatataaacaaatgaacagatttcagctgttcatttgatatattggtttgaattagttttaatgggccacatggcagttttctagcctgtaattgctattaaacagaattctgtaaattcactgaagatgtttaaatactctgtgtggtaatacaactgatttgtgttttgtacaagttaataactatagattgaattaaaaagaaaatatgaccaaaaaagagggtctatttaatgcagtttttgttttattactttggaagattcatatgtcttaatttcaatttttcttttatttcattttttcaaaataaaattataagaatataagaataaataataataacagtaacttgtatttctactgtgctaagagctttaaatattttttctcatgtgattcttacaataaacctataaagttgatataaatattatctcagtttttacagatgagaaagttgaggtttaagaaggcagaataacttatctatgtccacagagctaacaaggttagaatcaacacttatatattattgttagtttcattctaaaactgtgtttttaagcattatgtcactaatatatttatcctagtgaaaataattcttctgatcatctttaaaaataaataggcctaaaattgcaaagggattttgacctcaaatcgattataaatccattatatgaaactgttatatatggtatcgcatcacaatacttagaacaccgactggaacatagtaggtatacaataaataattttgaattaatgaaattatgaaagttctcatctaatattctaaatctttacagtgaagggaaaaataccttttaaagtgggaagaacaaaagcaaatggcacagggtgttagtatttgagaatggaatagtcaaataaaagggattcaaattcacttgactggatcatttagaaaaactacaaataaagctggaaagtgtcaggctattccatagtatgcctactttacagattaccaaatacatatagtttatgtgagtttgtatacttaacaggggaatatttatttcctctgttaattttatgcatgttgaaatatgtgagggcctggttaaaataagaagccctctctgtagcccagataaaatgagcctctcattcttctccattaaattaggagacattggttggcctttaaatatcattctggactagttaagcaaactcataatgtttgacttctgtttgaccagctcctctctccaaactttgtcaaccacaaaatatcgtatgacacattatatatacctgatgatactcaaatactcttcatctttttattctctaccactttactagtgcagattatcatctgttctagaactaatgatgaaatcaccttcaaattattccccttgtgttagaagtccagcttgttgaccacttcttcccactatcaccatatttatcttcctagaacatgtgtctgttcttaaatcttgctaattccctgtcaccttttgctaattccaggaggaagtgtaaagcttcctcatgaaattaaagaagtctgccacagccacctttcctggctcaccttcccacaatcctccagcaaacctgaattgcaatcataaagaccaactctggctgccccagataaccaagcaccatctgaggctgaatcttgtttctaaaatgctgtagctcttcctttgttatcagtcaaaacccttctcaaacatcaaggctcagaaaaaatgccatctgtttcatgatgtttttcctagtctcccctattttactcctaccttaaaattaagcatttccataaaactttacttatacctacatttattgcatatctccttcccatatttattatagttgtcattattctttccttattggtttcaaactctttatggacaggtaaagtggctcatgtaagtgtttctcttccagtgcctagaacaggacaatatttgcagcaacaaaatattcaatataataaaaatatgttgtttactgaaaaaacactcaataaactcaaaaactacaataaaatattttgtacagaataaagatagcaaagaaaaaaacataattctccatataatggaaaaggaacatgttaaaacttgtattgataactagatgaatatagatggatgttttactggaaaagggaaatagaagagcagaaaggaaaacacatcaaaattattctttgatttcaactttccaaggaaaaattattttcaggtactaagtttgtctgcattgcaaaggagtgattttgtaatttccagaactgtcatcctttgttccactgttgtccttcacccagtatgctctctggggggttttaggagattgcacaccaggagcgctgggcacaatggcactgaagtcttgcagtgcaggaagcctcagcaatcaattcccacgctttccaggtggtgctgtttggttccattcacattaacttttcagctttctatgtgaagaaagcctccagatagtgaagagggagggagagcaataagaccagtgattacaaatccatcactttcattgttccagagccagtagcagaacacagctgatagacaaagcactggttttgttcaataattaggttgtttcttagaggagaatatgaagccttttcaatattttactctttttagaaaatatgtatattgtatcaaacattgtgtagcacacaatagaaatggaggttttaatagtagtccttattgtgaacatcaaatattaaaggcagttttgattagatttggggaagaatcagctctactgcatgcataaagccaaaatatgtgggacactggtccacctgagaagcaaggtagatatttcccaaattaagggtaattcaggagaggtattactattgcgtacacttataaaatatactcaaaatttgggcaaagataagaaaaggatttttaggcatatgggtatgtgtatgtctttctgaaaaaaaaaaaactaaaattttaagaatgctatcataatgatatacaagtaaaatagtctggatgtgaatacatccgggtcttttcaagatggtccttgccaggattttgttgaaatattattttcatgctatcaaacgtcctaagtaaatgtcattgtggtttctttatttactttttgggcccctactttctcaccgtatttccaccaagtctgacaccatgttagctgtaagtggggcaaagagatattataaaacattcttcagtgattagagacataaaaactataaaaaataatgtgttactttgtaaatagaattcaaattagaatttaaccttcaaaatatttttttttggaaagtgatgagaaaacactgcatctatatggaagccgtgcagtataacagaaaatgtcctgttgtataaggatggaacacagaatttatttccacaactatcactggctcctaagacattaaagctagtcacttaatttctggtgtctatcaatcagttcttaaaaatggaaacaatgatgcaaattcataacaagagatcatacaaatattgggatgataaataatatgtgactgtattttagttgcccagtatgccattttgtgattatttttcagaaaggattcattcctgaaagggaattacagaaaataagcactattggtgtgtactgtattattagatatttttacacaaaccattatgttgaactcagaataaaaggcatattttaactggacatagagccttgatttgttctaataaaaccctaatttgcccaagttttatcagtaaccatggttcccacatagtactcatggaggtggccatggtttttattttctaataagactcactgtggtacaaggtctgactcagagcttttcctaggaatataaaaaggataaataaaaatgtaaaagaaaaattatcaaactgtcccttgataactaaatggttgatcataaattggagtgtctatgcaaatgaagtaaataattaaaatctccaagaacagcattgactaggtggttgatgactggcaattataaaagctgaatttttaatatgcatacatccaaggagccagtaaaaattagctcccagactaatggacttgcctttcttccgaagcagaattttaatgagagcattatttataacggagagcccaagaaccagggtattcttgcttagtctcatttttttttccctgacaccttatccattaaactatgaacttctttacagaagaataatactttattccctaagaagtaaaggtcaaaatgacctcagaaattcgttgcattatatatactctaaagacatgccacttaggacaaaagaaatcataaagcctgtgtttctaaatacccaagttgtatatgcttttaaaatatatttcataagatcaaattacattccatatagttttgcccttccacaaattttctgtgtgattatttcctacataagataaaatgcaaaatctttgaaggacacttaaatctttttgcatatatttttataaggcttgagaatggttttaatcattccgatacgtgtatattgttaagctgctaatttctttgaggccattgaaagggtttaatttttccctagaaacaccattttgttattggcagtctgtgttataaacatcacagagtttaggttgccactttcctttttgatatttcaaccggagcgatgtctggttttgctttcatgactctttcccccacagttgtaactaagcaaggactgtttggcagatagcatctaaggagattttattgtctgggtgacagctcccttaaactatgagtcaggcaaaagcctggtccaaggatgagtcagagagtggtttactcagagctgccttaaacagaaagtcactagttcccatccaattctatcccttcaccctcattccagtgccaacctaaaatcatatgaccaagggagatgggtggtaaaagcattatcaggaggaacatgataaatgaggtctcattagtctaagcttgttcccttctgtcacctttttttttgttgtttttaagccctcagtattttagaaacttctatatctactcatatatactgaagaacctaaattttctaaaaaaaatcatagattttattaaaaatctcagaatgtaggtacctttctaatgtccaatatcagatagacaacagacaaatgcttaggataattaggttctttatatcaaccaaggcaaggccaggagcttctcactgagactctttgttcaataaactggagattgtaactttggttaataacattgaattgtgagtatagttaagtttatttttatatgtgttttggcaattttgtgtttcttctcttttttaattgcctatttttatcctttgcacattttcctcttggggaatttttttttttttctgattggtttgaaatacctctttgtgcattaagaccatgagttttttccttgcaacaagtatttttcaagtttgttatttgccttttaatttttatacttgtaatgcataagtatgtttatgcttctgtgtgatcaaatatacctatactttccctaatgttttatttcttatttttatatttagaaaagatgcccctactctgataccagatgaatatttacttatctttttctgtaattcttgtttgtttacaacaaatgtaattcattttggcatatggtatggagtagatctttattgttttccaaatactaagccagttgtccaaaggctacttatcaaatgtcattctttctccactgctttgaattatgtgatttataacatagatcttcgtagctttaatatatacaaaagcaattttttttctagtcggttccagccatttatttgttttactccagtattaggaatattttactatttctagaaaactggaatatttcctcacctagtaagtattgttttttgtctttttagcatcaaatgagctgatcatatagattccctcttttgatatatcaatatactgatgtaattaagtctatattatatcagtagagtttctaacatataaccacccttgctttcttagaataaatcctacttggttatggttttattatattaacacattactaatatttttcagatttctgcatatatatagtataactgagaatgttatgcagttttctttttgatctgtcattgcccagggctttataattttttcttcttaattcataatataaattggaaaatatagtagagaaagttataaaaatatggctgagtcaactaagaaattcaatgattcaccttcatctgccctacccggaaactgtacaaataaccaaagcattataaaaatcgagaaaatctaaaggtctgcaccagtactggaaactaggaaaggagtctatccacacaaagaatattgagtagtttctgctgtatgtggtgcatataacaaatgaagacttttgtgatagataactcacaattccacatcccaagaaaatagtggagtatctcaggaatatagttatacagctaggaagatcttcaatagcatctcctgatttgaataggcaagggctcaaagcaagggcaggtctgtagatagataagatgcaaaacttctgcccaaatagtctatgctcagcacattaaatacaagtatagtcatattagctcaaaagccttcaggcagtcggacttctccctggtatggcattaaaagctataaataataaagtaattcagtaaacagtataaggcatgtagaggataagcttgagatgatcatacagaatataggagaaaaagaaaaaataatgaaaacaaccaaaggaaaaccatttgcatagatgaccgaccttgaaaaactaaggtactgatttttctatattaacccaacatgaactccaacataaaattgggagttactggtggatgtctccatgtttactgcaccaattatacagaagaggcagctgtcagtcagcctttcctatcctccttcaatttggtgttgtagattgctgaaatacactacaatgtttttgtgagtatcatctttccttcatcatcagttcccatttgttatatatatttctttggtcattgtaatcaggatctaggatgaagaacacaatttttgccttattcttttatgtctttatttacttaaggcaataacactgtaatttagttagaaacttagttcattaactcaaaagagaaattataactaattttaaactctctgagtttaggttttaaaaattagtgaaatttctcattggtttcaaaataaattaatcataaatatgtacaagctattttttaagaaacaatatcttaatcataaaagtcacaaattgaacttttttaaaagcattatttacaggaaggtgctttttttcttgctgcacttttctaaagataaatacatgacccttaacatttccagtttccagttgtcacacatctttacaaaggcaagcacaaaatttgcacctgttatatgagagaagtaaatgtcctttgagatactttgacagatacattataacaaagtaaagcaaaatttttagtctttatataaaaataaagtagaaatatctaattaaggatatgaagaaagctggtactatttctgatctttctaatgcccaaatgaatgttgtattgtttcaaagtttcaaattctattaaaaaattgctggcagatatgttcttattaaacatataacatcataccactcctacaccccgaacaatcccacccaccttgagtacaaatcattttcaaaatattgtttgtcaggaatttttcttcagctatataccatttaagaatgacactaaagggaaatactagactagggaatctgtttagggaaatctgctattgaataaaattggcatagatttaataatatgagtttgaagatagaaatgtaggtgtttgataaaaatttaggtaacagaaatgaaagcatttgaaaatagacatttaagatatttaaaaatagaatccaagatgatgtcattaaaaactgtattatcagaaaaagtagaagacaatatattttaattaggaggggtaggactttttaaaaaatgtttaaaaataaaaatgtaatgtattttaacaataggacaggacaaacatcagttttttaattaaaacccaacttggatttagtttctatagtactttagatacttgtatttccaaaataatatacagacagctactcagcatatgtgtgaatatgaacacatacaaatatattaggccatttcaatttttcatcacaaagttaaaatttctagtgacaattagtggttcattattccttttagaaaagtggctgaatataagatcaacatgaaaagataccttgcagtcctatatacttgtaacaaacaactagaaaattaaatataaagtaagataacacttaaagtagcaataaaaaatcaactacctaccaaaattggtcaacaatatggaatttctctatgctaaaaactaaaaaatattattggtggaaattttttctttttttttttttctttttttttgagacagagtcttgctctatcaccaggctggagtgcagtggcgcaatcttggctcactgcaacctccaactcccctggttcaagcgactctcctgcctcagcctcctgagtagctgggattacaggcgcccaccaccatgccagctaatttttgtatttttagtagagacggggtttcaccatgttggccaggatggtctcgatctcctgagctcatgattcacctgccccggccttccaaagtgctgggattacaggcatgagccaccacgcccggccggatattttaaaagacctaaatatatgcaggaatatttcatgtctgtgcattggaagaactcaatagcataaagatgtcaattcttctcaaattgatctataaatttagtgaaataccaaataaaacattccagcagtttcttttatagaaagacaagtgattctaaaattcttatggcaatacaaagggtcagggatagtacagacaagctttaaaaagaacagagttggaaaacttacactaccagatatcaagacctactataagtcttactttaataatgacatggtgatattggctcaaaaatagacaagtagagtaatggaacaaaatagaaggcctaaaactgagacccatataaatgttgccaccacttcaacagaagttacactgtaattgcaatggattgaatgtttgtgtcccttctaaaattgatatgttgaaatcctaatgcccaatgtgacattattaggagtgaggctattgggaggtaattaggtcatcagggtgcacctacatccacgcaaatcatattagtgcccttaaaatggaacacaagggagttctctcactctctgctatgtgagaataaaatgagaaaacagctatgtgtgatccagaagagggccctcaccagaacccaaccatgctagcactctgatcttagactgccagcctccagaactgtgagaaataaatttctatgttcatgaaccactaagtctatggtattctgtcacggaaatctcaactaagacataaatacaatggaagagaggttgtttttatgaatgatataggatcaatttcatattcatatgacaagtaataaactattgctccaaacttatacaatacacaggaattaatcctagataaactatataccttaaagtgaagtgcaaagcaataatttttaaagaagataatggaagggaatagtctaatcatctttgacttttgggtatgtgaggatttattaaatgggccacaacatgtattattactgaaagagaagatagaaacactttcaattatcaaaatcaagaaattccattcattaacgccattatgaactgaaaagacaaccagagtgggagaaaatacctgaaaaaaagctagggtacagaaatatgaagcactcctgtaagtcataataaaaagacagttttcaattaaaaaacaggcaagagatttgaacagtacatatacaaaaaatattcaaaggactaataaatatattaaaaggcattaaacatcattagtcatcaaggaaatgtcctttgaaaacacaatgagataccactataaacgcaataaaatgccccaaagtaaaacagcagataacgcaaactgttagcaaggatgcagagtgggaaaagaatattaataatagcattattttcaatagtcaaaacctacaacaactttaaatttccatcaacagtagagtcagtaaataaatggcatagcttcatacgttgaaataccatatacaatgaaaaataatgaaatactgccacacaaaacaattgaattttataatcttttaaacattataatcttttaaacataggagtgcttcatatttctgtaccctagcttttttttttcaggtattttctcccactctggttgtctttccagttcataatggcgttagtgaatggaatttcttgattttgataattgaaagtgtttctatcttctctttcagtaataatacattttgtggcccatttaataaatcctcacatacccaaaagtcaaagatgattagactattcccttccattattgtacattaattatgtacaatagtacataattaataccatttatgtaaaattaaaaactttattgataaaaatcaaaatagtgtttactttatggggagatagttattgagaaagggcatgaaggaggcttctggacgccgtaatgatctacaagtcaacttaggtattttcacttgacataaactcaccaacttaaacgcttgtgatttcagcactttgctgtaagtatgttatatactccaacaaaaatgttttcttacaaaataaaacagaaatatgcagaagaaaaacttcatatcctcaggggaataatgaaccatacgtccttaacacagaggcgaaattccacagcagccccactcctgaagtccaaggcagggaaatacacacatgatgataattaagtgaaactgatttatttttatctcagtatacatttttgtagcgctatatgacttcatgtgttgtgcttaaggaaatgcattcttatatctaaagtaaggatgaacagattgtaaattcaagaactgtgctggagtttaagacttttttatagtaattgttaattttcttaagtaaagatttctgccttgattacaactaattagcaaataaattttctttctgtcatatccccttatatggaatcaaaaacttattaagcatatgtctatatttgaatgcatttttacatgtgaacatctcttttatatatttaaatgtatatttgacatagtagagtatatatttaaatgcagacacacacaaatacatatgcatttaagttttaaatgaatagtaaacagtgatatggataacccaaaaatcgtttctatttgaatttggaatgtcttgcatgatttttgaggtatatttatcttcttgattacagcttgtttagactgatattaaaattagtctgcactacttgaagacacaacacctgatcttgaagaattatatctaaaacatattagttaacagaaagaaggtatctagggattaagtgttttacactaatattcatccagaaagatcagcaacatactgataaatggaaattaactgtaaattaaattcaatcattaaaataaggacatgcctgaaacaaaattaagaaattggcctaaagtgaaaattagggtatctcaatttattttaattcttcttattttattctgtgtgtgtgtgtgtgtgtgtgtgtgtgtctgtgtgtgtgtgtgtgtgtgtgtttgtgttgagagagtgtatgctacaataaaaagagcacagcccttagattctggcaaacagatgtttgactactgagtctattagttttaaaatatggtagcaagttacttgacctcttgtagttcttattatagaatgtgccttgggctgtgatcgtgagaatttaaccacaatggcatatgagttcatagtttgcttttggttgggcaaagttaataagtaagcaagggacagatcatgaggtagagagatctaggctgaaagatgataaattcactttgggatatattcagtggaaaccatcaacttgtaccctgatcaatagcaagttggatttagtgatatgagctggagacatagttcagagtcatcttatatatgatggactttggaaatggaagctttggaaatgaacccaggccgcctggaggagtgtgcagcatgagaatagaggagagcctggaatctagaagcctaagaataacaacatttaagggaggccaagaagagatttattttgcatcttataatctgatgatacagatgtcattagtttgattacatgtacaaataaacagagcaagtagagaaaaaatatttattaataataacaggcaaccacaacctccgggtacctaggggcaagaatataactgtaccttgtgagggactggagccaggaatgagaagccttcaagggatcccgagaggatgtccctcactcttgtttctgtttcaacctgaatatcttctttattcttctacaggcaggcttcatttgttcttctaaacacatgtttaaaaaagttaacactgaagattcccagttttatgtctcatctatgcaagaggccaactcaaaacaaaagtagagttaaaggccttattctcagtttttgggaaagggcattatttcagatacatatcttaaggcttttcactgattttcccagcactgctgtctccaaagtcatctagtcacttgtcctgagagtgctgagttctcccctccccttggctgcccctgtgcaggcacgttggccagccatgtgccaataattctgcctcaatgaccactttcagacttcaattaaacaccatgaaggcgggtatggaatcaggcacattgtgcagctgccaaaatatccagatgatgtaccctagaaatataggggagtttgatttccaagaagcaaacttgaactgaatcccattccttcttccctcccaggattagtcagagtcatagttttccctgcattctgcccaccaaaatcctgtatggcaaaggatataactctgtagcaacttgctgttccttttgtgtagtagccaatgcaggaatgccttattccctgtctgtccctgcctcacttctctttctctcattgcagctgctctgggcttgcatctcttaagtaaagcgtttgcacattaatccttactttagcctctcttttctggggaactcaggtgatgagaggcagcttattgcttagatgtgttcctgtgtcccctctgattctttctgcaagggagaggaaggcaaagtattcccaagaaaaagacccttccacatgcctctgtgtcttagaaggcacaggggagcttgtttccagaaaagaaggaagcattgccgttaggagagagaccccaaaaatatctgacaaagattaaaagtatagtcatcaagaattattctaggccaggtgtggtgtctcacacctgtaatcccagcactttggtaggttgaggcaggaggattgcttgagtccaggagtttgagaccagcttggacaacatagtgaaaccccatatctacaaataataaaataaaaattggctgggcatggtggcgcactcctagagtcccagctattctggagggtgaggtggaaggatttcttgagcctaggaggtcgacgctgaagtgagccgagatcacaccactgtaagagcctgtctcaaaaaaaaaaaaaaaaaaaaatctgttatttattgctccttttctgtgtgtctcttaattgcaattatcaatgcttttattttacttttctctttaaacagttcaatgaatttgattagatgagttattactataaatatagtatatttctgtgaaaaaataaccctttgaggaaatttattataattgatcacttctgaagagtgaggaaatgacatgataaatatctttaggggttgttgttttcagagtatttctctatgaaattaagaaacaaaaccttcaaatgtaattctacgcccttatcaaaatgatttccttacaaggaatattttggatttccagaaaccatacaatcactaattcagtttaattcactaaggtaaagtagggaagatactgcactattgcccttcctgcagtagaaaaaggcagcaacaaccaacgagaagctgggttagcgcttggtaacagtcttggtgtgatctgtggaatacacgtttaggtctttcatggcacctcagaatctctgcccttccattgcttgttctaagcctaaggtacatctaagatagtcaagagaaaagatcatcatagcaagatagaaagacatgacatacttcaaaattagctctcccaaccactgagaaaaaaagaaaaatcactaacttttctctacttcccacctcaccatcagaaggcagtgtttagctttctacctttcctttttatgcattcagcaagttgtataaagcttatgatatgtagggcaccatttaagaactataaatatgaactaaattatatatcaatgccctcgagaatagtaattttcacaatctggtaaagaaaagaaatctctttgtttgaataatttgttgtgttctgaattcatgatatttaaaaagctaaattttgctacagttaaaatgttttcttatttatagcaattcttaaataagccatgttagaaagtttggattccagagaaggcattaatgcaaaaacttaatcatcatgttaaaattcccaacaaatttcaagcaatacctagaacctggcaattcctattgaaatggcagtgcttagggcaaattggaaagccagctaagaagttttctaccggcaagatgaaagataatgtgggaccaataatataaatcattggcttggaccacctattttattaattgccttattttagaagtcagatttttgtctcagaagaatctgggaatgggagacaagagaaaagacactgactttttaagtgtcttcccaaccccaggtttttgtccttgtttagaagagaaaagagaatttcaaaaacaaaactaatttttattattttaagcagctatttaggtctctaaatagaagccaaatagggtagatgaaggaatgtggactctgcagtcagtcaaattggatttgatatctactttttatcattcttcactgaataaatgtggacaatttacttaacctctgttaagacaaacctaacagaaatatctcagtttgtccatccttaaaagggtcatgataaatatttatgttaatttgtaagaattcaattatatcacttaataaatgacacatacagggcagctggcatacagtaaacaaaagtgaggctgagaattcattggcagcagaattatctgaagacttgagacattaaaaccatcaacaaactcagtaagagactctagtcccagaaatttctcaaataacaagttctataaaacaagatccatttgaaaaattctaaccacattaaggccaggcacggtggctcacgcctgtaatcccagcactttgggaggccgaggcaggcggatcacaaggtcaggagatcaagaccatcctggctaacgcggtgaaaccccatctctactaaaaatacaaaaaaaaaaaaaaaattagccgggcgtggtggtgggcgcctgtagtcccagctactcgggaggctgaggtaggagaatggcgtgaacctgggaggcagagcttgcagtgagctgagatcacgcctctgcactccagcctgggcgacagagcgagactctgtctcaaaaaaaaaaaaaaattaaaataaaataaaaagaaaaaagaaaaattctaaccacattaaagctattttaaatattttatgaataacttagggtaacaatattttaattgtctaatttattagccgaaatcttcaagacacaagcttttcagactaaagtacccaatcaaaacaaacataacctttacttaacacctgtttttgtaattgcaagtttctttaaccagaatcacatggttctcaaatcagactgaacaggaaggcttataaaaatacagatatacagatggagagtcagccccagagttttcaattgaataggtgtgggatgtaagtttttcaagttctcaggtgatgttgatatgcctgatccagaaaccacactttgagaaccactgaataagaaaatagtatctcagatgctttcacatacagggctatatattaatgtaaaataaacatggacatatattatgtacataaaaatataatattagaatttaaatataatatatattacatttaacatatatatatgctatccaattatctcttttgcttcactgaaaaccataattcaactgagatatctaagtaacatacttccagaagtaggatcataccaagactccaagccgcattagccaaattttacctaacaacaaaatctctgttgttggttgaattgtgttcccccaaaagatatgttcaaatcctaacccccaattacttatctctgttttcagtggtacagaattgggaataatgacactctattgggtgtttgcagatgtaattacttaagattagatcatactgaagtagggggagccctaattcaatatgactgatgctctcataaaaagaagaagggacagggacagagagagagaatgccatataaagacagaggccgagattgtaatgctgcatctacaagccaacaaccgtcaaggactgccagccgtcaccagaaactaacagagagacataacattctccctcagagacctcacaacatagcacacaccttgatctcagacttgtagtctccactactgggagaaaattcatttctgttgttttatgccacccagtttgtgatgttttgttatgacagccctaggaaactaataatgcccttcttcccccagtacctgatgattctgtctgcctctaaaatttgcctcacattgcaacattttttagtgctctctcctactcattgtatttttttttttcatccttaggagggtttctttaaagaaggagaggattcagggaaagagggtggggcaaattgtgaccatctctgcctaaatcattagaactcaagagagctggggccaccatggagacacttctggccacttccttctgattccacatcaagttcctcaggctctgggccctgttttaattgtcggcctgtggctttgatatcctcttcttatgtctttttggcactaaaccttgcctttcttcctggctcttcttgcccctcgcttttggcttggatacctctgccatgtcctgcagctggatcgaggaaaacgttccacttgcccttcatttctggctcctactgctctaatttacccagttcttctctgactatccctgagtccactcttaacaatataacaatctcctcacccaagaggtccactcaactctgtttttccataaataaatttctcctcatcaatcttctttcattaaataaaatgtgtctgaaacccaaagacacaagatcttttaccttctcctccacttcttactgtctcatgacttttgggaacctgatacgttgactcttaatactactttagttatactgccatttttaggatatgattgccctgcttctgctcagtaatctccactatttttgatgtctacttctgccctcttctcttccttgtcctatccatctttctgtcttcaggacagcatgacccattcatcactgtcacactgttcgtcttttcatcattgccagatacagtggttctcaactctggctgcacattagaattacctggaaagctttaaaaaactagttctccgatggctttaccttcagatattctaatttaatgggagaaggccttaacatcacatttcttaaaaatcatttatttgcctggtaataatcactggcctaccattatgctcaacagattcaacctttatgatatttttcttacttcctagcctcatagttcttcactttcaatgttaagcattgccactttgtttctcccaccccatcactcagacttgccttacaactcttgataacttgaaataactctaccatttaccaacataatcacaaactctgacactgaaataattgcagtcttctcctcacctttctcacttccagtaaataagctctaaattttttattttgaccctattttgttctttgacttttaaaaaattaccttacatgatgaatttactttcaggtctaccgaaccagacatgtggtcaaccttgtcaataatactaccatctattaggaaggagggtttattctgaatttgtcagatttccatagaggggacggaatgtgtgatttctaggatgaaagttttagaagaatacttgagacctcttgtccagggcctctcatagacacatccccaaaggagtgtgtgattggtaatcatctgactggtaagctaagggaaagaacctgtgggtatatggatcagtctttattcctctcctgagttaaggaggcagttttttttttcttatttaccaggccataagatcatttttcaactctgccaatggctatgtgggtaagccattcattcatggagaaaatacttagatttgggtttccaatctacattttctaattcagctatatccataacaagtctcgtgttctgatttctgtgtgattccagtgattttcttaccattgtttcccaacttatgagaggaagaacctcaagaacagactcaactaattaacttccattcattctgcttttgttgcatatctgacctggggatctggggatctgtcccccaacaactctttttttaaaaaataaattcaagttttattctagatttgggggtacatgtgcagatttgttacatgggtatgttgcatgaggctgacgtttggtatatgaaacttgtcactcaggtagtgagccataatacccaataggtagttgctgtatcttattagagaaatgcacaaagtcctgcttcttggatccactgtaattcttttaaactaagctagactcttattattgcatcctttttaaaattcctagtgtatgcttactattgatgtccttcctcatagcaattcctaccttttctattctactaaagctcttatactaaatccacatcaccgagactttcagtgaataacttcagctcatacagttttgagaaaaccatataacatttatactctttattttcccttcactttaaaatttattttcatccatcttctcttcctttacatgcctcccttaagaataaccattctttttccctcagtacctcttcacaagggaaagattgagattctcagtctctcccctctctaagacttcatttcatcaagtcctctcatttgtttacatctgtaacttctccttctttacaaaataatttctctgcctaagggcatggtcataacaaacaaagccaggaactaaaaacaaaatcctcaattctgttactctttgaaatgacttttttgttttcctcccttcagcacgtaatctttgaaaaaaaaatcatctagattttatgacttttttctcacaccttacaacatgaactccccctaaaccaatggaaatacctcatttataattcatcaatagaatcataaagagcctatcaacaggttttgcttttctcacattcagtctctctcctttctttcctttatccaacccaccagtgttttaggcttcagatccttgtatagatgataatatatggttgttgtcactgccccaactttatatgtacatttacaattactgacctaggctctaactcagcaggtctctcccccaatttatcagcttactctgaattccctacttcaataagtgacacacttatttcctaatgactcaggctcaaaatgtcaatgccatttcatacattcagttactaatttcttcatcattcattatgtacctgcttcttgccaaggaatattttatgtcctggggattacaaagcagaataaaacaatatctcttttcaatgagcttatattatattgaagaagaagactgacaagtaaacaaagtatgtggtaagtgctgttttagaggtagcactgaaagactgttagaagacaaagcagagagcaattcatgttgtgtgagggagttggaagaaatgcttcacagaaagcaggtgctttacttcagtctttaataagaactaggcagttaaaaatagagaaggtaagtccaagaggctggtagggcagaacttataaagtcaaagttgcgtaaagccatgagaaatttggtttgactggaatataaaagcaaaagaaagtaggacgaacaagagtgagtcaaaagacttataattagccaggcatggtggtgccttcctgtagtcccagctgctcgagaggctgaggcgggagaatcacttgaacccaggagacggaggctgcggtgatccaagatctgacatcaagccaatgcactccagcctggttgacagagggagattccacctcaaaaaaaaaaaaaaagaaagaaagaaagaaagaaaaagaagaaaagagagttatcatgaaagtctccatatgttggtatggagttagtgatcaaaattgcttttagggcaatggtcctagcaacaacatggagtgagaaaaatacaaaactttgattatacttcctcaaattcccaaatataaaatcatctgttacatcttgcaaatgtgtcctttacactgcctttaaaaatttttcccctactgtttatattccactcctcccattctggtttagtagctcattacctttcctttgaacatccagactacaaagagaacaattccaatcatgccattcacatagtcataagctgtccaggacacttcactgtctaccacactgaaggtcagttattcatcatgatgttgaaggcttttcacagtgacatagctatctaattatctgctaatatgaagtggacatggtcagtgtcacaaacagcacttttgcgtgatatttatacgtggcagaagcttttcctcccctacatctttgatttgtgtttctttaataccttgaacaccatcttcgccctctgccttttgaaagcctgtccatccttaaaaattgattttaaaatacatctccttttgagattaaaattttaaattactccgaacatatgtgattgtttctttatgctttcatgaaacattgtactttttatatgtgacttaaaaatttatctgatgcagccatcacaccacttattctcatacagcgtaaacttctgacagtgacactgcatgactctggctttcattttctttcatttcatttcaaaatattgccttgcacaaaactgtattaattaaggttgttaccaattccagaggttactacttgtctttttcttcgaaacttcatagttcaagataactatatgtttagtcatgataatttattatgtaccaagcaagaagtaagcaccttaaaaactatcctcagttgctgatatggtctggctctgtgtccccatgcaaatctcatcatgaattgtaatccgaattgtaatccccatgtgttgggggagggaccttatggaggtgatgagatcatggaggcagtccccctgtgctgttctggtgatagtgagtgagttctcatgagatctgatggttttataagaggcatttcctcccttattccctctcttgctgccttgtgaagagatgccttccaccgtgattatgtttcctgaggcctccccagccatgtggaactatgaacaattaaacctctttcctttataaattacccagtctccagaagttctttatagaagcatgagaacagactaatacagttgcctatattttcgatgtctcctccctactctactgcccctagaaagcattaaaaacaagcaaattggatcaatcacatttcaaacttcatgctcagaaagtgtcttcaggcactattgtactgtatgagaaaaaataaagttactttcagtgaaagaattggcatttttaactttgcaatgcccaatgaacaacatgattttgttctattttttactgctcaactcattgatgtcaagtagttactaccagattcaaagagagacactttacctcaaactgcagtgtttacactttcttgtgatttttcattcttagattctattatgtggtttcttcactcctttactcagttctgtcttgatatatcagagcctcaggcactgtactaatatatatcctaaatatttttcttgattccattatataaaggctcccattcttgcaacaaaatgataatggtgagaaataaagagttaaatgcagatttttttgctatcttaactttaaggacgctatataataatgtagaaaaaatgtacagacacacatatagtgaccaaataaaagtaaggtgttattatgtaaaaaagtgatggataccattcaattcttcattttttacccctacttaacatgacaataaactattagcaaacatggaaaattgattatgatatggattatgttaattcagtcattcagcaaatatttattaagtattcattatgtcccaggaaactgtgcaagttcttaaaggtatatagataagaatatatagacatttttctaaaagatgtcacatgataataaatgtaaatcagcaaaggaaagagtggaggtgggaagaaattgagaagtaatgtatgttgggaattataggtgattattcttaagtaccaaaaagagacagaaagccagaggagatgagaacctaattcctattcaacagcaggaattaaccagggaattaaaagaaacttccagttataagcttgaaaatgggagtcaaaaattacagcataagtaaaatttagtgtgccaaccagacactgggtgctatagacaaaaaaatatctagacaaatcttgcccttttttggaagctgaataaaaataaaacacatatggaggcaatgaacaggaagaacatctagaagatctagaagaaaaatactaaaaatagtattctgcacaaattagaaaaataaattaaaaaataaatgatgccatcaagaatatccaaaggacatttactttaaaagacctgatatgtaaacagaaaagtatgaaaaaatgcagtgtgaaaaggaagaggaatacaattaaaaataaattgaaaggttattaactatgtaatagcagatctgatacaacagcaaaggaatcgctatgtggaagattattttacagaccttttccagggagtggaggaagaggatggaagcactcacattgtgcaaaggaacaaaaatattggaaaaaaaaattagataaaagatggctgttatggaagtctgtaaacaaagagccatcaccgagatgaatggtattctgaagaaagtgcaaccatacctattcccaatcttacttaacatctgcatatgcagtttgaaagagctcatcagatacaggtgaaaaaaaccacactgaagcctgttccacaaagttgggcacctgctcccagcactcacagaactatgtttattctaatagatacattctagaaggacattttaattgaaagaataaagaaaaatgtacaagcttacaggaaaaaaactacattagccatactaaacaataaacaattcacttccaaaatatgaaaggccagggcacaacaaagacagatgcctgacaaaatatcactcaatattttttgaaagaataatattctagaaaattataaattaataaaattgaaaaatcagaaaacaagtagaaaacttgaatagaaccataccctggggaaaaaaattgaaacagctgaaaagatctaacctctaaaacagatgctgggaccagatggctttatgaatgagtcctctcacccgttaagtgacccaataatgccaatactgtttaaactattccaggatctgaaaaatagaaagatagcctgctcactgtataaagctagtataacaatgatactaaaatatgggaaagaaaatgaaagaagtaaaaatggcacaccaatttcactttggtatatagatgtaaaaataatataatatttgcaaacttaaatcctgcagtatattgaaataacatcagaatcaagcatattaaagaataagtaatagattcaaaatagagaatatattaatatgctctgtatctattccattcccaccttctcaaacacttcgactgtagagtcctttatggcagagtgggacagaggttgtttttttgggcactgctgggtcttctgtgcctatcccagtatcttgccagagtaatcaataaatctctctcagtatgtggaaaattgaatggagaggttgttggaggctgaggggaggcatttgtaatagatacaagtaaagtttagcaaattaaaaattgataaatttcctcaacagggtatttttacattatgtaccaaaagccttagaaattcacaatttctgagctagtaacccatcttctgagaatttattctcaagaaatggtaaagatcatgtacaaacactttcatcattctccttgtttattatacaagattttcccctgactttcctttaaatgatgcaggttttcacaatacatgcttcggacctttctctacagtgtttctaagcctctttatcctggctcatagtttaaattaccatctctcaccgatgatctacaaattttgcctctcattctaacctatattccaagtccagaacactatatgtaacaacatttttagcatcctcccgcccccttggttgtttcaaagacatcttagcacagtatttacaatattgaatttatgatcttctctcccaaagtttgccattctctgaggttctctaagaaattccatccagttcttcaaatttagaagtcatcactaaaatttcaatccatgaccctccctaaatccatccataaatccctttaccatattttattgatataatattctaaatatttactaaatatcaacttctctttaagacctctactacttctatccaatgtcaagttaatgagtgtctgctccctgggcaactaactagactctgtacacatatgcctgccattctaatacactgtttacactgctatcctagagattcaattttttaatgaggaatatattcattgataacatatctatacacaggaataagcttgtacaaataataaaatactcatctatatacaaatcaataaaagcttttgcaaaagagatatatggagatatgaagtgtgatgatggtgataaaggagaatgaacaaagagaaagaagtggaagaggaagataaagatgaagacgaagaaaaaaagaagaatgataataagaacaagtataagaaagacttttaaaataaaataattatctacaaataattttaaacactaaaaaagatgaaagaacagcaatattcaatttcttcgcaaactctgagaagctcaacaagtctttcaaaagcaaccactaccggaaaatagactgtgacgatcagatgtagtgcctcagagagaggcaccttcactgtatgtcattaatacgtctcaatcacagtgtcaagggtcaaagaaagaaagagtaaaatatgaactggtccaagcagaagatagaaccaataaaccaaccaaataaaataatgggctattgtgacatggatttagcaccagcagttgcttgtatataaaatattcccctcaaccccaattttctttgcatactttattccttcttcttcagatctcagctcaaatataattttcttactaaagctttgcatgagttccaaaccccatgtaacattgtttcgaatatcctgattttactttcttagtgtttatcacagtgattatttgcagacattttattaaagtctgtttcttcctcattagtctttgcgtcctttgagagtaaaaatatatactcatataaacacagggcctatagagtgccttaaaggcattctataaatatctgttgatgagattaataaacaaaaaatgagaacaaataaatgaacaatccaaaatctcgccatactggattattacttttagtttagtttctgagtttaagtctgtcttgaggtcataaaatgttggctacaattaaatgtttcatgtgtgataaaaatagaaaaaggaaatctgtgatacataaaaacaaaatccaagtttctccctctattccctacttcaatcccactgagctaaccagtgctaattaacaacatgtgtataaattcttccattcctttttccttgttcataataataataatagctgatatttatggagtacttattatatcccaagatttgttctaagcattttacattattatttcatttatttctcaaaaatctgtaataaaactactaatactactccattttgcagatggaaacactgaagtatgaagatatttagcaacttaccaagctgggaaagtcacacagctggtcagaaacagagccagtattcaaataaatactcagatgatttggcaccagagtcctctgtgactttatgctgggtctttctcaatgtacacactaacttgctgtatatacctgcataacaatgtactgagaagcattcaatcagtaatgtgtttacaaagctgttagaaccacgcctggcatatagtaaacacttattcagtgtatgcaattattgctataatgtttatttgttttaatgagatataatcttgctatacattagtctataacttgcttgtattacttagcataagtattggatattctctcttgttttctagtttacttatgcatttaaatatgtctgtacacacatagaaatcattttacataaataggttcctgtatgcttagaatctcctgtttcctacaattcctatcttcttccctttatccactctaatgaacatattaacaacctgatcataatgtgttttatgaaatattattattaatccaactgtacctccaaattcaacagaaaagaaaaaacatttccaagaacaacagcaaaaatcccacaaacacacttccagacaaggtcctttggtcattgtacaatacaatacctacttctgtgcattttgctttacttgttcaaatgtatctgatagaaataactcaaaatcaatcaataggattctattttattattttattgactatatagtaggcaaaggagtaagagtttatgtcaaaattattttcttgatgagcagtcacttcatttccaggtttttgccaccataaatggtgctgcaaaaacatactcagatataaatttacacatgctgcttttattgcaaggttaaggagcacatcattttaaatgttaatagatgttaccaaattgcttttccaaaaggctgtaacgattcacatttctaccatgagtaaatgaaagtactctcttccccacatgactgccaacagcaggtgaattggtagttgtcactttattttgcatttcactgactagtgagtttgaaaatcttttcatacatttattgtccatttatatttccttttatgtgaatggcctattcatatcctttgtctgtgttactatgaatatatatataaatatatatatatatatggccctttatctgtttatctgtcatctgcattgcaaaatttttaacaaatcaaattttttcctgttaccttatttattgtatcttttgccatggaaaagctttatttaaaattttgataattaacttattcatattttatacttctgccaattattaacttattgcctgtcagcttcatacccaaccttctaaactcagctctgtgatcctggagctgaaattgcaatttccatttctgtttaccagtagggtccgtgttgagctctggccacagtgggagctaagggagatggcaaggctggaggaggaagccaggacctggccttttctatgtactccttgtctacttcctgtgtgcctccagaggactcttgtgccttgattcttcatcccagcagctctttttatggcagcagctaaatcaatttcaatttttgccaaactcatagaaccattctcattgcaccctcttcagagacactaacagcacctgaggagcacctcattttagaggtttgagtttaagcccttcatctaagtcttttaagatttaataactcaaacttttatttggcccctcttccctaggtattgtagttgcttggtacagttaccacctctctgatcctttagttctctcttttaacactttcagctacctagttagtaattttatatatataatagttgtatcttaaattatatgttttggaataaatgatgtggtttctcttcaacagtgatataataattcataaattaagttgggttatttgtattttcttaggaagtaatctatttgctctggattttcaactttattgccatagtaatgcttgtattttcttattttatatgctattccttctatacattttatttaatctcttctatcattctaatgtatatatatatatttcacttgattaaaataactggattatctatattattggttttgtgggtgcatatgtgtatatatgtgtgtgtatgtatatgtgtatgttgtgtgtccatgtatgtgtatgtatctttgtgtgtatgtgattgtgtactcatgcacgcgtgtctatgggttgatgtttgtgtatgtatatgtgtggggttttttaacagccatatagcacagcataatgataaaaacattttgtagttgttaagagagtatagctattaacttaatgctctagtgcagaattcaccaaactttttctataaaaggctagttttgcaggcctatagtctttgtctcaacaaattaactctgcgattgtaataccaaagcatccataaacaatatataaatggcatgctctggggtcactctctatttgaatctttgccctctatcccatgactttgcccaactaacttaccttttagtgtctatatctcatcttaaatatcaccttcactaggagcattccatgtttctctactggatccttattatttaaggtgtggtctgtgcacaaggaacgaccatatcacctgggagcttatgagaaattcagaatcttgggctccatgcagtagtgtgtcagagttggttcacactgatttgtgaaagcagaatacgcacaactcttcccaaatcagagttcagtgacattgagttggtagcttgaaattgtccacggagggaatatttataccatggcagtttgcaaatgctacaaatgagagtgttttatttaagaaaacaaaaaaaccttgtttcttgcagagcattggcttaccccagacctactgaattggaatctgcattttaataagatctccagggcatttatattaatattaacattaaaatttgagaagcactgcagtagatcattttttcccaaagtacatgttagaatcacatggcatgctaattaaaatacaaagtcctgaaactcatgtgtacatagattcagaacctctttaagtggagcctcagaaatcctttttctgtaaaaatatgcgttataaacaagctttctgcttggttcttaggcaccctaaaatttgacaattattgttctacaatatctgtgcccagggcatgctttgttttctaatttataatagagcagaactgtagaatcataaagaattattcccaggccttgagacctactcacagaacttacacaatttgtatggctgaattttggaattattatggactaatgacccttttatgccttcattttcctccttttagaacaggaatgtatacagttgttattctgtgcctgcccaacaatgtatatttggtaatatggggtagatgatttgtctattttagtttcacaggtctacagatagagaggaatggaatttaaggagctacacttaaactacgtcccaggtgcatcatccacacctggatctagttaggtagccggtttctggacgtcagatcgttgccaattggatgaaacttttgagaggacttggggaggggctgcatgtgggaggactgcttaaggactttctaagttccctcatttgcttaatgatggtttcagaatcatcagggttggagtgtggggaggatgatgaggtggaaggaactcaaaagttcttagcacattggaaatctagctcagcactttgtaaaataaccatatttttaaagccaacccccttcatagcgtttatcaaagtccctacattgctggggatctcacatgtgtaattcacctcttgagaattgtgtgtttctctggccggttgttttttatcttttttccctagctcatcacatataacagagaaagcagacacacacagaaacccccccagaaaccttttctccagttcaactactaaccctttcatatgctccacatggaaaaagagcttcaaattaatcacacgtgtctatcatacacggtgactggtgttcactttggagtgtggactctgttgttgtcaggcttagctcaaactttggatttaaatatgctattaactctagtagtgtatttgacacttagttaattttaaggaaatatttgttgagcgaaggaaagccacctattataaaactgagaatattttatatttcagggtttttcctttctgaatatgtgttttcatcctattttaccaatgatcttaaaaattcatgtattatagaaaaaaatgaaaacttgtattggcttcataatttgggaagtaaatactatcatataaaatatagatccttaatgtgcataaagtttcagttatgcaagatgaaaaagttttggagatctgttgtacaacattgtattatggtaaacaatatacagtagagttaaacatttgttaagatagtacatctcttgtgctttttaaccacaataaaatatttacaacccctcagaaaccttggaaaaatgactgtttctatgggggaaaataaaaccctattaaaaataataatagtatatatatcctaaagcaggcagtaaagtcaataataatgtaaaacaattttctgaatttgggaaaattgaattatagaatgtaatggtgagaataattaattgaatatataatagaaaaagaagtatttaaattttgactctatttgctctgagatttcattcttattccctttggcttatcaggggcaagtgagattgactctgaactttaatatttatttgtattggtatattagtgtttccctctgccattatactatatttcctttgcattatttccagtgaattttatgatgctggtagttttacatagagaggttggtttttttaatgcaaaaaaaaaatgtagaatttttttcaaggaaaatgtaattctgccaagtactttggttcatttgatgctgcctgtttaactctgttcggctcaatcactgtgttggacatattgtgacaaaggctcattttcatcaaaaggaatccccagagggtttgctgcttcaatgaaagggaattcattaaatatagtctaatgtaaggtgattggaatatatatattccgatacacatatgtatataattgcattttagtcagttcttatgctactgggagcgtttttttaaacactcacttctaaatgaagaatgctgcatgaaagctttttctctttctgaaaaacagctggtttcttcagcaattcaacctagaacaaagaaataaaaaatactacatgctaaagcagatccgcagtaaaaattttgtagaggcaaggcaaagtaacattaataaatgaagctaattaggcttgatttgcatatttaactcatcttaattacacaaggattcagcaaacattttaaaagctgcaatcaatctttcacagatatggttagttatttacatgaaataacaaaaactaggagctttgttaatgattactctgtttctaatttatatgccagtgagatcatttcagtattaataatggaatatattttttaacaacctgtaaacccataaggttaaaattccaaagaattttttcacaaatatgtttttgagaatttccagaatatatgaaatgttatataaattgctctattgtattaaaatgttttaccttgttcaaataaaaaaagatctttataaaattcttttgacattaatttttaaacttggaaactaaggtagtagccataatagagacaagcagaatatagtaggtgataagtaggagaattttttcttgcagctggcataaactttaattctgctcacccttggatacaatttgctttctcatctttaatagtacttttgactggtcacagaatttgaaattaaatagggggcataatgacacaatatgattctttttaatttcagtgttttatttagataaattattttgtaaaaatatacgcaggaatgctgtctctgtgttgtgatgtgaggggctggcaggtgcacttgaagtggctaagtacagaaggttctgtggacaagaacgcaacagtgcacaaaactttatgctgtgcagctgtcagatggttgtgacattccattattagggctccatttcttagatttttctctccatgagtgtccttttataacatcaaaaatcttgacccttttgcttaaattaccttgaaagggtggaggtcatgtggttaggaaaggacagctggtgaagggtgcatttaccaaacttgcaatgtgtgtgtgtgtgcgtgtgtgtgcattagtttaaaaatatgtattaaatgcttcccacgtgctaattcatcgttgtggttataattatgaagtgataaagacggtacactaaatgtcatctctgctatcatagagcttgcaatctgcatattatgactatgtaattgttaacatttattgagtacttgctttgtcacgggcagcaatcaaagcactttacaccaattcacttgttaaatccccaaaatggcactatcatgtagatactatattatttctattttacagatgagaaaactgaggcttagagtgttccaagggcacagtaagcagcaaagcccaaattcagacccaagtagtttcgctccagacactgtgcttttaatcattacattatatgcttgtatgatatccaagtctgtttagatatgtattcaaatatgtaaaatatacaacttttcattttgagactgcatataagcccaaaatatattcatgcaatataggtacaatacaataaatagtataaaataatgtcacagtttaccttttgcaaccagttaatgttctaatggctattgtattcctaagacattttatgagtagtagaataaagatatctgtagctctttgcaaggggttgaattgtgtccccttaaatccatatgttgatgtcttaatcctcagtatcttggaaggtgactgtatttggagataaggtctataaagagataattaaaattaaatgaagtcatcaggttgggcccaaatgcaatatgactagtgtcctcataaagagattaggacacagatagacacagatgaaaggccatatgaacatatagggggatgacagccatctacaagccaagtggaaggactcataatgaagccaaccctgcctacactttgagcttggatttctagcctctacaactgtgaagaaataaatctctttcgtttaagccacccagtctgtgccactttgttatggtagctttagcaaactagtataaacttaattgtgtctaaggatgagaacaccactcaatatctgaaaccaaaaagctgaatgtataatacacttaagtgtggaagaattatactggtcagagttacccattgagcaaatccaattgctgattttatatccagtttttgtgaagagtttactttggattgtgctggttacagaggcaggagttggttgaagtcagttttagaaaagtagcttgtattggtcaatgagactttttttttgccagttacagaagtagaaaaaagttgataatagcattagaaacatgttcactgtagtgaatcctgaaccagttggctgactttcaagtcgtgtctgttgttatttgacttttacaggagtgctcactgaagttacttgtcattgattaattagataggtttaaaacccactctgattgtttacttgtaagcagggctgtagaactgttgctaattgattagatgagtttataactagttctggtgcttgtgagcatggatagagaacactgagtcttttcctgggagagtggtgacttttaaaattctcagcagccaacaaaaattaataggtataacaaggaatagagaaaaagctacaaattaatctataaataacaatatcccttacttgtgtaggcattatgttaattgctttacataaatttctcccactgtaaatggagatttaaaatattactaatttcctatggtagagatgaaaagaattgctatacacaaagtacttagtaaagtgtttatacgaataagagatagtatcaataattttccaataagctgagttttaaactctgcaacttcactcaaatatcacattcttaaccaccacaataataataaaatgcatatatattatggtttcatttatatgaactaaggtagatacatgagacagtgaggaaaggggattgtatatgtatgaactagtccatgaaatatacaacaaacatgatttatggtagttgcctctggaggtggcctaaaatgggagactaacttttcattggagagtgttttgtaatatttgactttacaaccatatttttatatttcctttctcaataaaatatagttaataaaaattgtagggatgtttttactaagaagggcatgagagaatgttttggaatgctggaaacatttcatatcgcaatctgaataacaattacacagatatatacacagataaaaatgtattgaggtaagcccctaagatttatgcattttagtgtatgtaaattatatgtcactgatatggtttggctctgagtctccacccaaatctcatctcaaattacaatcctcataatccccatgtgtcgaggggagacctggtggaaggtgattggatcgtgggggcagtgtcccccatgctgttctcatgatagtgagtgagttaacatgagatctgatggttttataagcatctggccttttccctgcttgcacttctctcttgcctgctgccatgtaagacatgcctgcttccccttctgccatgattgtaagtttcctgaggcttccccaggaaaattaaaccttttttctctataaattacccagtctcaggtattgctttatagcagtgtgaaaatggactaatacaatcactaatataaaaattgatttaacatatcaaaaaggcattttttttgttttctctgacatttaatttatttcatttgtttaacttttaggttcaggggtacatgtgcaggtttattatataggtaaattgcatgtcacagggatttggtgtacagattatttcatcacccatgtaatacgcatagtacctgataagtagtttttcaatactcgtctttctcccaccttccaccctcatgtgggccctgatgtcttttgttcccttctttgggtctatgtgtactcaatgtttacctcccacttaaataccaaaacatgtggtatttcgttttctgttccttgttgctatgttagttcacttaagataatgacctccagctctatccatggtcctgcaaaggacatgatctcattcttttttacgcctgaatagtattcatggtgtatatgtagcactttttttcttcatccagtctaccattgatgggaatttagattgatttcatgtcattgctattattaatagtgctgcagtgaacatatgggtgcatgtgtctttatggtagaaaggcattttaaaatctagccttggaggaaaaaaaatgagtgaagtggactcacttcatatttttgtcttaaaattttttcaaaagaatatggaattcattgattaagtaagtcattataatgagaaaggaaattcataagcattagcactttaatgattttagtgataatatgcttggctacttattttatgatttaattttggcctaatttttaagagttttaaaggtttttttgtctgaaatatgacttttgatgagtattacttaatttttttttcaaattttcacatgacactattgacactaaaaagacttttactattttgagggaacaagcttaatctttatacatagggttcacggtcagtcaggctaggctagcttgtgttatggtaaaaaacaacctccaattctcacaacatgtgtgtcctgcttcagttctatgtccttcatgggttggaagatgggtgtggggcattcctgctggtcttcccagggatccaggtggatctctcagccatgaccttgaatgttgtttgtttctgccagagggaaaagggactcctggagggcatttgcacctatcattaactgctgaaaatgcgaagttgggaagagcctgagaggagtattctatgtcatttccattcaccactcttaagccagaactcattacatggtctctcataagcccatggagggttaggaggtgcgtatctacccagaaaggaggaatattggaaagatttggcaaacagcctcactcactccatcttcttgcacataaagggctaggggactttggaatcaggcaaaactggaaaagtgtcatgactctgccactttttatttgtgggttagatgccactgttttcatctctagaatgtgaattacaatagtacctatctcctagcattgctgtgaggattaaatatgataacaactgtaaaacatttagcataatgctttaggtatgtaataaacacttgatgaatgtaaagctgcatcctccacctggaatcaccatttccctatagttgtttaaaatgttaataggcaatggaaaagtcaatgggtgaatatgctcccgggttagaactacactgaagcaaaggtgttggggaataagaaagtgcacgcatttcatgtcatgactgatcagaatgaaaataaatattgagaagactaagctatttgtccaataataaagcatatctggtgagggtggttttttgtttttttttttttgcaatttcatttataatctccatgtaagtgtgcttactttttcattcaataactgtatcgtatcttaccagagatgtcttaggccttggggatgagaagacggaggagtggatgagtttgtcttgtggagcgtaattttagaggcaggagactacaataaataaggagaaaaattcatgaagtaattttgttaatgaggagtgatatgaaggaaacaaaatggggtgacctatttgtcaagtattggcatctgtgaatataattgaaccctgaaatatcagggatgtgacacagtggaagctcagttctcattcatggactacccaattgtaaggtcccgaatggcagcttttctctctgtggtggttgagaaacccaggttccttccagtttatgctgcctcatcatctagaggccttctgcgtatagcctgcaaagaacggaaaatcaggagtttggcagattatggtggatattttctaagggccaggcctatgttggacttacttcacaactgtctgtgttagcagtggaagagatcagagttaccctgatttaccgacggcaaatccataggtgtctggagcaaattcagcctttgcctgctcagaagaaagaattcgactgaggggcataaagcagaaaaagagaccgagaccggggcaagttccagaacaggaagaggagtttattttaaaaggctttagaataggaaagaaaggaaaattcgtttggaagagacctaagcgggctcatgaaggatcaagggagaaaagggagcaaaaaaagggaggcctttaaccttgttgctaggacttcatgggcttgcctctttcccatgattcttcgcgtagggtgggcttcccgcatgcgcagtgttttccttaccctttggaattgagcacaggcatgcagtgtgtttagggaggtatatgcatgcccatctgaggttttttcctttctccagtggcatgtgccccccagaatgtcatacttcaccgttttgtctcttaacacacatgcccaagaagctgcttctccctggggcctgcattcaattaacactttaatgttcacaagcgtggaccatcaggagattgtctctctctggctaatagattaaatatcatttttagagaggcaatattgtggaaccatcacccaacatttcagtgggtgatgggagaggcttctcctgcccagctcttgcctaactacctgtagcacctgcatttcactgagcagaactcagtcacatggccacgcctgacctctagtctggctgtgtgcccaggaggaaaaataaaagtgtttcatgaaacagtttctgctactctaatgactggttgtaagagagacgtcaggaaattagatctcagacagcatgaaaaaggttgtgtttgagttgaaagcagcatgggaaggataaggacatgtgtatatctagatgagaacatctgcaataaaggaaacagaaagcacaaaggcgggagcattccaggcagttagaaaacaggaaggccagtgtgacagctgtatgttcttgtatctaactgtacttagagttattatcctgacagtacaaaggagttgtctggatcagatatcaaaccatttactcagagagaagactgtttattttctattcctcaattccttatgtagggggcagggagggctgggtgagaaccgggtgtaccttgtgggtacagaaggaaaggggttatgtaccacgagaaaggaaaccccaaaccatgaaactcaattttctttcttccctctggggagtgggggttggagggagagagggaaacagagagagagagagagacagtgagagagggagggagagagagagaacattaaagaaacctttgctctgaaatctaaacaaatcttcccaaaaagaaggaaagcatcggtttgcaatccttggatgtgaaagaatgcctcagggtgagatgtccctgtatctccccaggggtctctatctttagggttgctattcagtcattctttaactcaggtgccagaactctgcttagaaagccctgaccatgaagaaatatgaaaatattcgaggaacacagtgaaaaggaagagtggtaaaggatgaggtcagatacagagacaagagccgaacaatacagggccttaagacacaggcagagagtttggagttcttttagtgcaatgataattttttggttggctgtatgcaggagcgtgacatggtctgattcagcttttgttggttgctctagtggcggtgaaggggatgactgggagtggggtggagtgggagaaggaggctcctgccatagtcagggtctgtaggatgatggcctgcccccagagtggtgatagtggcaagggatgaagctgggcagagtagggctgtattttgaagaaagacttgtagtagataagggttggggctggagtgggggaagaaaaagaggtattcttattcccaggtttttggttgccttggtttgtttgtttgagcagctggtgatgccatttatatgtataaagatttcgtgaagatcaaaatagacagttgggaagtagtaaatcaacaagtcttcttttgcttattatgtctgacgtgctgcatcagacaggtcaccagcaggaaagaggggactcacggagtaagctcaagtttaatgtttacagaggtatgggcggcattaagggagctagcacagcagccagggactcgcaacaatgggaaatcatcactgcccactaccactgtgtctgaaaggggaggggaaggaaagcattactggatgcagtgtgcaagtggccatgagaaaggatacaggagctgtggaatttggtagagaataaggccaccgacataatcacagctgaacgggaggtagcagaagtggcaatttatccattctctctttgtgcttatccatatcctacaggcgcttccctctggctgaatccaaccagagcccagaagtcctaagaacataggcaatgtagttagtagagagcctggcatagggcggggcagagccatgcggagaatgaatctgagggcaacagaacaaacagcacccatgtccacaagagctctttaagaaggcaaatagacattcaaagttggaactcagggagaagtaagggtggatatgtcaactggaaaatattcagcatttcaatagtatatgacaaatattaagagccaatatttgtcaggcccttactctgtgctaggcaacataccaacatttcctgtgcattattatctcaattaattctcctaacaaagctataggttaaatgccattatctcattgtacatatcaggcaactgaagcacagtaaagcaaagcaatttgtttaaggtcacacagctattaggtggcagatccaaaaattaaatgtggccatttctacccccagggtcagtgatagagatcattattacacacagcttctctgtctgaatcaaatgctggagcaatgcatattgggtcacattattattattttttttgtaaactcttctttcttttttattttttctccttttgaaagacaactattctgacaagaattcatcaaagaagagattccaaattttaatgtcccagtttgagtattgcttttgattaaggctgtttgcagactagaatgttagtaaccctcacattccctataccacaaaaagaggagattcacttttatcttgggaacaaagctgtgtagaaaagctttttaaacttattttaattcatgaaacatttatcttcgagtcaggttttgttatagcagcacaaatgtggtccgtcagcatttcctttataaccccatatttccagggtttttcaagagtgccatagagattctactttgaattaaaacttggcattcagaatttgaaaaaaaaagctactacacttttcattaccaattaatcaaatagtttagcgattctcaagttagaaaaggaccaaatgcaaaactttcattaatacaaaaatattttaagacaatttgctaatttatatctttgtaaaaatattaccactcagtatacaagtattaatattacatcactgtatattagttctcaaaattaaccaaaaaatttctaagataatataaaaaactatgacatcttatgctttgcctttttggctttgtaagtaatttatttctattttgagaattgggatgatttgaagttcttagcataattggtttaaagttataacagtgtcaagatactgagccataataacaaggatggttgagattctgagagagtatcaaagtgtttcaatttatttttgtgaaatttaaatttatgtggggaaattttgcactctgtgaacaaagatttgtagcatgaattgattctttaaattgatatttggaagttaacttgctgagtacaatgacgataatgaggaccaagtagagattagtttagttataaagcctttccaactttgcttggttcagagatactccatgaatggccaataacagtgaggggcatcatgatgatctacctttggtagctcattttgcaatctcttctgtaatctctcccagccttcaaagatttaaggttaaataaatacaaggtagtgaatgagagtagatgaagacttttgagtgaatctactcttctgactgacttctttccagccacactggcttccttgttgttccagaaatgtgtgaggcaaacatctacttggagacatttgctctagtttttcttcctacctggaacacttttcctccagaaaaactcccttcctatactttggctatactcccttactatactttcattggctaactcccttactatactttcattcttggctaactcccttactatactttcattcttggctaactcccttactatactttcattctttattcaaactttatcttctgggtgaagccaaactggataactctacttgataatgtgatttcccttagttcccaaatcccaaaattcctactattactaaccctgcctgacaatttcttctcttcagacttattatcttctagtacattttatgcctttatcacaaaatgcccatctcctccactagaatataaggtccgtgagaataaggttctttgtctatttgttgacatatcctaagcacctagaattgtgccgacaaatattaattactcaaaaatatttgtcgaatgaacaaatggttgaatgaaatctgaatttccaagcacatagcaagactctccaagcaatagtccacatatgactttcccttgttctacagaatttgggttatttccctacaagagtcaagaatgcccgttgaacactggtgttcaaaatgaaaggccccacatttagatatttagatccctattataatgtgttataggtccatctttcccggaaacatttaaactgaagctgggatgtttttgtagttaattttaattttagctattatttggataagttaaattgaatgaatagatgtgaagtttggttctcacaaaacaaatgcttattctgtatttaaaaatgccactgtatatattttataaatttttatacaggtaataatgttaatgctgaactgtgaaaattcaggagctaaaatgtgattctatcatttaaaaagaaaaagagagaccccactgcctacccccagcagcagtagatatgctgtgctgaaaataacagctttctaataagggagttcttaatagtctttggcctcagggcttgaaagctatgctaattgagaaatgcagccacttagtgagagtttactaccagctcagtggtgtaaaagcaacaacagtagaatttcagtgtagataccagtactatggtatgctccccgctctaggtctgtactattctgaatagtagttgatagcaaaagctagaattttctatggtgagaatgtattaattctgggaggaggggctaaaaattactttaaaacttaaaagcatctttgaattcctttttacgttccaaaagaaatttatttgactctgtttctgctttgtcttcctagggtatatgtgagcagtcactttatggtcacatgcattctatcaatgatgccatttttgatcccagggtaagttcagttctcccagtaaactgtttttaatgcttcatatatacaaattcatttttataaaacaaatttccaagctaaaatggtaagttaatgaggtgagaagaacaactttaggaattagttgtaaacaataggaaaagtctataggtatatagggttgcagaattttaaaattcacacacacacacacacacacacacacacacacacacacacccccacacacaccccaagtcgtagcaggagtgacaaggaattctactgtagtcaactttacttaaacacatttttaagagccttttgtccaatttgggcttcaaaaaaataggtgggctatagactgcataaaattttaatgaaaaatcattaaaataactataattgctctgtaatttttctgtaagaaaacctggagaagaaaaagcagttaaagaaaaaagttttctccaatttagaacagaacagctttgatttgacagctttttaattactcatggaaaagtttcaaatatgtccttcttcataaaaactgatgacaaaacaaaaatattttatctgccacttgaggtattcattcaggtgtaaggatgatttcacaaacaatgaaaattgttggagagtcctttgagttttctgtggtttgaatgtatccctccaagtttatgtgtcgcaaacttaatccccaatgcaagagtgtttggaggtggagccttataggagatgtttaggtcatgacactggcgccctccctcctgaatgggttaatgtctttgaaggaagttgaagctgcaagttcagtctttttgctctcttgctctttttcctccctccttctgttatgggatgacacagcacaaaggccttcatgaaatgatggtgccatgctctgggacttcccagcctccagaactgtgagaaataaatttattttctttaaagttatccagtttgtggttttctgtaatagcaacagaaaatggattaagacagttgccacgtgaattaaggatgtctttaaaagggttcagatagtaatcaaagaaggatgatttaagtctgttctcagatgaaagagatttgactacatagatgacctctcaggttcatttaaactctatgatttaattatatctaacattttggttgtctcaaagttcccagtagagtgagaatcttaattccaaattccacttcttttccaattagctataaaagaaatctgatggattacttacatctaacatcacaatgatagcatagtcaaaattctgttaccatcctgctagtatcattcttttagaaagaggaaaaatgctcactaaaaattatatctactaagggaatgttgattgctccaattgaaattgtgcttgtgtcattgtcaggcctgggaattttaatgatgggctcaaccaaaattacattttaatagattggtctttgtaagaaatattctatctaattttctgtagtgagccaattagttggaaagtattatagattagttctagataccaaggaatattttatttccagcagggtatggaaaaatttaagcactatggacccattatgaaatagaatatagttttatgctgaaagtccattaagtggcgtatagcttcacatgccctacaaaaattaaatgggagctgaaatgaataatattttgtaaatcaggcattttattttggcaagcaatataataactgcaaaagacagcattttacattctaaatattaaacttaataaatatggaaataagcaaattagatttattgaattagcaatcaagagagacatacattaatttcccatatttcaaagggcaagataacagatatgaggtttaggtgtccaatatcaaagtagctaattttttttattattatactttaaggtctagggtacatgtgcacaacatgcaggtttgttacataggtatacatgtgccatgttggtttcctgcatccatcaactcatcatttacattaggtacttctcctaatgctatccctcccccagcccccacccctgacaggccccagtgtgtgatgttccccaccctatgtccaagtgttctcattgttcaatcccacctatgagtgagaacatgcggtgtttggttttctgtccatgtgatagtttgctgagaatgatggtttccagcttcacccatgtccctgcaaaggacatgagctcatccttttttatggctgcatagtattccatgttgtatatgtgccacattttcttaatccagtctatgattgatggacatttgcgttggttccaagtttttgctattgtgaatagtgctgcaataaacatatgtgtgcatgcatctttagagtagcatgatttataatcctttaggtatatacccagtaatgggatggctgggtcaaatgttatttctagttctagatccttgaggaatcgccacattgtcttccaaaatggttgaactaatttacactctgaccaacagtgtaaaagcattcctatttctccacatcctctccagcatctgttgtttcctgtttaatgattgccattctaactggtgtgagatggtatctcattgtggttttgatttgcatttctctgatggccagtgatgatgagtattttttcatgtgtctgttggctgcataagtatcttcttttgagaagtgtctgttcatgtcctttgcccactttttgatgggattttttttttcctagtaaatttgtttgagttctttatagattctggatattagccctttgtcagatgggtagattgcaaaaattttctcccatcctgtaggttgcctgttcactctgatggtagtttcttttgctgtgcagaagctctttagtttaattagatcccatttgtctattctggcttttgttgccgttgcttttagtgttttagtcgtgaagttcttgcccatacctatgtcctgaatggtattccctaggttttcctctagggtttttatggttttaggtctaacattgaagtctttattccatcttgaattaatttttgtataaggtgtgaggaaaggatccagtttcagctttctacatatggctagccagttttcccagcaccacttattaaatagggactcctttccccatttcttgtttttgtcagatttgtcaaagatcagatagttgtagatgtgtgttgttatttctgagggctctgttctgttccattggtctatatctctgttttgatactagtaccatgctctgttggttactgtagccttgtagtatagtttgaagtcaggtagcgtgatgcctccagctttgttctttttgcttagcactgtcttggcaatgcaggctcttttttggttcctgaactttaaagtagtttttttccaattctttgaagaaagtcattggtagcttgatggggacggcattgaatccataaattaccttgggcagtatggtcattttcacaatattcttcctatccgtgaccatggaatattcttccatttgtttgtgtcctcttttattttgttgagcagtggtttgtagttctctttgaagaggtccttcatatcccttgtgagttggattcctaggtattttatctttttataactattgtgaatgggagctcattcatgatttggtttcctgtttgtctgttattggtgtataggaatgtttgtgatttttgcacattgattttgtatcctgagactttgctgaagttgcttatcagcttaaggagattttgggctgaggcgatggggttttctaaatatacaatcatgtcatctgcaaacagggacaattcaggagcaggttgttcagtttccatgtagttgtgtggttttgagtgagtttcttaatcctgagttctagtttgattgcactgtggtctgagagacagtttgttgtgatttctgttcttttacatttgctgaggagtgctttacttccaattatgtggtccattttagaataagtgcgatgtggtgctgagaggaatgtatattctgttgatttggggtggagagttctgtagatgcctattaggtctgcttggtgcagagctgagttcaagtcctggatatccttgttaaccttctgtctcattgatctgtctaatattgacagtggggtgttaaagtctcccattattattgtgtgggagtctaagtctttttgtgggtctcaaaggacttgctttatgaatttgggtgctcctgtaatgggtgcatatatatttaggatagttagctcttcttgtttaattgatccctttaccgttatgtaatggcttctttgtctcttttgatctttgttggtttaaagtctgttttatcaagagactaggattgcaacccctgctttttttttttttttttggctttccattttcttggtagatcttcctccatccctttattttgagcctatgtgtgtctctgcaggtgagatgggtctcctgaatacagcacactgatggctcttgattctttatcgaacttgccagtctgtctcttttaattggggcatatggcccatttacatttaaggttaatattgctatgtgtgaatttgatcctgtctttatgatgttagctggttattttgcccattaattgatgcagtttcttcatatcatcgatggtctttacaatttggcatgtttttacagtggctggtactggttgttcctttctatgtttagtgcttctttctggagctcttgtaaggcaggcccgggtggtgacaaaatctctcagcatttgcttgtctgtaaaggattttatttctccttcatttatgaagctttgtttggctggatatgaaattctggtttgcaaattcttaaaggatgttgaatattgtcccccactctcttctggcttgtaaggtttctattgagagatcctctgttagtctgatgggcttccctttgtgggttacctgacctttctctctggctgcccttaacattttttccttcatttcaaccttgatgaatctgacaattatgtgtcttggggttgctcttctcgaggagtgtctttgtggtgttctctgtatttactgaatttgaatgttgttgaatgccttgctaggttggggaagttctcctggataatgtcctgaagaaagttttccaacttggttccattttccccgtcactttcagatacaccaatcaaatgtagatttggtcttttcacatagtcccatattgtttggagactttgttcgtttctttttaactcttttttctctaaacttctcttcttgctttatttcactaattttatcttcaatcactgataccctttcttccacttgatcaaattgtctactgaagcttgtgcatgcatcatgtagttcttgtgccatggttttcagctccatcaagtcatttaaggtattctctacactgtttattctagttagccattcatctaatcttttttcaaggtttttagcttccttgtgatgggtttgaacatcctcctttagctcggagaagtttgttattaccgaccttctgaagcctacttctgccaacttgtcaaagtctttctgcatccagctttgttccattgctggtgaggagctgtgatcctttggaggagaagaggtgctctggtttatagaattttcagcttttctgctctgttttctccccatctttgtggttttatctacctttggactttgatgtcggtgacctgcagatggggttttggtgtagatgtcctttttcttgatgttgatgctattcctttctgtttgttatttttccttctgacagtcaggtccctcagctgtaggtctgttggagtttgctggaggtccactccagaccctgtttgcctgtgtatcaccagcagaggctgcagaacagcaaatattgctgcctgatccttcctctggaagctttgtcctagaggggcacccgcctgtatgaggtgtctgtcagcccctaccgggaggtgtctcccagttaggctacacaggggtcagggacccacttgaggaggcaggctgtccattctcagagctcaaatgctgtgctgggacaacgcactgctctcttcagagctgtcagacagggacgtttaagtctgcagaagttgtctgctgccttttgttcagctatgccttgcccacagaggttgagtctatagaggcagtaggccttgctttttgggcactttgtttacctactcaagcctcagcaatggtggatgcccctccccctgccaggctgaagcctcacagttggatctcagactgctgtactagcagtgagcaaggctccatgagcgtgggaccccctgccccgagccaggcacaggagagaatctccttgtctgccggttgctaagaccttcggaaaagcatagtatttgggcgggagtgtcccgtttttccaggtacagtctgtcacggcttcccttggctaggaaagggaaatcccccaaacccttgtgcttcccgggtgaggcaacacctctacctgcttcgggtggccctctgtgggctgcacccactgtccaaccagtcccagtgagatgaaccaggtacctcagttggaaatgcagaaatcacccgtcttctgcattgatcatgctgggagttgcagactggtgctgttcctatttggccatcttggaacagaactcgctaatatgtttttatttgcacactttgttcataccaaaaggactattacaatatagctccaaatcagtatcccacagcctcattaaaattttccattaattgatcttttctttgctgcaaatatttattaactactaatatttttaaaaaataatgtcttgttatgatgactgacattttttaaggaaatttttggtcacttatattaattgttttaacaattatgttttatgtcacatacctgctaagcaatgtcaggaggttgagaagcagctgtgactgcagagtgcagggactcccacaggtctcttgaggacatggcattgagacacagttcatattcaaacaaactattaaagttgtatttaaaaaatccatatgtggtacatatatagaaggcaaaaattttagttatttggtattagccttgctcattacttggtgcctttagggatagacattcatgttgcgttaccatttaaagttgcatttagctatttacataaacatagtttggggaaaattctacaatttcagatttgtaagtaggaatcacacatgtaaaactcaatgttatcaagctagcaatctagattcacagaaacaagggtaatgtcagtaagatggtggaataaaaagtaaccctcaactgggcacagtggctcatgcctgtaatcccaaaactttgggagactgaggcaggcagatcatgaggtcaggagatcgagaccatcctggccaatatggtgaaaccctgtctctactaaaatacaaaaaaattagccaggtgtggtcttgtgtgccggtagtcccagctactcaggaggctgaggcaggggaattgctcaaacccgggagacagagattgcagcgagctgagattgcacaactgcactccagcctggcgacagagtgagactccatctcaaaaaaaaaaaaaaaaaaaaagtaaccctcctatctccgcccacaagaatcctgcacccatccacagacaaaagtctatcagcaggagtttcaggattcaggtaggaggctgcagagccccagtggagcccaagacttaggaggattattttgagagtacagaccagcacccacgtagctgatctgctgattatgctcccaggttcaagcctaggaataacctcatttcccaaagggcttggctagatccttgtttggccttaaacctgtgccaaaaccatttgcccaggcatccaagaggaaccacacagactactgcctcagtgaagagacttgtctgctcaatgacagtggtcttcacactgaaactgaaagttgttctttggcttggcactagcctccctcagctgaggttccacatgaggactgcttgtacaaggatacagaaggagacttgcccatattctctcaacctgggagtctaagcctccataatgagttcactaacctccatttcacagcagattttgaggtgcaccagactcagttccagctccccttactacttttggggaactatgctgtctatgcaaagacctgctgggaattgcacactcacgtgggccagtgagacaggttcgtcagctgctgtcacacagcagatcctgagagggcccagaccacttgtgcaggacctgccgggaagcacacctgtatggacacagttccactgcgcagagacctgctgggaagcacacctgtgtgggccactggaaaatatttcagtcttaggttcctgctcagctttcatcaacagcctagggaccctccttaagtcttccccaggtccatctaggacagagagccatgtcatccttggaacctttgtgagattcacagcaaacctgggctgagaggttcctctagtgctaagacaacttcagtgatcacaggctcagggaacacaattagtatttttagatctctggaagacgctctgaaaaatgataggcacagtaaagccagactgtgaagactggaacaaatacccagtctttcaaaatgcagacattgtcacatgtccactattatcagtaatattcagggaaatgttaccttaccaaagagagaaaataaggcaccagacactgattttaaagtgacagggatgtgtcatctctcagacaaagaattcaaaaatagctgttttaaggatgctcctcaaacttcaaaaaatatagagaaacaattgagaaatttatcagggaaattttatagagagattgaaattttaaaaaatcaaacagaaatcctggagctgaaaaatataatgaatgaaataaaagacacagtggagagcattaacagcagaattgatcaaacagaagaaagaattagtaagcttggtgacaggctatttgaaaatacagtcagaagggaaaaagagaaaagaataaaaataaagaagttacaggatcctacaacagttgcctgtcaaagaaaagctcagaagtaggcttcactgctgaattctaccaaacatgtaaaaaaagagctaataccaatgtttctcaaactattccaaaaacttgaagaggatagagttcttactaactcatcctatgagaacagcactaccctgataccaaaaccagacaaggacccaacaacaacaacaaccaacactattggccaccattcctgatgaacatagatgcaaaaactctcaagaaaacactagcaaaccaaatccaacagcacatcgaaaagatcattcagcatcatcaaatgagatttatcccagggatgcaaggatgattcaacataggcaattcaataaatgttatatatcacattaacagaatgaaagacaaaaattatatgatcatctcattagccatgggaaaagcattcaataaaattcacaatccctttataataaaaaccctgaacaattaggtatagaagcaacataccacaacacaataaaggccatatatgagaaacctacaaacatcatactaaatagggaaaagctgaaagtttttcctctaaaatctggactaagacaaatatgcctatctttactatttctgttcaacatagcactagaagtcctagccagagcaattaggcagcaaaaagaaataacgcgcatccaaattggaaaggaggaagacaaattgtctctttttacagatgatatgatcttatatagagaaaactctacagaccccactgaaaaactgttagaactaataaattcagtaaagatggagtacacaaaatcaataaaaaatagtaacatttctatatgcaatagcaaactctccaaaaaagatatgacaaagaagcccatttacaataactacaaaaaatctagaaataagtttaaacaaaaacatgaaatgtctctgcaatgaaatctacaaaataatgatgacaggaaatagaagaggacactaataaatggaaagataccctgtgatcatggactggaagaattaatattgttaaaatatctggatcagtctcttctcacactgctataaaggactgcctgagactgaataatttataaaggaaagaggtttaattgactcacagttccacatcgttggggaggcctcaggaaacttaaaatcatggcagaaggggaatcaaacacatccttcttcacatggtggcggcagaagtgctgagcaaaagggggaaaagccccttgtaaaaccttcagatctcttgagaactcacacactatcacaagaatagcatgagggtaaccgcccccatgattaaattacttcccacccatccctcctagacatatggcgattatgggaactacaattcaagaggaaattgagaggggatacagccaaaccatatcaatgtccatactgcccaaagtgatctacaaattcagtgcaatctctatcaaaatactaatgacattctctataaaaattgaagtaaaatttcaaatctttttggaaccaaaaggctgcaaatagccaaagcaatcctgagaataaagaaaaaaactggaggtatcatactacctgacattaaaatatactacaatgctaagaaattcaaatattcttaccataaagaaatgacaagtgtttgaggtgatagatatgataattatcctgatttgagcattactcaatgtacccatgtatcaaaatatcacattgtatccataaatatgtagttacatgtcaatgaaaaacaaaatacatctttaaaaaagattcacagaaacagataggcaataaacaatatttatatatggccctgaaaaactattgaattgaattttatttgttaaattgaattttaattctcttatggtattagagctcggatgtcttaatttctccttgatttctccattggaagtagatatttattttaaacctccttttaaagtaatctgtcatgagacattttaaggaactataaaagctacttattaagtcatttttataaagcaaagccaaaaccaaaaaaggaagatgacagtaatttccagaaaattattaatagccacagaaaattcaatctaaaggaaaaaataaaaacaaaaactgtaaataatacgtggcaggaaaatgagcagggagcctcacctgacttcaaatttccaggaagttgacctaagtcttactaggatggacattccatagggccttctagaagctcttgctggacttttccatttttccttatttttattttgcattctagtctcatcttgaaattagtcatgtaaatctttgatatttatgagatataccaatatgttttattatttctttgcctataactaatttctttcttttctctccttcctgcagggtttcattttatcttgctaacgatagtctctcatagttctttcagggaaagtgtgtgggtagtaaactttttttggtctttgtatatctggaaatgtcattattttattttcattctgttatttcctctgtcactattgttgctgatgagaatcaactataaatctaatagttgatcctttgtagataaggttggatctttctcatacattttaatatcttgcatatttagcttttaatttttctatgctgtgtctacatgtagatttgcttcttttttgtttttctctggacttgatgtgtcttctcaatatgagcacttttgtctttctacaatgctggaaatttttcagccattatgttattaaatattgtgttttgtcaattctctctagtatctcttttaggaattccttttatatctctgttgaatcttctcattcacttcatgtttctttttatatttcctgtgctttactactttgtgtggcatcccaattaatttcttcccaactgtcttataaatcaatctttctttagctgaatcctgtttaattttattctttctactgagtttttctatttcaattactacatttcttatagaaatgtagtattttagattcttttcaactttgtccatccttgtttcattatgtctagtttgattttaggcatatattaatttctttttttactttttgatctataatttctataaattttgagtggcaggaatatttcttcattatcttatatttccttgtttcctagaaacctgcactagcattttcacctcaactattccaatatgaattccaaatcaaaaagttcactgaaactcttcttgagctctgtattgttgtacccaatgagtaattttcattgtcacttaaaatgttctcctctcttgagccctgagaaataaaatatccacaggcaccgcttctcaatctactgtgctggatcctactttattacttgactgctaaatattatagtgtatcaaggctcaatcttaaatcctgttatctagcagattctctttataattcatattatttaaacttgtaacttttaattttatttatatgatgatgattttcaagtaaatcccactctgacccccaaagttaccattagtcattttgcaactcagcctaaacatctgatatctcattaaaatatgttaaaaatgaaacttgctttcccataatccacactgattcctttctccattatgtcatcttaataaatattattctattcatctagatgcagaagtagaactctccgtcatagctagcaattgtcttggggatttttgtctgtttacttttttcaaaaatctctctacaccagaattcagggaaaagaaataagaaaaggatatttccaatttcattttacccaatatctccactatgtagcatagtttgttttacatatttaatattcataaaaggagatgaataaataaatgaatgctgaattcggaacaaatataagcacaaggctttcattatagcattgtatcattagatcttatttatttcaacttgattaggcttccaaattctgcggatgcttagctgcaaactaaagttatttaattatcaggacagattcgctgttccttagaaagctactgtggcatcatagtttaccatgcctttggagtctctgtacaattgtccaatttcagttatatttttctcctattggtacttttcggattctggctttgctattcataagacatatgatcttgagcaaattatttagctcatctttaaaatgagtgacaaaagaacagagaatattagataatacatacaatgtgttttaaatagtgcttagtaactagaagatggtactactgctactactgctattattattactaaagtctgaacatctctaatccaaaaatctaaactccaaaatgttccaaaatccaaaacatgacaccgtaaggtgaaaattcaacacctgacacctttgctttttgctaatttagtgtacacaaactttgtttcatgtataaaattatttaaaatgctgtataaaattaccttcagtctgtatgtataaggtatatatgaaacataaattaatgttttgtttagacttgggtcctatccccatgatattacattatgtatatgcaaatattctaaaatttttaaaaagtcagaaatctcaaacatttctattcctaagaattttgtataaggcatactcaacctgtactattgttaatggagataatgttcctttctagccatttgttttcaaataagtagaagtaaataaaaaataatcacacacaaatatgtataatataaattccttatagtctataatttaattttctataacataatagtagtgtaaacataaacttgccatacatattttgcacttaagcaaagttcaagaacataaaatgttaaaattatcctaaaaaagaatgtgtaactgtatgaaacctgagctaaatcctactaaaaaaataggtataaacttcagagggagtattttgtttcttttatatctggatatgttatacaataattaggcagttaaatgttttaaatttgatctaagataggttaattgcttttcctaagttgccggtaagtagacataaatgcatcaattcacattacctttttaaaaaaccagtgataaacaaaaaactgcaattgcctacctaaaaaagtgatcctgtctccactttagcaaaggaagttgaatttctgatttctcaattttgtttgttacctaagttcaaacagcaagcactcaatatcaatctctggccattttatataaagaaatgcaaacaacaattaggtcatacagtgattgatcccctgaaggacaaatgatgtcaggcagtatttatgcaccaaaattatttcaattttgcttacttttccagcaatccaccttgatgtcaactaccatttagctgggccaataatattgatatttgatgtcagttcttattcattactgcaccaagatgatgcataagtcaaaacttttagatgtgtggtgaaaaacactaaagcaggttctgtctatccaaggaaattggaaacaacaatagaatataaaattaaggcatatgtaatctccatttttattttagaaaatatttaaattatgtcaatattcctacatattcaaaaaataattttatatctcaagcccatcctatactatgtgattttttaaactaaatattttatgaaattaactttttgccttaatactttttgtactttggaaagaaaataatttctagtaaaaagtgaaacgctttaaaaaagtaaagcaaaagaaaagcatttgtataagcagccattaaaaaaattaattagaatataaggtaactataataaattaatagaagtattctatctttatttctactttgttttggtgttagaaatctaatactgtaaatgactacagataaaaatgatacatttaagattctattgcaccacccccaaattttaacctccaatcactcctatagtcaaatggagttcatttcatacatttgtcattttgttgatgggtctatgaaaattgaaagcaacataattatgtcatatttcttgacatttcctctttgaccaaaaaaaatcaatcgtttgttttctatatatgtatctttggataactttaaaaccttttggcatatatgaaaacagttcagtagtgaaatttctacttagcaaccctttacatcaactgtgtcctggcactaatctaaatagtgagagttcagcaatgaaaaataccaagtcctgtcctcaggaaccttatattctcttaataatcagagacaataaaccagtaaataagtgaataatctcaggaatatgaagtgctacctatcaagaatcaatcaggtagaaaacagcaataaggtgagagttggggcttaaaatgcaatgatcagagagagattctctgagagaataaagaaatcctaaaagttctgaaggaagataactcaagcataggcaataagagaggccaagttcctgaagtggtgacaacatggtcccgtggaggaatagcaaaatcgggacacatagagtgaactaggaatagattaaacaggtggaatatcttgaatcatatagataactgattggtaatgtcacctatacaaagataacccagctatgagaagtttgtaatggatttttttatgtgactaataccttaagtttttttaaccctagaattcttagcataattctcagtatagaagcactaatcaataaatattcattgactaggaagtgtcagaaagtcactgtaggtcagaactgaagggatatttaagaggacataggaccatgtttgctgtgacacaacaaaatttattttctatcattgattttaaattttattttgaaatttaatatactttgcagactccccatgattgttttgagcatatgactgccaaaactagttcaaaatattttatttttttataagaaataatgtcactgatcaggatatttgaccactcagacaactggtcttccaatacagtaaaatctcatttaaacaggtttcacagtacgaaattgttctaagtaacgtgaaaatatcaacataaaatgatacactcctctctaattaggatttattatagccagtcttaatttgcatgtgatttaaaaagtataaaaaactacatgtatgataaacagcatgaatttttaagattgttttacataacagggataatgtctaatgcatgaaacattgtttttgaagcacataattagagcaaaaataattgtcacaccaatttactcataagcacaattacaagaaaacttgattatcccctttaatgtaattttccccacttaattgtatgttggtggatgaatgtgaccctgtgagtccatacttgaagaagtgactgttagttaacatgcaaaaccacgggcagaacaagagagtctgccctttctctggaagagatttaatttgtataccaagtggctctgcagggaaactgttttaaaaggtacatcttccagcaggatgggctggaatttcctggagcacctttcaccttgcccttgggctgtcatgtgcatcatcaccttgctctgccatttactcaatagctagacctaaacactcaacagttttctaactaaaggaatttaatctgctacctagattgcattcagaaacctaaattcattgaatttttttctgaaaccattcaagtttttatatatgttttctttttttttaagatttagcaaatattccctgacttgttatttgggtggttgtgaagtgaaagaaccttttgtttctaactttaatacctggttgcatttagatcccttattccacctgagctggagaaagttaggaccacagagaatcttaagtatacactctgtttctttttcatgaggcttgatactggaattggctgcagtcatttaaaatgttctctttttagtctgagggatagaatttttttctaaggaatagctggttttcaatttttacagactgaaatacaaagttatgaaataaatcaagtcattacattatgaattgcttttctatcatgttatgttttgtatacctaaaatggtaaaaacagacttttttggatgtgtgaggttgtaacttcgccctctccagggtattatggatacaattccatatcttcaaagaaatatgattgttttactagtgaaaaaaaatgtagaatttctaagaaaaaataaggctagcaaacagaaggacagtctgttagaaataattcttaaaaaggctctacattttagttaaatatatatagctccaccctgtaatctgtttttataaatcaaattatagattttggatattttatcaagtcacttcaatatgaagtacaggaagaaagatatggcacctttcctcacccatcttaaggatcatagccaaaagtcctgtaacaaaagacaggtttacaagggaaaagtataacaaatgtatttaatcagggttttacttgacatgggagccttcaggaatgaaaacttaaaagacccggggaaaattgtctattttgatgcttagatttaatgaagaatggacaatcacgtagaaatgtgattgggcaaaagaatataatctaatggtaatagaccgagggaagaaatccagtaaggcctgactttcttttccttccttctttccttccttccttccttccttccttccttccttccttccttccttccttccttccttcctttttttttttttttttttttttggcgtttctgtatagcatttctttcacctggcaatggggcaggtcccacctcgaatcacgtcttcaaaatagaagagatggagtgagcttgctaggctttacggagaagggagaagggagaagggatggattgagcttcctaggttttatggctttctttgggggagagaagtttccgtttctatgactcgccttagggaagaggagttctggtttctatgactcattcatgggagaaggagggtcggaagacaggaaggtggagaaggtcagaggcccttccaatttccttcatttcaaagtattcagcacaccaaggagccatacttcagggtgtcgtgttctgagctccaacagtggcaacagccaggcctggtttatggtcatcaacatgaatcttggtattgtaaacattatgatgacacaaccctattcatatattatcaactttatgtatataatggaacttctctgaatttatgtgactgtacttatgcacatattaagagaaaataaatccattgcaggttatcccagcaatgttattgcagtgagcactatattaatcaataataattagctactttaaaagactcttgccaaattgaggaacaccttaggttactatcacaataaataaacagatcttacagattgtgtatctacatcatgtaatatcttctgcaatgatcaaacagcaaaagtacattgttgttaacaatagtaattaacacattgctctcatctttgctagatgatttgttttatttctctatggtgtataaaacatacatatatatttttaaaaggattatccccaagtacttaagaaatgattattttgaaattactagaaatctgaagttgtaaattttttgtagtaagttctctgtaagtgtttgtgaaactgaattcagtagataaaaatattttttcccacaagggaaaagaaatagatttgatggaattttgcagtttgccactatgtcagctgctaatatggacattcaggattccaaatccctctttgacctctaatcactgctgcagaaatctagtgcttctctaattgtcaatccctgccctctgcctttcatatcttggagaatataaaaggactgacttcctccctggataaaggacaacagattaatgaaattaagtgtctgcctcattaaaattgtcatccctggtttactatttcaagtgcagtatcaactgtggctagcttttactcttcagggggtccagtgatgttcagtttcttatgtaaatttatgcaaaaactactccaacaatatcacatgctgttcctttcaaaccccaaaaggaatgctgtgtttctttatctggtagatggaaagagcagagtgggagtgagctgagttacaggttaacaaacagaatactggtctatccaaggaggaggagagtttggaaggaaaacacaatatttattttcaattgtgttaaatcaaagattcacctgtatgtatttcatttttatctgtaaatatttccaaaatgtaaatttacatggcaatgcattttattttgtttaggaggattacaaattagccaggatgattccatagctcatgaagatctagaatcatgtcttacccttttccctactgcatcagtcctgtcctcttcctcaccacacaccctcacccggcactaggccattctggcagggaaagcttgtctgggtgatacttaatgaatgactaatcatgttttcaaaactctttataaaagaagtttcatcatcttaaagtatgtacaaatttctttggtcagtttgttataacaaaataaaaagtagaccagtggtgagatagaaacagactgttctagaaaaaagggtgggttagagcagcttgattaaatgtattaaaaagtggtagaatttagtatttggcaaattgatattttaaagcacttaaatgtcctttaattctcaagttgaatcacccatcatcatgggttgttttaggaagtaaaattatcagtgtaggcttcattcaaatgtaaataactatggcataagtgcctcatttaaaaatagttgttcagaagaaaataagctgacgggcagggggaaaacctctcaagttataatcatttcaggaaagtacatcctgtgtatatgtctatctgtgtgtatgtgaattgcccagttgggtggccacattaattgtgcatatgtgtcatattatgattgctttaagattggttgggagagttattggcatgttttagttaaatcttatatttctcagtttaattgagaaagcaacaagagagattttaaaactctaagctctactcaaggcttttcattgtctggttatgctcactagtgagccacaaccttctccactgtcccctaacccttcttatatttaccctcaactttggccagttccaagattgctgtgccaaaatcaattaatatgcatccaaattgaatgaaaacactccaaagaaatatctttaatctgatttacatatgaatttattcctgtcttcttatctaacggatttcaattcaaccagatttagtttcagatcccaactatcacttaccagttgtgtgaattagaagtagcctaaattttctcatatgtaatatggtgatattacctagtgcctcataaattcatcaagtttaccttgttggatgctagatattttgtatttttacaaatagtcttgaactttgttctggaatgctgtcaagttacttagaaactggttagtacttccagatttgttaggtgggaaagaagcagtgctcaaactagggctaattacttccccgctactaaagcggggaagtaccccttctttgtcttctaatctacccagtgacctcaaatcttgaaatttttcattctgtctgttagggcagtcctcactttcccagtgtaatctgaacatcttttcgtgttccctctaatcatttcaggtagttcttcctaggcccctaagtaatttcctcacagtcatatgccaatcattactgagctaaatactagaggaggtttctctgcagatctccagggttttctctgtgcaactctcacctcacctcttctgtacactctgcctcgcaaattctacctgccttggcatccctggaccctcagcttcgtttctttaattagggagtctgctgtgctttgtttcagttccctgtccttgtgttatgggatagaaatcgtcaaggtagtatgtcaacgtagtcttctctggctgacttcattcgttttcatctcttgatgattattgccctttgttacctaatatgcagtgtcttgtaaaccattgttttctatattttgtccaggtttttggttgtttcaggcaggaggatatacctgatccctttgactccattgtgactggaagtcttttttagcatctgtttttaagtgtcaacagatttcaccagaagatatgcaattgtaataataatagcattatttttaacatttatagttagcccttcctcctatacaaaataaaagttggcagtatgtttgaagaagaccttaattatagttctgcttggaccatgaatttcatgcgaaggcttagacaaatcccttaatttctcaagactttacttttctattccatggaatactttgatctggacaacttttatattatctttcagaaatatattgataatcactaacattttccttttgaaattgagaaaaactatagactatgaatgcatgacttataaggctttttagagaagcaaggatttattttcaacacctggtttttctgaactctgaaagattctttgtgactcaatacttaccggtattaacaaaaaaccatgagatctgtagaggagaaaagaagagctttattttcttaacaataatctcaaattggggaggcatagcctacaatacaagtgagcgtgccttccaatgaacaaagtgggggtctggcttcaatagagaaaattctcaccccagttctcaaccaaatccatttatgcaaatgaagcattcaaacttattcagttctgattggttgaaatagataagccctgattggcaagcttccaagccccaaactggaagtctctagcagccggtgtgagagtttgagggtcgtggccacagtttatcttgacaacaacagaaactggtttggattaatcacagaaagggaggttttgtgacacttttacaacacctttctgagaacatggagtactttctgagaacacagctccctcacttggctgtggccacctggttctgtattaactttgagaacctcagtcagccatgaagacttcattttgtctgttggccagaggcatgctttaacactagcaaacaccacagcaaacctgagatctttcttctgacatacagagtgatgccaaactgtaaaaatttaacaccactcgctcttcagatgtggagtagtaagcttcaatttttacttcatatctctttggttttatttcttcatattccagaaaccctactgccctgctttgacattacagtatgttactatgtaaatatatcaaaagatattgctgcaatgtgacaagtcacatcggcagaaaacaccaagggcctataagacaaagatctcatacatgaatatctgaaataatgccaataatgacactgaaaatgaagtaaactcacatgagagtcagaacatttttttagtgcttttagaagaggctcactgccagagggagaatgcatcaatttcatatgccatgtaaggaacttccatttctccttgaataaaacgttagtttcaaaaattgtctttagagtagaaagactctctgtgatttattaaaccttcttctccccttcaccttcagaaatccactaattttgcatcgtatttggcagccaggaagttgggccagtctatattcaattccttcaggactgtgctttcaatttggcatctgcaaaataagcattatgctaggtgtcgtgggagattcaaacaagtaaagatctagtcctttttcttgataaactaggctaggtgtggtagctcaaacttctgagagtttgacaacagtctgagaaacacagcgagaccccatctctaccaaaaaaaagtagctgggcatattggcatgcacctgtggtcctagttgcttcgggaagttgaagtgggaggatggcttgagagcaggagtttgagattacagtgagctgtgatcatgccactgtactccaacctgggtgacagagcaagaccctaactcaaaattaaaaaaaaaaaaaaaatcaaactctatccacaaagtaggtaactatttgtttgtataaggtaacatgttataagtgccaaaagtggctaactaaaagtcagtggagaaaacttatatttacacaaaaacctccacatagagtagctttattcataactgtgaaaacttggaagcaaccaaaatgtcctccagtaggtgaattgatagagaaagtatggtacatccagacaatggaatgttactcgggacttaaaaaaaaaatgaactattaagccatgaaaagagatggcataaacttaaatgcacattactaagtgaaatagccactctaaaatggctacatactgtatgactccaactatgtgacattctggaaaaggcaaaactgtagaaacagtaaaaagatcagtggttgccaggggctggagggagggagggatgaatagacagggcatagacaatttttagggtggtgaaaatactcttataatgatggttacacttgtctaaacccatagaacgtacaccaccaagagtgaaccctaatgtaaactgtgagctttggatgatgaagatgtgctaatgtaggttcaccaattgtaacaagtgtaccactctggtggcagatattgctagtgtgagatgctatgcatgtgtaggggagacaggacatatgagaaatcttcatactttcctcttaattttgctcagaacctaaacctgctctaaaaaaaataaagactttaaaaataatcagtgggtatatcgggtataattcttgaaagagttctattgcaaatatgagaagttttgctttgactttccaggtatggaaataatgattcattcattcatttgttcaaatatttactaagtatataatataaacccaaaactgaatgtgtaaatgatctggaacagtactgtccaatagaactttctgtaataaaaagatgatttttaatctaaaatgtccaatgtgataggtgctagctacatgaggagatttttaactaattaaaaataagtaaaactgaaacttcagttcctcagttgctgtagttacatttaaagtactcagtagccacatgtattaaacaatggtctagaatgaaaagacgggcatgtatataagagattgcagttttgtaacatgaatttatggaagcaacagaaggaatacattgtgtcacttagaggactttagaagaagttgtgttggagccaagttttaagaatggttgatatttaccagaaaaataaataaggaatgagtatcccagtcagtggaaactaagaagaaaagcatgaggacttggtgcatttgaggaatagccaatagagtaacatatggggaaatttaaggaagatgataggcaggaaggaggcaggtcaaatttacatttgagagtctcaaatttgcatttaaaaatgactgtcatggctgggcctatgccttgtaatcctagcactttgggaggcctaggcgggcggatcacctgaggtcgcgagttcgagaccagcctgaccaacatggagaaaccccgtctctactaaaaatacaaaattagccaggcgtggtggcagacgcctgtaatcccagctactggggaggctgaggcaggagaatcacttgaacctgggaggcggatgttgcagtgaactgagatcgtgccactgcactccagcctgggcaacaagagtgaaactccatctcaaataaaataaaataaaaaaaataaataaataataataaaaaaaaaacctaccattagcatagagcaaggtttggcaatactgattttatggactggtaattccctgttggaggtgggggctatttcgtgcattataagacttttatcagcatccctggcctccatcaactgaattccaggggcactttctagttgcgaaatcaaagatgtctctggacattgccagaagtcctctgggaagaaaaaatcacctctatttgagaaactttgctgtaaaaatggccttccaaggctgggtgtggtggcttacgcctgtgcactttgggaggtcgaggaaggcagatcacttaaggtcaggagttcgagaccagcctggccaacgtgacgaaaattctctactaaaaaatacaaaaattatccaggcgtgatgatgcatgcctgtaatcccagctactccggagcctgaggcaggagaatcacttgaatctggtaggtggaggttgcagtgagctgagatcacaccactgcactccagtctgggttacagagcgagactccatctcaaaaataataataaaataaaataaataataaaatggcctgcaaagatagagggttgaagtgaggaagttcactgcatgtgtcccagtgtgagttgatgacaggctaaaataagggatttttggaggcaaatttcaactgaatagaattggaaaggaaagagatggagaatgggataaaaagctctggtgattgcctggagtttggatccttttgttgaaatggaaagtgcagcagaaggctcaagttgaggaaaagattaatttggctttgaacaggatgacattgaggtacgtggggaacttccaagtgagaaatgctatcagtagttggaaataaagacctggaatttaagagagagttgtgaattggagatgtagattcaagagtcataaacatcttaatattagttgaaatcatgggaatactcctttgtgcttccagcagtctggacttaatgacgactcatagtttctgactgatctccaaatccacgctttttgaatcaattcaacacatagcacctgttctttcctgatttcatatatgaaaagactttgaagtctacactggcctatttactgttagcgcttctgcctcagggcccttgatcttgctcttccctcttcctgaatcactcttcattctcacagcacaacttggccccacaaatccattaggtcttaattcaaaggtcacacattcctagtcttgacaggctatttgtatttcaacaccctgtctgccaaacattccttgtctacatttttaaaaattctccatagcttttaacatttaacataccacatattttactgatttatttaatttattgtatgtttctttacagaagcatgcccgttccgtgaggcttgtccaccacctaaaatcggcacaggctccataaatatttgtttgatgaatgaagagataggttttctatagaatgaggcaaatttgcccgaattcagtcaacctcttacttataacaaacttgagtaccacaagaaagcaatcttcacttgtttttcaggatctcagagacacagtcttgcactagataataccttcttaacttactgagactagtggccttcaacattccctttaacgtatcgatatttatgtacaaaacacataagaactttttttacatcatatgtaaaatttacattcctcagtgtgagctccagaaactttggaatttttacacattgttaacctcatcattaattcaccacattccccatggagtagtatgttaatttctgctttgtgctctgacattgtgccgttttcgataaaaatgacaccttcctgccttctcttccctattatttgtccataatcttcatctatctaaaacattacatttccagaaagctgtattcacctgatgaatttatcctagtgttccgctcctagaagatactttcttagattctacagtcttgaattaggtgatcaatttgtattctaaacaatacctacttctagcatttaactcttctattgtaattgcctagttactcctctctctgacaatcaaccagaagcttgttgaggtcatatattaattgtttttcttcctcttggtccaagccagggtcacagtagagttcagtaaatattagttgctttatatacattgtctttatttctagttactcttctgccttgtcaatttaaacacctgcttgcttgatttgttctttgttaatacatgtggtacttgttgacatgctcctaaagctctgttagctgttttggtgtgttttaccccaataacaaagtatgcatgtttatgcatctaagtggtttcatgggtcccggagttcggatgtctgacccctccaaatctcatgttgaaatttaatttccagtgtaatggtgttggaaggtgggacctagtaagaggtgtttgggtcatgggagcaaatctctcatgaatagattaatgccttccctgagggaggggatgagtgagtttctactcttatttcccacaagagctggttgttaaaaataacctggaacttcctctatctctctctctctctgtctctctgtctctctctctctctctctctctctcactcttgcttttctctcttgccatgtgatctctgcacacactggctccccttgccttctgccatgaaaagaagcagcctgaagccctcaccagaagcagatactggcgccatgcttctatagtctgccgactgcaggaatatcggaggctgggcaatttataaagaaaagagctttgggtggctcacagttctgcatgttatacaagaagtatggtgctgtcatctgcttttggttagggtttcagggagcctccactcatggcagaagaggaaggggagctgacaggtagagaaggggagtgtagctgtcacatggtgagagagaggaagagagagggggtagtgccaggctggttttaacaagcagctctcacagaaactagtagagtgagaactcactcactacaagaatgataacaaaccattcatgagtgagccacacctatgactcaaaaatctctcaccatgccctactctaacactggggatcatatttcaacatgagacttagtggggccacactaaccatatccaaaccatagcatcaggttttcaattccgagcctgtgttttgctaaccaaatgactctgggcaagtttaataacttaaaccttggttgtctcatttgtaatattgagcagtaccagtacctaaccataaagatgtagaattaaatgagatagtacatataaatcactttgtacaagttattgtaatgatgtagtgctgtgttgtgtactttagctgctcggtaattatttttgagatttccagctcatatccatggagcatgattggtgatatggtagttgttaatgcctaacagactgatgatggcataggaaagaagtatacacccaaaattacaaacttatccacatctttccagtgctctatatttcctccttctttatacttgaactttctaagcattcccaaatcttaccttctctttccgttctaattccataatttatttgctttatttgtgccattagagtattgaggaaatggtgtaatgagctattgcttaatgctgcataggcctgtcctaagagacatgctaatgtatcagtactaaaaatgtttgaaatactaattttcctcctaatgagcctaaacattttattatagttataccttaataccaagttgcaggtcattaccttcacatattgaaggcagctgatgtttcccggacttaatgtctctgccatttgcttgatgacccctcttacttgcccattttgcatagcagaattttagaaaataaaaattagatcacttgacaggtactgtgtgtgatgttttgatttcattatttctttattcaaaaatatttttctgatgataaaaattaatgtatgataatttcatgaaatctaactttttaaattgaaaagaacaaataaaattaatgtgcattggcttactacctgaagataaccatttctgatttattttcaatatatgctttgtgtatacatacaacatagacaattttgcatgctgctattttcattgaactacatattttttcgtcattaataatcttcggcaatgccattataatagtttagttatatatttatatatgttatctaatgacatatatatttggaaatgccaaaatatagtttagctatataattatacatgttatagttttatatatttgtgtatatatgtatgtgttatctattgatgattttttaggtttctacagttttagcttgtaaataatagtgtgaggaacatctatgtgacaaatttgtatcttattgactatttaatgtatcctgatggggaaatattttctatatttttaaacttttgtgatatactctagtagttttgagaaaataaaatgtaatacagtggataaaatcttggactctgcagttaaccatacatgggcttgaatccacactccaaatcattctaactaggtaattttagggaagtgactttatctctttaagcattattttcctcatttgtaaaatacaattgttgcacataaaaaataatcctataaatattgagcatatgtcatggcaaaaactgttaattttagttgtcaattactacatccaccagtaatacaaatctgattgtattgcagttttatcaacatcaatgctgtcattaaaaatctattctaatttgatagaaaaaaaggacatgttaattaaaaaaccccaaatcaaactaatttaagcaaaattagggtgttcattggctctatagaggagggaaagatcactcccactgcctttttattcttttctgggctctttggctggtccaggaactgaactgatataacagatgaacaggagaaaagcacacaagttttattaattttacatttacatgaggattttcatcagagagcaaagtccaaaggaatggccaaaggaaaatgcttttatattttttagacaaaaaatataaatttgtaaagaaattacacaacaaggggacctggctagggtagtaagttctaggggagatactgggagatacatgagaggtggaaagctagtggaagataagggttatttgggggagattatttattcaggcctatttcaaggctaagtcccagtatctggtgataagaattcttctcacgccctggtactgggaaagcaccccttgcaaaagaatatttaaagcctgctgcatgcaagaaaagacaattcagccattctttttctgaaactataatttctccaatgtttttatctcaaaatagtcaatataccaatttggcatatttgaggaccatacatcctttacttcttcagctcacaaacctagacttcagactgagcagttggcaactggcatttagatttagcaggaaccaaaactcaaataccacctgacttcctgaatggtcttactcttattagtttctttattgtactagacctgagcatcagaaggaagattacacatgtatatgcatattacacattttctgaaaccttttattcagagaggaaatagcttatctctctcacattagtttggaaaatacagggaggtaatcttattgctcctacctgagccagattcctaccccttaaataatgactccatccagggagatgaatttctatgaggacaccagctacagtgtaggaaatgagaggcagttcttcaaaaaaagtgagatagcaaacctatgactgctagagtgatcttgggctgggtaaccaagctaagtggatctactccaaataaaacactgtttgaatttatttcactcaactatagtcctagggtcagtgaaaaggttttcaggtgtttaatcattctttcttctgtctaggtctcatttcaagagcaatatttgtattgtcttagtggttttcctctttatttcttgtatttctttttgttatatttaagacaattttttcaaagtttattgccagttgacttttaaatttattttgttctggaaatgccattttgctgaagaattaacagtgaacattaagtccttcagagcatttggtgtggtttctttaatctctaccatatttttaattatccccttttccctgttgttgcttaattatgacttttttctttgtgattatttttgtctgtttttgacaaacctttcaatttgtctgtctacacttttcaaagagcggcttttgattttgttgatgttatctcttattattttaataactttaattttgcttctcattcatcatatattaattatttctaccttttctattctgtagaaaagagcgtcttcaatttaattctaatatatttattttaaatttcgctttaaaaaatgcatctgaaattacaaatttttattaataatggcttcagcttccttcaacaaatataatatgaattccttcatttggattaattctgagcactgaactctgagcttttcttcctgctcaaattcctttctaatggcctgggtaaagtcaagcctacacgccttaacatcttgttaaatagggcttttttgaggcctgtttgaagcccagtatactgtggcttactttccaacctgactctagcatagcgtcacatgacagataacagaccctttatcttaacctaagcatttgtttttactgagtccaactatttagacaaagcttaactctttcaaccaattgctaactaaaaaatcccaaaacccacctatgacttataaggctctacttgaagatgtcctgccatcttgggccaaaccaatatgtatctcccatgtactggtttattatattacctgaaattcctgtctccctgaaatgtataaaaccaaactgtaacctgatcgcctcaggcacacttttacaagatttctgagactgtatttccccagcatgtggttactctcatgggctcagaataaatctctttaaatattttggcagagtttcctttttctctctcttttttttttgttttgtttgtcaccagttccaaacttgtaatttattttgtgtttttttcttttagcttccaaacttttttttaaacctttggtgtaatttttagtttctaatttaattgcatcatcgtcataaaatgtggcctttataacacttctttgtcatttcttgaaacttattttgtggcttatcacatacttcacatatatttgatgatactatatatttggcaaatactgttttccattttagatcaagctttattttttgaaggggtggtaaaatgttgtatatctttccttttttgcattatctatcattctgatggacttgtattacaatcttccccattatttgggaaaataatttatttttatactcatgataacttttaaaatattttaaaacgtcatttgtctttacatataaatttattagttataccttgtggctagagtattccctttattattctttagtaatagactctagtaatttcttttctgtaattatttttttctgacactgatactattctacaagcttcttaggaattagcatttaatgattttattcctttattttcactcttgaatattttgggaattttgttattgtttctgcttgtttttaatgtttctcttgtaaattgcacatagttgtattctttattatttaaactattttagttgtttcttacttttaattgttaagtatatcccattggtgggggggggggggtggggggtggggggatgtgacagagagagagatatatatttctgtattggtattgccataacaataacttgtattttctgctaatcttgttttatttgcttctttttaacttatttcctgaattttgcttaagataagatttagattaggttagggttagaattagagttagggtttggattcagcattttgtctttgattttaactaaatcaactttgattaaaaattactgaatttttgcctgggcacggtggctcatgcccgtaatcccagcactttgggaggccaaggtaggtggatcacaaggccaggagatcaagaccatccttgccaacatggtgaaactccgtctctactaaaaatacaaaaattagccaggcacggtggcatgtgcctgtaatcccagctactcaggaggctgaggcaggagaatcacctgaacccaggaggcagaggttgcaatgagcccagatcaggccactgcactccagcccgggtgacagagtgagactcggcctcaaaaaaaaaaaaaccaaaaaaattactgattttttaaatatttgtgctcaccattatatattttgaccaatgctatacttaggattttactttttcatggtgaaatacaaacattaatacttctttccataagatatttaaacatttgtattcattaaatgaaaatgcattcaatccaaagtgatatttaactaaagcatagaattttaggttgaggttttttcccccggtacaatgaggacattatcccactggttctaatatctacttaaaaaattaattgaaatgtctttaaaatattttaaataggtaatctgtcatttttcacttgtaggtaaatatctcttcgtccataatatcccacatttttcattacactctgtttaggtgcagttttatttttatgcattatactcaatatttggagcgcaattttagtcttgatattatatttttcttcaattctggcaaagtttcagccattacacctttggatactgctgttctgactgtctttacattatcttcttttggaatgcttataaaacatatattggaatatgtaactccacccccaccctcaagtctcttaatggtttacatgcttttatctttcaatctctgtgtctacaatctagctaaattttccagattgtgatattccaatccactcactttcttttcaactttgtctagaatagagtacatcctatctatagagccctatttcttcaatgactaacattttaattctcttggatttctcaagtcattttagattgtgtttgtttcatttcttttttatttaatgagtaatagctctttattcaaatctttgagactcacactttcaaatctttgagactcacactttaaaatctttttcagtctttcataattttaatctatacagatcacttttatcttccaattattgactatattagctttagatctccttgcatgttatggaaaatttttggtagcttcttttgagtaagtaaaaggtctgatcatctcttttaactccctttatttcttttcctctttctttgtgcttacccttccataactttcagtattgtaactatctcctttgccccaggtctcccaggcccctagttccagggtgacctaggataggctttacgtttaatgtagatgaaatctgccctctggttttgaaaccacagatccagtcactgagtgtgctacttggtaaaggtccaggtggcaagactgtgtgttaactccagagtccttaaatgtatagattaacaaaaattgtagcttcaaacaacattagccggcaacttttgtcagcttcattttgtcaggaaatcttaccccagccatggttttagcagtaagttgatgtttatcttccatctgacacaaagctcttttagtctctttattattccacacaagctgaatgaccagtctgcttccaaacccaaaacccagagcctatgttttcatccctattctctattttgtgtttctgttctgtttttacttagtgcatagtatgcctgtcatcctgtcctcaaactcttcaaggcctcatacttttaaaaatcgttttttagcctcactctgtctttgagacatggtacagcttagtgactctaaagccacatggccttaaatcctggccatttcttttttaactgtgtgaactgtaggcaacttaattaagctttctgtggctcaatttcctcattcataaaatggaggtgatcacctattccatcatagttttgggtttttttttttttttttttttggtttcctgatatatgtatatatctgtatacaaatgcttggaaccctgagtgacacatagtaattacccaattagtgttagctattactagtttttaattgtctcatttcataggtattttttaagaccatcttgaccagggtccttccataaattatttaattcttctagaatatatttagttttatattatgaggtagaatcacagtttgactcatcatatagttgtgagagtcagctgtgacattatttacaggtatgttataagtgataaagaattatgcaaatgtacgattttgtgtcttatgatcacaaaaacatttttttctgagttttagctcatttaaatttctatatttgtgaaaaaattcttttaaattacatacaatcaacattgattactttctactttctttatatttattcattcaattagtgatttaaaatcaaatacctaacatgtagcaggaactgtgctgggtgctagagattcagtgttacagaaagagctccagacctaaatggaaacttctttgagagctttccatgcaaacacatttagtaccttcccattctcagtttcagtacttgtaccagtgacatattttaaagtctcatgagactgggcacagtagctcatgcttataatcccagcacttcggcaggtcaaggtgggaggatcacatgaggccacaggtttgagaccagcctgagcaacatagcaagaccctgtctataaaaaaaatttaaaaattagctgggggtgttgacaaacacctgtagtttcaactacttgggaggctgacgtggaaggatcacctgagcccaggagtttgagattacaatattgaactgcagtccaccctgggcaacagaacaagatcctatctcaaaaataagatttaaaagtaaagtaaaataaaatgaattaaaagctcatgaaataaatagtaatatgtttggcaatgatatttgaataatatataactgttatctttgaggagtttaattatttgtagttattcacatttaaagtattaaaggattataaaaatacacaaaagctttaataaatgacgtaactccccatttaatcattgtacatgtgtattatatactttaatgtaaccacagtttggcataaatttttccatgttttacattggttctataattgttgttttaatggctttataattatttatctaagatattcatatagtcattctacaattatctattgaacatgaactatattttattctaggtcactagaatgtactgctaaacaaacaaaacaaagttccttcacttagtgtttacaacattctcatgtatacatagttgatgtaaaatcattcatttaatttttctagtatgcagtataactctttgacaacagaatattatatatattctattgttcagccttcaggaatcactgaagaaaggaaacaatgtcctgggcctaaaatgcttttattgttcagtaaattgactttccaaaagaaaaaggtatttatatatataacatacgtgtatatgaaacccagcaagttgaaccaagaaactacttagctgactcatcaggttgaaggttcaaactacaatcaaattggacctgagtcttccaaaataggttaatatcctatttcttttagagatgcaatataaagacatagggactttcatagaaaaaattatgttactatataatatttcttaacctgagcactagccccgtaatcctaaaagttaggataatgcccaagtttgaaatatttgttttaaaaaattatacaatgccataagatatgtttatattaaggaatactattggtttataaaatagtattttaattatttatttaaattattaatgacctcattaacattccagttttctccttttctttcttagttttaccatatataaatacatttggaacctctgtgcagagagatagtagttcagtctgcttgtctctctgcatctgttgataacaagtttacataacagttgcctcaagcagttttctgaacccaccacagcccaaggtttacttcttccatattagattattattgcaaatttcacttgtttccattttgtatttataaataatgctacattggttttttcataatacatttttctttaatttataataaagttcagaagtaatagtaaaagtttcagaagtttggacatttttgtgatacttgatacctattgctaaatttttctcttataaattctcagcagcctagatgaagctagattgatcttatgttattctactctctaatttattattaacttcatgtctatatggttttctcattataggatctttaatttggtggtgggaggcttaacagaggcaatcaggagtggtgactattcattttcatctcagctgtaccctttgtccacttggctaaattctactggcataattaaattcatttgagtcttatgaccacaaagcatttttttgggcttcggctcagttaatatttctatatttttgaaacaaattattttaaatcacatagagtcaacgttgattactcttcattccctttgtattcattcattcattcaattgtttattcaaagaccaaatgtctaacacgtagtaagaactatactggatgctggagatgcagtgttacaaaaacaatcatagctctcaatctgagctttctgcacatccaccttcagtagcttcccatcctcaggatcagtactactaccaatgataaccagaattgcattttagagatttccaaacctcttgagtcttgactttcattaagattgtcatgaaatctcacctatctttaaaaacattttctttgaaatatttcttaatttacgttaaatgccttaaactatagcttgactgtcataaattgtaggtaaaatgacttttccctaggttgtcaactaatctccttcccacatctctccatctccacatccctcaaaactcaaactacacagtttggattaacaacattctagtttattctgtctcgaggaaggagattggcagatggccctccaattttcctgaaatgggagaaagaagaaggatacagggcattagaatattctaagtattgattctggattctctgcctcttccattgctttctgtcttgtaagtgattcagacctatcagggttggaattaatattcacctgcaaaactgctttggaaggacttggaccaaaataaaacttttaggtaacctttgtggaagcattactcatctatcagcttaacaaatacttggttgagctctgctatgctccaaacactgtaatagacactgcatctgcctcactagctaactggatatatagttaagctgttcttccgttaccaagtatctttcagttctcaaatctaaatgcaaacttatttctattacttaaaatattaccatatttggctgggcgcagtggctcatacctgtaatcccagcactttgggaggccaaggtgggcagatcatgaggtcaggagatcaagaccatcctggctaacacagtgaaaccccgtctctactaaaaatacaaaaaattagccgggtgtggtggcaggcatctgtgtagtcccagctactcacgaggctgaggcaggagaatggcgttaacccgggagacggacattgcagtgagccaagattgtgccattgcactccagcttgggtgacagagcgagactccatctcaaaaaaaaaaaaaaaattttcatattcattttaccataatgcatactttgtcatggcttttaagtttctaaggcaatggaaaaagtctagctaaaggatgttagttattcaaaattgcttgaagttgctatgtactagtttattaatgaagcatttagcacagtacctggctcattaaaagcatttcataaatattgactcactttcatattatcaaactattgcacttgatcatttgacagcaatagaagtttcaagtattaaatgtaaaaatattaaaactatttacctactcattttcacacaataacaatgatgaaactattttttattttaagtatacttcctcaaattttaatattcaatgggataaagtatacttcaagattttctttaatccatagactccagacaatgaaagaacatcaagtccatccacctgcctgtggcaagaggtgcatccagattaaattccgataaaaacttacctactctgttcccaaaattgaaaaaaatttccattctgtgacttctctcagatcattgaaagcccttatatttggaaagaattctttctaatttctaacattaatattccttgccgatactgagaactgttctttccttttctgaaatgaaattcactgattcctcacaattcttataatacatgtttacatatttgagggcattccaagttctccatgttccttttaagtcataaaaaagattaagcatctcatttattagattggggacaaggctgttgtattactgtgccagtgacaacagttatagaattttaaaactaattgcattcattgcattactggtgtgtttagagaaaaacaatgagtccacttgaactgtaatacaggatgtactatttttacagaaagaatagaaatcaaggagtaagtgagaaaatatgtgagctagttcaaaatgataaggaaaattataggataattaaggtattaacattaacattttaaataacgtagggagaaaatgagaggatagtttttaagttgacattaaaaaatttgaactgcagctgaaagggaaactgtacatcaaatgggaaacagtatattgatgttttataaacataattgatgattttaatgtggccaatactcattcaatttgtgagtggacaaagaaattaaatgaccagaatgatgagaatgagtgaagactatgagttgctggggagcagaaacccctcttattcaccagcatatctccaatttctgtcacaaagtagatgctcaataaacatttcctgagagaccagcaggaggcgtgtagacagaccctgggctccaaactgaactgatgagcctgggccactgctactatgctgcaaaactatctctccccaccttccattgccatgtcacttgaatccattcacccttccttctgttttccttcccctttatccaattaccttcttccttgttccactacatgttaccaaagcaagcccaactatgttttctgagaattttgactaacagactacaataggcaccatttcattgccatcaacttcacctggtccctgtcattctacctgctatgcgatattcttctctcactgtgtccattttacttcctacctctttttgttttttctctatttgaggtataaattatcaatgctaactaactgtgagcataaaagctgagatatgcatgtggtataattttcccacattcacagtttttatgtgtcacatatatcatatgcattatatgatatatgtatatatatgcaaattatgagtgtacatgtttttgttttgttacatcttctaatgtagttaaaatgaaaatgcttgtctgaaacgttaactccaaaaatttagtgtaggattttatatattaagaatatcattttaataattttatgtccaaaataaagttattaacaactatttcttagtttagaggaatgtaatcttatggctgtaataaaactgtaacacttaccttttgtctataggttactatatgtatttgtatatatgtagtgtgtgtgtgtatatatatatgtgtgtgtgtgtgtatatatatatatatatatacatacatacacattttatttttgtttatcttatattttgaagggtcacatgatagcatcctgtgatgcctgtggggttacaaagctgtgggactttcggaagctgttaccaattgtgtccatcgatataggtccaagtcctggcaatgaggtgaattttgattcatcaggtaggatcatttttgtctaatgtttctgactaagccaataacattaatatttgttctgaaactattttgtttctccttaaatgtatgtatttctacgtaaatgtctgttcttaatattacattatattacattacattaagatatattttatcattacgtatagcatgtcatatgaaagaattatattcatatatttaaagtcagaaataatataggtgataatgtgtactaatctagatagcataggtttgttagcagtgccatgcaaaatattcaaacctccattcctcagaatcatcatccaaggtaagcaaattcgattttctaaaggcaaaatagctaacagtagagaagaacaaaagtttagcaaaaatgaacctgaaatatttttagtgtaataatttaatgttaaaaatttaatgaattaccccatattgtgtagagtttacaactaatttgagataaacatttatcttattgttgcaattatgtgctgtgcattctataatgttattatatttagtttttattccacaatgatataagtattatcaattagataaaatattttatccttgttgatgaggaatagtgtagcagctgattttatgaaccacacaataattccagttgtccatttataaggttaaaaatacagttgcatctgcatctttaatgatagagtttactaaataatgtatatatgttattgaataatatattttttctttgctattgtgatacatgttttaaactattttaagttttgagaatattttgaatctttgagcattatttgtggtaaatcaaagttgtggcgatagcaaaaacttgattttaggtgaagaagtaaagaacaaataagaagaaaatattttattgttttaagatagtccacgtttattctttagtccagaaagtatgaatataccaggagtaattctagagccagaagataattgtgtgtttcttgggactggtttcataatattgccatcacatatctgaaatttagaaaatggtaagtttgtcttcttaacaaactttaagttatgttcccattacagattggcatatgaaccacactagtaacaatggcttctttaaaaatgttttagtaatattcttgttaagacatttatggtctgccagaattaaaaaaagaaaacactcttcaaaatagaagtctcaactatgggaatttcatcttatattgcaaaagcctattaaagggtcaatttatagtttttggcatatataatctacattgacaccatagctctaaaggaactcttacagctttcacttgattttcataaacatttcacatccttaaatccctttttattatcttgagctagcattcaagtattcatgtctttgaattttgaactccgaaatttcaaaattttgtctgtacttcctaatagtagaagttaaaaggtgctttgaaatatcattacaattaataatagccatgtattttattgtcattaaatatgttgccacttgctctttgccatccttgtcatccagcccaaaagttatttgcatacttagataaacatgattttaaataaattacagtacctatcttctgtcatacaggtcagtgtgattttaaggcccttggtacatcaaacctatttttttctctccatgactgatatatacttggtgatacactaatattaagaaaagcataagaatcagcagtagaacagcaagaaacatcaaagacaacacgtatgaacgagggactctaatgaaaacactttatcagtctgaaggaatatgatttcaacctgaccttcccatccctttgaccatttctttaaggaacataccataataaattttagttccatgtgtgtgagaaattactgtcataaggattttctcattgaataatgagaaatctgtgcttctgtacaagacaagtcctcaatgactcttcatttaaaaggttgaattatatcaaaaattgaagaaactggggaaaacaaacataaaatctaatgagagaatgaagaaagaggtgaaagtcacaaagttaagtgctagaaattatgttcatctcaagagagtaaagaagagtgcaaattaagagccaaacaaaattgaaataaggatggggcacataggtctcttctagttgcatttattcaggaaaaaaaatgatttaaagagaagtgtaacaaaattgtatcatgaaaatatgagaataaaataaaatctaatttagtaatctcaaaatacacattcatttgaatatacctttatttattcccagtggcaagccaatacaagcctatatgatgtaatctttttcaaaaaaagcaagaatataattgaccctattggcaataatgaacatgtattgagggctcacattagttatgtctaaccattttttctagtcaaaactctgtgacagaactaaattgtgcagttatatacacctagcgtgttatttgtcacaacttatataatgtgaggccaggcaatggtctgctgtctccgctgtgctcttggactattgaaaacacacatgtaatgtcatcataatgttatgtaacacatgtggaattataaatagcatcctgtctgagatatttcatataaggaatgtgggtggttattagatactttaagtggccattacataaaagttgctaataatatttaatgtctctagatcagtttaatttaagggtgtctcaaggttgtgaggtgtactgtttaaaaagagttattttcttatgaaatgacagatctttataaataagggatttcttatcactgcaaatccaacacagtataggaataaattgaaagtagaggtcattaaaaggctgaaactgttatctataatcttaaatttcaaattttgatgtataacaaaattttctctatttattaacctcataagtaaatattgcttttgtggatttataaaagtatatatgtactaataaatagtaccttatctgtcttaaaatagagattattcacagagtatcatttttaaaatgtagctttggcaaaaatgttggaaaaccaaaggtgaagaaaaagaatatagactatatatttcagacccttaggtttaatcacatgttcagcaccttttagactttaggcacattacctatttctcctcatggaaataatggaagagacaattgccttgcagtgttctaacgtggactcaaagggataatgatattctctaataaggaactcagcatcttcatctactgtagggaccaaccccacaaggtcggtgggtctctccctgtgtgcggcgacgagagagtgtagaaataaagacacaagacaaggagataaaagaaaagacagctgggccccagggaccactaccaccaatgcgcggagaccagtagtggccccgaatgtctggctgtgctgttatttattggatacaaagcaaaaggggcagggtaaagagtgtgagtcatctccaatgataggtaaggtcacgtgggtcacgtgtccactggacagggggcccttccctgcctggcagccaaggcagagagggagaggagacagagagaaagacagcttatgccattatttctgcatatcagagacttttagtactttcactaattgactactgctatctagaaggcagagccaggtatacaggatggaacatgaaggcggactaggagcttgaccactgaagcacagcatcacagggagatggttaggcctccggataactgcgggcaagcctgactagtgtcaggccctccacaagaggtggaggagcagtcttctctaaactgccccggggaaagggagcctccctttcccggtctgctaagtagtgggtgttgttccttgacacatttcgctaccgctagaccacggtccgcctggcaatgggtgtcttcccagacgctggcatcactactagaccaaggagtcctctggtggccctgtccaggcataacagaaggctcgcactcttgtcttctggtcacttctcactgtgtcccctcagctcctatctctgtatggcctggtttttcctaggtcatgattatagagtgaggattattataatattggaataaagaataattgctacaaactaatgattattgatattcatatataatcatatctaagatctatatctggtataactattcttgttttatattttattattctggaacagctcgtgtccttggtctcttgcctcggcgcctgggtggcttgccacccacagtctaccatgttttatcctagtgctgaaggggtctgagaggtcaactcattccttttagggatgagagaaattaaacatattggtgcacaagaaagatgcttgaggctgggtgccactgtagaagttttctagggaaagcataagtattaataaacaaataataaaagaaacaaggatcaaaacctcacttttatgtaatattaaaaattgcttaatcagtaaagttatatgtaatgcgatatatacatatatattttaagtcaagatataaacatataggaatcaccccctagagtttagcttttcctgttgctgtaaaaaatcagcctctcatacatttaaaaagttgtatgtggcacagcattatttacataatgttttattatcaaatacattgcttgtgacaaacacagatacatgtgtatagtagtatatatttatatcccaagtatttgtgaagggataagtgctcctttctcattaaacagaaagcctcctggtaatataatgctacacatttttgtgaacattcactacctaaataatgtctctcacctggcctactcaaaatgccatatgtttgatcattcaaaaatttattgctatttcagaaaatgttaaatggaattgcgtagtgaaagtaataaaaatgaaccatgagaatttatatacatacttttccacgtctctcatttcaccatgtttatgtagtttagcaatatttttctctcctttgtaaaactaattccaggaaatttgcaaagaagtcacatcctaagtcctaagaaaatgcagaagctgaagtttgagccagatgggcactttccagtagaaagcttatcagtatcagatcattaaaatgagcaaagtttcccaacattatgttctccacaatcggaaccacaatagaaatcccaaaatgggacgaaaatatgactccattcaaaatgcaaaaagtatcagaccccccccccccattttttcataacctaacaagataactctaaaacccttggttcatatttgattcatcagtttcttctagaaaaatctacagttcatcattttttatttaataggaaatttgcagttaattccctctgatagaagcagtatagtgtaagggagagaacatttatttagaagttagaagcccaagttttgaattttctctccactagttactagcaaaatgatcctgacaaaatttccaaatatttctgagcctcagattttttttgtatttaaaatgataaaaatctgtagggacttctactaccagacaagatgttgtaacaaagaccaaccagatttattcctaacctaaaacgattgaaagaaacaaaaatgtatgtacatatatgaaacaagggctttcagacatgtaatatttggcaataaaaaactgtaatacctgagagagagaaagtaaacaaggtgagccctatgactgctccagaatatagcctggagaaagtttctaggtttcaactcagggatgaagggacttttggctaattcccagagttgaagagccagtgggtagtccaggaaggccaaggcagcttgagtttgcagggcagggtacaggagagttatgagccacacacagagaactggagatctgcagagtcccctccagtcttcagctggctaagagtgaatacatgaaagcctgaggccagaaaaaaatctatcttaagcattagaaggaaaatcccaggagctcacacaggcctggaaataatttgtgttcgcaccaacaagaatgggaaaaccttacaattcaaaaagacagcaggttggcaaactactgcccatgggccagcttggcctcttttcatatatggagctttattggaacacaacctcgcttatttatttacatattctctaaggctgttttcaaactacaacagcaaggttgagcatttgcagcagagatatatggcctgcaaagtctaaaagatttacttttttttttttaaagacggggtcctatgatgttgcccagtctggtctggaactcctgggtgcaagcaatcttcctgcctcagcctcctgagaagctaggaagacagacacgtgacaccatgcctgagggtagcctaaaatatttactatcttgctctttacataaaaataaaattgctgagttagagtgctcagaagaatatcgcctccatagtgaagcaacattaactcacacctctggatcttgtcctacactaaagtcttttgaaccaccgtgttggctcatgtattcacctatttaattctcaccccaactcaatgagattgttactcttgcccctgttttatagttgagaaaactgagagacaaagcattaacaggcccactgtcacctagctgattaaatgtggagttgaaattcaaatccagagtctaaatccagagactaaaatctgtaagtttatgttattctgactcttattctaataattgtatttggctttatattgatacatggcatctgttaggagaaatgattcatttgctatgaatattgaaatagtcccattaatgacacttagtgatagttgactcaaagctaagacatggaatcctgttattgacattagttttcaattagttgcctctggaagaaaacactaaaagagaatctccctagtattatcttccaggtttctgataggtcttatgtgcaagaggcattctcattacatctgttttcctcctgggagctagaactccaaccttacactgcagtgtaaattcctattcaaggaattagggctgaatttagttgtcaccacaactcaaaatgagattgttattcttgcttctgttttatagttgagaaaactgagagacaaagacagccagcacctccagagcacttttttgtcttttatttaaggcctggtctgcttaaaaataattattaaaaactgaaataggaaaagaagaaagtggactgggccaggcatggtggctcacacctgtaatccgagtactttgggaggttgaggagagaggatctcttggccaggagtttaagactagcctggacaacatagcaagatttgatttctacagaacattttaaaaataggcagatatggtaggacaacagtagtcccagctactcaggaggctgaggtgggaggatccctgagcccaggttgcagcaagaggatggctgagcccaggttgcagtcaactatagtcctgcccctgtactctaacctggatgagtgaatgagaccttgtctctaaaaaacaaacaaacagacaaaaaataatttaaaaagaagaagaaagcaggccaacttgttttatctctaaagcataaggcagatccaaactaagatgttcttccgaagaacaagcccattctaccacatctggacacagagctgtaagaggagaggataaaatacaagagagaaaaggtgaccaggtggtccttctgaattattttacaatcccattatttcattacctgttgagtgaccctattgtatatgcaaatccattttgttcttaagtagaatttgggcctcactgattctggagaaaggaactggagaaactgaaggatgtcagactatgtggctctttggatgcacaagtctatgactaatacctggaatgaggtatgctatgctccaggaatcatgcttcctttttcaatcaccgcagcacatgagttgggtttccttcctcccattttaaagttttaagagatttaattacatgtgtatattaataaatacacatgttcttacagttctgtaaaagtcagaattgcatttcattaaaatgtaattttaatgtaatgtaaattaggaactgtacagtaaaaaaaactgttatgctttatctggaaatttaactatttttctctttgattttgtcttcttatcccctaggctagaagcaattttatttatctgccagcaagtatggaaaataacatattaataataatggggacaccttgaaaactttaactaaaaacaaccaaaaatatattaatttagggataatagtcatagttgtgcagttttataaccataaacctgttctgatttgtataatgtccattctgattggttggtgatcatgtcatatcagttattaaatatttagactatcctaatgatgactcataaattatgataactaaaatgcatttcaattgcatgatttatgatagattaatataaattaaagttattgacttctacaaaatataatttattcaggaaacgaagtcttgttcctttctgatatcaggcttgaaagattgtatacttaatctaatgataacatcattgcacaaattatgaatcctcccttttgtaattgtcttcacaactttaagcacaatgttttaaggttccccaatacccacaaatcttttctctgagtctagactgaattttcagaaacatcgagaaattattcatgtctccatcagaaaaggacatttgaatcaggaacaaacgagggtctaaacagtaaaattgttgttcatctgtgatttgtaatatgaaattgagtaggacacttaacctctcttgacctcaactttatcatgaataaaatacaggttttgattaggtgacgttatcaattaggttcacagcctaagttttaaacaattgcattttttcctatgtttagaataattagaacatgatatcctgagtcaaacataatattctaaaataaaatttaaatgctcctctatgctattttaaacttgaaaataaaacatcaaaatgtaagtaaaacattccacttttcctcgatccaaaacagaaataaaatttgatataaaaatattatttaaaaattgagccccaaacataaatggcagctgtattgctcagcaagactaaattgttattctcgcatacctcacaacacggtctctgtagcaacaggaattttgaacaaaaaaaatgcataaattccaacattttaataaattaaattaatgactggatcaaagtcttcttacaggactatataagaacctgactcattctgattaaatcagagccgaaaaataactttacaaattgcagcattatgcaggtgcagtcaaaggagtgtcattggttaattccttaatttggggtagtatttttaaaataggtatatttataatttttgtttagcgctctgatacagttacataaaagtataattgtaataatataattggaacgctataggtatagacaatcaaaaggtgcttggaaatattttcctacttaaatacctccttggaaattgtttacaaagcaactatataacgatgcacacagttatataaaaacaattttaatctagcacatgcccaaataatgatgaattctaaattagtgtaatcatatttagtgaagatatatgtatataaacaatgtgctaatgccaaattatttttcaacacatttaagaaattcaaaagatttgtatctatgtggcaagtatgagaaattagttgcgtaactatacacatcttagtatcatctaggcaagaaactactccagtgcatataattagctatgctggtatgtttgcagatataataaaaattacatgtataggctggcataggtcattttgaaacatgaaaagatgacattcttcatacatactttaatcaatagaaataaatttatacaaagaaagaagagataattagaccttttacttttttcctaaggagcagttattacatttaagaggaatgtgttatttagatctaatagcatatactagtcattagattgaaaatcaagagttaaaatttgcagtgcacacatactgcatgacccaaagtcaagtagctcaagaatttgtcatctttttaatagactgtgtatacaaaattgaatagataatcatctttagtctgccaagctgatactttttaataggataatcctttaagggaagctgtagttcaacagatgtgcaaatcaacccagaacaaatagcacactactcttggagatagagcctgcacagttggcacttgtgataacttgtagttatatttatctaaaattgaatttcaaactatattcaaatatgatttactcaaatctgattgaactcagaagtatattttctcacttgttctataagagaagtgtaaataaaaattgtttaaagtcatcttcatgtaacatctcctaccatgcactctatcaccaatagaaaaaataattgaaaggaataaatagcatattgttattatgaaaatcaatactctgtaaatattttgaaataatgataagcatctttgaataatagacatacatttcagaccatgtcttctatccaaaaatgttatcattccctctcttatatatctgttggtctaacagtgagaattatgttaattcggttgacaaatatttaatgtaagcctactatatgccaggcactgttctaaattctaggattcagtgttaaagagatagaaaatactctatttacaaagcaaattgaaacaatagacatgaatttgcaggtaatgactaggagtattgcaaacaaactgttccacatgttatatgctacatgtgtcatctgagtgctgtttgtaaagaatagcatgtatttgaaggtggagaaaaaagatgggcattcctataatattagctatataaccacctaattctcttctaatggactcaattaaattaatggactcagtaattagtgtaagttttgattattactgcttttttgttttatcctttatgcctttcataatatttgatttttttcttgtatttatactactttaggtaccatttttccttatccaaatttggttgtaacagtggatccttctgctacttgtgcttattttccttctacttcttttgctgttcttactcccccttagctcctttctctgtaatcatttttatcatccttttttttctttttcatcaggtacaaataactgaattaatcatacttctcagtatgtgataaacttattaatctccttttatgtgccgttcctactttcattctttcccattctccatggaagtttttaaatgtctttaatatgttctcttagatctgcagatatccttgaagaacgtatatatagagaaaattattctgtgtatgtacgtatgtaagtttctaaaaactatgttttgctatgcattccattcaatttcttgctttttcattttacagcatgttcttacattttacccacattaatatatgcctatcaatttaatcaattctgtctacttgatagtatttcatattattcatcttactattttatttatccattgctgtaatgatggatgcataattttcctataagccccttgctacctaaaggcattctgcactaaacatttttctcaaacagaagtttactgatttcatctagaatgtcttttattaaattgaaatatttagattatattgagtcaattgttcagctcccacttataagtgagaacatgaagtgtttggttttctgttcctgcattagtttgctgaagataatggcttccagctccatccatgtttctgcaaataacatgatcttgttcctttctatggctgcatagtattccatggtggagatgtacaacattttctttatccagtctattattgatgggcaattagattgatttcatgtttttgctattgtgaatagtgctgcaatgcatatatgtatatatgtatctttgtaatagaatgatttatattcctttggatatatacccagtaatgggattgctgaatcaaatggtatttcaggttctggatctctgagaaacttccacatcatcttccacaatggttgaacttatttacattcccaccaacagtgtaaaagcattcttatttctacacaacctcaccagcatctgttgtttcttgacattttaataattgccattctaactggcatgagatggtatgtcattgtggttttgatttgcctttctctaatgatcagtgatgttgagctttttctcacatgtttgttggtggcatgactgtcttttttgggaagtgtctgttggacagtgagagcacatggacacagggaggggaataacacacactggggcctgtagaggggtggggttgatgggtagagagagcattaggaaaaatagctaacccacgctgggcttaatacctaggtgatgggttgataggtacagcaaaccaccatggcacacttttacctgtgtaacaaacctgcacattatgcacatgtactccagaacttaaaataaaaataactttaaaaataaatttaaaaaatttttaaaaaattaaagagtcaaaactattttgtttgtctttgtatttttttggaggagggattgctgaagaatatcaaccctgctgttaggtcacaaaaatattcttctcttctagcatctttctcttttagctttacgttggtagcttttacattttaggtctttaatccgaggtgcaagggagtgttatcagtccatttttcctgcaacaacaaagaaacccaggatcttcctgacttatagaagcatttgtttctcgttcccttatcagaaagcttcaggacagttcaaggctgacttgctttcctgggctcagcctaatgccatgtgtctgatttcagatcccaggaccttttggtgggacatgtcctcatagaatgagcaggtcaaatgaaaaaccaaacttgtgcaatcacatttaaatcttttttgagatgtcacaaattttaagtctgtttaacattccattgaccataagaaggtcatagcaagttataaaccaagtacaaaaccactgagatggggacatatatcctattactacagatatcaaagacaagtttcatggtaataggtggagatttttaaccctattacagggaagaagtaagtactgggaacaataatgactatagagggagattcaactttatttctctttctaataagtcagttttcttaacaccaccaactctactattgaaacttgtctcgttgatttgtgatgccacttttattagagatcaacttcaaaccaatagacacatcattttctgaattttcctttctaatatgctggtaacattgcctgtttctgatctagcacaatactgtttttgttgccgtgatgttctagtattgtctgcttaatatctaaatgaagccacactctttgtacttctttttaaaaagtatccattgagttttctatttcttgagacttttggagttatcccttttaaaatttcaaactgtatttcaatctgttagagaacatgatctgcattaagttcatcttctatgcaaatatagacaatttgttcactgccccttgtttaggcaaaaaatgcatttctgtgcagcaattggttgattcaaaaaatttatagaactttcaatttagcttattaactagttattcaaataatttatacaatttattttttgactgcttgagatctcagtttctgacatgcatatattaaaatccttaaccacaaatggtaactaatttatccatataaatctgtcagttttcactgtatgtattttgaggctatgtttccagatacatatatatgaataatcattatacattcttgatcttttttccctttgtcaaatataacatctctttcatgtgattttgccttaagttctattttatctcacattaaagttggcaaacctttttatgtcatattttccaagtaatcttttccatacctttactttccatacctttttatggcaatttgtttttatttatttttgtttttctccccaatctgatatttatatttttgagatggttaatttactcataatagttgcattgtttcctacatcagtatgcttgcttagaaaaatttttgtattggtcagtattctccagataaacagaaccaatatgtgtgtgtatatataagaatgtatgtgtatgtatatatgtgtgtgtgtgtgtgtgtctgtgtatatgtgtgtgtgtatatatatatacacacacatatatacatatatatatacacacatatatacatatatatatagagagagagagagaaagagagagagaggaaaagatttattttaaggaattagcttatgtgattgcgggggctggcaattgtgaattcacaggttaggcaaacagtctagaggctcagaaaaacttgatattgcagctcgagtccacaggtagtatagaagcagaattccttctttcttgagggccttagtctttctttattaacgctttcaactgattggatgaaatcattggattggatgaggcccactcacattatggagggtaatctgctttacccaaagtctgtgagttcaagtactaatcacgtctttaaaaaaaatacctgtacagcattatctacactagtgtttgaccaaataccgggtaccatatgtacaatggcctatccaaattgacatataaaattaaccctcacaatgctacattgtgattgtcttgaccttgtctttcccttgatgatcttatttctttcaggaaatatttactatgccctattctagacagtaaaaatagagcaatgaaaaaatatatctgctctcatagaacttacattctacttgagaaagaaggttcagtgaatgggaggtggatgataaatagctaccgaaattaatgccaacatatttgccaagtggtgataagtcttatgaaaaattaagacaagttaagagaacaaagagtgatgaagtggaatattactttagaaaggatgttctgagattacttctctatgaagtgatacacatgagcagacacctggatgaattgagggaatcagtcaaatggttatcagcaggaagagcattccagaaaaaaaacagcagtgcaaaagatttaaatctaaattatgctttttgtgagtgagattggataaggaaaactatgagagatggatcaaagtgttagccaagggcagattatggatggtcttgactgtggcaccaacgctggtctttattctaaaaagaagaaataattataagttagctcaattttttaaatgcatgtacatttgatggggtataggtaaattaaaatcttgccaagagaccaacacatgcaacttaaaagagagctaatatatttgatctcaaataaaagaacaaccaatgaatttgtctgctattaattatggatgatcaatccacagcaaatcattcctatttatgtctaaagacatggtgggacttaaatcagagacttaacagtataaaatggtgtagaaatttaaatgctccggacactgctaagagacagcaattaataatatcatgtaatgaaaaattttgtaaactactcttatattcttgtataagggctattagatgttctgctgaggaggagatagttcatgagtttgctactttctagttccacatcaatggataatttctccctctttactgtatggaaatttataatatgtagacattttgatgttgataacatttagaagtgtttaatttttagtattatcagcctgacagacataagttttattaaattagtttgagaatctctttgaagatatttgcatctgcataagtttgcatgaaaaaaaagtttgcattttagggggaaaactattatatcagtgagaattttggagtattttgcttattctttctggaactttgaagtaatgtgaaatagtgtttagaaacctcatctcaacgtagggggcttcttagtaataatacactgtatctgcatacccgtttataggttttaatccaattcattccaccaacatatcttctaatgcttagtcctgttgtcttctcatgatcaaaaatgaccccttttaaaaatgctttgcatcaccatcctttttttttttttttttttttttttttttttttttttgccaaaattgacatccagtttgttttaagacagtttcattaggtcatatgtctagatttgttacctccattcttcctctgcctgggcctaaactattctataatttttctctgtccccactgccccccacccccttgaaatcatagtcaacaattaaactttgctacttataagaaagacttgacctggctttgggacagccaactgagcataaagtggtgaatatgctgttgagagtagtgcttataaccccatcatatgtcagtcaaccagattagcatactgctccactattttcattaatgaaggcagaatttgtgttaagaaagccatatttgctacaattcaaagtcaattagctttctcgtgaaaaaatgagtttctcatttaggtgcttaatgttaaaataaagagggcattgttcatattaattataaaataattcaaaaagacatctctagacaccaatcaggaaaagataatcactgaagattatctgaaaataaattaaatgtctaagcataagtcttgttcaaatataatatctcaaatccatgcaatggaataccatgtgactattaaaatgtcataaatgtgcatataatgaaatataaagatagattttcatagtacatagtgaaaacaaaggcagtggaaaaatgggatataggatgtaacttcacaataatcatctagatagagaggtatatagacaggatgctgtgctgctcattctccattggccccattcctccactcatccattctatgttcttctctgccttcctctattccctgggaggctgacttgcctattgacttgtgtttggaattgacgaatgggaggcacttacaggagagtgaagggcaggaagagagggagattggagcatctactccctccacgcccccgggctcgggtgcacttgcacagtggctgcattactctccagctacagctcccatcaggccgacttactcctgagactggttctcagccaggctcctgttaggccattttctctcctcaagcctagtgtcagtaacaactcttcactgcttctaatttacatatgtatttccttaatttattcctctatctttaccccttggtaaatatttagtcccttcattaataagtctctttaaaacttccctctgagagtgggctctttgtttcctggcggggccctgaccgacacagttgctcataaaaggcctggcatgctaaccactacaatgtgcgtaggcattctctgagaagtgttttgccttttgttctaaattttctaaagtgaatatataacgagttttcaatattaagaaaatcaagtaaaaatgtttctgtacatgaaagagaaaaaatgaaaataaataatgctagtatgaaaccaagaagagctggtatctttttaacttgttttaattggccatattggtcttaaggacctcccacatctaacactaagtcttacccatctcctcccaaatgagttagaaagagaggaggagaagggcagatgaagaagactcagctgaagccaagtgaaagttagcatttatacctaatggaagttaataaagcttaactccttggacttcacatatgtctggaaggaagagattttccactctactgtcagggttaaaacacttacatagcataattctaactccggctctgtccctccttcctctctccctctatgaaagtggtatctatcttggtaactggtgtcattgaatagcctctacttgtgccgctctccttggaaaaacttgtcatctagtcacacaggttcttccatctattactgccagcagacagcaccagcagtggaggcctgagttaccacaatgctgccaataattaggtgggcatggttcattcactgtggggagtgttaggatgcccatgagccaacaaatttgtgttatgtgttcagcttggccttatcacattttagctgcattctgttctccctataaatcctgtgccttttcctgggggtggttccaaactggagaaggaaaggaaaggatactttactgatgttctcaaaacacagtaacatttagatcccttctatatgcccacaggaggcaatatttttttaaatgtgtatttttgttattctaaatgtcttataattactgcagtcatttttgaaaagaatatgaaacacatgtaaaagaaaaatcatgaaatcataaaagagttaattgtatactttttatgaaactataaaatcactatataatatatatttgataatataatgttttcagtctaattatatactttttttttttcattttagttatgtacagggacagtagaacagttaggaaccaaggtctccagagtgacactgactggttttgaatctagattctaccacttattcattctctaaccttgggcaaattccttaatttttcttttctttttctttttttctgttttcttttcttttttctttttctcttttttttttttttgagatagagtcttgctctgtcacccaggctaaagtgcagtggtgccatctgagctcactgcaactccgtctcccgaggtcaaaggattctcccacctcagccttctgaatagctgggattacaggcatgcaccaccacacccagctaatttttgtattttttttgtagagatggaaattcaccatattggccaggctgatctcaaactcctgacctcaagtgatctgcctgcctcagcctcccaaagtactggaattacaggtgtgagccactgcgcctagacagttccttaatttttctatgcttaagttttcgcctctgtaaaatgagaataacaaaatagtgcatgttgttttttgtgagccttaatgaaatattcatataaacatggtgaataaggcataagtctctgcccttattgtttacacagagaagcagaaaattaactacctctttctttctgtctctgtctcacacatgacacgcacgcacacacatgcacacacacacacattcataaatggtataagcaaaataaagccatgttaagtatacacagtgaaagagtggatagtcatattttagataagatgtgcaggaaaggcctctgagaaaaagcaactttcctaactgaggaagcaagtcatgcacaggtcttggcaagaacatttcaggctgaaagttccaggaggcagaccattagttaaaaaaatgttgcagaggtccacgtgattagagtggaatgaataaggaaattaagataacgctgaatcgattacctgagagcaaaggggaacaaaccccccgggtaggttccagactcagtatctgagaacttccaaaggatgtggtactattttacttaatggtgggaaactgtgacaaggtagcctgagcaagtgttgttacttcaaatgcagctatctcaccagcaggattttgtgtatggaatactacaattaaacattgaattaaatattttatgttgtttccaaaactaagtcattatgattgtgtatgatatatcccaatgttttctattaatggtttccagaaacaccatctttcttttgtaggttagaacattatcatatgaaataagatgccaagaaaagaacttgttatatcacgtaactcataatttgataatccttgagtattcataattaaattgaaaaagtcattatttcttggactataatagtatctgagatgtaaattaatgtatttatttgttactaaccaatataatttaattttataccactttaactccccattttgtgttaaaaaagaacacaatcataatttgactcctttattcaaaggaagtaaattgaaattcaaagtgttgcgcttaaaagtgagttggttagtgtttaactttcttttgagcacttctgtccccaaagccggtcagtactttgcattttggtcatttttcttttgctgagataatgagggtggggactctttacaactgcaggcaattgctttgagctccgagcactttgaagagattagccccattgatattctctccaatatttttggagagaaatgctgccttcccttgagtgtaagacgaacggctgttgaatagaaacttcttttgtctagcagagagtatggtaatacatattctcttcttagagacatatatacaacattagaaagttatctaagatgattgggagcctcactacactgacttgttaattttgtttaaactttcagttaaatgtggtctcatttacctggaaagtatccttaaagcgtttgagcctggattgtattgctattaagccagtgaacttggtgatgaacaagttaattatcctggggataaaaagggaaaacggcataatttctgccagcaatacagtgaaaaatatatgagtgaactatttggaggcctgcccactcagtaggacttagctggccagtaacctgatctctctggtttgagttcatcaaagacatttctttgatctaaaaatgttacagaatgctaaaattcagatgaagccatataaataatataaattttataccacttgactccacatgcattatgtttttgtttcagagaggttcagttagcaaaaatatcaattcaaatgacttttctgtcattaaaaaaatgccttttgtgggagagggatacacatacacttaggtgtgtatacatatacacacacacttaggtgtgtatacgtatacacacacacttaggtgtgtatacatatacacacacacttaggtgtgcgtacatatacatacacatataagatataaattaaaataaaattaattaaatatatatttaatttcattgctgcaattctacctagtgtctcacataaatacaagatcatcatctactgattagcttgctcctgcagacaatcggatagatactaaaacctcctgaaggtcatcataacctcattttctgaaagcatcccttgaagttcaatagcttagaaagtttctgttgcatttgtgtcccttgctgggttgtatatacataaaaagggatattactttcattcagagaagataataaaaccttgtgatttaggaaacagggttatcatcaaataagccttttatttatgctattcagactgcctatcttcaggatatcgcaagtactgatcaatttcaggtcaattggatgtgtgaaatagaagtgttgtggtataagctcatgattatgtcctgtagcttgaaacagtgaatttgattacatgacatgttgctgtaccctctttggtcttattgtctgcacacttcaaataatctacctgtgccaactctaacagcccatttcattctctaggaaataaccttgatataactctaaccatttcttcatggtgttagaaattataaactcataccaccttcatccttagaactttttaactctagtcccaatatcattatccaggattctgggcaggctgccatatagcactgtgatggataaatacaaatgggtgtgggatttgctgaagggtgtctaggctcagaaaattgccattgtgcctttacatccaagagcgcctcacaagattacaatattttgtgactccttaaccttggaaactagagtccatgagacttttctaagatcataacaactttcaggaaaggagataattttctgtacctcagaaaattctgaggtacaggtctggccacttttacttcaggccaccaccttagttacactggaccttaattatcatggcaaaaatgtgaagcatcaatttttgactcctttacattgaaatagatagtttatgggtgcttagactgtcaaagctctcctttatcagtgttcttttctctaatttacaaaatatattttgttgttttgttgcactttgctgagttatttatattccccttgtacagatgctagcatatcaataaatagtttatatattttataacatcacagaaaacatttattgagggcctttgactctagtcattatcattacttttcacaaacttgcaagatgatttctaagaaattctcattaaactcttttaaagtttaaattcgaacatattttctcagcaacttttctttgcttttaaagaactttggctccttgcactaacagaataccatcaaatcagttctactcctatgtagtaagacaaattttatctttttccatagaattgaataatttcatgatactagtttaagaataaggcttgaagatgctgatttgcaactgatactggtgcatcaagtatcataaaattccttaagaacaataaataagtaaacatatattttaagtgaaaagttattaatgtttttttctttttaaaatacattttattgtgtatatttgagatttacaacatgatgtatggggtacatatagataaatggttactatagtgaagcagatcaacatattcatcactttacgtaattacttttctgagacaagatcagctaaaatctacttatttaacaaaaatatctaacatagaattgcatctcatgttacacattagatctctgatttatcctgcatactttgttttttttttaaattttattattattatacttaaagttttaggttacatgtgcacaatgtgcaggttagttacatatgtatacatgtgccatgctggtgtgctgcacccattaactcgtcatttagcattaggtatatctcctaatgctatccctccccacttcccctaccccacaacagtccccagagtgtgatgttccccttcctgtgtccatgtgttctcattgttcaattcccacctatgagtgagaacatgcggtgtttggttttttgtccttgtgatagtttactgagaatgatgatttccaatttcatccatgtccctacaaaggacatgaactcatcacgttttatggctgcactgcatagtattccatggtgtatatgtgccacattttcttaatacagtctatcattgacggacatttgggttggttccaagtctttgctgttgtgaatagtgccgcaataaacatacgtgtgcatgtgtccttatagcagcatgatttatagtcctttgggtatatacccagtagtgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgaacattttttcatgtgttttttggctgcataaatgtcttcttttgagaagtgtctgttcatgtcccttgcccactgttggatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtcaattttggcttttgttgccgttgcttttggtgttttagacatgaagtccttgcccatgcctatgtcctgaatggtaatgcgtaggttttcttctagggtttttatggttttaggtctaacatttaagtctttaatccatcttgaattaatttttgtataaggtgtgaggaagggatccagtttcagctttctacatatggctagccagttttcccagcaccatttattaaatagggaatcctttccccgttgcttgtttttgtcaggtttgtcaaagatcagataattgtagatatgcggcgttatttctgagggctctgttctgttccattgatctatatctctgttttggtaccagtaccatgctgttttggttactgtagccttgtagtatagtatgaagtcaggaagaagttgaatctctgaatagaccaataacaggctctgaaattgtggcaataatcaatagcttaccaaccaaaaagagtccaggaccagatggattcacagacgaattctaccagagctacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatctgcagtaaaatactggcaagccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaatccttcatgctaaaaactctcaataaatacggtattgatgggacgtatctcaaaataataagagctatctatctatgacaaacccacagccaatatcatactgaatgggcaaaaactggaagcattccctttgaaaactggcacaagacagggatgccctctctcactactcctattcaacatagtgttggaagttctggccagggcaattagacaggagaaggaaataaagggtattcaattaggaaaagaggaagtcaaattgtccctgtttgcagatgacatgattgtatatctagaaaaccccattgtctcagcccaaaatctccttaagctgataagcaacttcaacaaagtctcaggatacaaaatcaatgtacaaaaatcacaagcattcttatacaccagtaacagacaaacagaaagccaaatcatgagtgaactcccattcacaattgcttcaaagagaataaaatacctaggaatccaacttacaagggacgtgaagagaagttattaatgttgaaacagttcagttaatgttgcctgcaggtattagtttaatgttaagtgctgaaagaaattaatgcaaaaattaatggcttaacatcatcaatatttacttctcactcacatcaatccaatgtgagaaggattctgtgccatacatacagtatttcagtagcccaggatggcaaaggctgttccattttcagtatttagcttcaaaggtcactctgggcataaacatctagccagtggacaggaaaagatagggaaagctttcttcatcacttttgcacgaatctaaaataaatattttccactactagggccagaggccctcaataaataaccacttcattcagttagcaagtactagttccataccctgcctagataaaaaggagactgagaactgtattccttggcatagtagccattttcgagccacaactctaccctgcagaagccagtctgaatcttcagtggagagtcaacctgtgtctacctgaacctgtaaattgttactttatcagctataattcttgggttgcagtcaacagaaattgattctgctatctctcctaagaaagaaatagattagaaggatatgatgcagtttgcagaattcgaaagaaggttaaattgaggaaccaggaataaagaaatatatatatatataaagaaatgtgtgtatatatatatataaagaaatgtatatatatatataaagaaatgtatatatataaagaaatgtgtatatatataaagaaatatatatataaagaaatatatatataaagaaatatatatatatgaatcagagaaattctgtgaataaaaggaattggattgatgaatgtggtcttctgagtactgtcaacatgagtacgtctcatctcaagatgagatggctctagccactttctgtccaggtgttattccattcaagatttgaattaaagaaaagaacatctgattagcagagcacttcctcttggctagtggagatcggggtatcttgattgacagtcctctaagattttacccaatgagacatgggaagacacctcaaagccaaaacaaaaaagagcaatgtcaaaagaaggggtgatagaggttaggttgatcaaacaatatatatgcttttaaaaaatcagttatttcagactacttttagtttaatacattaaaaagcaagaaaacagttcctggtcagaacagcaaggagaaaaaactgataaatcattataatcagtataaaattcttcttcctttttgttgtaatttgatggccttgaataaaattttgaatccttcagtagttaagtttctttatgtataaaggtgcagatgagagtactttgtcatatgaggcagtggtgtttggttgtggggaatgggagggaaacagcaatgagaattaatgtgttagccattttatatgttgtgatttacttggaatatcccataataaaaacatttttactgcttataaataaaattatactttgccaaggagctattataatatactaatttgtattccactgataaattcatcttttaatgtatggataccttcagattaaatacaggtttattaaaggcttttgttgatgacaatgtcctcaaatatagcatttaccaccatttcctgacaaataactatgtggtgaaatggatccaaatgaacaatatctaagtagataaatgttaagatactgtaaaggaaagaaacttctttttttaaaaaaaaaacaatattattgctagctagaggtgctatagatagtcatccataaaaataaatgccaggtttgaaaactacaggatatacctgtagaatatcataaaacttacaatgaaaaaaaatcctccaaacagatcttaatatgcccctcttatctgttcactctatcctgtagctgtagttttccaagtaggctactaagcggtctttcaaagatttattttaacaaatggctgctctgtctatgcacaaagaaaatgaaataaccctataattttgtgaatttttaaaggtaagctaacaaaaagattcctttcctgttcctttgattccaaagaatgtatagttgtatattattttcccttgggagctcggtaagacaatcttcccctgagtctttattcaagtatttcatataacaatagaagtacagtgatggtcaatttcttttaaaattttccatgtatgcttactctagagcaaattccactagtgcccttaagagtctctagtggaatttattgaatgtgtgtgtgtgtgtgttttatatatgtatctaaaaatagttctttggcaaaaaaatatgtgctatcaattttttaaaattacactggcttttctagactttattaacgtatctccggagccagaattttatgctaagctttttttaaaaaaatttctatttgtggtatatctatattcagttataattggggaaaaaccctcacttctggagtgctgatgaatatagaattatttaagaattaagattatttcaagaattatgtttggaataaatctcttaaacacaattctcagtatgtgagcttatgatatttatatgaaaactaaaaccatttttcttgccaatggatatgaaattattgtcctattagacacctagaccctatttcctgcagaaaggagcatcattcataccattgcctaagctcaaagtccctgaattttccttaacttctttttcttaacatatggaccattaccaaatgtatctattttgcttgcagaataggttcaaaatctaaccctttagatgaattgtctttaaaaagattgacttaatggtgacagttccattttttaaaattcttaatgggacctatggttctaccagcaattctctagtattccaggaattctcaggattttacatctttgctgtgactttcctgcttctgcctggcaaaccctgattcattctttaatattctattcaaatagtactttttctaatatcactccctcactttttctcccaactctattttttaggcgaaataaattcttttgtcatctttgtaagaattatgacagaaggtaggttttttgtgaaacaaaaatgcttcttatggaagttatatttgctttccgttgtacattgatgtgttacagaatggcttagtacttagcactgtagtttgctgagtatttatagtacctctgctagtatcaaattaacctaacaaacaatgaagttttataataattaataaaaaccataagtttgttcctataagtaaatattttatatgtcttaattatggagaaaagttcaaggtaaattttaagttaaaaaagcagaatatatatatacatatatatatatatacatatatatatatatatatggccagaattgttatatctaacttcacaaagtgtatgtatatatatatatatatatatatatatatatatatatatattcatactttatttgtacatataaactcaagtagatatatttgtgtttatatatattttcaaatacatttacacagaagaaactgagaggaaatataggtacttacttttattaacccaaattagcttatttttaaaatgtcattaaatctaaatatacctaactagggtattttgagaataaaacgttcttatttgactgaattatctttcttcagacaggagatatcagagttttgcaaacactgtgctatatttttataataaaccaatctaggaaattggaatgtaggagtttaatggttgctatattatgtagtttgtgaaataatgaaagtgagggtaatcaatgtgaaaaactgcatatataaaattagaaacagatgctaataaacaggtggttgaacaaaaaatactatggtactggttcagcacgcttgtgctgaggaaacatctggatgtgggtgttttactccaaagctagaacttgctaacaagaaataaaaacaagaaatttcttgagtgaatagagtgaatcaaaaagtgattttcaagatgatctttaagtctatattgcttttgaatgtctatagagtaatgaggctgattcacatgcaggaaaatatgtcgataacaaatatcataaatagagcacacgtgcacatacaactaagtttgttttgtagcacacccagtgttttgaaaaatattaaagtaatatttctaatttctattacccagtattcgaagctgaatttccttacaaaaacattttgatgatttttatcagaaagaaacatattttgaaaatgtatccttctgaaaatcttcctagaagtgtttattatatatagtatgcatgcaaataatatatagtttattatatatagcgtgtaaataaaagcccagttgttaccgtcatttagtagaaagcttatacaattttcttttgacgtatgaacatttcttttgcaaactaagatgacccactctacaatctacaatcactataaaactacaatacctgagtaatgaaaatattgccaaactctaatcacttctctacttttagaaatatttagtaacacaaaatttaagtgtataaaaccaaaacaaaatcatctagcctgtaggaatttgttgcaatagtatttgtttttcaccatttgccaaattagaaaagctggacctgtgatctaaaagatccaattctctggtcaatttttttatagcctgcattgtttccattgagttttatgctatcagttggtataattttttttttctgtttggccataatattgtaagcatacgaaatgggcaatatgtcaggaataattaggcactgtggtgctgaaaccccagcgtatatactgcttcttttatagaagaaaccagttacctgtagtcttgtcagtttaacttagcaaagaccatctgtttgcagccacctcttttctcagaggagcattccctcttccacaaagaattgctccatgacgtcaaaaacacttttctctacaaaatggtctctcctgtcttcatttctttctgttttctaaactgggttgctttttagagaatcagcaaatgtggcactagataacttaagaggtgaaataaaatgaatccgatagacagtgctctcaatagaatagatatgaatgtgcttagataaatgtatggctacaggaggctttcttgtggacaataactatccaaaaatatttacatgtatttgggagtctaggtttatttgcaacagtaagccaactggtatttgtcaattacatttaaatttaaatttaatttcaaatcatactgaacattatgagtggaaaataaatggttttatgtgcttagaatttaacagtttatatgtaatattatgttttggaaaaacatgtaaatggtgttagaatagttcagctattactaagccattctgggttagcagttattcaggaaaagactgtcaattttatataaaacctcttagataaatagtatgggtatatgcgaaattacacagataaataatattctgcatctttcatccctccttcccatttcatgacaaactactgttttactaaatatgacaatgtatattttaaaaccaccagaaattataatacctatatttcctgcaactggggagtaattcagagggaaactgggaacttacccagtggtgtatgcttgagtttatatgttttatacatatgttgagggaagaatgcggcaagcctgacatttctgcatatttcatggtatttagggaatttgtccagagcagagtggaaattttttgttctagccctctttgttcatatgttgccacagtgatctatgagttaacaattaatggctgtgatatttcagtgcaaaaggacagttgatcatcaaaataactcagatatatagtcctgttataatcattagaatagtatttagtatccaagtatttccaaaataaattcaataagctataaatagataataatttccatcttatttaattaccaacaaactttttctttgtagtcagtattcatccttcctttaaatgacaagttagtgccataaaaacaaggtagcattcaggaaagcaatatgcactgcactgatacagaataatcaccaaagtaagaaaaaggatgtatacttggagttaagacacctagacacatatttttataattaagtgcaaattgtaaattatttctttgcagtatgggctctgatagtggttccaggattagatttttcttatacctaaagaatattttcggaataattaacaactcatattgaatctgaaagttctcacattgggctagatgcaacgtgacctttaatctttacctagtttaaactcatgccaaaccaacctgggatcattttgggccttgagtggattttattacaaacttctgttgtctctcagttaaagttgcccccgattggtttagttttcagttttattaaagatagttattatgtaccatccaaaagtaaacaagacttctgggtaattttacttagcatagtttgttttccaaataaatttagaaataattttataaaaatgacataaatattgcttgaaaggcattaaattagcaatagtcagaacatagcttaacagagaacatctgagaagaaagagaagcaataaatgtgagtagatgtaacaaaggaatatctaacatgagaaatgtgatttttatattttcaatttgtgtccctctctgcctagtactaacagacagaaataagaactgaacatgatgtaatgaacagagaaaagggaagtcatacttcttggctaaaggaatggtacaaaatagaggcctctaacttgacatgacagaaagtatgatgggattttcaaggcatcccaaggcatcccaggggagctttagacgtagcttcctatcttataagcagtcctttttctcactgcctgcctctgctggccaccaattctatatatgaacaccatgaagaaacataatgagggcacatgtaaaatctgctccactcacagatattctctatccagggtgcaagctttgctagaggccgtctctctctaaatcctttttcttcttttcttcctccactcttactgcattctttacacatctaagtttaaattccataaagcaaagagtcttgcaattctctgccattgtcacttccataagatgtaaaattgtatattttagcccagcaagtacccagtagtcaagtagatgtgtttaatttttacattaaagtgtaaacaataggaaaaagacgatttgacctagtcaaagttgtggttgaaaggctctctatctaccatgcctcttgcatcacagtgacttaaagtgcttttctagatggcctctaggcatcacaactgcatgctgttaaattcagccaccaccagcacacacatactcttcatacacgtacaaactcattgagaacagaaaatgcaacagtgatttaaagccctatgttatctaaaaagcttcatggtctttaatcttttaaatgttttctacttgatcatggaataaaatgaactgacagtttatctctttcttctctctaccttttgctggagatttaaatatatatacatatatatattgtacatgtatatatataacaaaagaagggaaagtaataaaatcaaagatcctagaaatattccataccagataacaagctctgttgttatcagtttgtttattttattattcttataagtttgagactctgggtaatcagttttcttgattttaaaactaaatataccaatgcctccagtagtacactggatattcttaaataccgtctatgccttttcaaagtatatagtctaaaattgatgtgaataatgaacagatggactaatatgtgcgttacacaactaagattaaaaagtaacagccagtctcacaattgtttcttctgtccaatataaatgctacaagattatagacatgtaccttaggtaaatgtattttataatagggatgaaaaggactgcaaatctttaagtcaaagttagttgctttttgtttctttgtttacctttaatcctttcatggctgttacctgatgagtaagccaggaagctagagatatacaagatatataaatattaatgttataaattgggataaagaccaaaataattgctccagtagattctgtggtttttatacttgctctgtattttagcaattgtaagaaacgatctccttacaaggtgccagaatcatgtcactttattgtacataaatatcagatcacattgctcagattttttccaaacttcagaaaaattttgaaaaaaataatatgacatacactttaaattttattttattactgtggccatcaattatgtgcttcttatatcccaattataaggaactctagaagaggtcatagcgatgaagtgcctggcatatagtaaatacacaaatacttgttagaggaatcaatgactctaaccattggttattttcctaatacagtaaattagtgataatctccagtttcattattcttcctcttttaaaaatattcctttgtatacctaaatgtaccatccctatttgaattactgcccgcttccctcactttgaaaatccatacatctactacatatttttctatttgtggttatctgaactcagacttaacctgaagcagatccatttctgtccccatatcatgcctaaatttacttcttgagattactatgccctattatagacagactttcactcagggacaaagaggagaattactggtgaagagaagctttaaaaataggggctatttttcttagataacaaggattctggagacaagagctactattattggtgtgaaggctcaatgacatcagggtgtacacctctgcaagtctctcggcccttttactctcagctaaaatgtggctactatggctctcagcttgttcaagtcaggaaaaggagtgaagtggctcatttttcttcaataaagaaagcagaagctcttccagaaaaaccataacacacttttgtttatacctaattggcttgaactttgttacatggcaaaccatgatgaaagggaagcagggacaagggtgctggagataggtcagccctatcactcctgtctcattttagctcagcttagaaacctgtcctggctgataatattttcgtcatctgtgtagtccaaacttgcagtgagagcctgcttgtcttttcctcaaatgtgcttttatgaagaccaatgaaaggcttcaccgaagcctccgtgtatagattaccccatctgagattataaagaagcaatcacaagtggttgaggcaaatttaagctccatacaggataagtacatatcttaaaacatttgggggttttgacataaatcttgactcattatctcaataccatttaggtccatgctattctaactgtggtctttactatacatgtatttatagtacacattctaaatgtttattttcaatttatatacttatcatggaccattaacaaagagttggcaaaccagagccagtttgccaaccatatatcatatgaaataaatatgcttatagtctgatatttttgttcttcactgacatgtggtaaacatctctctgcatttcttgtttcttttgtttgtcattttgatgataaaatgcataattcttggtataccatttaaataaaattttattataattattggatattaaaactcaccaaggattatttttgtcatataaatgtaaagttagttgaaagcttttcaagctttattagtaatactaacagccactcatcccaactatagtgtctctataattgccaatttttactagtttacttttaatgtaattgggttagctaggctcactcataaaatattaatgtttacactgatttgttttgctttaaatgacagcaaaaaaaagacatttcttttgtcaccccacaacattctcagggagaactgtggtacgttatgaggctaactattgcttgaatattacctgtgcattacttaagggggaatctgcaaacagtttcagggccaaaaacaaaaggtcataatttgataaaaatcttattgcctgatagctcgcagacatctgtcagcagttttggtttcttttaaagggcagcacatggctgactgatctcatagtaggatttataagtataattattgccatataattcaacaaatcacttttatcactgaaaacttaaagctttccaatttttgctttttagccatttaaattttagggaaatagtcttctgtccaataaattttaatttcaaaataaagtcttcactaaaatttaagtagtttaatgacaaaatagaaatgaaaattttgtctttaaaaattttttttttgcttttgcatttagaatattctatggatataaaaatatagcagctgggccttttaggattacattgattattaatctcaataatcagttgtccttattaacattcataattaacatgcatagcttattgacaaaggtaatttgcttgcatgaaaaaaataggcttatttgcagaggctgaaaaatgctttgaaaagtgctcgttctagaggctcactgctttctaagcacactccactgtaatctaacatagacaattcaagaaaataacctttctgagcttgggtctacctatctcataaggttattatatgcataaaatgagacattttatgtaaatcagtgaacacaattcctaccacataatatgcacctgataatttatggttattgtacagaagcttatttcttagttactgggtagaagcagtttgtgtttggaaatgagaatactaatttggaccaaaataagaaacagaataaaataaattcgcataaatagatatacctgtcttaaatgtccctgaaagaattcctatgtgataaaaaaaaaagtctacagaatgatgatgagataaactgcacatcaagaaaactagagaaattacaaagaggtatttttttaaacattaaacagttacataaatgtattttttaaatttcgaagaatggacaactgtacataaactggagtgatgtgagaaggtgtcacagagcaagcaaaacttgcaggccagacagagacagaattattggagacctgtccaagtgtgcctgcgtagtctgtgacaaaggggcaaaggctaaatggaacagatgtatggtcatgtggagaccagagagcagagggacctgaccactatatccaaagcagccccacaatacacacccaacaagatatgcccttttagcctttcatcctgtttgtttcctttatatcatgtttcacaatccatactcatcttgtttttctattcctttaactgttagcaacctatctcccccactataatgtaagttctgttagggcagagtccttgtttgtcttctacagcactctgttcataaatacccagcactgtaccaggcataaaataatgttcaaaaaataaaagttgaattgataacaaagaatatgagctgaaaattaaatgattctttcaacaagcattactggataaactggggaattatattgtcaagtattaaaagaattccctgacaccttcaccctaccacattgtcttccaccacagaactgtgttgaataagctccccactgccacaggaggagtctcatagctcacagtgaagctggagtataaagcataagattgtcacctctgaagttaaaatgcatggtccaggtatatgaaggaaagatttatgagaatctaattactctgagtttttccttcttctaagcaaataaagactccatgggcaggggcaggagagaggggaagatgaaagtcattggggcttgagaagaatgaggagtgaagatgatgaaattatttagtaaaatgtaggaaaaattgtacgtccagagaattagaagagttacagatgaatctgtagaatctggatgaataaccatggctgagaaccatacagcttccccctccttccactgaaataacatgacataagtgttctggagcatacatgtcactccaaagagaaggaatagatggaggtaatgaatactaacctgactaagtacactacaaattgtcaaaattcctctcctatgggataaaaaagagctcaatacagaaacatgcaatatgcaagtagttgtttttttgtttttttgttttttttttgaaatggagtctcactctgtcacccaggctggagtgcaatggcacgatctcagctcactgcaacctctgccccctgtgttcaagcaattgtcctgcctcagcctcccaagtagctgggactacaggcctgtgccaccatgcgaggctaatttctgtattttgttttagtagagacagggttttgccattttggccaggctggtcttgaaatccttaccttaggtgatccacccaccttggcctcccaaagtgctgggattacaggcatgagccactgcacctggctgcaagtagtttcaacaggagggataaatagaagctttcaaagtttacacttgaggaaccactatggtaggacactatatgggcgtactctcatttgcaaaaatagttatacgttaagtgtaagtacatacaccaatatatatccccacacacacacacacacaaagttccggtatattcctgttttaatccatagtaatctcttgtttcaaatacttctcaattattctttcacttttgtctaggtgcttcataggtgagaggtactatgctatgtgttacctagcaatattttatatgggcaagttgatgtaaatcaattcaaaaagggaaagtaaaatcttggcaaacaaatgttttccttagctatgattattaaatctaagtactcattcatctacccattaattcattcaaaaagaattgtcccttttatcagaaagcaagagtttttctacattttattagcaattaaactaacatcttactggcccatatgaacaatatcatctcccctagcttgaacggaagctgagaaacaggctttttcatccactgtagcagaagacagcaaggaagaaaaagtctgggaattagtcatgtaaacaataatgtctgccataacaaacctcaggttaagacaaatccgcctaaccaaatcttggctatctaagctgtccagtttttcaggttactcttataactccatatcgcttaacctttttttttttctggtcggaggaaaggatgaaatgaggaagaaaaaaaaatgtaaacaaaatgaaataggctccaaactttcggacaaagtagtactttgagctattctctctagccatacctcttctcctttaatatcaaaatgcactactatttaagcgatttttgtattggatggaccttgagaacatatgactttaaatgctgacggtttattgcagcagttccatccagaaccataagaagcccaagttatgagaaactgggatagataggtcagagtgtctgcccctcctctgcccatatcatccctttctttgcatatccacttctccctggatacccacatctcatgtagctcaatctctcacttgaccatgtgagattcatttgccaaggctagaatgaaagtctacaaaggaaattcaaaaggcattgccaataaaggactagttaggccattaagtatatttgaaagtgtaatgaggatctaaagggaaattttgtcttattgcatacagtctctcaaagatgttgtatatacattccacacatttataaagcaagtaccatttgccaagcactgtattacaaagtatgtgtcacctgcacttaatctttgtttatgcacaatcatagtgcagtgtctgaaaattacatttagatctgattcttcaaaccataaattaaaataattgaaattccatagtttagaataaaagggacttattaaactaaatatctggatctatttctctgtatttcaaaaccaaacattctttggtacctaatccacatagagtatttcttcatatccataaaaatgcaaactctttgcaaatgcaattgctcagtcttcagaggtgagatatctttacttctaagtctcttcctatccttatatttacctgctgtggttctgaatactaattttaggaattcttttgatattacactgaactgctatttttcaaatttgaaaatctctgttactgcaattacttccacacttcttaagcaacacatctattttttaactcatcctttactcatagcagtcatcaactaatttgatgataatcacttactgattcaagtgtggggtcctgcatccctttctgtgcttcatttatagcaaggtgtgtcagtctgggtgtgatttaggaggaaacaggtaacattttatacatagcaacatctcttgtccaggaaagacctcaactctttacaaaggaatcgtggtctttttaccttttagttgggtgaatgttcactttcagaactaacaaatccatttgtataagtatgttgtattgcatagatttgtgcagtacttctcaaaatgattgtgagactcctgtaagcttttggcgaatgacagactcacaacatctgatgttaaattaacatcataaagcagaatttgcatctggccaccaggcctttagtcatcaaactagcaaatggaactaatgtggaataataatgagagagctggcttttgagaacagaagactaaaggggaattttaggaaacatgcagttcacattaaaaaaaaaatcaccaaagctattaaacactgaatgcatcttatttttcatgtcagctaggtttatcattgtctctgccaggacattcatgatttttctgctgcaagtaatgttgagaagtttttgataaccattttaaatgccagtcaggtaaacagtcttcttttctctggacaaagctctatgtacctgtgcattttgcatattttaaaataagggcttgaattgggagaatttttcaagactacagtgaaatgtgatcctaggagactatcaccaaagcagcaaatgctaaacatgatttttttttgtattgaatgcataaacacctttttttttgcatttttctccatgatattttgatagaactattgaaaatactctagggaagagaaaagtttttaagaggtgcttttaaaaaatcaacttaattatatagttaagtcctttatttgtaaattaatttatgtaattcaagtagatatatgtgcttctttaccaaaaactgagctcctatagattatattttgcatcatcaaaattatcaacaatcccctttaacaactagtaaatgccacctgaaattttccgaaattgggatcatacagttggaaaaaaattgaatgaataaaaattttaattgactgaaccagtctccagaatgaacatcctactctgaaattatcttccagtttcctgttttgcactatcaaactctgtcttatctctttcctttttctctttttaccttgatgcatgcatatagacatatgtagccacacacctgtcactctctacacagtcatactacaatgttactagaatatgctccacgtctttcgtctgtgtctgcctcaatactggtaatctctcccctcctcctggcattactcttggagtgaaaggtagttgactaagattaaaagggaatatgagtgggacctttacaagcttcctctcctccctacttgccagattgtgttgtttgctttggaatttatataggagaaataatttgaaaatttttgagcagtgcacttcaattttcttcttcatatatgcccccaaattttgaaaacgaatatataccctcatataaaattgatagctcaaattatttttataaatttaaatggctacaaagactattatatacccttgtatacaattgatagctcaaattatttttacaaatttaaatgactacaaaggctattatctccagcctgttgtatatgatatatcatcacagatcaaatctttatgtctgcctcaaattcatatgttgatgtcctacccccaaatgtgatggttttcagatgtgcggccttaggtttagatgccattatgagagtgggggccccatgatggcatcaatgtccttataagaagagaaagagcctggagctccctcttcaccttgagaggacacagaaagaaggtggccttctgcaaaccaggaaggcgccctcaccagatctcatgatagcaccctgttcttggacttccagcctccagaactgtgagaaataaactgttgttgtttatcagctaattggcgtatggtactttgttacagcagcctgagctaagatagaaaagtgctgtaaatacatatttgtcaaaagcttgtagcgacaggtttagattattcaatttatagtaaatggtaaaaagccagtcctcattatcaaaccagtctgccaaatcaggcttactatgggtcagaaaagcctacctcaattatccattcttcttctgaattctagatagaatcacagaatgacagaattgtagaagaggagaatgatcaatcaatagatggacagataggacagagaccacctagcagaagcaggggtccttcactgagatatttttgatttagtgagaaaaaaggcacagccactttcaataatgcttatcagaactctctttggttcccttgctagactcttccagtgggagctatgcattttcaaattgccccttcgttggtataccaactaatgttataccttgagcagtaatttgctcctctttagtaaggtaggaaaagtgtgatgatgaaaacagaagttagaaaggaaaaaccagggccgggcatggtggctcactcctgtaatcccagcactttgggagaccaaggtgggcagattacttgaggtcaggagttccagaccagcttgaccaatgtagggaaagcccatctccactaaaaatacaaaaaattagccaggtgtggtagtgcatgcccctaatcacagctaggtgggaggctgagagaggagaattgattgaacttgggaggcgaaggttgcagtgatccaagatcatgccattgcactctagcctgggcaacagagtgagactctgtctcaaaaaaaaaaaaagaaaaaaaaaaaaaaaggaaaaaccaggatgctgtgaaccaatcataaaaaagagttcacatagaatttgaggttctagaaaacgatttccgtatagttatgtgtccatgtacttataagaatttatttgtgatcccaagggaacacgtacaatttgaagatccttgcttaaaatggttttaatatgcaaattcctgagcttcatttccattagtttcttattcaagcagtctgaatgaatcattggacattactttgggaaaaaaaaaacaggactaggacaaaagaatggattagtaaggaagtaaataaatattgctctaagagaagctaaagagtttaccacaaaggttgaaaactctgtgaagacatgcaagtttatgattcctttctaggtagaagtttatgacaatttgaacaaaaattagagggcttcaagaaacgaagcattctacctttccagtgatggtgttcatattagtgacaagttcagaatatattaaggaaggcacgcaaatgattgatatagaacagtgtagtcattttctccttcactgctcatctttccttaatgtttcttttttcctgatgccttaagaaaatagtgcctgtgtgaaataattaatgaataatgttaaatttgttaccgagtaactttacaatcctggtgaaactctttattttctatttcttagaaaaaaatggagatttgtttcttctatgaaagattggttctgctgtctcaggagcaaaattgaggagaaaataatattttgttcacagagtttatttagctgtgtttagctatgcttttgtaatgtattctttcaaaagctgttttcttttctctttgtcatatactatagtttgttctgtttattgcacttagtagtattgtatattcctttattttttttgtacttttccaaagagacagttctaatattttatggcatttgggatggttttgtttttcttaagtgtctttcatacactgtatcttctggttaacagagacccatgggtaagcaaaatactctgtttacaaaattgtgcccatatatgattattactctcttgctgtaatgcattgtaaaaaataagtaatgagactgcaataagcttctgtcttacatcaagttcccctagaacagcttgagattttgcaatggggatttgtatgcaagagagagcttttaagagaaacccaaatggaatgagagaagcagatcagggaagggacagaagccaagtgacgatgaagttttagctcaagtctgttgtcagcctggtcctacaaggacctctgctacatgatcagtactatagagttgtcccatctagaggcaaagcgaccaagctttgtatccccatatcagtcggctactggctgttaaggccactggtatagagggtgaggcataatttctcagacatttccaagcaaaatggattttatcaaaaggtaattttaaaaaatacatctatgagcaattagcagccaacacttccagtagctggtggatgggtgctgtcctgaccagagaaagggaactgggaggagctctggtcgcctctactagaactgctgcaccaagatactcatccaattaaaattttaagagcttttgctaaaattcattaacatctaattcaaagagatcttttatgtgtgtgtgtgtgtgtgtgtgtgtgtgtatgagagagagagagagagagagagagagagagagagaagggggtagagctcaaagctatgtctgccaagattttaggcagaatggttcagttaaataaaaggtcctggcagtaataaatctgtgtgatttatttgctgtgtaaccttgagtagttacttaacttttctgaatccagttcatcatctctgcaacgtctgtcatgggtagctacctgaggattattgtgaaaaaaatgtgtgtcaagttgctgacaaaagggagatactcactaaatgatggttcctattttatattcagtacaggttattgtcctccatttcatgacctcagacacttgctttgaaaacaaaacaaagaataaaaccaagtgagaaaatgtggctatattggtgcaaatgttctctctactgcaaaaacaaaacaaaacattcaacactaagtatcatctctgtgtaaaaaagtagatcatttagtttaatttctttaatgataaaattctcagacactaccaacgttaaagcaatgcaccattcagatgcacctttgcaccagaaaaaattggttggcattctttagagatgtttaaagagaattactctttatataatactcaactattatagtcagaaaatgctaaacatgacttggacaagcaagacattatttaagactgtaactgactcattctaaagcaatgcattatatgaccagtaggctcaaatagttggcgagttgtcatggggcttttgctttttctagcaatacatgaaatggcaatacatgaaaattcacttcagtcttgattaaagacaaaatatgccctggatctccaaaatctactataggcaaacctgtctacctagatcataatagtcatgaagtatatgcactaatacacatatgtgtactcatagactgtatcctcttcctcatacttgctcagaaacactatacttttactttacaaactattctagtttgtatgtttggtatctgaaattacaggaaaactggaagcaggaaaatgagatagaagaatggtacacacagtaaaacttcacattgtcaaattgacatctaacagcccagagcaataattcttcaaatttgtgtctgttttactagcataagacatatttgtgcacattattgcattagatctttataacacaatagaggtttgctagtcaaataaatattctcattttacatgtgaagaatgactcaggatgtttctgacactttcaaagtcacaacattaataaaatggcaaaaagggatgtcagatgcatatagtagatcacaaaatttgcatccttatcatattgttagattttaagaaaggaggatttttcctgataactcagaaagccctgtttctgaaaccatttggtaaagggaaaaattctgcacatttactactacgactggaatatgtaaccatatcttttagttaatacacatttattacacagcatccatatgtggtagccattgtgttaaactctggggatttggggatgaataagtaaaacatagcgtggccctcataaaacttatagtgtaatgcaataggcagataacagtagatacaaaaataattataatacattttgaattacatgaatgaaagaaaataaccagcagaagctacagggatggcctcttgagaaagtgctatttaatatgaaacctaaaataaaaggaatagtctgccaggaaaacaaataacacttccaggcacaaggaatgatgtgtataaaagccctaagggtggaaaattctttgcaagttctaggaagagttaaaaatgtaggaaaaggcagagtgaccaggggaagatactgagttcaaacacacacagatagatgagagatgatagatagatagatagatagatagatagatatttgagagatatatagacttgacatatttcaagcacagaatgttattattcaattcacattttacaaagattactctaacaactctaggaaaagaattacagggggttagcattagatatgaggagaccactgatggggctgtaatagaagtgcaagattgaactagaaacagtggtggaggtggagataagtgatatattagaacaaactttgcgcataaaactgaaagggcatggtgatggattagagatgggagtgcagaggtgagtaaggcaagtgacttgacccccttggctttctggcttgatccagtgactaaatagtgtctgaggtcattactgagatgaagaagactgggcaaaagtagaaaacagaatcaggagggaaatcagcagttcatgttgacacttggcaagtctgagattcctatgagaatcagatgaaattcaagtaaaaaaaactagctatggaagtctagattctgacggggaatttcaagctggagttatgaatttgaagtcaccaacattatgattttatttaaagtcaaataaacaactgctatcttccaggatcacagagagagtgatattagtaaaaatgcccaggactgagccagaggaacaccagtacctagtggtctttctactatatcacagtacttccttagaaaaatgttcaaaataagtgtaaaaagttaccagaaccagaatcgcccatatttaataataatgaaaatttcaggcccttaaagaaatattttcactatgttttcttaatcccgtgttgaatgtcataaccatcagtattgtatgcctcgggaaggtggagatataggacagaaggaagaaaccatgccagagagacagaaatcaacatgccatttcaatctttcccctttgttctttgaacttctctaccgttttctccctgtggagccttggcatcttaagatcttgattatcagaacttaagcatgaaagaatttcttgtcttgatgccttatctcttctgcatccagaggaacttcatgatgtttagataccacttaacaaatacgaaaacagaaaaactaccctaagatagtagacacagaggccatccgtattgactgtttaatagttcagggattgcacaataaaggcaactatcattgctaaattcagaatggaagaatggtaaatatcacttagtcccagaatattctcctaattccaactgaaatatacactacaaaccaagaaaaatgcagaaggtgctcagaaactgcaaagaaaataattggaaaagaaagagtgaaacacaaagagtgaaaccagtctatatgcctgttacattatttgtggttgaattttaaaacatgcatcatatacaaactaggaaaatttcttaatttaattggatttaacatttaagtatcaaaagcagaatactaatttagctgagctaagaataatgtagggaaaacctgaaggatagtataatgcactgaatcatatagcacaatataatccatcaaaaccacagagcctacaattttctcgctttatattcggttgaaaaatgacttcagagtatgtgcttataagaataactgatgagaaatctaagtggagggaagaccacttgatgccagcttcttatgataatgtataaatctaacagccataattaataatagttaaaggcttaaatggccctgggatattcagttaacagaagacaggtacacctgccaatatgaagctttgaaacttgcttagagaaagttagggcaattaacctgactatattccactcagttttgagtaaaaatgaatgttatgaaaataatgtaggtcagatattgacttgcaatattatttagagttctgatacaatatatcttaaacactgttcagtcattttgaaatctgtgaataaatctcaacatgtaatttatacagacaaaataaataagaaaaatgcttactgagtttatattcccattttggcgttaatatcatttttaaaggctgttagctttatttggaagtcagagaatttctgaattaataaagttcacattaaaataaaacatcattgttttggacatagtctacaatatgaatggactatgtataatggactatgtataatggactatgaatggaccatacatactgtatggactacagtatgaatggactataaataaatctccatagtgaaaattctcaaatctcctacacatttactgaaaaattaaaatatcattgtcattgcaaataaaatattattggcattattaataaaactgttttgggtactctatacaacttcttttagaggtattttctcagatttttgtttcatcagagttctacttctgttatttacattttggtacttttcattgtaatgtatgtgatagctatgtgtggtaacatcagtttacattataatcacctgtgttttttatatgtgtttttccactgaattaacctattaataaagtgaatattaaacacccagatttctaaaatatatatatattatgaaataaatattatcatatcgattctcactctttttatcagtaaaaggtaatatttaggcccaatttgctattgactttttacctggccattgggtgaaaatggcccaaggtttttgtaatcaatgactccacaaataaatcgtgtataatcttatagataacttgttttcactttatttcaaacatggtagcagaattgacctcttttattgtgtaatttttatttttatttcaatagtttttggggtatagctggtatttggttacatggataagttcttcctagtgatgatttctgagattttggtgcaccgtcacctgagcagtgtaccctggaccctatatgtagtcttttatccctcacctctctcctacccttcccccacccactgagtcctcaaagtacattatatcattcttaggcctttgcatactcatagtttagctttcacttacaagtgagattatacaaaatttggtttttccattcctgagttagttacttcacttagaataatggcctccagctccatccaagtttctgcaaaaagatattatttcattctttttttggttgagtagtattcttggtgtaaatataccacatttgttcattaatttgttggttggtagacacttaggttggttccatatctgaaattgtgaactgtgctgctataaacatgtgtgtccacgtatctttttcatataatgacttcttttcctttgggtagataccgagtagtgcaattgctggatcgaatggtagttatacttttagttctttaaggaggctctatactgttttccataatggttaactagtttacattcccaccagcaacactgctggtggcagtgttccatttttaccatattcatgccaacatctattttttttattcttaattatggccattcttgcaggagtaatgtggtgccttattatggttttaatttgcatttccctgataattagggatattgagcattttttcatatgtttgttggccatttgtatatcttcttttgagaactctctattcatgtctttgtccactttttgatgggattacttgtttttgtcttgctgatttgttgagttccttgtagattctggatagtggccctttgtcagatgtgtagtttgtgaatattttcttccactctctcagctgcctgtttattctgatgattgtttcttttgctgtgcggaggctttttcatttaattaggttccatttatttatttttgtttttgttgcatttgcttttgtggtctgaagtcatgaattatttgcctaagccaatgtctagaagagtttttccgatgttaacttctagaagttttatggtttcaggttttagatttaagtctttgatccttcttgagttgatttttgtataaggtgagagatgaggatccagtttcattcttccacatgtgtttgtcagttttcccagcaccatttattgaacagggtgtcctttccccaatttgtgtttttgtttgctttgtcgaagatcagttggctataagtatttggcttatttctgggttctctattctgttccctgggtctacatgcctatttttataccagtatcatgctatttgataattattgccttgtagtataatttgaagtcgggtaatgtgatgcctctagatttgttctttttgcttagtattgttttggctatgtgggctacttttggctccatatgaattttaggattgtttattctagttctgtgaagaatgatgatggtgttttaatgagaattacattgaatctgtagattgctttaggcagtatggtcattttcacaatattgtatcttcccatccatgaacatggaatgtgtttctatttgtttgtatcatctatgatttctttgagtagcgttttgtaattttccttgtacagatctttcacctccttggttaagtatattccaaagtatttgaattgttttgcagctgttgtaaaagggattaagttcttgatttgggtcgcagcttggtcatttttggtgtacagcagtgctactgatttgtgtacactgattttgtatcctgagactttacagaattcgctgatcagatctaggaactttttggatgagtttttagggtttgctaggtaaacgatcatatcattagcaaacagcaacagtttgtcttcctctcttccaatttggatgccctttatttctctcttctcttgtctgattgcctagccaggacctccagtactatgttaaatagaagtggtgtcttgttccagttcttgggggaaatgtttttaacttttccccattcagtgtgatgttggctatgggtttgtcatagatggcttttattactcgaaggtaagtctgttctatgccaatgtcgttgagggttttgatcataaagggatgctagattcaatcaactacttttttacatctattgaaatgatcatatgatttttgtttttaattctgttcatgtgatgtatcacatttattgatttgcatatgttaaaccacccctgcatccctgatatgagacccacttgatcataatggattatctttttgatatgctgttggatttggttagctagtattttgttgaggacttttgcatctatgttcatcagggatattggtctgtagtttccttttttcataacgttacaaagagggggaggtgagaggattgcttgagcccaggaggcagaggttgcagtgtgctgagattgcaccacttcactcctgcctgggagatagagcaagatccccatctcaaacaaacaaacaagatctcataaaatataagtttataaaaattgtaatctgataaaaattcaaagtttataaattcgaggtttttgagaaaacaattaattttaatgtttgtgaaacaaatatagaacatggatacacagacaatattacttaacaccaaaggcctgtctcctttttccccagcccattagcttttgattcaagaaaataaatcaagtttaacatatttgataaataataattaccacacatgggaagacattgtctgagacacagagtaattgtaaagagagttgcttcttccggccaattaacaggtgatccactggatcagctcagcttttgtgtttgcccagatactaggaaaaacttctggaaaagtggtgtcaatatcaaagggacacagactggtattgttttgtggatcaattagcaaaaataactgtaaatgtctctttttctaaagacggagccaaatttgtctacagggccacaattaagtagcataaattcttacttcagagttggtgcttcaccatcaaggtatcaataaaatccaaaatagagattcctgactaaacactttcgattagtttcttaaaatctagctgctaagtgaaaatatttaaataataaacattttaatttacttgtaataggggaaattaagatatatcccatttcagctagctagttttcctgcccttgaatacatgagagatacctgcaaactctaagctttcatatgaatgaattcaggcctcattaatgcacagtacatgacaagatagacctacatgtggtttgcatttgtatttatgaagatagccattggaaagaataagtagccatataaggaggatgttaaaagttcctacaaagaacaaacatttcatatatttaaatgcatcaattttcatacatttaactggtgtgctactgaggtcatatgctagttaggtcacttcagcatgtcctctacaatgcctgatatgggatagactacattttattggcataacaccaaccaaaattctggaatagattatatgatattctctggaaataatcttttggatcaaattaattaatgagtatgctattgcctgagctgcaatgtcaaaaatcacatttctttcttttcttttcttttcttttcctttccttttatttatttatttttattttttagacagggtcttgctctgttgctcaggccaaagtgcagtggcacaatcacaactcactgcagcctcaacttcccaggctcaagtgatcctcccacctcagcctccagagtagctgggactacaggcatacaccaccatgcctggctaatatttgtaattttgtgtagaaatggggttttgccacattgcccaggctggtcacaaacttctgggcttgagtaatctccctgctgggcctgccaaagtgctgggattacaggtttaagctaccatgctcagccaaaaatcacatttcttataacacgtttatttactttggatgtgggagacgttacaccaacaaagtcagtcatttagaaagaaagagtttaacttgaaaatttttttacaacctaaatacattaaattgatggctgccttatgatatgtctgtatttaaattgatgacaaaagtatttacagaaagaaaagagggataaggaaagatatttgagcaacatgggagggttgctgatggactttgaaggacataaatgactaatatttaatctcagtctgtctgtgttcctagaatatgaaaaccttcagtaaggtaaggtatattaatactaggaaaggccttggatgagtatttaatgaaaattatagagaagggataaattctgactatggtcaccatcggggcagaggtaaattatcctcaagaaagaaagattgaagccccaaaatccatagaggtagggagtaggagtcagaagtgatcacgaagccacatgcactggcaggagtttgaagcagttttaagaaggaagttgcacttcccataaaatatgaaagttgggtttgagctaatctgatctacatctttaagggccaagagacagagaattgaatctaagatacacaaataaatggccaaagcatcagtctccaaacaaacgtattcaaatagaaaaacaaaggaaataaatactctattttgaattttctattagtgccaccagagaaagcatcacagatgttttccggctatctcctaagctgttaaagaatatgattctgtgaaacagacctgagagaattgccttctcttttggtacaaaaaaaatctaaagtttcattttctgaaatctctcacgaggtgaagtcagtgtagaataccaaaacaggttttaaattctggaaacctaaattattctcttttatgttgtcagcaaaggtgctttattcacactaaatgaaaaatacagtcttcatttttctatatctgtgagagatttataattgaaaataaagataattatatcatgataaatataattggatgatgtccaatttaaacataaacttccatattactttcaataatgtgttttattttattttctggttctggtatatttctaagttctttaaagcatttaagttgaaggggggaaatggcagataggaggcaggactaactttcagctcccactccagtggatagagcagcatgtggagactcaaatcgtgaattttggctccaagaactaccacaggaacataccagaaagccgagagaatccacagaccctttgaaggaagcagagctgctgcaggccctgggagacagccaaaaaactgtgactgtccaaagtatgaaagggggatcatcggcctgaacacacatcctcacatcctcactggggaacctcaagttccagatcaggggataaggatttgaccttacctggagctgagacaaatttagagagctgagtaaaatatgggaatagaagaagcagtgggaagagccctgtggacactcgcggtccccagggaagccatttctgactttgtctcccaggggtccttggggagggctaccagaggaactggaaaaagaccacaggaagaaggaaatttccagctgaacttcgtaacaatttcaaccaaagtttcctggacggaacctggagaagggggcgaatcaggggtgcagacaagcacagaagctgtggcaggtggggaagctcaaaacctgaaagccctgcttactttcacagccgggaggctggttgttggagcaagttctcagctctgcctacccactgcctggaaacaaactcagtaccgttgtgggggcacagtgggagtgagaccagccttttgggctgcataggagctgatgaggcctgtaactgccagctttcccccacttccctggtgacttgcatgatgcatcagaggcagccataatccctctgggaacatgactgctttggcctgaaaaccacacccccacccccacagcagctgcagaaagccctgcccaaggagagcctgagctcagacatgcctaaccctgccctcacctgatggtctttctgtacctgccctggtagccaaagtcaaaggacataatcttttgggagctctatggccctgcccaccacctgatcctccctatactactgcagctgatgctgtcttgaaagcaccaccttctggctgaaagccaaccaacacaaaactagcacaataaacacaactacaaccaaggaccctcagagtccacttcattcccctgccacctctactagagcaggtgctggtatccatggctgggagacctgaagacagttcacatcacaggactctgtgcagacactaccctgtatgagcccagagactggtagttccactggatggctagatccagaagataaataacaatcactgcagtttggctctcagaaagccccatccctaggaaagggagaaagcaccacatcaagggagcaccctcttggacaaaagaatctgaacagtagccttcagatccagatcttccctctgacataatctacccaaatgagaatgaaccagaaaaacaattctggtaatatgacaaaacaaggttctttaatgcccccctccccaaaagatcacaccagctcaccagtaatggatcgaaaccaagaagaaatctctgaattaccagaaaaagatttcagaaaatcgattattaagctaatccaaaaggcactagaggaaggtgaagtccaaattaatgaaatcaaaaaataaaaaataaatcagctgggcacagtggctcatgcctgcaatcccagcactttgggaggctgaggcaggtggatcacttgagaccaggagtttgagaccagcatggccaacatggtgaaaccccgtctctactaaaaatacaaaaattagctgagcatgttggcaggcatctataatcccagctactcaagaggctgggagaattgcttgaacctgggaggtggaggttgcagtgagccaagatcacgccactgcactccagcctgggcaacagagcgagactctgccaaaaaaaaagaaagaagaagaagctatatcaaaaaaatgatacaacatatgaagggaaaaatcttcagtgaaatagcataaataaaaaacaatcacaactcctggaaatgagggacacacttagagaaatgcaaaacatttaagttgataatgtattttacttttgatgccttgttgtttttattactgtaggagttaaaaatcataagatcctgaaaaacataataatttcatatgttcaattttatatttgtgacttcatatattgaataatttttactcaaagaaatataactttaaactacacagtcagtattatacaaaagcattggtcacacatcagcttgagtatataaaaaattttgaagcacatctcacctaaagatatttatgctttagttgaggatataaaacccataaataaaaataaacaaaaataatacatcaaaatatgctaaattaggctatatatgtcatcaatttgagggtatattgaaagatttcttattgatccataatatacctatttatggaatacatgtgatattttgatacatgcatataatgtgtagtaatcaaatcagagtaattgcagtatccattacctcaaatgcttatttttgtgtgtgttgggaacattctacatctcctcttttagctattttgaaatgtacaacaaattattgataactggccgggcgcagtggctgacacctgtagtcccacactttgagaggccgaggtgggcagattacgaggtcaggagatccagaacaccctgaccaacatggtgaaaccccgtctctactaaaaatacaaaaaaaaatagctaggtgtggtggcatacgcctgtagtcccacataatcaggaggctgaggcaggagaatcgcttgaacccaggaggcggagtttgcagtgagccgagattgcaccactacagagtgacactctgtctcaaaaaatatatatatattgatatctattgaacttacaactaatttctcccctctagctgtatttttgtacccattaaccaacttctccttatctctttctcccactctttctcccagctttctggtaaccatcattctcccctctaccttcatgagattaacgtttttagctgccacatatgagtgagaacatgtaatatttgtctttctgtgtgtagtttatttcacttaagataatgtcctccaggctcatccatgttgctgcaaatgacaggatgtccttcttttttatgggtgaataatattccattgtgtatacatgccacattatctgttcatctgttgatggacacttaagctgattccatatcttagctatagtgaataatgctgcagtaaacatgggagtacagtcgtctcttcaatatacatatttcccttattttggacatatacccagcagtgagattgcaggatcacatggtagttctatttttagttttttgtggaacctccatactgtcttccataatggctgtactaagttacattcctaccaaaggtgtatgagagttcctatttctctgcattctcatcagcatttgttattttttgcttttttataatatccatcctattataatatcacccaactgggatgagataatatctcattgtagttttgatttgcattttttgatggttagtgatgttgaacattttttcatatacaatattgagagattgatgtaaaaaattaatcttagaaaatgtataaagatctaagtcagaaaaaccattgccagaggtttgatctcaacctcattaaagttgatcctaatataatagaaaatcagactattaaagaggtagtttctttagaattgccagaacatttaatccttcactgagagcattctgcttcttggacctattgtgtagtgtgatgcacctccaggctaaaatattaccttcaaatcagaattttataaggggtaccattcttctattcctgcttgccctgggtgccagaatgctgattctcaacatcaggtagggtccacccagttcaggtgctttttcttcaacaattcttaaccagattagtttatgtggaacttaccaaagcagcaaaagattcatgactgtttatccccttcctttcctgttcctctcctcatcatattacatcttccaccaataaaattgataatttacttgattatgtgctcagtaaagatataccacaatttctaattccaaagtttcagtttttgctcattaagcagtggatcctgtttctatgctagcagtgctgatctatcttctcaaatatcaggccccaaaaggtggccttattttcattgatttctcatgcttatttcttattattatttctcatgcttagcttttctttattttgatggttaatattacgtgtcagcttgattgcatggaaggatgcctagatagctggtaaagtattgtttctgggtgtgtctgtgagggtgtttccaaaggagattaacatttgagtcaggggattgggagaagaagatccaccctcaagtgtgtgggtaccatccaatcagttgccagcgagactagaacaaagcagagaagaaggtatgacaagctggcttgccaagtcttctggcttccatctttctcctgtcctggatgcttcctgcccttggacatcagactctaggttcttcaacctttagactcttggacttacactagtggtttgccagaggctctcaggccttcggccacacacggaagtctgcactgtcagcttccctacttttgaggtttttggactcagactgagccactactggcttcctacctcctcagtttgcagactgcttattgtgggactttgccttctgatcatgtgcaccaattctccttaataactctctttcatatatacatatactctattcattctgtccttctggagaaccctgaaaaatacagatttcggtaccaaaatctgtattatgttgtcttttatgataacataaaagagaataatttaggtttccagaattaaaaacctgtgttgctattctacactgacttcacctctagagaaatctcaaatttctctagagagaaatggaattttaaggatggatttctttagttggttttggagtttctggagttctctgtttaaactgattagacgccaaaatggtaaggactctacttctagtagtatggagaatactgatagtccttggcatgaactgtgtagacatgctcaaagtaaaggctttgagtgctgaatctttttcaaactatttcagttgaagactttattttgtgtaatgagcccagaaaacatatcagtcatagtataatagtataatagttaaaagcattggctctagagctagaatgaattaatccaaatttcaactctcccactgtgtaactggattaacccatttatgcctgaggttgcaattttttttttagtttttgcaatcagaccttggtgatgacattgagcagtaggatataaataactcccacatgcttagggttccaataatggaacactagggataaatgggctaatagctatataacatagacagggcacttaatcttcctgtgcctcagttacttcttctataaaatggggattataatagtacctacctcataggtttgtggtggggaagaaataaataattacatcattgcatggcacatagtaaactttcagtagttaatgcaactgtttttgtttttatggttacgggatgaagttttctatttcttgaacccaattgctctgttttttgttattattattagtcttttatcattattttttctggctgctgcaatacctacctgggtctttatttctcccaatgctatcataaatgttttagatcccattagctaaaaggatcctttcctacctagagtccagactcaaaacagaccacttcatgcctctccatgcctaaataagggtcccttcacccactatggtagtgtagttattatatctcttcatgcctgatgtcctgggaatataactaaaactctagataggaagaaggatcagaaactccccagcctaattgtagagaaacccattgcagcctatctgagaaatgggaattttgcttgtgtctcacacccctagcatcactgtctcctgagccataaaataacagtaaacaaagttctcatttatgtgaaactttaacagcatgcatcaatcgagagatgttcaaataccctgggaaaactattcaaacaaaagcatatccactcacacaaaaagccacaaagaaatatcctctgctcttctttcttgctcttgctcttgctcttcaacatcttgaaagagttttatggaccatgggaagtaatacgtctttgcagctgacctagttgtcttaccacaatagtagaggtttctagcctttggttccaggtattgttaccaatttgactagtgctcccaattcatcagttactggtactgaggctcatagcaatgatgtcttggctttgcccagaaacatgaacacttccaccttatcttgagccaaattaagcctatttaacctgcaaccttccatagtcaataaggttacataattgattaatttgtcaccaaggccccatactcaagtatatttatttatttttggaaatggagataacctcagggaagttcctaaggccatctacagtgtttgtcatatgaccttttaccagccctactcttatacacatttttctcaccaagaaaaatggagaatttaaggtttataacaactcccagatattgaaccaaattaccattgaaatcaatatgccctcctacatttttcttaatctgcttgatcaacttgagtcagctgtgatttgtatcagctgaaactccaggacaggattagagggtaaggaagaagttggggggaagggtcttatctccctatcaatatcagaaatattttttaagtattcatgaaagactgtgttttcagatccttatgataattttgagtacaattgaccctcgaacatgtttgaactatgaggtccacttatacatggattttttcaataagtttactgaaaattttcttggagatttgtgacaatctgaaaaaaacttgcagatgaaccatgtagcctagaaataagaaaaaataaaaggtatgtcatgagtaaattcagtataaaatgtatttagatattagtctctttatgtgttaattgactatgatattgataacagtaagatattagtagtcaagtttctgtggagtcaaaatttatgtgtggattttctatttcctgggggttttgtgctcttaccccatgcatatttccaaagatcaattgtgtttggtaataggtttgaataaatgttaacatatttatgtaactctgaaaaatacacttttaagcattacaaatgattggaaaaaagaagaattatttaataaataatctttctttggtagatgggaaccagtaaatatcaaaggccttagaaacatgtataactcaacacaggaattctattcctagaaatctttttaatgaggtaaccaaaagctccacaatttggaattaagcaaaaaaatacacacacacatgcgcgcgcgcacacacacacacacacatatttgtgtgtgtacttatatatggatcttatgatagttatataacaaaaataatatgtaactgtttaaaatcatatttatctagaatatctgacaacaaaagaaagatgccataatatatttaagtgataaaccaaagcaatgaacgttatgcaccatgtcatatgagtcttaaagatgataatgactgcatggatgataatattgctactcacttgttttattttttactcttgagcacgtaacattttccccacagttacaatgcaataaatttaattcagaaataattatttttagtaaagaggcaaaaaaaaattccctacatttgaatgtattagtctagttcatgttggctgcatattagaatcaccaggggagcatgaaaaacaaaatatctgagacctactctaacttgctgaatcaaaatgtgtttcatttttagtgtttgttgttgttcatatttttaacatggttctcaaatgattttgaagtggtcaggcccacaaaagtccacactgtcatatgggtacaactggccttgaggataatattgctaactcctcaggatcttttcagaatgaagtgaaataatgtgagtgagtgatcctacagtcatgggggaataatccatctatgggcctatttcccaggacactgatatctgagaggtcttacatcttttggaaaagacctcttgtaagtagtttggtagaagtgctatgtctcttcagcacttcttcactgccttcttgtggtagcaaatcccagctccctgactagagaggggacctgcaaccaagactgagaaagccacaggctcctatctccctagtggtccaaggagtggtccaggcttggatcaattgatcattactaagaatttttcttatcatggccagcaaattgtcaagtaagcttgctccatcccagttttccctgaccagaaaatggcactattattcccccaatatgatcagagtaaaatcatctttccttataccctacattccacccatcagcaagtcctgctggttttcctttgccacaacccccaaaacttcccacttctcctggcctccaatttaccactctagtttcgggctactgtgacacttggtgcctatttggtcttccacttcattcttatcttgctaaagccgttgtccagagagcaaaatatacttgtaaaatataaaccaaattatgtatgtaatttcttagcttaaaattctccagtgaattcacattacatttattatagaacaatatttactctctgtggcctgacaagacatacttggtttacccctctctaaattcctccatttctccctcactctcttgtttctgactgtcttgctgttcctcagacatggcaagctttccctgattttgtcttttatctaccagaactgctcatcacccagacctacaagtgatcccttcacttatttctttcaagttttactcaagtatcaccgcctcagaggtaacttccttgacctccctatgatattaattcctccttctcacctccccgaccacccactccctgcatccatcaatctctttgctttcttcctttttggttcacagaacttggcactacctgatacacgggttacatgtccattgtttgactcttgtgaagtgaaggcttcacaagggcttccaccgtgattgtgccctgtatctgtacctagttgaggaccactatttatatgctaagttagacccccattgattggataaagtcaggctccagaagggcagactaaagccaccaagcaaggaacaagaactggaagagcttttgtttccagaatcaccccagctagctctactctttctatttttcatcccttcgatagatgaaccaaaaaagtctttcttttctcttcagttagtttgaatacaatttctgtcacttgagattgaaagatccctaactaatagccagttgaagattcagtttcaggacctgaggaattttagagggagaactgtgaaatgccacatctctgtgcacagcacactagaacatgtaagtccacacagcacagactcctcacctgcccgttaacctctgaaggcacggtgggccaccattattgtcaatataatcaaagaactttttcctcccctattgagtactttgttctttgtgtgttgtgtattcccgtcatctgctgcctgaacaactcagactcagctgcttcttatccttcttgtcctttcccttacccttccagatttgcaaatcattccagagttgtgaagggaattctaatcttttaaaattgattttcccagtttctcacacacacaggggaagcaaataatgcatgcaccatattatgtattaatacctttattcctaatccaatcttaaagcagactgattatccacttatccccacccctgaatttttttattcaaatgttcatacaaagctgtcacttattcctgaatgcctgaattttaagcaaagctgatgacttcacagaactccatacacattgagcacactgaaaccacctgtgcaacaacgcaaggcagtgtgaacaggcagggagctgtgtcaaggccagggtcagagaccagctgctagaattcttccctgaacccaagggagcaagcataggttttgtggcaatcttctcaactatagcattattgttgacattttgagtttaatataatgtacaggagctgttctgtgcattgtgtgatgtttagcagcattcctggcctctaccagctacccagtgtggcaaccaaatattcctccagattttggaaactgtcccctggaatgtatgtgctcagagaaggattgagcccaattaagaatcacatgtattcaaaaaaagaacttgtgtgataactcaaaaaatcaattctatctactgggtatactactatctcctcaaaatagtcagtaagaggtcctgggtaggtgaaggtgctacctctgctttacagttggaccataaaggtcatggcctttatgaaccaataagtatccattagaagtaaaattgtagatgagtgtgatctgtttataaatttgaaattttaagggatcttattttcttcatggccccttcatttaaggtgaaactctatttatagtgccttttgtgatagaactcgggctctcttctcaaacctacattcccactattccatcgcatgtgtcctatacccagccatatcaatatttttttattctatggaaacaatttgctttcttatatctccatgtcattcatacatactgttccctctgcctaaaatatccttcccaaccttcctttttactttttttttttttgagacagagtcacccacgctggaatgcagtggcacaatctggctcactgcaacctccacctcccaggttcaagtgatccttttgcctcagcctcccaagtagctgggattacaggcatgtaccaccatgcccggctaatttttgtatttttaacagagacaggatttcaccatgttggccaggctggtctcaaactcctgacttcaggtgatctgcctcccttggcctcccaatatgcccagtcttccatattttctttgatatgttacttcttatgatactgaaaacttcccttaattcctgttccttcctggcattctctattccaggcctgtaggtttgtctcctctctgattcacctattccaatgcctattcttataaatatcagttgagtttcttacccatctccaaatgatgtacttgagagccacatcattttatttaggcagatctaaattttgtgggtacagaagtttatgcaatctgggatgccctctttataaaaaaagaatataatattattaatataaaattaggtatatttatttagaactgggaaagaaatcacaacaaatgcctggaaatttaaagactcaaactcccttgtcaatttaccagaaatgcttacatagaaatatttcctaataggaacctggctttttctaccatctagaatgctctgcagctgtcagtatctcacagcaacctgtgcagttgagggtcaccagagcctaaggttcattacatttatggcaaatctgcctttaaaaaacgtatctctgcatctccaaggcccagtacaatggttatatggtagaaggtacttcataaatgttagtgatgacaatattaaattttatttaaaggttaagaaattccatcactcttttgttccagaaaaagacattgccagaaaccacctttctcaatatgacttagacaagactcatagatgacccccttgttcacataaggcaaggccagacacagaccctccaaattcccattctttgcctcagaaatgactaatggaactgcttgtcccaactgatcagctggaacaaaatgactgttaaccaaccttcctcaagatccctgacctctggctcacctccaggtgagccagcattcagctcctcccaagaatagaatagactggcctcacggaagatattctccaacctaccagcctatcaggccacctttgattccatttccccacactgcttctttcttgctttgtttactcctcccttcagaagcttgtagaccttatggtcacctccttctccccagtgcaacattatctttccccagccttctaggaagtctcttgccacagactttcaaataaagtctctccttactaagtctgaacttgctttttatgtgacagtgaaattactgaagaaaataagtgatgaatgactgagtgtgaactcttgtcaagcaacaagtgttctttgtaactctttcccgtactgttgcaatgataatgctattgctttcctactgagcctatgtggtctctcttttgacctctgttccttctgccagttgcaatacactcctctgtcaaccattactataagcttaatctgtcaatattgtcaaacagttctgacctctaccttgattttggcttaaatcccacctttgttataattcagtctagatcctaatccattcagactttttcctgccttagttccaagaaaacatgactctgtttctaaatcaaaatagagtatgtgagttagctttgaaaaggcctgatagatacccattgcaaaaagttagtgaaaggccattctggttgcaaacaattgcatgtaaagtcttggaggcaggaatttgaaattcatgcctcaggacaataaaattagccaagttttattttaaattggtagaataatgacagaaggttggagaaagcattttatgaatggatattgattgggattgaaaattatgagcattggttttttatgtgtgaaatttcagatattggcaaaatacataaatagtatcttataatgaatgaaaaagtactgaaactagaatttgggagacatttggattattcaaaatctttgaaaaatgctgtgatgatgatgatgatgatgatgatgacgatgatgagatggagtcttgctctgtcgccaggctggaatgcagtggcacgatctcagctcactgcaacctccgcctgccaggatccagcgattcccctgcctcagcctaccaagtagctgggattacaggcacatgccaccacgcccagctaattttttgtattttagtagagatggggttccaccgtgttggccaaaatagtctccatctcctgacctcttgatctgcccgcctcggcctcccaaagtgctgggattacaggcgtgagccactgcgcccggccagtgctgtgattcttaaaatgaaatcttggagcacagtacatttttgcagtacaaatatattttccaaattttgggtaaagactaatattttctcacctttataaaatacattaattgaattctctgttgatttcacaacttcatgttaattatagaatgcagattggcatatttaaaattttcaatgttctgaacatctaactacataaaggacagttttaaacttattctttcattggaggcaggtattatgttgaaggaaactgggcagataatgaaaattctgtattggcaccctgcataggcacaagatattaatatataaaactatgattaagataacattaaattataaagtaatttttacaatctttttttatagattaacaaatacaaacttcatcagacattaaaatccattatttcagataaggaacaatgatttataagagccaagtggtggatttaacacaaactcacattttaataaaagtgttacaaaattttagttattaaaaattcaaaaaggttaacattttagatataaaaagagcaaggcacaaatcgatttaatgggagataaagggtaaagcatgcaatgcttagactttaaaaatccaattattccaattgctctgcatacattaggcagtcatattttagtgctatcccatgccttacttgtcttgctgccttttgtcaaagctcctgtttgcattttaattgacttggggaaaagcaagggagaaaagaaagggaagttgtaaaattaaagaaagggctgtgcatgtttgaaagcacctatgtgaccccctctgactatgttatgccgatgctttaaatatcattctgctccaaaagtaagatccctatcagtctggctagttttaaattgtcacttccaaatttaaatacattattttatgaaagtttatcccaccactcttaagagtacttaataaacacaaaaatcatagtagagatacttggaaacagccactaggctatacacactttccacatgctaaaagaataggccacaattttgtttatgttatgtttcacaactatttaatatctgcaaactttcatgttctcatctgaaaatgaggatggtgagagcagctttataagaaggctagtagaatgaaggaaacggtaatgcctgggcatgcctgatgaagtgcaatgtagcttccctgggagtggctcatggtgttttgttagacattctgaagtgcttttgtagctgcttctggggcagtgggtctcaaacttctgtctccaaccctttttatactcttaaaaatgttactgaggactccaaagacctttgcttatttggattatatcttttgacactgactatattttaggttaatgcatattttttttcaatatgtataataaactcactacatcccagcataaacaaatgttttatggaaatctacattttccaaaacaacaaataaagagagaatgatagcattgttttacatttttcaaaatgctttaatgtgtcgcatgaaagacttcgattcttacatcagcttctgttgtcagtcttttatgatgtgttgttttggttgaagcataggaaaaaaatctggtttcacatagatctggggttggaaaagggacggcctcgaggtccccttaaacagtctgggggacccctagaagtcctgaagccacccttgagaattgctgttctggaaaatagaagcaatggggagaagagtagagggtgtgtttcccagcactggtttgtgccaaatctgggaaaacttgacggaaaaatactagagaccctgagacttatgttttgcctccacgctgcctttaatctgattgcctgtccattgccctgccgtaacccattcccactttgctcctgccaggaagatcagaattctggtctgtactcatttggcagaagaacctgggaagagaggataagagatacttgtacaataacgccttcatattgtgcaggttttactatactacatgaggagagtggggaatgtgatttgatttattattgaatattatagatccttgaaatatacagatatgacatttacagtttcacaagtgacattgaagatgcatggcaggtagtcatgtcactttgttgaggcatgagtttggaacaggtggcaaagctagtgggtaaatgtggcaagtcactgacaagtgggcttagctgactctcagcacctccatcccagtgtaatttaccagtggccactcttgttgggtgaacttctcctaaaataattaaaattattgttgaaaggcttgggttttgaaggggttttgttgttttgtgaaaaatggccttgggaaattaaaaatccaactactattcttggaaatggaaacagaaggtgaagctatagggcttatttaaaaaataactctacatttgttttggtttactatttatgaaataattaaggacccaaatatttaaatttaaactttattgccttttatgaaggtaattaaatgtaattgtggtatccacaaatttgggcatttggaaatatcaggaatctcctgttaaatctgaatttacatttaatattagatgaatcagtgttgttattaattctcagttttgtatggtttagaaatcttttgttaaatctatttttaggagaaactgaaaagtattgattattgattataatgagtagtatttatagaaactttgtaaagtaaaagagaaacaacttatcaaatagaattatttgataacttatcaaatagaatagaaacaacttatcaaatagaattatttacttatgtaaaattttatgtactatcatctatgaaggactgaatttaaaaggcttgaaatatttgcctcacatatataaagtgctaagtgtttgctatttttatactttcttacaaataccaattttttaaaaaaatccaagaagaagaaacaaaacaagataatttattgagtacctgctctgtgccagttacttttttaggcatttggaatagactgcccagaacagaactagatattgtatgtcatacatcacaatattttattccataaaagtctccaaattcttagaaaatgtcccttctagtttctctgtgtctgtgtgtgtctttactgtaacttattcaaatttgctctcactgaaatatattattgcatgtggcaattcccagctgtttatttccatctgaaataccaaaccaaatatttcttaattactgttaactgatgatggaagtatagacagtataaaccttattaataaacttactacacatgaaaaaagataatttagcaaaacctgttggcaggttcatcctctagagatacattacattttgattatttttttattgatactccttcatatctaatagtttataaggacattttacacatatagttgaaaacatatcaacatattaactttaatagaatacaagatatagaatatgatgtttaaaaatagaagactgtaaataggatttttatacctaagttagcttaaatatgtaagtaactatttaaatatcttataagaatgttaacacatttttagaaagtcttgaatccttggtccagatcttcttatatctaatctgcttataacttttacctagaaaatcagccttagatgattttaaatgacttagcttacctacagccatctaaaaacttgttttggacttctgattctggatagatatagtttcagataattgaagattaccaaggtactgtctgcttacgacacggaaaagcttaatgtttggctaattttagttgcatttgagtttgttaatttttaatcagtaagatttgttaggtaaccttaaagttaagtcactgctactccccaacccaaagccttctcagactccccattcacacctctcacgtccaatcataattaaacactctgtgttctcataacactttgtacatatcactaatatggaatttgttatagctgaatatgctaaaactggatggcaaaattcagggaatcgaaggcttctgttaggtttctccctctaatgcttcaggtagtgccaggaaataataaacccccaacaagtatttatagggatcaatggattaatcttgaaggggcttttttacttaaaacgtaataaaattaacatggttaaaataaaagctgtcatatgacatgtgctgaaggtattttatattctatcctttatctactttatcttttggggagcatactcactacattctttttccatatggttaaaagagagtgattcaaactctctgccttaggggtgagcatgtgattcaggacttttgtagtttctttttcacccaattccccagttatgagggccaatgtattcctttattttgcttttgataattctaacggagtgtcacacacattcaatagcttcctggctaaaataacatctgcattttagaatttccccataagaaatatttatcaggttcaggttctttagaagtttaactacagtttgatatgcatatgaaattctattttattgcctctcctactacaaaagtttttcactctcacagtagttttatttttcttttcacagtatttcaagtattttgatcagagccaattacttttaaatgtagttttttttgaatgatgttttctttgtaacttatcttatttctttcttgactgtctaatatccgaggctttgttgtgctccattcttttctcatgcttgccatttgtctcgattttcttcaatgattttttcagcctatttttcttactcaagataaagaaagacatagacacatccattttatatttcagcaatatttatcttaaataaacctacaaagcggttaaagtaagatgtcccactgaatgtcatagatattaggaatggcttatctttctcttttaactctctttattaaaagagagaaactgctaaagagtaaatatttgtttttttgaatgcatctctttagcttttgacccccacctgatctctcaaaaaagaaaaaaagtgacatttttactttccagagcctacacacagacaaaaatggctttaaaactctatgcatcagaggaatgctaaagaaagaaaaatatttcatgttatttttcgtgttttcactttagcatttcaattacatgcttgttagtgtacattcttcttatgtttggggttggttttgatgagtgtagtagcatgatattttttagaatgttttattacaaaatcagccaatactgtttaaggattacattaaaattggtaaactgccaattgaaaaaaaacattaaaaatagataatatctgaataattattttaaataaaaatatgtgtttttgcctagtgacatccattctcacagaaaagtggtattgaatgtttcatggtacatctatctcacagctaagacattaaaatgtgttgagaaattagtttccttgctattctttttttttttttttttttttttgaaacagagtttcgctcgtctcactcaggctggagtgcagtggcacaatctcggctcactgcaacccccgcctcctgggttcaagcgagtctcctgactcagcctcctgagtagctggaattacaggcacccaccactatgcctggctaatttgtgtatttttagtagagatggggtttcaccatgttggccagcctggtcttgaactcctgacctcaggtgatccacccgccttggcctcccaaagtgctgagattacaggcgtgagccaccactccctccttgctattcttgagcacattgtagtaaaatgacctatttggagccagaaatgaaccagccacctacacaaactcttgttaatcttttcagccaaattatagccttaaattttaatctcagaagaaaatttttgtcactcaatctgtgaaatacaggatcaaataaatggcttttgctttaattttttttacacttcatgacatagttgcttaccatgtagaatacttattgctagcaatgtaattatcatgaacagtgtctgaaacatccatttttagtcaagttctgtgactaatcaagctaaaacatacattttcaagagatccacctgaggactgtctatccatggattttctatcccactgcactttaaaattgactgggagcttctataaaatgctctctggatgtgcctcataccaaataaatagtaatctttgaaggtgtggccttgggttatattttttaaaactctacagataattttaaggtgaaccaaggttaaataccatttatttgaaccaaatgaatattcagaaacatgttattcaatttttagtcacttgttgagaactaatttcttgacaaaaaagacattcactttgtggttaatgtcaaaaattttacctttcatttcttaatatgaaatatattgcagaaatccctgataatcacaaacacctgcattttaaaagatttccattattatgaactattttttattattatttggatcttcctggggagactttatctcactgggaggtaatctatgttaagtcttaattcaaaaaatgaaagttcttgagaaagggttgaagcatataggtcattagcaaaaagctgatgttgaaatattcactgaagtatccattataataatgaatactaaattactataagatttattttcctagaatagtaattttcccatgtgagcactctgcaatattttacagtagtaggttcacttcgagagttgtttctgaatacgtatagcatatgaactaaatcaaattggtaaaaataaacatagaagtgagggagtaaccaaaaaaaaaataaagttatatccaaccttttgtttcagaacaataaaatgcaatctactgaaataaaatatttgattaatttaagaggttggtatttagtagcaaaatttaaagcaataaaatagttttggtaatggtatttaaaagtaacctaaatttaagtatttcttctcatcaaaagatacttctattataataaaatatcaattttaaattataattcttaaaatatttattaagtgcaaagtttaatgatatactgtaccagagatataaatataagtaagagatgattcctgcctttaataaataggtattcaagtgtggatgacacagacatatgcagaaaactcgcaatgtagtgactgctatactaataaagtgtggtgatcagaagagggcatgtttcagttatgaggcattgaccaaggctgaccaaaggaagagatgttgaaatgggttttaaagaatcaggagaagttctccatagggagcagaatgggtaaagtgaatcaataaacttagagcattctgcagaaaggtaagctgttcaatagggacagaaatgagaatgtaagtgcaaagaccagctgttagtggggctgtagtctccttggccccagatcataaagggccttgaaagttaagccaaggtttctgctcttcttcccaggggcaatggaaaaccattcaaacaatgtaattttgagtttcttaagactcctgtttccttggccactttccttagcctgacaccagcttgccttcctacagccatacatgaattttctttcatattgatgattttgctaactaattaaaatgtttcacaaacaatgacttgatttcttaaaaatcagaacaaaaacagtgaatgtcccataaatatatgtacacataatttatattatttctcttaaagatgagccattatgattgaggtttataatttcttcagtatgtgcaaatactataattttgatgtataagtacaatcacagatgaaatacaaatttagtttataataagtttgaaaaagctttgcaaccaataaataatgcctacttcatctgaaaaacttgagaattaaatcagaggaaggagttgcagactaagggatttctggggaaaggctgtacaaataattaccctaagaacacagctgtgtttgctttgttgttggataaaaaatggtattaaccttaaggtttcttttataatcctgggaaattttaagttttcaaaatgttttacttgttgaaagtaagcaaattaatactacaaacaaacattcattcattcaacaaatatttatgaaacaccaatataagtgaggcaactttctagaaacagagtatgcagccaagaaacagagtagaactgtccctgacctcatagggcttatcttctagtgagggttgtcaatatgtgggcaggggtagagtcaaataatagggaaattaactggtgcacaatattaacagataatggttgctgttgaaacaagaagagattggattgctaacagagggaggaatttgttcatttttattgaatagttggagaagggttcacgaataaggtaacatttaagccatgcatatagaagagagcagcaagaacaaacctcaagtttaaaaagtgctccccgctgttcaaggggaagcaagaagtccaatgtagctgcaagacaataagtcaatgataggatgaccaacaggagatgtggacaaaatgtagagatgcgtggagcaagggagatggagccaaatattgtagggccttgctggccatttggggaccttttttttcttttactgagtgaggtaggaattcattggacagtcttacattttagaagaattaatctggcttttcctaaatctagattgtggagaatgagggtataaggagtctattgtgataacccaggggaaagctgatggatgcttggatcagagtgaaagcagggaaggcagggacacatggttctattctaagtgtatttgttttgaagacataagaaacatgaatatcaatatgtaaaatattaagttactatctacttaatatgaaaattatctccatatatgtgacaggcttttattattaccaaaaacacaataatcacaaaggcttcttcaactctaaaacagttaagaaaatatttcatatatttttcattgacatcaaacatcaaaaaggagagaggaaaaactatctttgtgattgttgtgtgtccaatctatgtgttggcacataaatacatttactttacttataatatagtatctgatctgaaaaataaactgttggaatatatgtggatgtttgtttccttctaatcatttaaactgactgtgttattgaaatcaaatttataaactgcctgcctatgtagacacccagaagcaattacaaatgcattgaaaacatcattacttacattctggccctatacagtctagaagtggtatcttttcttcctggctaggtagttattctgaatcaaggagtctgactacttccggtagaaagccaacagtgggacttcaaccattacttaaatgtaggctggagacagaatctgaaaaggttttcatttgcaaattactgcataacatactacttcaaatttattagcttaaaacatgaagcacttatgatttctcataagtctcaatggatctcagctctgcttcttcccttgtctgaagtttgctggcaggttggtaggggctagcccgtctaggatagtcttagctggtatgactcagctctgccccttggattcttctcatagtgaaggtgaaagtacatgggacaaagtgaaaaatgcacatactttttcaaacctctgcttgtgttaagtctgataatgtcctattggccaaatcaagtcacctggccaagcgcacattcatggtgtgggggtaaaaggtctctgattatttaataaaaagaacttcaaaatcacaagaactttaaagagcaaacaaaacaaacagcctcaaccacaaacacaaaaatcattacaaccatcatatctgtgacaagtgtcaagtttggaagacaagcaagtttggttaaggccttattccaaattctgaccttttgttgttcaccaaaatgtggttgcagtgcctagaacagaaaagtgattcaaaggctgtttaaaacacttccaaatactccccccaaagcttaccctggtaagcacactaataggatcacacaagatcacattttggacacttaagtgaaaaataagagatacaagacatgaaattcaagaactattcagttcagtctttggaaaaagacaaggcaatttctggttggagctgatcccctggctcttaaattgtacttgatttcttcaagtttcaataatcagatctttgaaaatttcaccccatgcactctgatatcttatactttttctcttttattgacatcagacaacagctaaattggattgccaagtatgaatcaaaataattcaaagatgattaaaatattaaggatgtctcaaaggcatgacaatgtaccagtctagcacactagtccagaaaatgtaaccaagtctagtgtagtgttttccagaaggtcttttaatataagcaattaatttttaaaatgttacaataaaattaatataaacttcatgcctagaatctgttaaactcattcttcctcctgataattattccaattaatttgtggtcaaataatagtgattatggaaattttagagattccacatcttcttattctgactataaaccacagtctgggtaatttgctgcatcaataatgtcaaaattaataagctaaagtcaaaacagtattagaaacagttttaatatttactacaaatatacctaaaatctgctttagacaagagagaattaagtaaataaaagccaacaacattaagaatttattttgttattaccaaaaactacatataacatttcctattatccttgattcaacgcttttgccagttaggactccaatatgtacttacccatatcccaaagacccgtattctgtatcctgatgcctctttctcttccttccttgattaatcattgctgtaactgctgtagctgttctatagcagttctctcttttctgccatagatggaagccattttgaaaattctaacttccagttgagtagccaggaatttttgctattaataaatttctttcttgtggaaggtgtatgtgtgtgtgtgtgtgtgtgtgtgtgtgtgtgtgtgtaaatgtgtatatctaaaactttaattttcctatcttattattttcttccccttagacaaatctcagtttgttattattgtacctagagtaggagctaagaataatggctagtttagagatggaagtctgaaaaattcctgaatctaagcagttaaccttctttctatgttccttttgatgagattctgtactgtgactatttgtaaatataaaagcagctccctgagacagatggttatttacagtgttttctctattatgcaggataaattattaacaagaaaataattgaatattgaatatgccctggcaaagaaataatctttcaccaagtctgtcacacagtatgctgcaagcatgcattccaattagtagagtgggccaagtagattaatgtatcaaattgtttaaattcatgattcaatcctactttccttaagaacttagtacaattgcaaatcaattattattcaagtttgttaactttctgcaaatttcaactatattttatgactcatggatttaaatcataattcaatatgcatataattgaaaaagttttctcaaaagcttgttttcatttattttcattttgatagcattatatcacagctgatcaagtaatttatcatgttaacatattaaaatgcattcataggaaatattttacctcatttttataagtaattttttaagctaccaaggattggaatagaaaagaacatagttaggagagggaatagccaaattattttcatatctttggatcatactatcaataggagaaaaagcaaaactgtttaaccattataaaataacagtagactatatcaatggttctcaaagtgtgcagtacctggaaatttgtgagaattgcaaactctatcaccccagaacttctgaatcagaaagtctgcaattagggcccagccatcagtattttgacctcaaactgattctgatgaaaaggtaaagttgcacaactactctcctattgagcttttatctcttcaagcactgttgcagtcatattatcatttaatctacatttaaaagacaaagtattatcacaatatttaacaaatgagaaaaatgaaattcaggaagattatgattagcttcttcaaagctcctcagctacattgatggcagaaccaatatctgatttgactttcactaacatttgtctccattaacaaactcataattttcagcctaaatggatagaaacattaaaggaaaaggaaagtctaagtcagctgcaaagaattatgttacatagtttctgctatggagccaactttcattctttcaacaagtattataccagggactatggtaggtacaggagatacaaccagaagcaaaacagagttctttctcttatggatcttgccatctaccacgagaagcaggaaaaaaaaaaaggataatttcactatagaagaaagtatataaaggatgtaaaggtcactacgatgggcacataggaaaaacgcttcttctggctctaagattaaaggaagaggaggcaggtggttcctggaacatgaggtgtaactaatctttcagtagagtaggggagaaaatatcttaatccataaaaatagctaaagatgtgagagagaagaatgggcatgcatctttattatcctgccatttgttatctaaagaacagtgcaaacatttttaattttcattattatgaagggctattgtctgtatattatatttatatgtatgtgtatatatatttatatgtgtatgtgtgtatatatatgtgtgtgtgtatatatgtatttgaaatccaaaatgttttcaattgagttttcttattagaatgcaataatttaaatattttagagcataaaaattaagctaatattcattcagtttattaaaaaactataatttggaagattaaaaacaaaaacaatagttcacagcttattttatatttgtgggaatcagatacaaaaaaaaggtgacttgatgcccctagaaaatatttacagtcaatacaaacatgggagacagctttgaatatggtgtagaatacatgttaataaaaatgtataatatacacaaacttctggtctgctgcagtttgtatagcattatgaaattaatgaaaatatattattttcataacaagtgtcagcaaaatgcagcacagtaatgttaaactattctatttttgcagattcaacctcatattcagttttctcttacactccagcattacatatgatgaatgtgaaaaaataaacaggcaaacacctaatatattatagcagatggagaaaaaatagctaaatcggaatgatttccctaaattttcagtatgtgaagcaatgaaaataaaaatttaatattcagcctcctcattttaattatttcacaacagtgaacccatagtgatcagggtattttgtgtattaaattatattgtttggcattattgttacgtgattctagataatatttctatcagctaactaatttctacattaaccaaaatgtatagctaataggccaataaacatgacgagggaaaagaggactttctaaccctttgtgagtccacaaaaatgctcatttctagaaaaaccaaagaatacattgacctcactatcaatcaggtaatgtcaatgttagctgcagctctggctgtgcacaaattctttttgcaacaaggtgagacataaataaatatcccgtcagtgatattaaatatttattacattaaacttttaagtattgaaaacaacttttaatctcaggaagaaatattatgatagtttaaaattagttcataaataattggatatttatagatacagtaggttgctttcagagtttgctctcagcagggaattaaaatgcacctctatgcacatgctggtgcagaagagatgaaatgcaaaaccaagatctctccagaggacaccaacattcttggacaatttccaaaaggaggcacaaagtacaggctagttctaatttggtgtctgatagccaagagagaaggccattgttgtggaggtgatgaatggggaggcaatgaggaggggtcattacagaaatagcaagcagttgtggcagttttttgagttaaattttacaaagaatattttgaaaacaagatgggccaaacagaaccaaaccatctgtctatcttgggtctcaaagctgttggggaagagacagttattgagaaaccatatccatcccaaagatcttaaattggaagcatagtcaaggggttataatgccttctttggttgacaagttctaacccgcttcagtctattacaatctcagatgttgtctgtaataatgcttggtgtcctatgtcgttggatccagacatcgttggaataaccaaccatgtcccagaacagtgcttaatggaaacaactaagtgagtctaggattaggtcagggtttgatattatctatgctatttattgactaaaatatttcaaatgcaatctagcctggaatagaaaggtagacaagtcaatctagaatagaggtaaaaattattcaaattaattttgcaagtggatgttttaaatgcatgtctattatgacatgttttctagactctttaaagaactatgtcagatatgaagtagtatttattcgacttcagagtgaactgagacaacccatgatttagaaatgaggcaaaaattgtctcagaatagactacagttaaataaataatacttataagtttataagtattgtataacgatactcatgcatataagaaatcatggtatttctccatttacaattttgaaatttctattttcctattaaaataaagaaaaatacatcatctatgctagagggcttcatgtagccaagtggcattactccagcattgagcccccaaaagaagaaaagaggtgataggataaggaaagagcacaaagaaacttgcagtaaactgcacatacttttgtccttcaagaggcattatattttccttaaattcattgccagttttccttggggaccattgtctgttttctttaagagaatgtgaggatatatttatgtattttaactgctaaattaatagttaaaaattcaatgtgacttttatttctttcaaagaatgagattaaaattttaaatggtttcttttattaaaaagagactatatgcagttttatccaaatactttttctatgtgtttaattattgtataaccactaaacatattatataatttgtttttatgcaatagtagtggatatgtttttaaaagtttaactaatatatttttaagatgaatagaacaaacatttaatatcacttaaaagtgatattagaatgtactaccctgcactaacagctatttttgttacataaatctttaaatacactttcttattcttgcagtcatagttaaggaagaagttgtagaaaaaaagtaaacatatggtagatgctatttattcttttttctggtaatatgaaaagtcaaatttagaatttcaagctagaaatatctcagagagtatagtatcttttaccttaaatatattctaaattggtatgaaatatttcagtatctcatccaaacttgtcataaagttcactttattattttcattttcttatttaatattctcttctgataactgcaacattcgtggtgaatgtgattcagagttttcagtggctgtgaaaagtccagttagtcatagaattggtagctatggaagaactttggagaatatttcagattcttatagtgtgttgagaaatataaatcattgcattcaaatattaactaaattactgctcacctctgactgtgaaggagtcggggggggctcagattgtattggatttactcaatttattctaaaagtgccaaatgcatgtttggacagtagttcattttaaatttctttaaatatctctagtgtcatatataataacaaatgaattataatgtatattcaatgactatatttagtgtcatcctgcttttccttctttagaattttattagaccaccttacataaaaacagcatcatcaaattctgatgtggtatgattttctctgttgaataaatatttcaaaaaagccaggggcattagttaagaggagcattaaaaaaacaacccaaatgtcaatccaagttagtatggataaataaaatgtagcatatctatgcaatgcaatgcatccaatgatggaaatgaatgagcacagagcaaaataaaatgtgcagtgaaagaagtaaaaccaaagaatacatatcctatgattcttttttataaagagttcaaaatcaggcaaaactgttttatatcatttagaagtacatactataaagagcttcacagcaagtcaaaaaaagggggggccataagtgttagcatagaggtttgcctccaggagggagaacagcccctggaaatagaaagtggcacaagagggttatcttctggggtgttggcaatagtctctttcttgacctgagggcagttacataggtgtttgctttacaataacacattaatctctgtagccttctgtatatgtgccctaattctcagtaaaaatagataataatgatgatgatgatgatgatgatgatgatgatgatgatggtagaatagatggatggatggatacatagatgtaaaaggaaagggaataattaaaatcaataaaactaggatatttgatctattgctgtctatttcaaccaagaggtacagttggactgccatagaaggtacatcataaagggtcatggtacatactttggaaagaagtctaagacaggaactaaaaagttgggtctagaatccagatctatactttgacacattctgtgtatatcatggaaatgatcacttcaattctttgtgcatcagggttcttatctgcccactgaggtaataaccatttatagaaaagtctgtgataatttcaatgagattatacaaattatttggataataatttttcatctgcatctttctcccaaatcctccaatcctgtacatgaggatgtaaaaaaaattatgaggtataattaccagtaagcaccatctacttttacatatttcatgtatgcagttttttgttcgacaaacttttgtggtttttttaattattttgagttcaggggtacatgcgcagcatgtacaggtttgttacataggtaaacatgtggcttgctacacagatcatcccatcacctagatattaagcccagcatccattaactattcttcctgatgctctccctcctcccacctgccacctttcaataggccccagtatgtgttgtttccccccccatgtgtccatgtgttctcattattgagctcccacttataagtgagaagatgtggtatttggttttctgcttctgcattaccttactgaggataattgctttcagcaacatccatgtccctgcaaaggacatgatctcattcctttttatggctgcatagtattccatggtgtatatgtaccacattttctttatcaaatctatcattgatgggcatttaggttgattccatgtctttgctattgtgaatagtgctgcaatgaacataggagtgcatgtatctttatgatagaattatttatattcatttgggtgtatacccagtaatgggattgctgggtcaaatgctatttctggttctaggtctttgaggaattaccacaatgtcttccacaattgttgaactaattgacacttccactaacagcataaaagaatccctttttctccacaacctcactggcatctgttgtttatttgactttttaataatagccattctgactgctgtgagatcatatatcattgtagttttcatttgcatttctctaatcatcagtgatgttgagctttttttcatatgtttgttggatgcatgtatgccttctgagaagtgcctgtttatgtcctttgcccacttttgaatggggttgtttttttcttgtaaattttcaacaaacttttgttgagcaaaacactgtggtcatgaataaggaaaagggttttattatttttatgttgcatacacacatagtcacacatgttcacatgcacacatgtacatgtaccacacacacacacagaggcaattttttatttcttaattcccttttatgaattggtgtctctaaacatgataagggaagaaaagtatcaactaatgattatgcaccacttttcagaaatattgaggtcatagtctggaatattatgaaagattctttcaaattatgaccctcttgaaaataatttggaaataaactgattttgcatttaagtgacactgatggattaataagttaatgtatacctagattttgtgatattcataaaaagattgtaactgaatatttgtgtagtattgatttgattttagatacctttaattaatagcaacctaagtccaacagcacattttgcaaaagcaaatttatacacctgaaataaaatgtaagttgattttattaaatgaaagtccaaacttacttaatatgagtccattgagtccaaactcaatgatttaaacatattttctccaataaataatgccccatagctttcttaaattaatatttactcctgaaataaatattataccatatttattggtatgatatttaatagaaggtaaagaatttaatgtgcattttcttcctcaaataaataaatattgaacttaacttgtccttcgagcattgagatgtcttccactaaacacctacagctttaaacacacctcctggaaccctgcatagaatgatttaatagttacatattgagaagaattttaaaaagtgtctctgacaccctctttattccattgaagaacttaccactggtgggacagaagaattgtctgtggtcgccaaggtttttttttaacaattactaaaaatttactttttacatcttcatgcccattggcaaagtaataccaaattgcaaggtttaaactatgtaggttttatttttttatacaaacaacatttatttccaataatgcaattaaattatttgttgtctttatgtattatagctatgacaacagtacaatatatacccaactctatcatttcattctacaaccagtagtacaattagaatttgtgtctatctcttagcttattttgaactaattttcaggacacagcagtacaatgtgtagagtacagtgtggtgggcatcaatggttattctgaggaagaaaatgggcattaaattcttacctcctatgaaagaaacatagtaggggtgtaaatatatttatttcattcataactttgataactagggcctacccatctgccagactatattattgtgtaaatagctcccatctgagctaggtgtcttgctaactcagatcaattagtacttgtaattgaagctcaataataattactgctacatctagtgagcatttaattcctgtgtgccaggcatagctatagatacagtttaagctgctcaagtttaacacagtaaaaatgataagagcataggtgcttataaagaattactattacaaggaaactgggtatgaatacagtttttaagggtataattttgggccaggcttggtggctcacgccacactcccaacactttgagaggcctagtcgggtggatcttctgaggtcaggagttcgagaccaacctggccaacatagcgaaacctcatctctactaaaaatacaaaaattagccgggcatgggggcgggcacctgtaatcccagctactcgggaggctgagacgtgagaatagcttgaacccaggaggcagaggttatagtgagccaagatcgcaccattgcactccatcctgggtgacagagcgagactccgtttcaaaaaaaaaaaaagatacaattttgaattcactgcctatatctaatttcccagcatttattacgattcaccaaataaggtagcaatcatatatagggatttttagatcatgaggtttttaggtgtcttctggattcagatgagttccttgaaatcatcttgcaaactgaaagtgactgtgatataagaaataaccataaggctatggcaaagctgagagtgacagagtttatgcaattttccttaggaaaactgcatgatatctattttgaatcctccacctggcattactcattttatttatggaacgcattctccccagagtgacatcttctttccgtatccataatgtataattgtgatccttagaccttatcatgaaaggacaggtggaatattattttaagcaccaggatatttcttagtaaatatcatatgtagagtattgaccctttcagggacagcaatcacatagcaaaaggaaagcacaattttatctcttgttcaatcacattgttattctctttattctctggatttagggtctgttcctataataggtaacacttctaaagataaagaaagcacttaagagaattttgggatgtgttccacaagagacctggaccacattttcagttaatagtgtttgataaattgaccatgaaacattaaaaaaaaaacacagatcttaattcattaattgctgttagcattttattcgtaagataattaccatacatgtaatcattaatgatctacgctcatggagaatgtctttacaggatgatatttctgagatgttttaagactcctacattactgaatttgtaaagggaactgtgatttttgtttcaaaaatttaataagttaaatgattaatacatatagtcctcccagaaaaaaggaaaaggcaaatcatagtcatctctttcattactgtaaaatgtggtaataatttagagaccaatattttgttgattcaatttttgtcatttactaaattaaacaataatatgtataacataattccagttatgagtttactcttgggagtaactatatctttacttcatctcatttcctctctaaaaagtcatctggatgtgaaagtatacacacaaggtaaaatatatagtatattatagtgtaaaagtatgatttttaaagaacttggaaaaagaaagaagtttaatgggacttatattgggttctatagatgcagattaaaactaatagttacagtagttttaattcctatgtttcatgtatagaaaccatgctatcattcttctaaatctgtaagctttttgctgtagatttaggatttagagcattatatctaattctaaaacaaacatttgaattatgaagaagttcttatgctgcagaaatttatttaaatttagactgtcattagcatcaagaatattttttattccattaacaacttttaattaatcatacaatttgcttttatttcagaaaataccacgtatctttatagactaggagctcagatatattatttccagctttcttgatgttacctcatattgaagttgccaatggtaggactgcacaatctgaatacatatgatgagatattttatgcctcgttttccatctgcttgagttagcaccctttcaccattggccatttcatactacccaatttccatgtaatttgtctctctaatcttgtcagccccttgaaatgaaggtgcactttattcagggattattttcatgctcaagatcattttgtgaattattttatatcattataaataatcctactgttaccttttcaatacaagaatttgatttcccagcattaatgggttcattcaatagtagtgccaagttcatacagcaacactgtaattgcattttaatcagaaactagtaatatatgctgaagatactttgttaaattaacattattgctgtgattaacaaagcacactgttaagtgaatattgcatgaattaaattacatactagatcacttacatagtttaggatttcatgtgctatctagctacctcttcccacaaaatctacatccttatctgttttactcataaaaatgtaattcttgaagctcataagcatagctacttaaatgattcctttgcttaatagaaacatctttgttcactacaacaagcttatctgcactacattttttaggaataaaggatatgtgatatgtattatttgaaaactggcattcaattgccacacttggctgttcaccataaaactcctatttgaaatctaactttgaggacttctttgaggatactagagttatagttctgaaatagttacttgcagaaatgctatctattaatttaaattttggtttaaaaaactcataatatttttttttgagacaaggattcactctgttgcccaggctggagtgcaatagcacagtcagagcatattgcagccccaaacttgtggcctcaagtaattctcctcctttagcctccagaatagctaagactacaggcaagcaccaccatgcctggctaaatttttttttgaatgttgtagaaatggagtgccactatgttgcccaggctggtcacaaattcctgtcctcaagcaatcctcccaaagtgctaggattactggcatgagccactgcacccagccttaatcatttttagtgcacagtttagtggtattaattatagtcatgttgttgtaccacagatctctagaactttttcattttgcaaaactgacactctgtacccattaaacaataaatcctcattttcaaaatgagatagcttctctagatttagtaaagctctcttctttttcattattttgcttttctgtgaaaggggacttcaaatttattttgaggaaacaaatgtaaacactcatcttaaagtatgtatattaagactattttaataatcagagcaaactttcatttatttagctattttcagtttgcagcctaccatgccaaacattactttattgctgttccctgcagtccttttgacaaggatggagcactgtcagagctgcactggagctggagacagggatagaggacactcaggatgacagcccccacccagaatcctggagaggaaagttgctattgttgaaaacataatggatctggttgttattaaagtacctgaagtcagctgcataaattgggaagcatatgcacgcttctgctttactgtggcaatttaaaacaatataaatttcataaaattctcattgaaaaaaaatgaccaagaaaagccctaaaaatagtaggaaatgttacccatcattacatcctccaccatcaaggccaagtagtcaatacccacgccagataagcactgtgtgcctatgtgaggtggtcattaaagaatgatgaggaaaggaccacagaaatcaactggtgtcttcccaaagtcctggggacgctgaggaacacacatgggtctcataatgtccatgtccttcccttatacctcaatgctctttccaccttgccctggtggaaagtcttgtccatatcacctctaatccagcattctcaaagcagcacaaaactgtcttcagaagactgaatgtttctacattccttcatattaattccaggaaaagaattcccaagtcaaataattcaaatgctaagtgtattttttaaaattgtttttaggcactttctcttaggaatgtaaactctttgagggcagggtctatgtcctttcatcattgtgttcatcaggctttatcattgtctagcatatggtggatggataaacaaccatctccgtaaagatatctgatttctattccaactacacaagctccttttctagtatacacagccaccaaaataatgcttaaaacatatgtctcagaatgacaatcaagatagaagtcttaaagcaagaaagatgttttccttgtttgttcttctataaattctctaaagattcataaaatttagctatacaatctacttcagataatggcttctagatgctatgtagaaattggcccattatgcaagataaaaatcatctaagattataatgcaaatcagtcatcataaaaaatataaagatctagaatttatagaaattctactgagcatttattttatgtgaaagaaaaatacatccacagtacatacataattaaatgtaaatgtatgctgaaaaagttcataatcatgaaaaatacatatcttgatggactacttttatttggcaacctttaccttccaatatctgtcataatattagagtagattagaaattatatctacagtctcaactcattttatgaaatatgagtaacggtaggtatagataatttattttccctcagctgtacataaagatggataattacatctttctaaaaaaatgaagctgaccaggcgcggtggctcacgcctgtaatcctagcactttgggaggccgaggtgggtggattgcttgagctcaggagttcaaaaccagcatgggcaacacagtgaaactctgtctctactaaaaatacaaaaaaaaattagccgggtgtggcgatgtgcgactgtagttcccagttattcgaaaagctgaggcaggagaattgcttgaacctgagaggcggagcttgcagtgagcggagatcacgccactgcactccagcctgggcgacagagcaagactccgttgccaaaaaaaaaaaaaaaaaagaggaagaagccattaggtctcttctaacctttacctttgcagactttaatgttgtcagctagtccaacatcattatgcactattatttgaaggtgctcatccattttcccagcatcttttgtgttgtcataacccttacatgcagtatcagtaaatatggctttattgtttgacaacataaattccttagtgacgttttcaaaagaataagagtttttaaccatttagttaaatagaaataaattgatgatgggaaatgtctgcattctatgtttaatttttctatcaatctaaaactgctctaagaaatagaattcattaactaaagtaatgatgtaggaaaagtttaaactaatttactgtttacttaaactgcaatagcaaaggcaggagaataacttaacaaccttacagttaattattttacaggatatgttacctgcctttcatcttccctgagtataagacaaggaagcagacttaaactctcatgagagaaatgtaagttgtataaaaaaaaaaaaattctgatggtcagagtctgctaatagtattgaaacttctggatttcatatcctggatgcaggtgattaaattgtctggtatagcttaacattctcttgcctagaaagaagaagataaattagtcagcacttggaaaactgatccaacttcttgttactataattctatatttctcagactggtttgctaagcccattagaacaggggcttcatgaaattaaggtcacaggtctaattcttatttcaacctattagcttccctttcttctgagggactttacttcaaacatcagccaatcatcttgtaactttcacccagtcacgaaactcacaagacaacatacatggagtggtcaggcacctactcattcccataattctctggaacatacttcagtgtgggctggactatcggtgtcacaagaagatacatgacaccgcagagatggcccagtacagtttttccttgtcaaaatcataaaaagactatggtaatcctacaaattctgattcacccgtgtcaaagaaaggaaggaagcttcagaaggttgttttcttttctccttcagagacttacaccaaattattttgaatttgcatttttttccagtctttaattcttgaccagtaagaagtctctcaactctagtcattgaatctaccaaaatattttgtttcaaaaaataagaaaaaaatattgcatttttctacatttttgagtagaagaatctccctaatcattggttataaaaaatgaaaatataacactgaacaagttaatattacaaataacaaaataaatgcccactgtgtaaaaataatgcaaaattcatatttcaaagttaccataatttgaatacataggtctcttagagtcaaaaacctcataaaatgtgtgatgacatttttcaggacatatgtagcatcttctaatcagatgctaaatgtgatctattaactatcacttgggttgctgcagccctacatcgattgttttatcctgttgataaaataaaaatttacctcaggaatgactcactggttagtaaaactgaattctcttaagcttaggacttgggaaaatcaataattggaaagataaatgttttgagtcataatgaaaagcatgtataataaaatcctgtataagagcctgaggcatcatccaaatttatagaagtggtaactaagtgttcaaagacaggatagaggaaagagcctagaaacctggttcaatgtctggaaatatttgtctctttagagtgataaatgagttttaatcaaattgactgtagaaatagaaccaaaaggaacattattctaagtggtatcggtaatcaaggaagaaaagcctggtattaagaacttaccatcttttcagtggtcccttaagatgaaccaacgatttgaagaaaacaaacttgattataatatacaagcttgcctatatttatttataaaatattctcaaagtgtagtttaattttaataaacctctctctctgagtcagggctcataaaatttaactatagtacctggcctaatttttttgagtcatatgttaatgtaaatcattaattaatctcatatattgatgagtatagtatgaattatctttttataatatctttgatatataaatattcacataaaaggttataatgtgttctaaagaattaatttctgactatacattatatactactagtgtctagtttaagactatatatcacttcttgtttgggaatttatgtttatatttaaatgtcaataattatcttcactagctcaccaattacatgcaattagtgattacaggcaaataatttcctaaaaatttgaatgaaatgatcttttaaattgtgttatgaaatatcaaacaatatagagtttggattggcaacagtaaatagaacagagcatctccttctacccatagcccttctctgacatcctacaaataggaatgaaggagttcctcaaatctgcacagtcaccttagggcctgggtcaggttttacccccaagacacatatacgacagaaagacaggaaagtgtaatgtgatcaccagtaatgtttctaaagttcaaatttaaaactttcacagccatttataaattcttatataagtaattttaatcgtaatgcattgcgaataacaaaaactcctactgtaatagctttcttgggaatccactcaatcagttacatatgtataggaaataaaggaatgccttcaaattataaaaaatactgaaaaatatttaaattggatatatttaaaataattacttttttatatagaatgccatagatcagaatccatatgaaaattgaaaacatgacctattatttatcagctcccaatgcaattataaatagatttaattggcactgggatttaaggcttacttactagtgtgtaactaattaatagaattttcagctcactcagcatgtgacttcttcaatgataagctgaagttccgaaaaaaaaaaaaaagacttaaaatgactatgcacatgatttttaaattactctccatgtttatggagtaattgagaaacaaactaagtttcatagtttctgaggccctgataggaagccaagtaaggatttaatatgataaaaaacaaacccacaaaaaatcatacattaaaatactagtaagataaataattgctgtaagtgagcttctatattattaaaactttttggaatgtaattaaaattaattttagagaatttttaaaaatagttatgtaagaatcaatttctattttgaaaagtgtattatgactactaatgctccattggtttaaataaataacactggaattctatattttatcataatcatctttgttactaatatagctgattattatactttcattaatgccctttattcaacgtatatttttattctttgtacactcaacaagactttgtttagaagtttctgtagtcttaacctgcctacctcttctgaaatgtctccttattctctttttatctctaagctttctattaaaaagtatgtctaactcaatgctttcttaactacatttccaaaccttttactatgccaggacattcttcagattcctagaaccattggttgctgttctcatgttccagtgtccttgaattactattgtctgaatctgcattctatctataaattatgcatgtcttcaaatagcacctataaacttctacttctgcatgctgttccataattgccaaattactgcacaagaatattattctgactatacagcagcattctgaaatcacggatttaggatttatatagatttatgtagatgcttttaatatccacgctattcccggcatatttttccaccctatatgctgcagttccctgattacctggcacttctccaccatctctttcccctagtccccaatgataatgcaattgtcttccattaaactgccttctgcaccaccttttgtagggcctaagtcctgtatcttaatggtacatttttataatttgaaaaattagatgtttaaaaaaggtattaaagaaaatataagtcattgagcatttttctctatacaatcaaaagaattaataatatattggctgaatgctttagagaaagacttggaaatagtctgaaacattttttctttaaagaaaactattttgtattttaaaagaacctatttttcacacataaaggggacagacttttgttttataaaatatactaaacatacattctagtgtgtacccaaggcagtgtctgaccatctgctggtaaaatttaagggcatttcaggtcaactcaagcaaataattttcagttcttcaaattaggtattcctgtcaatattgtattacatttgacatttgcactgttttattgggttagagccctaagcagaggaatttttttaaatttacctgatatgtgttcaaatattccctagtacacttcaaagggcctaaaacgtacgttttgaatgaataaataatcaaatgcataaatttgcactgtggaatttacatgcacagttaagccatcaaatgtaaagacagatttctagtatacgcccccattgtatgggtattgcagattttccatacctggtagtcatttggtatgcttggaaattcccaaggatacaacttatattaactgtttctaggtcctgaattttcttctagaaacctgttgacaaacaaaaaaaaaatgagagggaattaggagatatatgttgtctttctacctctgcctctaacagagggactttagacaaatccctggactccgtagtttacaaacgcacaaattatgaggacattgtttttctcttagtggctatggcagattcagattgtattttccaaagttggcagtagcaatatttctcatccaacattctcttccacaatgtcacgatgacattcctctcattgagaggtgaaatccatgatccctccctttgaaaccgggtgggcttggaactcccttgttactaatagaattgacagaattaacattgagtgacttctgaaggttgattaggaaaagccaagtaatcaaggctttgtatatggaagcacttatgctggaaccctgagcatactataagcccttgactatgcttagtccactgtgctgcaaagaagcccaagttatattccagagaacaaccaagcagagcagccaggcagtcctcagcttccccagccactcaccattgcagcttcagctaatctctaactgcagccacaggagagactttaagctaaaaccacccagccaagtcctttctgaactccagagctttggggaatgttaaatataatagaatactttttgctttcagctgctatattttggagatatttttaatgcagtatacagtatcattccttaggtaaagaaaaatgattccatgccacaaattgcttctttattctttgaaaaaaatataacctttctaattgactacataaatgtttttgtcagagatatgttagttaagtgccttgaattgtttcaggaaaacatgctataacaataattttgtttatcatatcatgaactcattaaaaataaaatgttttttagttttaattacaccaagacacaacactgcatcataggagtaaaccacttgtaaattgtaattgaaaatgtaatttttgagggctacaggctgggtgtgtatagtctactctttgtggctttaatcctagccttcttgaatcttcattagtgaaatctataaagaatgtaatcatgtatctcagaagaatcatttgttaagtgcgactgagatgatatattccatcatgaatataaccaaaagaatatcttttaggatattcttttatatcttttttccaaaaaaaaagaatcttgaatagattcatctgaagtctaataggttttgttttatattctgtttttacatactggattagtgtggatatctagaatgttaggagcctctcaagggacataactaatattcatcaatggatccttcacctttactaaatattgtccccatagtagatggtcagtaaatgtttgctgactgaataaaagcctacaagaaacagtgattaattagagtgtgactttaaaagctaatcatacaaagtatgtagttatatactttggttaagaagataaaagtttatagtttgagatgcttcttctactccaaggtcaacacactctctgcaaccatagctttatagcaaacattggactaggtatatgggaggacaggtacattttcatgaatccaaggtgaaataagaacagctgatgtgacaaaaaatcaacgagatccaggcatggtggctcatgcctgtaatcccagcacttcaggtggccaaggcaggaggattgcttgaggtcagaagtttgagaccagcttgggcaacagagtgagaccctgtctctacaaaaaataaattagcggggcacggtggtatgcacctataatccaagctactcaggatgctgaagcagcaggatggcttgagtctaggaggttgacgctgcagtgtgccatgatcacactattacactccagcagggacaacagcaagtccgtgtctcaaaagaaaaaaaaatcaacaagaaatcatagaagttaaatttatagtcattaaaattaaaaaacacaaaatagagcaatctctagttcagatataaaagtatattaaggaattcatccagaacacagaaaacaacataaagaaacataaaaatattgacactatgcatctaacaagagtgctggaactaagaggttagaggaaattttattcactccagaaatatttactgaatacctgctatgtgctgggtactattcttatattattattattattattattattattattattattattattattattgagacagagtcttgctgtgtcgccaggctggagtgcagtggcacaatctcagctcactgcaacttccactccccaggttcaggcaattcttctgcctcagcctcctgagtagctgggactgcaggcgtgtgacaccacacccagctaatttttgtattttttagtagagacgggatttcaccatgttgaccaggttggtcttgatcttgtgacctcatgatccacctgccttggcctcccaaagtgctgggattacaggtgtgagccaccatgcccggccgtgctaggcactattctaagcacttgattttgcaatgaaaaagccaacaaaaagtcctcctgagattttaattttataagatggtgggataagataataaacaaatgaacaaataagtatataaaggagagaagcaattgatactatacaaaaattaatgcataataagagaatagcaagtgacaaagaaagcgatatttgagacaagatggtctaggaaggactctcagatatagttaaatttatagaaaaactggaacgatctgatgatataagttttgcaaatatctgggagaagactgttctaaaaactggaaccacagcagataaaagttttaaggcaagaatagttttggcatacttgaaaaacaaaagactagtatggcagagaaagcatatttaaggaaatgataggtaagtattttcagaattgaagaaaaccatgagcccacagattgatagcaccctctgaaggcaaagaaatataaatttatacccaaacacactatgtgggactgaagaatgtgaaaaattaggaaagaaatcctcaaagctatcagagctatcagaaaaactaccagaaaattcagacagattgcccacaatcaagtaccagataaaggccagtaaacaaagtagagttattttgaaagtcatgatggacaaactaatccagatttttgtgaacataaaaatgcattttcaaattcaaaagtgaagccaaagtaaagacatttttcagcataaaagttgactgtttaccacccacagatgtacactagaagaaggagaaggaagaggagggaaaggagaaggaggaaagatagggatggggaggagaagaggaaggaagaggacatggggaggaagggaaatcagaaataacagtactcacagaaatgaataacatgtcaacaaattcatttaactagtaactgtaaaaaacaaattatttttatatgacaagtaaacacgattgacaataagatggaaagtaaaatcacactatgatttgcatcacatttagcaggaaaataaaaataatggaaaagcacgtaaacatttaaaactgtttagactgatacacatggtggatataacagtatttctagtagtagtaaaaagtttagttcaaagatttaaatttttaaaattataaatattgctgatttggagcctcctaaatacataacattttgagaaaaagtagattgaagtactatattagttagaagaagactagctatgttacagtaacaactaaaactctaatctcagtgctttagcctgatgaaagtttatttttcactcacgtactgtctgatgtgactagctagctcttcttggtagctttcttccaatgatgactcaacaattcagttccgctgatgttcactttgcaactcaaacattgtgaattttcttccagccatgaggttaggaaagcacagaaaacttactttatttcttaagtgcctcagaccagcaattacatatcagtttcactcacattctcattgacaagaattattcacatggccataacccaactgcaagaaagtctgtaaagagaggaacactcatagacatttgataagcattctctctgccacatttattgacagttatttatcatttcacatgaaaaagttacatatgtttctgaaaaataaatctcaaagaaagttaaaagtaactaaatctcttcaatgtgtaaatagaaatcattcagaggggaatattatggatttttggatataattttatgttaaatatattttaagtatttacaaacaatataagttagcaaaatgaatgaattcacaaattctctaataattattcagtttctcaaacctaatcatattgaataaattcaatattttagtatgtacagaaggaagaaaacaagttaaaagctttctaattgttaattcaataaccttttgtaaaataaaaaataccttttaaatttgcaatataaagtaaaattaaagctcctttagaaaaatatataaatatttatatatttctatttatatattatatatttatatattatatctatatataaagaaatatatataatttatatatatttctaaaggagctttgagatatatatatatatatatatatatagagagagagagagagagagagagagagagagtcaaacttttaagtttagaaaggcaaagcagagtttaaaccagaagcacttttgttattcgtttctctaaaatgaattgtctaattttctcagattttgattattttgatggtttgttccactttataatgtcagaaaaatatgctacatcatattaaaaaaatagaaatttagcttcaaactacctttgccattaaaaagtctttttttctatctaatatgcacataaagcactattgttttattacagctaatgaatacagttaaatggaaacatttaaagatttctttttcccttacctgggacatattttttaatgttctttcctatgataagttactatgtatattgtaacattgtgaataaatacaagttagggtttgggtgaatatattttcacacacacacctgcacacacacttaaaattttactcagactttgagacctgagtaaatctaaggctacagatttacttgttgcagaaagaaaaaaaaaaagtcactgcaaagctatggaagaagtatgaggtcaatttcaagaattaaaagtaataataataggcaaaagataaagactagaagaactgagggtttgcttttcctctcacatttatttctgtgacacaaaaatgaatatttcttaaaaatctttaataaccttaataactgagtactagtaataaaaattatcaataactgagtacagctgataaagattatgacaagtcttatgtggttatatttcatgtgctaatgctcaatatatgtaaaatttgattttaaaaatgatcagttagcaaattcatttcatgttttgtgagtaaggatgcacattactgaatttcatggttttctcatttacgtatttcaagaacaatgtcactgcatggggcttcctctgtgtccaagaaacgtactcctataaagtgcttgcttgctttgattcactgcctcagacatgttccactatatctgtttgcatctgttttttagttcaaggttaaattattcatacctgaaatacagcacaaattgctgaaaagtagggtctaagtagccaaggggatgtttatttctgtctgctgaaaatgttagacgtaaaacactgataaagtagtagaatgcctttagtttgtttccttttaaattctgaggaattgcatcagactaataatcttaaatgaattgatctgatgctttgaatattattattttgcttttatatggatgattttaaaagatgtccactctctaagtaaaattttattatgtctggtcataaaaatatgctcagaggaaagtatttcccattttataggccaagtctgtaaaaataaaaaatgaaattctttgaaatttttggaaccacgtttgtttcccaggggcagtatggaatgatggtataaagaacactggatttgcttgcaaaacctaatatgttgacattttgtgaaatagaaatattccttttttttaattttgtagctctaactttgttttttattttaattttttattattatactttaagttctggggtacatgtgcagaacgttcaggtttgttacataggtatacacgtgccatggtggtttgctgcacccatcaacccatcatctacattaggtatttcccctaatgctatccctcccctagccccccaccccacgacagaccacagtatgtgatgttcccctccctgtgtccatgtgttctcattgttcaactcccacttatatgtgagaatgtgtgttttttggttttctgttcttgtgttcgtttgctgagaatgatggtttccagcttcatccatgtccctgcaaagaacatgaactcatccatttttatagctgcatagtattccatggtgtatatgtgccacattttcttaacccagtctattattgatggacatttgggttggttccaagtctttgctattgtgaatagtgccgcaataaacataagtgtgcgtgtgtctttatagtagaatgatttataatcctttgggcatatacccagtaatgagattgctgggtcaaatggtatttctaagttctagaaccttgagaaatcgccacactgtcttccacaatggttgaacgagtttacagtcccaccaacagtgtaaaattgttcctatttctccacttcctctccagcatctgttgtttcctgactttttaatgattgccgttctaagtggcatgagatggtatctcattgtggtttggatttgcatttctctaatgaccagtgatgatgagctttttttcatatgtttgttggctgcataaatgtcttttttttttttgagaaggatctgttcatatccttcacccactttttgatggagttgtttattttttttcttgtaaatctgtttaagttctttgttgattctggatattagccctttgtccaatgggtagattgaaaaaatattctcccattctgtaggttgcctgttcactcctatgatagtttcttttgctgtgcagaagttctttagtttaattagatcccatttgtcaattttggcttttgttgccattgcttttggtgttttagtcatgaagtgtttgcccatgcctatgtcctgaatggtattccctaggttttcttccagggtttttatggttgtaggtcttacgtttaagtctttaatccatctttagttaatttttgtataaggtgtaagaaacgggtccagtttcatttttctgcatatggctagccagttttcccaacaccatttattaaatagggaatcctttccccattgcttgtttctgtcaggttcatcaaaggtcagattgttgtagatgtgtggtgttacttctgaggcctctgttctgttctattgatctatatatctgttttgataccagtaccgtgctgttttggttgctgtacactcatagtatagtttgaagtcaggtagagtgatgcctccagctttgttctttttgcttaggattgtcttggctatgcaagctctcttttgggtctgtatgaaatttaaagtcgttttttccagttctgtgaggaaagtcaatggagattgatggggatagcattgaatctataaattactttgggcaatatggccattttcatgatattgattcttcgtatccatgagcatggaatatttttccatttgtttgtatcctcttttatttctttgagcagtggtttgtagttctccttgaagagatccttcacatcccttgtaagacgtattcctaggtattttattctctttgtagcaattgtgaatcggagtcactgatgatttggctctctgtctgttattggtgtctggttttgcacattaattttgtatcatgaggctttgctgaagttgcttatcagcttaagtcgattttgggctgagatgatgtgattttctaaatatacaatcatgtcatctgcaaacagagacaatttgacttcctctcttcctgtttgaatgccctttatttctttctcttgcctgattgccctggccagaacttccaatactgtgttgaataggagtggtaagagggggcatccttgtcttgtgctggttttcaaagggaatgcttccagtttttgcccatttagtatgacattggctatgggtttgtcatacatagctcttactattttgagatacgttccgttaatacctagtttattgagagtttttaacatgaagggctgttgaatttaggcgggctgtatatcttaaaacaatcggtcagcttagtcagtcagtagtgtttgagagacctgaatagccaaattaggaaaaaggattgcaagttgatgtgagttctttgagaatgaagacagtttcccactgagtttcgttgattctttccttacttaatcttttgtttctatttgtttgagaaaacgatgtaaaacttaggtgttactattttaaacaaaaattaattacagtcatatttataactaggctaggagtaaaagatatatttagttgggggaaaactcatttttattttctaattttgagaggtatttttaaaactaagattggttttttttatgaattgtaaaaatcttttgatgttattcttttaactgaaggatgtaagaccaaaagtaaaataaaataaaataaagaacactggatttggaattgaaaaccaggatccagtgctggttttgacacttgatagcctgaggggataatggtgtaacttcctgcatctataaaatgtgaggaaaacgcattttaatatgcatagtaaactaacacagtcttccattaccaatgcttattatcattgttgctttaatatgaaagtattttcactatatcaaagttactagcataaaatcaatcatcagtgaatccattatcaatctaatcagtgtctatctggcatctttgtcttgctagtgtacccacttcctccttttggtggtataactgggtctttccttcagggaacacattctgtgatgtgggcagatttatttcttctgtagccaaaagcataagaattaattagaatgtctgtcactctggccctgggatttttctaacgtaaagaaatgttgaaaaatgttaatgctgagtagccatctcccaccaccttcaatccacaatcaacattttattatagctaatttatccatttatctatcttcctacccttacatcaatgcatcttatgttttgatgcatttaaaattgacttgcaggtatcaatacagttactctaaacacttccacacatattattgattagagtttaatatttccatgaggcagtgcaactcaaatctctaccagatatggaatgttattgtcccagaaaattgttctctcgtgccccttttcactcaatctccatctacctctctcagctgcaatcattaccagggtggttttcaaccatatattagtttttgactacagtaaagctgcaaataaatggaatcttttgtgtaagatttcttcatatgtgttaatgtgtatatcagtttatcccttatttctgagtagtattctattatatgaatatattggtttgtttacgaattacgctattaatgtgggcatgaggtgtttttggttttcagatattatcaataaagcttctgtgaacattcttctacatagtctctcatgaaagtgttttcatttctcgtgagtaaacactgagaaatgtaaagcctgtcatagggcaggtataggtttaaaatgatctcataacttttctcataataaggatataatgttatattcccactagtaatttgtagaagtttcagttccacatcctcaccatcatttggtgtgtcaacatttttaagtttagctattctggagtgtgaatattagtatctaatagtagttttattttgcctttccctgatgtctaatgatgttgagcaccttttcatgcacgtattggccattcatacaccttttttaatgatgaacctactcaatattttgcccatttttaattggcttgtttgtctttttattgctgagcagtagaacttagttatttattgtagacatcagtcctttgccagatatatgttttgcaaattgttttttctagtttgtggcttgctcatttatttcttttcttttacggttagtgcctcttaggacctgtcctagaaacctctgtctacttcttatttgaaaaggtattctcctttgctgttttctaaaagctttatagttttaatatattgatctatgatccatctgaaattaacttttctgtatgttataaatctgggcgagagtttttgttgttgctgattgttacctgatgatttcagcaccatgtgtttaaaacaaacaaacaaacaacaacaacaacaagaacaacaacaaacccttaactgtccacactgggttcctttggtgcctttattaaatgtgaaatggttgtatatatgagtctactttctattgcctcttcagtttgttacattgatctattgtcaatttttatgccagtaccacactttccttaatgtagcattataataagtcttaaagtcaaacggttagaagtcctccaaagctgtttttcttttcaagattcttttacctattcaaagtttttattttttgcatttccatataaattttaacatcttgtcaatttgtttaaaaaattatgggaactcttttggtgtggaatgtatagattaatttgggcataattatattttgtatcttgcaatccgtggaaatgatgaatctcatgacttatttagtgttctttaatttctctaagcaatttttgtagttttcagtgtaaagctccaatattgttttaaatgcattcttaagtaatagcatgtattttcatacttttatatatagaattctctaatttttgaactgctgctagtataaaaaaaatgtgatagatttttatatacttagctcataccctgtgactttggtcgtttcacttattaatcatagtagttgtgttgtcaagttcttaggatcttcttcataagcaatcatggtatctgcaagcagaattttctttctttccacttgttgtgactttatttatttcttatcctattgcgctcttaagacctccagtaaaatgttgaatagaaatgatgtgaataggtattcttgctttgttccccattataggttaaaacactcaatatatgaacatgaaatatgatggtaattgtagtttcttaatagcttctcaatttgctaagagtgttatgaatgagtgttgatcatcaaatgcttttcaacattcattgaaatgaccatgtaattgtttcttatttattctcttaatatggtgaatgataatgatttttgaatggtaagccaatcttgagcttttgtaaaacagcgaagataaacaacattatcatgatgcattgttctttttatatattactggattaatttaacaataatattttcaagggatataaaggacattaatatatggatttatatttgtaaatgttgtattaatggtattgttgccttcataaaaccaactgggaagtgttctcactctatttgatgcaagagtttgtttggattgatgctatttcttccttaaatgtttggtagccttcactactgaaaccatatgggcgtatagtttttctttatagaaatattttgataacaaatgaatatataatagatgtagagctactcagattttattattcatttcatgtttttataatatttatttttcaagaaatttgttcattgcacttatgttgtagaatttcctggcatgtggtagatattttatttttcatttcagtaggtttgggagaacaggtgatttttggttatgtagaagttctttagcagtgatttctgagattttgatgcacccatcactggagcaatgtacactgtacccaatgtgtagtcttttattcctcacccccctcccactcttcttcccgagtccccaaattccattatatcatgcctttgcatcctactagcttagctcccatttataggtgagaacaaatgatatttggttttccattcctgagttacttcacttagaatagtggtctccaactccatccaagttgctgcaaatgccattatttcgttcttttttatggctgagtagtatcccacagtgtgtgtatgtatgtgtgtgtgtatatatatatatatatatacacacacacatatatgtacatatatatcacattttccccattcatttgttggttgatgggcatttcaactagtttcatatttctgcaattgtgaagtgtgctgctgtaaacatgcgggggcaagtgtctttttcatataatgacttcttttgctttgggtagatacccagtagataccttaatattgtaccacaggctcctgagacactgtttattatgtttcaatcttttaagtttttattcttcagattggattatttatattagtatatcttcagccgccttcctttcttcagttttcttttccttcagttagttatcaccactctgctattaatcctatctagtgaatttttaatttcagatatggttctattatataatttcaatttggtattttatatagtttccatttccctactgagtatttttatttttattctttgagaacataatttcttttatgtctttaagcataattatcatagttatcttagacttctttgctattaatagttccaacaactgagtcatcttagtgttgtggagtattacctgttttttctcttaaatatgggtcacattttttttcttagtatatcatttttatttgtattttggattgttttaataaggttgtagatacttttaattttgttacttttttcctaaggagggttgattgaattcattttagtaggcatttgacttggatggactaaaactacaagtctgtctcttttcaggtggccagcaactcaaatatcagttcagttgttttaactgtggctgggttgtttggcatttaccttgtgcattcctgattcagtggtcagccagatatttgggcagaaaaaaaatacatatatataatatatatgtatataacatagtgtatatctacactatataattatatatgtatatatgtgtgtgtatatatacacatatagaaataaatgcgtacacacacacgtatagctttttttttttttttttttttactttctggctctctcctttcctggattgtcacctgcccccctcacccctcccccacacacgtttcggcagatataaccctgagccatttccttcttccaggcgttcactctccttcactctccacctgcctatttgatttttggttggtttggttggtgtttattttgttttgttttcgtctccggttcctttgtgtagctttgtttttgtactttgtttttgttttcgtctgtattcctaaatttggttgttttaataggagatgaataccataccaaaagcacaattcccacaatgtgtgtttgcatttgtcttctaagtgaactcctgaattatccagctgcgttatctacatagagagccagatcatctgtctcaggcagttctcctttgaccagatctttccattatgaaagctcagggacattaaagtggttctcaaatccctttgttaaagaactgcgccattttactaagattatgtaatttttaatcttttaatacaaaggaagaaaattttatttagcagaggattaaactattctgctatgattttgtagctaaattaaaagaattatacttaaagatttttgttctgattagtgggtagtgttatttttatattaaaaaaacagataaaatctcagtccataacttcagggacaaaggaaatataatttttaaaaattttctaagtgataaaagactatacattgggtacagtatacacaggagatgagtacaccaaaatttcggaaatcatcactaaataacttatccaggcaactaaataccacttgttcccccaaaaactattgaaatgataattttaaaaagagctcccagaaaaagaatatctaattttttttttttcttttcattgtaagcctctaccacctggtaggagaaggtaatagtaaatttggtatcttctccgttttcttcccagggagtatttccacatgctactgtgttatagatgccaaacattagagaaaataatttagtccttggttcatctgactacactggcatccattaaaagtctattatttctttggttatttgtcatctatgcatggctttcttttcatcttaaggactcctattaagtcttgttctctctctcagctaactcctgggattctctttacagcatgagttcttgttcctgtgtccagagatctgttatcatgtttctaatttcttgatgctacttaccctcaaacacatagtgcctgggtatctatctttgactattcaggcattagccctttctcttttgcctctctcctggcaccatagagtatggtaaaattctgagacttggccaggtgcagtggctcacaactgtaatcccagcactttgggaggctaaggcaggtggatcacctgaggtcaggagtttgagaccagcctggccaacatggcgaaaccctgtctctactaaaagtacaaaaattagccgggcgtggtggtgggcacctgtaatgcaagctactcaggaggctgaggcaggagaatcgcttgaacctgggaggcagaggttgcagtgagccgagatcgcgccactgcactccagcctgggctacaagagcaagactcagtctcaaaaaaaaaaaaaaaaaaaaaaaaaaaaaaaaaaaaaaaaaaaaaaggaaaaacctgagattttgctgctgcattcctgaaactccctcaggactgtaaatacctccctctccctctctttttctctctctttcctttctccaccagcccctcccacgataccatcacataccgttcactcacacagagagctaggcttcagaagccccctggaattcccaatactgatgcactccctgattctcttcctgtccctggagaaggacttcttttctagtctggcggctaagaaagctctgcctttataacaaaactgtttatactcttagtctctcaggatttagacttctgaaacccaaaagctttgctttctgaaagtgtggatgtgagaataaaaatctagcttgaaggaagtaaagttataagtttgataggaattgagggggaggaggtagtgaaaattagttaattttttggaacactatcttatcacacacatttgccctttatacatttattatttttgctattcaaataaaagtaacaatatgtattttaacagagtaattttttatttgtgcttattaagttaaatttttcttttttctatcatcttggatataataaacgaagtgtaaatatatgtatatacctgtataattacagtcaagagtttaaagtttgtattctaacttgtctcatttataatttttatgctaaagaatgtgtgatgagagacctctgtggaattttgatgcaaatgtcaaccaaaaattcttggtagcatagatcatctgtctaattcaagacctaatgctgaattattagacaaacatctctgtaaatacaagattggtttatttttatcatgaataaaggggaattctcatacagttttattttactgtcctttagaccttacagtttaatatctaaatattagacatttacattagatatataattagactatctatctgatattcattagatagcctaatggatttgtcattattgtccttctgtcactttccatgtttaaaattttcccttattattccagcatcttcagtgtattatataagaaaaacatttatcaaactgctcttagcatgagaaaacataatataccaaggaaacaggagggaatttcagaaattagaataaattaaaactttgagttaattttttgaacgagtttttatgtttaaaaatgtgccatatttgtagggtctcttgaattacctgtaatatactataattgatttcagcttgatatgtattttttaacgtaaaaaaagatttcatgtactttgaagagtctttgttatcattatcttaacaataatgtgatatttatgttttaattaccacaaaacagcaaccaccacagactaactaaaataaactttgtatagcttccatgctacacacaaactaatcattcaaagttttctcaggatgatgaaatttttaagatcatgttaaattaaccataattttaataataatttatgtcaaaacaatattttttctgtatccttcatctccgtatctataaaatgggggcagggttgactaagtgattccaagatcttatttggctctaaaagtatttgattctaataaacaatgaaataaccgcaaataccactaagtatagacaatgagtatcaaaggaataatgacgcattgctctactatataaataacctttttttactgtaatcattctttacctgctattgtgaatcagtagttttgatgttaaattgtggtgtttttaaacaaacagtatcattttattttattttattttcctcagttttatttaggtataattgacaaatgaaaattgtatacatttaaggtacacacgtgatattttgatatatgcatggattataaaatgtaacaagctaatgcctctatcacttcatagttaccttttattctatagtgagaacaattaagatctactctttaagcaacttttaagtatacaatgctttactattaactacagtcaccttaatgtacataagatctccaggactttttcatcttataacagaaagtttgttcttgattgaatggttcactgagggcacaggtgcaatgaccccacacatgcataaattttatatatgcattttagcttcttgactcagcataatctctcatctgtcctctccggtgaattcttaattactgattatttatgtctttacctgctttgtttgcaagttttgcaagaaattttgcatattattgtatgtgtgtgaatgtgtgtatagcaatgaaatcatttctgttataagcacttgatagaagcatatatctttatatcagtcttgcgatttcagagtacttttgcatatatgagcgatcctaccttattttattgcctcacattgcaaaataaccttggctgttatacttcaaggtctcaggtgttgagtcattagcagctatggaatagatcagaattatattacagctgcacaactacaaacaaaaggtaatccaagatctttcaggcttaacatcagcatatggacaactccttagcacttggctgaaagaaagttaattcgggaatttcaagctaaattccctcaggatgacttctctgaatgatttttaactcctgtaatacaaatagaaaggcatgtgaaaataaatagtatgcaattaaaacagagagcaataacacagatatttgtgtatacatcttccaaaattggtcattttataaagaatgtattttagcatatttagtttatacatgcatgcacttgggaattatttagttcactgacatcctgggtagaaactagtaatagaaacagatctatgacaatttattagaattattaagtctatacttttaaaattaagcacaaagtggcatctaccagaattataaacaagaaactgaatttcagaacatttaaatttcagaaatctgtgtggctgtctggactgttgaaaccacctcctgttcttcctgcttaaaccctctctctgcctatactcccacccatatgccctaaatccatactcctcctaataggcaaattgatcttggagaaatcagatcaaatctcctatataagaccaagaatatttttccagtgtaccttatataaattaaaaccatctctgtggactctaagtgctgtcacgactgcatctgcctcttggacttcatctttcactcctctctcctcagcattgcagccacactagcatggacatgccaagtgcatttctgctatgctcactaatccatttgcctagactgccctgcccctgcctgtggatcttctaattttttttatttaatagactttatttttagagtagttttaggtttacagaaaaattggacagaaggtataggaagttttcatataccccctctcctttctcacccccttacactatattttgtattattaacattttgcattcgtatggtacaattgttataactgatgaagtaatattgatatattgttattaaataaagtccattaaggtttactctttgtgctgttgaagtccatgcattttaacaaatgtataacatcatgcatccatcattatataacatacagaatagttttactgccctaaaattcccctgtgtgccacctatttatcccttcttcttccttcctcctaaactcttggcaatcacaaattctttttactgtctctatatttttgccttttccaggatgtcatatatttggaattatatagtttgtggcttttgcagactggcttctttcactaagcaatatggattcaaggttcccctatgtctcttcatggtttgatagatcatttctttttagcactgaataatatttcattttatggctttactacagtttgtttatcatttcacctattgaaggacatcttggctgctttcgtgtttttgcaattatgggaaagattgccataaacatcaagttttcaactcttttgagtaaacgcttagaacaatattgatgaatcatatggtaacagtatgttaagttttgttagaaattgccaaactgtttgccaaagtggatgtacaaatttgtattctcaccaacaataaatttgagttcctgttggctccacattctcaccaggatttgttatatccgcattatggattttggccattctaatcagtgtacagtagtatctcattgttgttttaatttgcaatttcctgatgacatatgatgttgagcatcttttcatatgcttatttgccatctgtgtatcttctttgatggtgtgtctgtgcagatcttttgcacactttttaattgagttatttattttcttatgattgagttttcaaagtttgttgtacattttggatataacccctttatctaatacatgttttgcaaacattttctcccagtctttagtttatctttttattctcttaacatgtcatttgcagagcaggagtttttaattttaatgaggtacagtgtataatttttttatggatcaaacttttggtactgtatctaaaaagtcgtcaccaaaccaatggtcatgtagattttcttttatttatgttctagaagttttatagttttgccttttacatttaggtatataattcattttgagttaaattattgtgagttctaataattttttattgctgtttctcatttgtattctgattttaatgttaagttctcaaaggggcctttcctaatcatcctagctaaagcagtccctcccaaccaatcactgtttgatccattattctaattttcccctagcattgccattatctaaaattatattgttctttatttattttcattcttactttttatttctctataagtcctacgtgagctgagactcagtttgttttgtttactgctctacccccagggtctaagacactacttgaaaattatttagtgaataaatgaatgaacaagaaatgcatttaacaaaactcacagacacataatgatatatgttcaagtccttatctatgagtgtctttgtaagtaacaaagacagacaactaataggaatgaaaactagggtagcgaagaggcagcaacattcaaacaaaagtattactattttgtttgttttgcctgtagcatgtattaagtccaactgaatctagaatacgttgccacaagaatgttagtaatgttagctagaatcttagtaatgttgaatgatttgcatggaagtttttcaagtcccttatctattgccaatagatagactttatttttggagcaaacctatttaaacattgtgaacagtcaacagagctcaacaaattagatatagaatgaatgttccacaacagagtaaaagccatatatgacaaccccacaactaacatcgtacctatggtgaaaagttgaaagctttttctctaagaccacttctgttcaacataatactgaaaatccaagacagggcatttaggctaaagaaagaaataaaaggtatccaaacagaaaagaataaagtgaaattgtctctgtgtactgacaacatgatgttatagaaaaaatattaaataatccaacaaaaaatgttagaactaataaacaaatttggtaaagtttcaggatacaaaatcaactacaaaaaatcggtaatgtttctatacactaacaacagactgcctgaaaaaaaaattaagaaaacagtcccaattacaaaagagttaaaaggaataaaatacttaggagtcaatttaaccaaggaagtgaaatatctgtatactgaaaaccataaaacattgatgaaaataaaaggtgtcacaaataaatggaaagataccccatgtttgtgaattgaaagaattaatattgttaaaatgtccatactacccaaagcattctatagattcaatgtaataactatcaaaattccaatgtcattcttcacagaaatagaaaaaaaaatcctaaaatttgtatggaactacaaaaaatcctgaataactaaagtaacttttaccaaaaagataaaaagctaaaaagatttttaaaaaaagattaaaaagattaaaaaatagataaaaagataaaagctggaggcactatactactggatttcaaaatatgttacaaacctataataatccaaacagtatgatactggcataaaaacagacatattgaccagtggaataggatagagagcccagaaataaacccatacatttatggtgaattgatttttgacaaaggtgcaaagatcatacaattgggaaaggacagtcccttcaaaaaatgatattaggaatactggatattcatatacagaagaataaaaataggctcttatttcaaaccttgtataagaatcaactcaaagcaggttaaagccttaaatgtaagacctgaaactataaaactattaaaagagaacataatgggaaaatatccataacattgactggtctgggcaatgatttattggatataacctcaaaagcacaagcaccaagagaaaataaagatatcacaaataaatggaaagatatcccacaaataaattcttttgtggattgaaagaattaatagttaaaatgtccatactaccgaaagcattctatagattcaatgcaatatctatcaaaattccaatgttattcttcacagaaatagaaaaaaaatcctagaatttgtatggaactacatgggcttatatcagattgaaagcttctgcacagtagggtaaacaacagagtgaagagaaaacccatagatcaggagaaaatgtttgcaactcatatatcaaacaagagggtaatagccaaaatatacaaggaaatcaaactacttaataagtagaaaaacaaataaccccattaaaaagtgagtaaaggactcaaatggacatttctcaaaagaagagatacaaattgccaacagatacatgagaaaatgctcaacatctctaattataagagaaatgtaaattaaaaccacaatgagagattgcctcacacctgttagggcaactattatcaaaagataacaagcgttggcaagcacgtggagaaaagggaaccctcatacactgtaggtggtattgcaaattaatacagccattttggaaaacagtatgaacgttcctttattgtgagatccaggaatctcagtactgtatatatatatccaaaggaactgaaatcagtatgttgaagagttgtctgcactcccatgttgattgtagtactcttcacaatagtcacgatatggaaacaatataagtgtccatcagtgcatgaatggatttttaaaatgtaatatatttacacaatagaatactattcagccttaaaaaagtaaatttgtcatttttgacaacatgaatgcaactaagaggacattgtcttaagtgaaatatctaatggcattttagtggaaaattatgtaggaccaaccatgtcatccaaaaactcaatattttatctttcggggctgaaagaagaaccaacatgactgaaaataaataaattaacagatggcatttgaatttatgataaaagtaaacaatagagaaattatggtatggcttaatgaatataacaagaggcagcaagcatctgaagggtgtgtgtgtgtgtgtgggtgtgtatgtatgtatttatttgtgtatttatgtgtcattagatataccattagcttctagatttctgcattaatacaggccatgcatggaagagctgtataaaacgcttttccctatgctattcggcagtaattttttgaaagtcagagatggctgcatgtaaatgttactaagttctaccaatctctaaaaatcacatttaataacaatttgccagactttcatttatagaaagaaacagaattatgttagaaacacaataatcagctatttgtcttttcaatatcttctgggaaaaatttgcagagttttaaaaatttaaattatcatggtggacatttatgtccttaaggtatccatgtaatatatagatagcaaaatatctttgtttcagtttaaacatgaaaatccaaaattagcatatcataatcaagggaattgcctaaggttgtctttctgaaaagaaatgacgtttaaaaatttttgttttaaaatcttatgataaaatcaatgggactttttcataacttagagaagaaaataaaacatctagcctaatgtgacctcccaaatatagaaattgaattccattttaaatgatttcttttgatctttggacatatgcctattctttgcacgattatggctggaattggtgagcatagaattgtgtgtgcacactaatgtgtgtatgtgtgcatgtgtgtgttttgcttaaatgacattattatttattttttgatcagtgaaatgtctatcttttctgaagcatgagttttttactaaatgcaataaatttagtgtacattcaatttttcaaaactatttcaatccactctatgccaaactacaaattgtaatgccataagaattatattgcatgtattttacaactccaatctacttattggaaggagggggtggtgaaacatatgtcatgtagctgttaaaggagatctttgccaggtacttctaaagaagattttaattcaggagaaaataattgcaaagcagagaaggtctgtgagaagaatctatcttgagcacttaagctgaaaccagaagtccaaacaatgacctctgaatcatgggggtcaccttgtatcctctatttatctttaaaattgaacttatcctgaaatgtttgcttaaaggcaaatgttatttcctgatcgagatcttataatgaattaatgccagagacagaacttggattaaaggaaagagaatgtcttttgacttttaggtccgttattatcaatatgtttagtttcatagcttgtctcctattggagtcttaattcctttaaaattggaatttcatcacactcatctttgtatcccttagaacaccaggtacaagatcatgcacttaaaaatgtattgacttgaataattttccagtgcagtctacttgtctacataaatattgttagcaaattagacatgaaatggtaacattattgaacattggctgcatcttaaccatcctgttaatttcatttgcatagtctttgttcaagtattttacagttcaagctttcttttggaccataatccaaacatatttaaaaagtaaaaatgaagtcctttgtgggtattttttactttcataggagaaggtgtaatttaaacctgttggttgataaaatacaaaaagtatcttgggatctaagtttttcttcgggataccaatttgagtggtctgtcactttctgcttacaacatactgtgcttatcaaactaaactccccaaaatggaactcacgagcctctatgatatggctcctgactacatgtccaactttaccttcagtcaacctatggcttctatattctcatgagtgaacgtattagctttctactcctagaatatctcaactttgccattttaggagttttcacttgctttcccatatgcctgaaatgcatatgcttgattagtcccgtggttgtctccatagcgccctacagttcttggatttaaatatcctagatatttaaatatcttgtaaaggggtgttttctgaccatcttatctataaagtagctccccatcagaggtacttgctgtcacagcacattttttatttctttcacaggatgtgtcacaataatgatcatattcagtagctgtcttctaaaacaaagtataagttccatgagtacagtaacctttttctacctttttcccgaatatacccactgcgcagaaaacagtgcccaatagaaagtaaaagtctaggaaatgatttctgaatgaaaaaacaaatatttactgaaaaactgtgacttttgagatcttaatttaagcagtaaattaatttgaagggtaaagtataattctgatacttttttgcatttttgtcttctctaaaaccaatgactagttagtatacatgttgtaagccagccaaactgcattattatttcaacaattaagactataggacataggaaattaggaagttttccaaagtagtaatggggataaaaaaagaattttttagctttgtttttattcaaacaagaaataactatattttaaaatttttccccatcaaaggtactgaatgtaaataagtcccttatgataccaagtattttttcatatctatatccattttaataattagtttatgcaaaagttcataaatttagaggtttgttggaaagttattatttctaatctcctaataagctgaaagaaaattatgacttcaaacaatatattgaaaccttattaagagaaactggccacgtgtggtggctcatgcctgtaactccagcactttgggaggccaaggcgggtggatcacctgaggtcaggagtttgagaccagcctggccaacatggaaaaccctgtctctactaaaaatacaaaagttagctgggcatggcggtgggtgcctgtaatcccagctactcggaaggctgaggcaggagaatcacttgaacctgggaggcggagattgcagtgagccgacattgtgccactgcactccagcctgaggggcaagagtgaaactatgtctcagaaaaacataaataaattaaaaaaagagaaactgtgggaaaccccccccccaaaaaaaaagaaagaaaaaaggaagaatagcaggagtctgtttttataggaatgtcatttgagcttaacagatctagaggttaagctttgaagagttttaactatatatgtgattctcataatatctatttcattcacaggaaaatcagaataattcttataaggaaatttgtgatcttaatatacagtactataatattgacaacatttcattaaaattataagtacttattggtttcctttcaaagtgtcatatctgtgccatttctatctgtatagcttttacaattataatttatatttaccaattttcctttttaacatgatataaggtatgaaagtgttttatcacttcctaattattttattatattttgctatcatctactttgctatcatctatgttctgaaatttatttatgtctcttatatctgtatggtggaaattttttttttattatactttaagttctagggtacatgtgcacaatgtgcaggtttgttacataggtatacatgtgccatgttggtttgctgcacctattaactcatcattcacattaggtatttgtcctaatgctatccctccccctgccccccaacccacaacaggccccagtgtgtgatgttcccctgtgtccaagtgttctcattgttcaattcccacctatgagtgagaacatgcggcgtttggttttctgtgcttgtgttagtttgctgagaatgatggtttccagcttcatccatgtccctgcaaaggacatgaactcatccttttttatggctgcatagtattccatggtgtatatgtgccacattttcttaatccagtgtatcactgatggatagttgggttggttccaagtctttgctatcgtgaatagtgctgcaataaacatacgtgtgcatgtgtctttacagtagcatgatttataatcctttgggtatatacccagtaatgggatggctgggtcaaatggtatttctagttctagatccctgaggaatcaccacactgtcttccacaatggttgaactagtttacagtcccaccaacagtgtaaaagtgttcctatttctccacatcctctccagcacctgctgtttcctgactttttaatgatcgccattctaactggtgtgagatggtatctcactgtggttttgatttgcatttctctgatggccagtgatgatgagcattttttcatgtgtcttttggctgcataaatgtcttcttttgagaagtgtttgttcatatcctttgcacactttttgatggggttgtatgtttttttcttgtaaatttgtttaagttctttgttgattctggatattagccctttgtccgatgggtagatcgcaaaaattttctcccattctgtaggttgcctgttcactctaatggtagtttcttttgctgtgcagaagatcttagtttaatcagatcccatttgtctattttggcttttgttgccattgcttttggtattttagacatgaagcccttgcccatgcctatgtcctgaatggtattgcctaggttttcttctagggtttttatggttttaggtctaacatttaagtctttaatccatcttgaattaatttttgtgtaaggtgtaaggaggggatctagtttcagctttatacatatgactagccagttttcccaacaccatttattaaatagtgaatcctttccccatttatttcttttttttgtcaggtttgtcaaagatcagattattgtagatgtgtggtgttattcctgaggcctctgttctgttccattggtctatgtatctgttttgataccagtaccatgctgttttggttactgtacccttgtaacatagtttgaagtcaggtagtgtgatacttccagctttgttctttttgcttaggattgccttggcaatgcagacacttttttgtttccatatgaaatttaaagcagttttttccaattctgtgaagaaagtcattggtagcttgatggggattgcactgaatctgtaagttaccctgtgcagtatggccattttcacgatattgattcttcctatccatgtgcatggaatgttcttccatttgtttgtgtccccctttatttcgttgagcagtagtttgcagttctccttgaagaggcccttcacatcccttgtaagttggattcctaggtattttattctctttgtagcaattgtgaatgggagttctctcatgatttggctctctgtttgtctgttattggtgtataggaatgcttgtgatctttacacattgattttgtatcctgagactttgctgaagttgcttctcagcttaaggagattttgcgctgagacagtgagctttctaatatacaatcatgtcatctgcaaacagggacaatttgacttcctcttttcctaattgaataccctttatttctttctcctgcctgattgccctggccagaacttccaacactgtgttgaataggagtggtgagagagggcatccctatcttgtgccagttttcagagggaatgattccagtttttgcccattcagcatgatattggctgtgagtttgtcataaatagctcttactattttgagatatgttccagcaatacctagtttattgagagtttttagcatgaagggctgttgaattttgtcaaaggccttttttctgcatctattgaggtaatcatatggtttttgtcattggttctgtttatgtgatggagtatgttcaatgatttgcatatgttgaaccagccttgcatcccagggatgaagctcacttgattgtcttggataagctttttgttgtgctgctggattaagattgccagtattttattgaggatttttgcatcgatgttcatcagggatattggtctaaaattctcttttttgttgtgtctctgccagtctttggtatcagaatgatgctggccttgtaaaatgagttagggaggattccctctttttctattgattggaatagtttcagaagcaatggtaccagctcctctttgtacctctagtagaattgagctgtgaatccatctggtcctaaactttttttggttggtaggctattaattattgcctcaatttcatggcctgtgattggtgtattcagagattcaacttcttcctggtttagtgttgggagggtgtatatgtccaggaatttatctatttcttctaggttttctagtttatttgtgtagaggtgtttatagtattctctgatggtagtttgtatttctgtgggatcagtggtgatatccgctttaccattttttattgtgtctatttgattcttctctcttttcttctttattagtcttgctagcagtctatcaattttgttgatcttttcaaaaaaccagctgctagattcattaattttttgaagggttttttgtgtctctatctccttcagatctgctctgatcttagttattttttgccttctgctagcttttgaatttgtttggccttgcttctctagttctcttaattgtgaagttagggtgccaattttagatctttcctgcttttgtgggcatttagtgctataaacttccctctacacactgctttaaatgtgtcccagagattctggtacattgtgtctttgttctcattggtttcaaagaacatctttatttctgccttcatttcattatttatccaggagtcattcaggaggaggttgttcagtttccatgtagttgtgccattttgagtgagtttcttaatcctgagttctaatttgattgcactgtggtctgagagacagtttgttgtgatttctgttcttttacatttggtgaggagtgctttacttccaactatgtggtcagttttggaataagtgggatgtggtgctaagaagaatgtatattctgttgatttggggtagagagttctgtagatgtctattaggtccacttggtgcaaagctgagttcaagtcctggatatctttgttaatcttctgtctcgttgatctgtctaatattgacagtggagtgttaaggtctcccattattattgtgtgggagtctaagtctctttgtgggtctctaaggacttgctttatgcatctgggtgctcctgtattgggtgcatatatatttaggatagttagctcttcttgttgaattgatccctttaccattatgtaatggccttctttgtctcatttgatctttgttggtttaaagtctgttttatcagagactagaattgcaacccctgcttttcttttgctttccatttgcttggtagatcttcctccatccatttattttgagccaatgtgtgtctctgcccgtgagatgggtctcctgaatacagcaccctgatgggtcttggctctttatccaatttgccagtctgtctcttttaattggggcatttagcccatttacatttagggttaatattgttatgtgtgaatttgatcctgtcattatgatgtaagctggttatcttgcccattaattgatgtagtttcttgctagcattggtggtctttacaatttggcatgtttttacagtggctagttctggttgttcctttccatgtttagtgcttccttcaggagctcttttaaggcaggcctggtggtgacaaaatctctcagcatttgcttctctgtaaaggattttatttctacttcacttacgatgcttagtttggctggatatgaaattctgggttgaaaattcttttaagaatgttgaatgttgtccctcaaccctcttccagcttgtagagtttctgcagagagatctgctgttagtctgatagttaccctttgtgggtaacctgacctttctctctggctgcccttaacattttttccttcatttgaaccttggtgaatctgacaattatgtgtcttggggttgctcttcttgaggagtatctttgtggtgttctctttatttcctgaatttcaatgttggcctgccttactaggttgggggagttctcctggataatatcctgcagagtgttttccaacttggttccattctccccgtcactttcagatacactaatcaaacatagatttgttttttttcacatagtcccatatttctcggaggctttgttcatttctttttactctgttttctctaaacttctcgctttatttcattaatttgatcttcaatcactgatagcctttcttccacttgatcgaatcggctactgaagcttgtgcatgtgtcacgtagttctcatgccatggttttcagctccatcaggtcatttaatgtcttctctacattgtttattccagttagccgtttgtctgatcttttttcaaggtttttagcttccttgtgatgggttcaaacatcctcctttagctcctttagcttgttattaccgaccttctgaagcctagttccgtcaactcgtcaaagttattctctgtccagctttgttctgttgctggtgaggagctgcgataatttggagaagaggtgctctcgtttttagaattttcatcttttctcctctggtttctccccatctttgtggttttatctacctttggtctttgatgttagtgacctaccaatggggttttggtgtggatgtcctttttcttgatgttgatgctgttcctttctgtttgttagttttccttctgacagtcaggtccctcagctgcaggtctgttggagtttgctggaggtccactccagaccctgtttgcctgggtatcaccagcggaggctgaagaatagcaaatattgcagaacagcaaatattgctgccttatccttcttctggaagcttcatcccagaggggaacccacatgtatgaggtgtcaatcagcccctactgggagatgtctcccagttaggctacacaggggtcagggacccacttgaggaagcagtctgtccgttctcagagctcaaacgctgtgctggaagaaccactgctctcttcagagctgtcagacagggacgtttaagtctgcagaagtttctgctgccttttgttcaactatgccctgcccctagaggtggagtcaacagaggcagcccaccttgctgggctgtggtggggtccaccagttctagcttgcctggctgctttgtttacctactcaagcctcagcaatggcggatgcccctccccctgccaggctgctgcctcgcaggtcgcaggtcaatctcagactgctgcactagcagtgagcaaggttctgtgggcgtgggacccaccgagccaggcgcaggatgtaatcccctggtgtgctgtttgctaagacggttggaaaagcacagtatttaggcgggagtgccccatttttccaggtacagtctgtcatggcttaccttggctaggaaagggaaatctcccaacccctggcacttcccgggtgaggtgatgccccaccctgctttggctcacccttcctgggccgcacccactgtccaaccagtcccagtgagatgaaccaggtacctgacttggaaatggagaaatcacacatcttctgcatcaatcatgctgggagctgcagaccatagctgttcctatgcagccatcttagaaccggaccacatcctctttcaaggtatgaaagattattgaccttattttgtctaggtggaggaactgtatcatacagtggtatatttgagctactgtgggactgatctagtccttctataaagagactatctaaatgccttataaatcttgatatttttctaagaagcactatctttgagaaaaaacttattttctggtaaataaaatgaggaaatatgaggggcaaatttgagagccttcatctttcaattattccctttaaagctcccatttgattttggattatgccacggtgaatgcaaacaaatcccacttttcaaatggaataatttattttcttaatgtttgtgtttcaacctaaaagaattgtttttatacctacatttgaaacttcagaaaacaagattcacagaataatgaaaaactacattttaacctaaatgtggaactgtgattacagacattaccgcaagcaagtgattcaaacaccacttttcctgtgtcatcttttaaacaccactgcagattttttattttgaacatgtacttggcttctgcttctatctaagttagaggaacagtaattggatgtacccttgtgcctgaaacaataacaagcaacaacaaaaacaaacagaatatatgaaacaagcttttttttttttttttttgagtctcgctctgtcttcaggttggagtgcagtggcacgatctcagctcactgcaacctccgcctgccgggtacaaacgattctcctgcctcagcctcccaagtagctgggcctacaggcatgcaccacaatgcccagctaatttttgtatttttagtaaagactgggtttcaccatgttcgcaaggatggtctcaatctcttgaccttgtgatccgccctcctcaacctcttgagaaacaagcatttttttaaaattgcaaaacactaggcaataaagtagaaggaacccagagagatgaaaaacacagtgctacatttgcatcattttcctgctttcagagaatttctgagccacaactcgagaaaggagagcccagatggaaattgatgaactctgtaaggtaaggaaatgaaaatgagagcacagggacagcaaggcttttggaattcacagaatagagctctggagaggagaaagatacagaaggaaccccaaatatttgcataaggtactcctcaagtattcatcagagtactgatcaggacatgcatgtgaggaaactgacatttgtagtaccatccatcaatagcacaacacatattcatttcaagtatacatgaaacattgaccaagatatatactaagccataaaataagtcttagtgaattttaaaagattcaactcacacaatgtatttctctaactaaaacaggatagacttaaaattcagtcagtccccaaatatttgaaaatcaaaaaaacccatggatcaaagaagaaataaaaaagtattttgaagtgaatggcaatgaaaatacaaacataggaaaaactaaggaatgatgctaaagcagttcttaggaatttacagcactatatgctgacattactgaagaaaagatgtctcaaattgatgacaccaacgatcactttaagacactagaagacatgaaaattaactcaacatagcagaaaggaaagtataaatagcaggacagaaatgatcaaatagagatgatgtcggtaatgcaatgttggtttaatatttgaaatcagacaatgtaattcaccatgcgaactaaaaaacatgcagaaaaaaataaagaagacatagagagctatacttgttcatcaacagaagactcaaaatgattaagatgtcaattctccccagacttatctatagattaaatacaatgccagttcaaatccttgcaggtcttaactgaagaaattttcaagcttattttaaaactcgtatggaaataaaaaaatatagaatcactataacaactttgaaaaagaacatatttggagtagtaacactatctgctctcaaggtttattatgatgctacaataatcaagactattggactggcataaagaaataacttggtcaaagaaacagagtagagattacagaaatagatccacatatgggcaactgttgttcgttttttttaaatttatcgtctttctgaaaaatcttcatagaaaactatttggtttagctctcagtagcctgcccctgagctgtgaggaagcttgccttcttttgagctacctgatctttcttctgagcaagggacattttgggatggttctatctcttttaacttatttcctgggcgtcttctcatagactagattctctcatatagcagcatgagctttcttatacatctcctccatgtctagagttatgccgttctttatatattgagaggattgtttcttgtaagcatcttcatcttcctctacttagtagcacatgtaatctgcgacattctggctgataatgtgcttccagtgtacttctgcattaaattccttgctttcagaatcataaccgggaatcgtttggtactgtaagggatagacaaacctccattcacagctccctcagggcgccagaaactttattgccagtagtagttctggcaaggccttcatctccagtcacctccacttggccttcatagatcttgtccataccaaacctattgagaagcctgtggtccagcagcaggccagtacaatacgctgcagcgtaatttgtcaagccaaccttcacgccatattttggcagttcatgtgcatatgctatgcagactatcatatccccttctatacaggcataagcaatatgacaaatgatatctgttacactatcatcctgtatttgggtgtttcctatttatttttatcctgtatcaccaagcgtttctgagcatagtaatcaattttaccgtcccattgtcttctaaatttcacttggtgtctcttaaagtaggccttagtcttaacaactttaatgaaccacatcctgcagagcaaatgcccacgtctgcggcttggcagagacttctaggctcagcagcgctaggtggggaaaagagggagcaactgatttctgatgaagttgatgacagggaggaacgggaactctcacacactcctggtgggaatgtaaaatggcatgactcctacctgtttggaaaatagtttaacagttttttagaaagtttaatatatacctacctatcatatgactcagccattatactcctaagagaaacaaaaacatatgtccatacaaagacttgtacccaaatattcatagaacctttatattcaatagtcaaaaactagaaataactcaaatgaccatcatccaaattgtagtatgtccatacaataaaatgtaataaactactgataaacacagtgtggatgaatctagaaataatgatactgagttttaaaagctagtcaaaaaacagtatatatggtgtgatcccatttatatagaactcaaaaaaatgcaaagtgatctgtataactgaaagcacatcagtggcttcctgtagagaggattgcagtgggttctaatctctcattataaaggagaacaaagaaactttcagaggtgatggatatgtttactatcttgattgtgataaaggctccagaagtgtatacatgtgttaaaacattgaattgtacactttatatgtgtacattttattgcagatcaattatactttaacgctgttaaaatatgaataaagcacgttttaaaacatttagaaatccaaaatatcataaattaaacataaattataaatgatgtagattgaatcaattataataaaattacttaaaaaagtgttatcagaaaaaaagaaaatggtactctactatggtcacaataaatctaatgaggagaaatatttaataacactgataaacactagtggattttgttcctggttcaaatctgtcaattcagtatttcctaagattaatattaatttattgtataaaacatttgtgtttagtcaattgatagactgattatttcttctaaatacagaggaagctttatctgggaattgcattatttcctagtgattcttactacctattctaataggacacaatttcacagatatattcttcttgatttttgactaagattttaaagaaataccgtcttttaatttttgattaatttttttctacaatcttagaatgaaaattttggagcagaaaagaccacagaaacctttgtaatatatctcctcaatatataaaagccagaagtgagctcaatttaaatggctaacttaggatatgaggagtaattggcaacaagtgctggaaccagatttcaagtctcataatatccagtccaaaactgtgagacactatgtaggtttcttcaacttgacatattatgtatgatagcagagtggattttctaaataggtggaagaagcctttaccttcgactgacagatttgctgagaaaagacaaaaaggatcacagcaggttcagatgaaaaattgacaggagcctccacctaactctgatactgactcagcatgagatatatagatgacagcaaccaatactctaaaaaaattatatatgtaagaaaagatgcagcctagcaaacacataaaagtatataactgtgataattattaataattattaataattgcagggcccaccagtcttctgtcagtaaattgattgtacacaggtttactgcctgagtaatttgtttatcttgcctgcatcagttattttgttgaattatcatcataataacgtgtgtgaaccagtcttcttaaaagtgtaaagactttggtctcttcttgttgatttatagtttagtcatgacagcagcaacaaccaccacaaaaataatagcaaatacttatagggtgttaaatacatgccagccccatattagcactgtataacacttcacatattcccactcctttaaatacttcaggtatttctaaatacattacatatcttaacttctttaattgccacaaggcctataagtttgatgctatttttacccctaatttacagatgtggaaacagaaagatccattaagttatggagcaagaaacactctggagataatactctaaaccactgttttaaactgtagaattaactttacaaaaaataaaaaaataaaaagctttagccaaaatttagaagaaagattgtactccaaactaatgctttctgctgatattggcagaatttttgcttgctgctctaatagttttctgtttaatgagcaaattgctttaagtacacatataacactgcggcattaaggataaagatattcagccaattcctttctcatctgtgatagttctagctctgcttatttgtacaatagcactttgaatttaatctttagaaaaaacacaagaaattgacattataaacttctttaaattaccagtgaataaagggggcaataaaatcagtaatttattaaataaagcacaatggaagcattcattaagatgtcatgaaaatgctaattaataatcaaaacgtatcctattgatttgagagcttttcagttagacttccagataacatctagaaataagcactgtacattcttaagtagagatttcatgactaggtcatatccttatatagcacccctcttttggggtgtaaggaaataccctgcagtgaatatcctctgaaagagactgcgttatgagaaaaaacacaaagattatcttctaggtcactaacaagggctgattattttatgtcagtcatattgctcttcttttttcctttttgtcttgataaattgtatcagctctccaaaacccagcttatctcatccctttaatttcctttagtttgatttgtttcttccttaactttccagaacattgaggtctatacatagcatctagcaccaatttatatagtatttctccttttggttattgattctaactacttggttgagcattaaatattataatatacaccctactggtggtgcatctgtctcatgtttctctagctccacgcacctatcaaagaactacaggtaggagaccctcaggagcactctgctccttttgtccactgaaaagaaaaagtgtatattcatttggaggtctttgcgcagtactctgttgagatctacagatgcagaaagttaagagtacagctaaatattatgtaagttgaaaatgattggtgcattcattaggtaagaaagtcttttagtttttccaatctagtcaaacttcattaccaaattatcttttatccaataaactcatttttaaggttgaataatattttactctgtgtgtgtgtgtgtgtgtgtgtgtgtgtgtgtgtgcatatgtatttgtgtgtaaccacattgtctttatccattcatccactgatggacacttaggttgatttcatgtcttggctatgatgagtaggaccacaatcaacagatgtacaaatgtatctttaatatactgattttctttctttggatttatccccaaaagtgagattgttggctctattatagatctatttttatttttttgaggaacctccatactgttttccataatggctgtaccaatttactctcccaccaactgtgtacaaaggttctctttcctcatattcttgccaatatgtatcttttatctttttgataatagacaatttaacaggtgggagatgatacctcattgtggttttcaatagtatttccctgatgattagtgatgacagcaccttttcatctacctgttggccatttgtttgccttccttggaaaagtatctactcaggtctgttgctcattgtttaatcagattatttgaggttttgttttttttcaactattgagttgtaacagtttcttacatattttggatattaagcccttatcagatgtatgccttgcaaacattttttcccaatccatgagtttctatttcattctgttgattgtttcatttgctgttcagatgaaaaactaacgaaacccactgaactactaaactacttaactactaaaactgctagccgggcgtggtggctcacacctgtaatcctagcacattgggaggccgaggtgggcaaatcacaaggagttcgagaccagcctggccaacatgatgaaaccccatctctactaaaaatacaaaaaattagctagatgtggtggtgggtgcctgtaattccagctactcaggaggctgaggcaggagaatcacttgaacctgggaggcggaggttgcagtgaaccaagatcacaccactacactccagccctggcgataatgcaagactccatctcaaataataataataataaataaataataatgaaaaaactgctaaaaagcagacgcttttagtttgatgcaatcccactttcctagttttgcttttgatgcctatgctttcactgtcatagccaaaatgtcatcgtctagaccaatgttaataagctttttccctatgttttcttctagtagttttatgatttttggaaatatgtgtaggtcttattccattgagttaacttttgtacatcacttgacattatgcaaagtgaagtaagccagacacagaaagataaatactacattatttatttctatatggaaccaaaaatatttgaactcaagaagcagagagtagaatggtggttgctgggctgtggtgaacggagtaagggggagatgttggtctggggatacaaagtttcagttacgcaagatgaataggctctggagatctaacgtacaacaatgtgactatagttaacagtactgtattgtgtacttgaaatttgctaagctcttattaagtgttctcaccacacacacacaaagaatcttcagggatcccaaaaagtttatatgaatgcttatgtaatttatttctccaaaatccatgtaaaaccccaataatactataaatgactaaataaatagtgtataaaaaaataacagaggctgggcgtggtggctcacacctataatcccggcactttgtgaggctaaggtgggcatatcacttgaagccaggagttggagaccagcctggccaacctgccaaaaccctgtctctactaaaaatacaaacattagctgggtgtggtggtgcacaactataatcccatctacttgggtggctgaggcacaagaatcacttgaacccaagaggcagagtttccagtaagccaagatcacaccactgcactccagcctgggcgacagagtgagactgtgtctcaaaaataaacaaataaataaataaaataaaaaataacagtgataacttgttctgatattctctggctgcattagaatcactaaaaatgattgacctatgaaattattaatgctacccatagtaggctaatgatggatcacttccatgaatctcatcttcctcgtctcttaatttgaattgtaactgccatgaaagaccttttctaattattttaaatttactgaattagctgtgaattaagactgaaaagatatatttggagattaataaagttcttcaggaaaggtattttatttacatatttattttggtataagattccctacatcttataattacaccatcagaaacacaaacctaacttacctttcctccttgcatatttagcaaatgccataatcatgcatggcctgttactttctgaaccatttcctattgattatatccactgaaatgttgacattgaatgattgctgaactctatctgtacaagcactgaaagtatttgaaagtagaaattactcttcaaatttcatttcttttatcttttctgttataagaacttatcagtgatttccttctgtatcccattatagaaatggcatcatgaaataaaatataagctgacagttctcagatttattattgtatttgatatattgacatttttaaagagtggtgctctgtagttaaatgaatccaaagagattaaatctctttaaaaggagtcagtcctctaagagtggaattttcttgccaatgcagcttgatcagaccatagttgggggtgggctttcagaaattgcaacacttttcatctgctcatctatttgaggcagtattatttttttgagtttcaatatcttaaaatactgatttttctatcaatcattacaattgaatgcattcacattagttgatttctatgaaagtatcaatatcaatagaaaattacatcttggaaatggatttgactcatgtacttgaaaaatcagtgtgtgaggaaatttaaaagtccagttttcattaattttagcacaaagtgttttattgaaacaaaatgcttcacctatctgtattttagtatttgttacatatgtagaataggtaatgaccaagtcaggtgattttgggtatccatcaccttgagtatttatcatttctatgtgttagtaacacgtcaagtcctctctcctagctacttggaaatatacaatacatttgttgctaactataatcaccctactgtgcttttgaatattggggattatttcttctatttaactgtatacctgtgcccactaatcaaccttggtttaccgccccccccaatcccacccttccaagcctctggcatctataattctattctctgtctccatgagatcaacttttttagctcccacgtatgcatgaaaacatatagtatctgttgtgctgtgtctggcttatctcacttaatgtaacaacttccagttccatccatgttactgcaaatgccctaattttattatttttatggccaaatagtattcctttgtgtaaatatactgtatttttaaaaaatccacttatatattaatggacaattatgttgattccatatctttgctattgtgaatagtgccgcaaagacatgcaagtgcaggtaggtatccctttgatacacatatttctttttctttggataaatacccagtagtgggattgctgaatcttatggtagtattatttttgattttttgagaaatctccattctgtcttctatagtggttatactaactttcattcccaccgacagtgtatgagttcccttctcctcacatcccgatcagcatctattaaattttttttgtctttttagtaagagccattttaactgggataaagtaatatctcattgtggttttaattttcatttccctgctggttagcaatactgagtattttatcatataccacttgatcatttctttttgagaaatgtctattgtcctttgcccacttatttatttatttatttatttatttatttatttgagacgttgtctcgctctgtcacccaggctggagtgcagtggcgcgatctcagctcactgcaagctcagcctccccggttcacgccattcttctgcctcagcctctcgagcagctgggactacaggcacctgccatcacgcccggctaatattttgaatttttagtagagacggggtttcaccgtgttagccaggatggtctcgatctcctgacctcgtgatccacctgctttggcctcccaaagtgctgggattacaggcatgagccaccgttcccagccctttgcccactttttaataggatttttgttgttgttgatgagttgttttgagtttcttgtatatttcagatattagcctcttgttgcatgaatagctggcaaatattttctcccattcaacaggttgtctcttcactcaacggattgtttccttgctatgtagctttttagtttaatagtcacatttgtctatttttgttatagttctctgcgcttttggggtcttagccatgaaatgtttgtaagattgatgtcttgaagtgtattttctgtgttcttttctagtatttttacagttccaggtctaatgtttaagtttttcatggatcttgagttaatttttctatatatagagagcagtccagattcattattttacatatgtacatctaattttcccagaaccgtttattgaagaggatgtcctttaccagcatgttcttaatgcctttatcaaaaataagttggcaataaatatatggatttacttctggactcactgatccattggtctatgtgtctgctcttataacaaaaccatgctgtttgtttgggttattatagccgtctaacatattttgaagttgggtagtgtgaagtcttcagctttgttcctttggctgaggattgttttggcttttcttgctcttttttggtttgatatgaattctataattttttttaattctgtggaaagtgacattcttactttgataggaaatgcataggatctatagatgctttaagcagtatgaaaatttaacaaaattgagtttcccaatccataagcctgggatactgaactgtagttttagtttgttgttgtgtctttgtctggtttggtacctgggtaatgctagcctcatagaatgatttagggagagttctcacctcttcaatttttttgaatactttcaggagaattggtattagttctttatatgtttggtagaatttggctgtgaattcatctggtcctgggattttctttgctgggagacctttcgttactgattcaatgtcactactcacaattggtatgttcaggtttttttttactttttcctaattcagtcttggtaggtgtatgttgtgaggaattcatccatttcttctaggttttccagtattttagcatatagttgtgcataatgatctctgatgatcttttgtattttgttggtatcaattgcaatgtttccttttctgattttgtttatttgggttttttctcttcttcacagcaatattggcctgtaattttgttttgttttgttgaatgtgtttttttgaatctctatgtcattgagctctgatctgatatttactatttctttccttctgataattttggatttgacttacccttgctttcctaattccttgaggtgcatcattaggttgttgattataaatctttctactttttaaatgtaaatatttactgttataaatgtcccttttagcactgcttttgctgtctcccacaagtttgggtatttttgtatttccatttttatttatttcaagaaattttttgatttccatcttagtttcttcattggcccaatggttggttatccagaagcatgtttttaatcttcatgtatctgtatagtttccaacgttcctcttactgatttctagttttactctattgtagtctgagaatatgcttagtgtgatttctattttataaaagatttgttaagacttattttgtgtcccaaactatggtttatcctgaagaatgttccatttgctgatgagaagaatgtatattttgtaattttggataaaatgtcctgtaaatgtctgttaggtctatttggtcaaaaataaagtttaaatctactgtttctattaaaagtgcaatttaaatctactgtattaacattttccactattattgtattgaagtgtacctctctctttagatctggtaatacttgatttatgaatttgggtgatttagtgttgggtgtatatatatttagaattgttatttcctattgcttaaacaatctctttgtcattatataatggcctttgttttttctttactgtttttgacttaaaattgattttatgtgacataagcatagctactcctgctcgcttttggtttccttttgtttggaatatctttttccagcacttcactttgagtctatatatgtctttgtaggtaaagggtgtttcttgttagcagtatatatttagatcatgtttctttttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggcctagatcatgtttctttatccattcaaccagtctatgtcttttaagtggagaatttaatccatttacattcaaggttattattgatatgtaaggtttacttcctaccacattgttgtttcgggttgtgttgtatattttttgttcctttctttttcttctttcatttgctattgtggttaggtagttttctgtagtggtacaatttgggttgtatctcttcttcatttgtgtgtttggtttatcagtaagttttatactttcatgtgatttcatgatagtaaatgttgtcttttcgcttccagatttaggagtcccttaagcatttcttgtagggccagtgaagggccatcagtgtttgcttgtctgggaaaaacttcatttcccctttattgatgaagaataattttgctgtgcatgatatccttgagtgggaagtttgtttttttttaaagcactttgaatatgttattccattttctcctggcctaacaggtttctgctgagccccagtgttagtctgatgggagttcctttataggtgacaatatgtttttcttgctgttttatatagttttctctttaatactgactttagatggttggactataatatgctgtggataatttttggtattgtagctgtttggggatcactgggccttctgtatctggatgtgtaaatctgttgctggacttggaaagttttgatttattgtttttttaaataggatcttaactaaactcttgttttctcttcaccctcagggacattgataattcaatttcaaaacacccatattcaagttttgagattctttcttctgcttaatcttgtttattattgaagctttcagatgtatttttatttcatttaataaatttttcattttcagtatttctgattttttttaaataactattcggaaaatttctcattcatatcctgacttgtttttctgatttctctgtattgctttaatcatttttatttatctttctgagcttctttaaactcagcattttgaattacttttctgggaattcatggatttattttgattgggatatgttgttagaaaattatatttttgggaggtgtcatatttccttgctttttgatgcttcctgtatcctcacattgatatctgtgcatctggtgtagtagttgcttcttccaactttttaaacttacttttgcagagaaagacattttcctgaagatttatatatgttgttggttgggtagagaactttggcctcaattttgagtgcatgcgatattgtagtatctgtgatttcatcagctgtaaagtgtcagtggtatctttgaattcctcggtggcttagggcttagaacacagttattagtgaagaatgtggtaaagtcttactggggacgaggatgctggatagtccagtctttgagtcccagtggtggtagtggtgggctaagcatgccttaccttgagccgtagagcaatgtatgctggctctggtgttagcacattcaggcaggccaattcttgggcccccagatggctttctcagatgccagtagtggcagcagtaggccaggcttgtgtgtgggttcttgggcctctgggcagtggtgtggtgtgcataatggcataagcagtggtagcacaactcagtggaacaccaattcatgttggtgttggtgttgtcagtggctgcaacaggctggatgggcaagtcccttgacctgcagctggctcatatgggttagtgtctgcagtggtggtattggtaggttggataatcctgacctcagaccctggcagtagtgttcaagtgccagtgatggtgagctggtctggtaatccctaggcctttggaatgtgtgcttgggtactgttcagatgaaagctggtgagcagatttgtcatcaggacccctggtagtatgttcaggcactacgtatgataggcagaggcagaatactccccaggtcactagcagaatgctcaggttgggacagcagtggctgtgttatgagtctgcttctggggaggctggggccactctcattgggagcagcctaggaaggcagctgtggagctcatggtttgcttatgcactggtcctgcagtagcagcagtggtatttctccttgggacatgtgaaagttcctggccttccatctccctcctgtggcagctctggtagcagtggccccagggcagaatgcaggcctttgaagactaagctttctgaatggtaccagctatgggcctacaaccagggaaggtggggccactctcaatgacagcaacatagacaggcagctatgggacatacagttgcctcatatcttagtcccacaacagcccacagcagcagcagtggatttgttctttgggtgtatgaaatgtctggcttcccttatctctccctggactgactgtagcagtagcaccatcagctccagggcaggatgccgtccttttggaactgagctctcagaatggtgccatattgcagctgctcaaggctgagaagactgtgaaacccagcatgagctccctctcttaagcggtgcctctgcgcaatctgtaggcagctccctatgttagtttctaggctcgtgggtgccgaggggcttgctcttggctaagattgtgtaagtccatggcaggaatgtggagccctggggatcacacattttccctttccctgtgtctgggagcttcttccagctcccagtcaatcccaactgagaaggctgcctcatttccctttcattctttgactttgttgcttccaataatttctctgttgaatattggtgttctcttatagatgactcatttgaactatgaatatctacttgccattttggtgtcactttatggagaggcatataatagctgcatctagtcaaccctcttcccttatgacagccaaaatattattaattgaaatgccaactgtacttattaaagagcctagatctgtgatgagcagtgattcatgatttgccactgcaaacttgccatctatcaaaccttaactatagttaataattgaactttgttagcagcaagtcatgaatttagtcataaggactccaaagattatctgatatttgactatgtatactcaatctttagctggctttaaataacctgctttatgtttataggtgtcttccccaaagaagagagtttatcaaacaaaacataataatgctggtgatcttaatgcctctcccaatatgtttttctgatgccactacacatctagctagatttgactctttagtatgtagccaacattaatgactgttctaatacacacttgatttttatttcacagaatacaaaattcttgatttattggaaaagaatgataatgcctgtatccctgtatgagcacttgctctagccacggtcacagtgccatctgtctagggtctggggaatttaggcccattgatcatttggagaggttgaggagtaaaataaatagtacccagctctatcatcaagaggttagtgctcaggtctaccacttcactccatttttgataccagaatctctgctctcatcaccatcttctgacaagtttgaagtctggcaaccaaggagcaaaagtgggtggggcattattcaactaatggatccatgagataacttctttatcaatgcctgctttgttatacagcgaactctctgctaacactcataccatgagaaatgattttaacaaaaccctaaacttactccacactctaatgaaacagtttttgctagctagcatttattaagcgtatttttttaatcttactcacaataaataatttataccaacaattggtactcaaggaattttgaataccctccctccctaagctctccttaattggaacagaagggatatgaaggccagggacagtggctcatgcctgtaatcctagcactttgggaggccgaggtgggtggattgctttagccaaggagtttgagaccagcctggctaacatggcgaaaccccatctctactgaaaatgcaaaaattaaccaggcgtggtggcacatgtctgtaatcccagctacttgggaggctgaggctgcagaattgcttgaacccaggaggcggaggttgcagtgagctgagatcaagccaccgaattccagcctgggccacagaacaagactgtctcaaaaaaaaagggaaaagaagggatatgagattggaccagctgctctgttatatattacatattcacaaaccattttcttagccaccttcagttaatgtatttttaatttttatctttttaaattttagattcaggggatatatgtgcatgtttgttaagtggatataatgcataatggtgaggtttgggtttctagtataccaatcacccaaagagtgaacattgtacccaataggtaatttttcaaccctcatgctcctcccatactcccccttttcagaatcctcagtttctatcatttacatctttatgtccatgtgtactcatttgttagctcccctttaaaagttagaataagtgatttatgatttttatgtttctgagttatttcacttagaataatggcccccaactttactcatgtagctacagaaaacataatttcattcttttttatggttgcatagaattccatagtgtatatatgtttaatcctatcatccattgatgtgcacttaggttgatttcatgactttgctattgtggatagtgctgcaataaacatgtgagtatgggtgtcctttggatataataacttcttttcctttgggtagatagccagtagtgagattgctgggtcaaatagtagttctatttttagttatttgacacatcttcctactgttttccgtagaggttttactaatttacactcccatagtgtacaaacattctcttttctccacatccacaccaacatctgtggttttttgactttttaataatagccactctgactggtgtgatgtgttatcttattgtggttttaatttgcatttctctgatgattagtgatgtttaccttttattacatgtttattagccacttgtatgacttcttttgagaagtgtctgttcatatcctttgcccactgataatagtttggatgtatgtcccctctaaatttcatgttgaaatgccatccccaatgttggaaatggggcatagtgggaagtggttgagtcatggagacagatccctcatgaatggcttggtgcacacctcacagtaatgagtgagttctgtctctctctgagtttacacgagattgtttaaaagaatgtggcacctccccattctctctcttgttcactctgtcaccatgtggcatgctggctccccttcactttctgccatgattgttagctcactgaggccctcaccagaagcagatgccagcactatggttcatgtatacccagcagaaccacaagccaaataaaattgttttcttaataaattacccagtctcagtttttcctttatatcaatgcaaacagactaacacatgtactttttaatggggttgtttttgttattgttgttgagttttttgagtcctttgtagattctggagattaatcttttgtcggagtcataatttgcaattattttcttcaattctgtaggttgtcagtttactctgttaattttttgttgttatgcagaagctttttggtttaagtctcatttgtatatttttgtttttgttgcacttgtttttgaggtcttagtcataaattctttgcttaggccaaatgttcagagcagtctttcttaagttttcttttaggatttttatatttatttttatattttcaggtcttacatttaagtctttaatctacctcgagttaattcttgcatgtggtgagaggtatgggtccagtttcattcttctgcatatgactagcctgttttccagtgccatttattggatgatattgtttattatcattgtttctttctttccccattgtttatttttgctgacattggaaaatataagttggtcgtacatatgtggctttatttctgggttctctattctgtttaatagatctgtgtattttatttttgtatcagaaccatgcagttttagttactatagacttacagtataatttgcagtcaggtattgtgatgcctccagctttgttctttttgcttaagattgcttgggctatttggctctttttttttttttggttttgtatgaattttaagattgttttttcaaattctgtgaaaaatgacattagtaatttgatagaaattgcattgatactgtagattgctttggaagtatgatcattttaataatgttttcagttccaaaagcatggaatgtttttctatttgtttgtgtcatctgcaatttctttaatcagtattttatagttctccttgtggagctcttttaccttcttggttagatgtatgcctatatatatatatatatatgtatgcatatatatatatatacacacacacacacacacacatacacatacacacacacacacatatacacacacacacacacatatatatatatttgcatggcaattttaaatgagattgagttcctgtcttagttctcagcttgaatgttattgttgtatagaaatgtctctgattttttgtacattgatttttgtatcctgaaactctgctcaagtcatttatcaaagttaggagtcttttggaagagtcttagggtttctaggtataatatcatgtcagcagtgaacagagataaggaggatgatgatgaaattatcagaacgtagaaactgtatttttttatgattcagctccttgctgtgccctttagactagctggcaatggtagttttattggtaagtggaacctaaaggagaaaatcaaacagaaaattcactatcttgtaatgtctcagattttatctatagtacagaaaaggaacagagtcttgtgacaagggctgcattatcctggggaagtaagcagcaacttaatacaagaaaatgggctgaagggtaaactgtcttaatgattactgctgattatattgtaagcctatttgtattttatttttccctttaattttataaagtgttcttgggaacagttttagttttccctaggctcgatttctttttcaatcttgaggtgcaagaattaatatggtccaaatttggcaaagactgctctagatttttttcttggcaaggggcatagccatggtgtgagtcaggattagaggaatgaaattctcaggtagtaactctaaatatttgtgagtgcctagtcaggggtatagtatgaacaaatttggtatttttgtctattattttagtgtaacatttaattgaacagtgaactatgaggtaaattataagccctattaacagaattgtgaatccaaactttaagaccccttgtaaagtgaagtaaaaatcttggagtatctgtgagaaaagctcagaaaatcagtcagacagagggtgtgtagtaagaaatgttatagtcaggaatgaatgtacaatgtagtctaaataaattgtagacaaatagtaaaagtccaaatataatggacaaggctagaatctaaaaacaagtgtagtatactttttttttttttttttttttttttgagacggggtcttgctgtgtcacccaggctggagtgcagtggcgcaatcttggctcacttcaacctccacctccaggttcaagcgattctcctgcctcagcctcctgaatagctgggactataggtgcatgccaccatgcccagataatttttgtatttttagtagagatggggtttcatcatgttggccaggatggtcttgatctcttgacctcatcattcgcctgcttcagcctcaaaagtgctgggattacaggcatgagccaccgtgcccagcctatacttctgtgtaccacaattgtttccagtctctcacttttattaaagaaaaaataatagtaaaaaatttattggcaaagtaagttttaatctttttatacatggcctgattatttgcataaaatacagcaaaaatggtgattggccatataggctcttttaagttggctttgctgaaactttttaataaggaatctcaggttaaactttttaaaagtctcttcagattactcaagtcaatgatttatctatgcctgtagatacctgtatgaattgggtaaatttttctctttttgaagtatcagaataacttggtgtttctgggcctattagaaagtgacatttcttatttattacggttcagtaactttgtaaagaaattgcatagacaaggtacaaggccatttttaagggacttttatcaactttataagtcaactttaattttttaaagtagtctgatcatttctgaaaatatgtcattttagtcaaagccttggcaaaataaccggtatctctaattgtttcctattataaaagagaacagatttttattgaacttatgtaaataattaaattgccataaattaagaattctcacatatagtttttaaattctggaaaaattaggtagagagaaagaaatatgtttcaaattttgcttacaaataaacaattgcttatttgtaacaatttttattcaattgttaaaagctataaatatctcaaaagaaaaagattttctcccctctggaaaacaaaatgaaaaggatcagtaatcttttaagtaaaatttaaaaattattttagtcctccattggtttagtgttttgctggatgttgggttagcaatcctcatgaacacataagctttttaatgagagtgctagaagttttttatgagtccaatgttatgatttttaaaattattagaaacctatatttgagtcttttttacaaatttttttaaagaagtaaatttgtactgtagaagaatcaaagtaaaagctaacaattgtctatagatgacaaaagtcttagattagtcacagataaaggcataattgacaaggaaatttggttatttttgtgacacacaatttaacatgattatcataattattagtgataacataactaagacatttaagaattgaaccagaaagaaataaaaatcctgaacagacaaataacatataatgcaattaaaccattaattcataatcttccaagaaaaagaaaggcccaggagcggatggattcactgctaagttttaccaaatgtacaaagagctgacacaagtcttatgaaaactattcctaaaaatagaggactaaggattccttcctaactcatttaaaaaaaattattactctagtaccaaaatcaggcaaggacacaacaacaacaaaagctacaggccagtgtgtcactgatgaacacagatgcgaaaattctcatgtaccctaaaacttaaagtataataataataataataataataataataataataataaaagttagcaagctaaatccagaagcacatcaaaaagaaaatatatcatgatcacacgggttttagtgcagggatccaaaaataattgaacatacacaaaccaataaatgtgatttaccacataaatagatttaaaagcaaaaatcatatgataatatcaatagatgtagaaaaagcatttgataaaatccaacatcccttcatgataaaaaccctcaaaatctaggcatcaaaaaaaaaaaactacctcaaaataataagagccatatatgacaaacccacagccaacatcatattgaatggggaaaagttgaaagcatttcccctaagaaatagaacaagatggggaatatccactctcaccactcctatttaacatagtactggaagtcctaaccaaatcacccaggcaagagaaagaaagtaaaggcatccagactggaaaacagaaaatcatttcctggaatttatccatttcctctaggctttctagtttgtttccatagagatgttcatagtagtctcatgatcttttacatttctgtggtatcagttgtatgtcacctttatcatttctgattatatttattagaatcttctttatttcttggttaatctagctagaagtctatcagttttgtttattctttcaaagaaccaacttttcatttcactgatcctttgtattatgttttttatttcagtctcatttatttctcctctgatcattattatctcttcttctgctagctttgggttttatttgttcttgttttttagttccttgaggtgcaacattaggtcatcaacttgagatccttctatcttttggatgtagacattcaatactaaaaattttttcatagcactgagcttgctctctcctataggttttggtatgttgtgtgtctctttgcatttgcattgaattttttttttatttctgcctcaattttgttgtttgtttgcccaaaagttattcaggagcaagttgtttagtttccatgtacttatacagttttgatagttcctcttggtattgatttccaattttattccactatgttcccagaagatacttgatgttattttgattttttgaacttattgagacttactttataggcaaatatgtaattatttttgaagaatgttctacgcacagataataaaaatgtatattctgaagttgttgggtataataatccttaaatgtctatcaggtccacctggtctagagttcagtttaagtccaaagtttctttgttgatttctgcctcattgataatgccgtcatgtaatgactggtgatagtgctgtcaatggggtgtcaaagtcccccactatttattattgtattgctgccagtgtctttttgtagggctagtgtaatagtatttgttttgtgaatacttcagtttttttgttttggagatggagtctcactctgtcacccaggctggagtgcagtggcaccatctcagctcactacaacctctgcctcctgggttcaagcgattctcctgcctcagcctcctgagtagctggaattataggtgtgcaccaccgcacccggctaatttttttgtatttttattagagatggggttttgccatgttggccaggctggacttgaactcctgacctcaagtgatccacctgcctcagcctcccgaagtgctgggattacaggtgtgagccaccgcgcctggccaaatacttcattttatgaatataatgctctggtgcatatgaatttatgatagttaaattttcttgttgcattgaatcctttattcattatatagtgtgcttctttgtcttttattactactgttggtttaatctctcttatgtaacataagaaaagctactcctgttcacttttgtttttcttttgtatgatacagctttttctaccactttactttaagactgtgtcattacccattatgtgagtgtcttgaagacggcagatagttgggtcttttgttttttgtaattcaattagccagtctatctatcttttaagtggagaatgtatgccaactatgttcaaagttaatatttatatgtgaaattttgttcctgtcataatattgttagctagttgctttgtagtctcaattgtgtaactgctttatagaatctgtgagatttgtacgtacatgtgtttttatgatggcaaggatcatccttttgtatccatgtttaggactcctttgagcttttcttgcagggctgttctagtgttgatgaattcccttagcatttgattatctgggaaagactttatttctccttcatttatgaaattacttgtgtcaggatataaaattcatggatggcatttttttaaagaactccacaaacagtgcccttatttctttgagcttatggggtttctgtttagaaatgcatacttattctgaaggtattttcttaataggtaatgtgatgcttctttctagctgcttttaagattttttctttcacattgaccttagatagtctgaagacgatatgctttggtgatgttcaacttgtatagtatcttccaagtgtcctctgaatttcttgtgtatgataacaacactcctagcaagatccgataaattttcctaagtttgcccatcaaatatgattttctttttcttcttctccctcaggaatgcttataagttataggtttgttcactttacataatccagtatttaggttttttttcctttttaaattttggtttttaaaatttttctcttactgaattaattcaaaagagcagttttcattttttaacttttaagttcagggttacatgtgcaggtttgttacacaggtaaacttgtatcatggtggtttgttttacagattatttgatcactcaggtattaagcctagtacccattaggtatttttcctgatcttctctctcctcccaccctccaccttccagtaggccccagtgtgttttgttcccctctatatgtccatgtattctcataatgtagctcccacttataagtgagaacatgtggtatttggttttctgttcctatgttactttgctaaagataatgacctccagcttaacacatatccctgtaaaggacataatcttgttctttgttattgttgggaacaggccccccaaaatctggccataaactggccccaaaagtggccataaacaaaatctctgcagcactgtgacatgttcttgatggccataacacccacactggaaggttgtgggtttaccggaatgagggcaaggaacacctggccgcccagggcagaaaaccacttaaaggcgttcttaaaccacaaacaatagcatgagagatctgtgccttaaggacatgctcctgctgcagataactagctcaacctatccctttattttggcccatctcttcgtttcccataagggatacttttagttgatctaatatctatagaaacaatgctaatgactggcttgctgttaataaatatgtgggtaaatttctgttcagggctctcaactctgaaggctgtgagacccctgattttccacttcacacctctatatttctgtgtgtgtgtctttaattcctctagtgccactgcgttagggtctccccgaccaagctggtctcggcatgttatggctgcatagtattccatggtatatatgtaccacattttctttatccagtttatcattgatgggcatttaggttgatgccatgtctttgctgtgtgagtagtactgcaatgaacatacatgtgcatgtgtctttataacagaatgatttctgttcctttgggtatatactcagtaatgggattgcttggtcaaatggtatttctttctctaagtctttgaggaatcaccacactgtcttccacaatggctgaactgttttacactcccatccaccatgagtaagtgttcctttctctccacaacctcaccagaatctgttattatttgacttttcaatcatagccattctgactggtgtgagatggtatctcttgtggatttgatttgcatttatctaatgatcagtgatgttgaactttttttcatatgttcgttagctgcatgtatgttttcttttgaaaagtgcctgttcatatccgttgctcattttttaatggagttctttgtttcttgcctgtaaatttaagtttcttgtagactcttgttattagacctttgtcagatgcagtttgcaaaaattttctcccattctgtaggttttctgttatctttgttgataattttcttttgctgtgcagaatctctttagtttaattagatcccatttgtcaactttttcattttgttgcaattgcttttggtgtcttcatcatgaaatctttgcctgtgcctatgtccttaatggtattgcctaggctctcttccttggattttatagttttgggttttacatttaagtctttaatgtatcttgaattaatttttgtatatactataaggaagggattcagtttcaatcttctgtatatgcctcaccagttatcctagcaccatttattgaataggaaaccttttccttattgcttgtttttgtcatgttttcaaagatcagatagttgtagctgttcagtcttatttcttggttcttgattctgttccactgctctatgtgtctattcttttaccagaaccatgctgttttggttaccatagccctgaagtatagtttgaaatctggtagcatgatgcctccagctttgttctttttgctttggatttccttgtcaatttgggctcttttttggttctatctgaattttaaaatagttttttttttctagttctttgaagaatgtcattggtagtatgataggaatagcatttaatttataaattgctttgggcagtatgaccattttaatgatattgattctttctatccatgatcatggaatgtttttccatttgtttgtgtcatctctgatttcttagagcagtgttttgtagttcttcatataaagatctttcacctccctaataagctgtattcctaggcattttattcattttgtggcaattgtgaatgggagtttgttcctgatttggctctttctttgactgttgttggtgtattggaatgatagtgaattttgcacattgattgggcatcctgagactttgctgaagttgtttatttgtcaaagaagctttggggctgagactctgggattttctagatatagaatcatgttgtctgcaaatagagataatttgacttcccctcttcctatttgcatgcctttatttctttctcttccctgactgccctggccagaacttccaatactatgttgaataggcatagtgagagagggcatccttatattgtgccaattttcaaaaggaatgcttccagcttttgctcattcagtatgatgttggctgtgggtgtgtaatagatggattttattattttgaggtatgtgtcttcaatacctcgtttattggagagtttttagcatggatggatgttgagttttattgaaagccttttctgcatctgttgagataatcaagtttttgtctttagttctgtttatgtgataaatcacagtttcttaatttgtgtgtgttgaacttgcatgcatctcagggataatgctgacttgatcttggtggacaaacttcctgatgtgctgctagattgccagtatttgtttaggatttttgtatcaatattcatcagggatattggcctgaagttttgttttttgttttgttttgtttttgttattgtatccctgacaggctttgggatcaggatgatggtggcctcatagaatgaattaggggggagtccctcccctcagttttttggagtggtttcagtaggaatggcactagctcttctttgtacatctggtagaattcaggtgtgaatccgtctagttctgggatttttttggttagtaggttatttattgttgccttgatttcagagctcattattggtctgttcagggattcagtttcttcctggctcagtctcgggaagaggtatatgtccaggaatttatccatttcttctacattttctagtttatgtgcatagaggtgttcgtaatgttctctgatgtttctttgtatttctgtggggtcaatggtaatatcccccttttttgtttctgattgtgattatttgctcttctctcttttcatctttattagtctagctagcagtctatctatctattttattaattttttccaaaaaaacagctcctggttcattgatcttttgaatggtttttcatatctcaatctccttcagttcagctctgattctggttctttcttgtcttcagctagctttaggatttgtttgcccttgtttctctagttcttgtagttgtgatgtcaggttgttaacttgagatctttctttctaactttttgatgtgggtatttagtgctataaatttccctcttaacactgccttagctgtgtcccagagattctgatatgttgtatctttgttctcattagtctcaaagaacttcttgacttctatcttaatttcattatttacccaaaagtcattcaggagcaggttattcaatttccatgtaattgtatctttttgagcaaatttcttaatcttgatttctaatttgattgtgctatggtctgagagagtggttgctatgattacagttcttttgcattttctgaggagtgttttacttccaattatgtattttacagtatgtgccatgttgcaatgaaaagaatgtatatctgttgtttctgtgtggagagttatgtagatatctatcaggtacatttgatccagtgctgagttcagttcctgaatatctttgttaattttctgtctcaattatctgtctaatatcatcaatggggtattgatgtctcccactattactgtatgggagtctatgtctcattgaaggtccctaagaatgtgctttatgaatctgggtcctcctgtgttgggtgcatatatatttaggatagttagctcttcttgttgagtttaaccctttaccattatgtaatgcccttctgtgtcctttttgatctttgttggtttaaagtctgttttgtctaaaattaggattgcaactcctccttttgtctgttttccattttcttggtaggtttttctctatccctttattttgagcctatttgggtcactgcatgtgagacggatctattgaagacagaataccattgggtcttggctctttatccagcttgccactctatgtcttttaattagggcatttagtccatttacatttaaggttagtattggtatgtgtggatttgactctcattatggtgttagatgattattttgcagatttgtttatgtggttgctttatagtgtcactggtctgtgtacttaagtgtgtatttgtagtggctggtaacaatcttttctatccatctttaatgcttcctttaggtgcttttgtagggcaggtctggtggtaacaattccctcagcatttgcttgtctgaagaggatgttatttctcctttgcttatgaagcttagtttggccagatataaaattctggtttggaaattcttttttttttaagaatgttgaatattggcccccattctcttctggcttgtagagtttcagctgagatgtccattattagtcaggggcttctctttgtaggtgatgtggactttccctccagctgcctttaacattttgtttttttattttgaccttggagcatatgaagattatatgtcttggggatgatcttcttgtggagtgtcttactgaggttctctgcgtttcctgaatttaagtgttgccctgtctagctaggttgaggaaatcctcatggatgatatcctgaaatatgttttcccaattggtttcattctccccatctctttcaggtacaccaagacattgtacatttggtctatttacataatcccatatgtctcagaggttttgttcattccttttcattctttttttctctagtcttctctacctgtcttatttaagaaagccaggcttcaagctttgagattctttactccacttggcctattctgctattaatacttttgtaattgcattatgaaattcttgtttttaagttctgtcagggtggctatgttcttctctatactggtcattttgtctgtcatctcccataatgttttatcattatttttagcttcctcgcactgggttacaatgtactcctatagctcagtgtacttcctttccattcaaattctaaattctacttctgtcatttcagccatctcagcctcagcctggctttaaaccctctctgaagaggtgatgcaatcatttggagaaaagaaggtactctgactttttgagtttttagtattcttgtgctgattctttctcatgtttgtgggcctatctaccttcaatctttgaggttgctgacctttggataggttttttttttcttttatcctatttgatgaccatgagggtttgattgtgttataaggtggagtcagctgactagcttcatttctgggagattttagggggccaacactcagctctcaacctttggactgtgtactataattctgggggacttctattgggccccaactttgttctctggtttgaaccttgaggtttggagttcactttgccgggggaaccaaagtgtggcagctgcagcaaagtgcaagtggatacaggggttcctacctccctgagagcattcaccacagtggtagaggcaaggcagcagctgggacagcaggttgtggggtgtcctgctggagactgtgctgttgcactagaggtgatgttggctggtttattttttgttggttttcaactttctcttggatctcattgagcttccttatagtctatatttctaattttttatctgtcattttcaaattttcattctattgaggatccattgccatagaagtagtgtgatcttttggaggtgtcaaagcactctttttacactgctggagttactgagctgattccttctcttctaaagaaaccgtcattttctttctttctttttttttttttgaaattgctattgtttgcaagggactttatatttattttttcctcccttgaaggtgtgactgtagtacatattttgtatgatcatttggcttctgggtgcttttagacaaccgaggctctgtatgaattcattggttatagatagcttttgtgtggtggctttctcaaattctgcttgttgtagctatacattgggcatatgagccaattcactctcttctaggaggccaggaatacagggatctcaggtagctgatgtcctccctagcactgtgtccttctgtcagccactttttgttttgttttggtttttgttttgtttttggtgaagtttggtctccagtaggtggtgccagagccagtttccctttggatattgagatgatgtgtggaagcacctgccctaatgaagctcatggagggagtttgtggtgggatgcactgaggtttccagggtggtaaagagagggctgcaccagctccccatcctgggaagtcaggaatatgatccacttccatatcatgcccctatctcagggttcatggccttcagttcagatagtcactgtcctttatctccaggccacaatgcaacttaggtctgtgagaaatgcctgtctggtggctactgatgaaatgacctttcagcagaacctcttcccccaacaccaaacagatgactctgcagttagttggtttacactgttttgcagtgatgctgccactctgtgtagaaaggcagaaattagccccgttctatgtacaagcctaagcagtgggcacaccttcactgaggacacagctatcccaaaaaatgctggaaggaggacacttacggcaacctccaacaggaaaggccttggctacctctgcagcagtgtacgggacagtgggagatccatttctggccactagggtcacctatccactagggcagaacagtgccccctttggagatcagcactgttacctgcatttcctctgttccgaggagcgctttggcagtctgcattccccctctctccctctctctagggtcagcacactcgaaggactatacctctagggatcccacagctccccagggacctgatggacctctgtagttgccaaagtcaccgtgggttttgaggttccctgggtaggttaatgacccataacagatacacaaacagtgtggtccctgccacctgagtctgagtttggtgtgagtgtgagcacacatggaggaaatggctgcctcgtgctgtgcctgctggaagttcccaaattgccaccaacaaacagcattgttctgggttgattgataggggaaccccgacagtttggctgttagtagtctgtcacacaggtgagaggagcaagagatccccctattgtaaccttttgtcaggactctaacttcctctggggtcaatctctgccagattctggctgccttccttttctgcatcccaacttctttgtatgggttctccaacaggtttcagcacactttcctcagttccacttgggtcatgattattcacctgcaaatttgatcttctttctgaggagaaatggcatccaacatctctagtcaactgtctggggaaaaaaactaatttactttctaaatgtttccctttagttagttaagtttaaaatgtgatttcctccaggaaataatgataatctctctcttttgtggctgaaatgtatgccccactctacatagcatacttagagtcagtgatgtggatcccaccctcatacacccttactctttttttatttgaagtaataaaataaaaacctttatcaaatgaaatgagttaatactgacagcgtatatttgaaaatgaaaaattgtaaatttataagcataaaagtatctccacactaataagaggaattattcaaagaaagaaaaaatattttacatgggttttagtgtgtgaatcatttcctttgtgatgaaaatgatcgtgtttaatgatatgaatcatatcttttaacagttatgataaatcttctaaattcaaactgaaaattatatatcagagtcttccaaattaaaaacaaaagaaaaaccctcccagggtgagttagtaatttttagagctgtattatctctcagtttatgcacttgaataccacttggtaaatgtacctgctgcaccaaagtatactttagtttcatgcagagtaaagataactcattatatcctttttatcatttgaacatcaatggctatggaaaaagtaattttcatcctgggtaaatttgctcatattctcaaggtgtacatggacctgactttgagctgtgtgtatagggttcttggtatattatttagtataggtctagcacattccagagcagattaatcatcctctaaatgctcacttctcacaaacagaaaccaatgtatcgacctccatgtgccctaacctgctgagctgtgttgatttgatttatgggaagttgatcattcacactaataatcttttatcaccttatgtatggggagcacaaggcattgggttatttttttggcttttgcaggagtctatccttagaatacaacagtgatttataattatttttctgaagtatcatttagatattctaagcaaaaagtctcatacagtgtaatataattagtactctatttctgaatggactttccctttcttgctttttttgaagcagattatctaagctcatttctattgagagagatctgctaacaaagcattcaagttagggttatcactgtcaaaatgaagtggaaaatggcaacaactccttttttcattaaaagctaaataaacaaaaattcatttagtattaaaaaaatgatgacaggaagaaaaccaacaaagctacctgcgaatatttcattacataattttaaacaacttaactatagataaaattgttttcagtaaacaaaatactttaaaaaaaaacaggtaagtcaaatcaaacatttactttagtgaaattgaaattattatttacctacctaagtgtcatctttaagaaaatgaaaatcaccataaatatttgtcaatgctgcaatatatactaattattccaaccaatactactactatctaccaaactatgtgcattcctgaaaggacctttgtgaagttacattacttttcattaattttaaggactttcttttccctggatctttaatttacatgtgtcagagtgctcccaaggattcgattacttttcattttattctagaatgttgataagatatatttgggaacatttatctaagctgccatttcatttttagtaaaattaggacataaacatgcaaacattatacctccttgtaaggcttaaataggtcagtgtactgccctggcacatagtaagaattgcataaatattatctagtttgaaaagtttttataattcctactaattaacattcactagtttaaagtatttctacaaataatttttatatttttctcttttttcacatgacctctttgcaattcttctatccatattcttctccaagttctttggttttatttccaaaataaaagtcctgaaatgaacaatcagatctaaataccacattcaggataatgaccatgagcactgaatggcagcataacatttaatgttttattcttttgtttttaatttttaaccgctttttttcttctatacaactaaacaatggctcgtatctttattagctgcctgaaatgactcctaagtattctaaagagattattgctaattcaaaatatatgattatgcactggtaattattccaaataaatctacttaatagtagcattattgatttgtcaacttgcagcattgtatttgtatctaggcctaataattttgtatttatttccaatttttctgtggttcagtgactaacattgcattgttactacaaactagatgaactgaaaatcagcatgcacatggtcagttgcttctggaaataattttaattttgccttgagttatactttcttagaaatggaattattaccatcccatgaatatcatttttcacatacttaacatattttttcataagttagttccatttatgtaaatatggttgtagctgcctagtgttaaaacttatggatgacaattagcacaaatattgagttacatttacttatataggatttctaaaagtgctttgggaaaccccaagtttatactaagtgctaactttaatcttgtttccaagttctaaaacatgaatgacatcatgaagtctcattctgaattttcagtgttgatatttattcagcaataggagcaaagaccctacagtcagtctctgtgggtttgaatcccacccttatcactcactagagaaaccttaggaaagttacttaacatcttctcaaataccttgttgaatttggaatgactgcttttaggataaatggaggtaagaaaagaggatattccaataaagtggaacagtttaataaaggcatgggcaggagacccaaagaagtaattgattaagttaggggatgcacatggtgtaataagttggaaatgtttaaaaaaagtgggttcacattatggaagacattcttgaacatccagagaaatagttgggcgaaaggtactataatgaaagctgttttaaaaacactacaagagtaactcatgcatgaggaaagaataaaaaatgaatgctgttgaagcaagaaagtagctactgcattcagcctgatgggtagtggagaaggttaaaccaatatgatactgtattaaaaaaaaaaaagaaggaattggaaaaatatgagagaattctaatgaaataattgcacggatgaatgcttctgagcccatcacatcctagtcacaattcctggtttcatttattttgtttcactgtttttcaatagcaagagaggaattaacagctaactgaggcaagcatcagcacagaggcagggagcattaggggtggagcagtcagggaacaggaagactgcagtgtcatcttgagtgacaccaaagaatatagccccataccacctatttcctccatctgttaacaacatttctcaaaaccagggctactgtcaaatttataaatactgttatttctaaatgtatttaactgatttaaatatgtttgctactgctggttcccttataatctccatttataatatttaaaaggttctgtgttggcattcagatggaagaaaaagcatgagaaatttcatcttgaatatgaggttatctaaggaaagaattcggttagcttcaggtgaatttattcttcccccctccagccccatcttttttatttatttatttatttatttatttatttatttatttatttattttgaaacaaggtcttgctctgtcactcaagctggagtgcagtggcacaataacagctccctgcaaccttgaactgccaggctcaggtgatcctcccacctcagtactctgagtgtctgggactacaggcgtgcgccatcatgcctggctaatttttaatttttttgtagagttggggtctcactatgttgtccaggctagtctcaaactcctagactcaagcaatcctttcactttggcctcccaaagtgttgggattacaagcatgagccactgcacctggcccttctttttctttttaccaaattatgcgtaagtatttccctgattggtttggggtgtttcgatttagtttaaaatagaaatatatgttttaaagtagtgcagacctctagcttttaatccagtgacagcagtaaataaaatgagatttgagaatatgctgtcattgatctgccctagcttcttttgttcatgaaggattaatagagaagaggtgatttttcagtcttctgtataacaacttctttggttcaatattacaggagccttgggtcactgtggtgaccatgttccctttgaccttttactttttgggttttttttttttttagattttctttgcaatttatgaacctcaagtgtcttaataagtaagtgcctctgtaggtagcctattgtgcagagttgcaataaaggaaaacactactagaaatgcaacacagcactaatcccattaacaaatgcagccagtgtcagagataccataagaggcaatttgactgagatgggaggacatcccacatcgtttatgggctgttgaacaagagactttcttagcctcatcagcaggttagctgcatatgaatcctcatttttatttagggacagagccccttgcttataatgctattggtcaaaaatgagcagtttttactgttgcctgcaacgttgctagcaccttatttggggctctttttataaggacccgcgatgaaagttgtagatggtaactgtgaagaaatctcccctccctatacccaccttttcaggctctgagatttgaataaaataacttttatagaaaatattttctatattaaattctataactctaatccaaatttgtagatcctcaatcttaaataaataagcgtagttttcttcaattttttatctaggatattttgtctcaagatcctatcaatgttacataatataaatcctcatattctcaccctgacccactaacttaacaagcagctgatatactgcccccatcttggccattctcacggattctataatacttctacagccacatctgctgtttccagctctccactaaatcatcaatgggcctaattttgccagaccctaggcccttagcactgtgatccaaataagttaataagaaatctctaattattggactagtagcaaaacttcatgcaatgggcttgggctgataatgcaacacaaacagtaacatccccttgttagaaacatcccaggttgccgtgcctgctgctgattcctgaatgcaaattgcaggtatgtttgggctctagaaaattagaaccagaaccccattagacaaaatcaggtatcaactcctgatttcacagttgagaaaaccacatccaagagtgttcaattttctgaccaaggtcacacagagactttgtgtcaacataaggccaagaatttaagtcttctgacttccggcctaatgttctttccacttcattttactgccactaagtccaagtcattaacattaacataaaaataatttgagcacatactccattgaaaacagactacattaaaatatcaaagatgtgaactgaaacatcagtctcccaaatggagtgagcacaaccttggatcgttctcacgttttagagagatgcctgtcagtcacttaagacccttaagattcccgaacccatgttaataaatttctagaatactttggatgctttagactacaaacatactagtaattactgctaaaaataatgtaaaaaatggaagctttattagttcacaaaacaataggccagaggtggtgaaagtccagagttagttaattcatcagtttaacaatgtcagggttctggttctctgtgattgtatcagctttcctttcctgatgccactatattcccaggcattagacacaaccatgggcaggggaaaaagtggctaatgcctgcctgtggcccttttctcagagttgagaaaaatttttccagtcaccttccccagtatattacagctcattagtcagaactgcatcacatgtccttgcctaaaccgatcgtggtctagaaaatggaattaccacaatttttttagagtaatcaacattcttgtgaatcagaaagccttcaagtatcttgacaaaatcagaattctgttggcaaaaaagaattaggatgtatgtaagggaggatggtgattgattcatataattgtgctatatttcttaattaccaggcatatggttctttttaaagatagttatgatgtaagatatcaggatcctggattcatcagcatctaacaagttactacttctggtggccaaatctggaagcgtctgttgcatgcaataacatggcacctgggaatatgcacttctgtgcccattatgactgatatgcgatacttggaagaatcattattctactcacagaaggaggaaacccagcaaatgttagagaacaagacttttaacgtaagcagtagtggaagatctgatttactcaccccagcccctttcccagatgtacttgaataaaagagtgagagtgaattcttttttttttttttttttttttttttgagacagggtctcgctctgttgcccaggctggagtgcagtggtgcgatctcagctcgctgcaacctccgcctcctggattcaagcaattctcctgcctcagcctcccgagtagctaggattgcaggtgtgcaccaccatgcctggctagttttttgtagagagatggggtctcaccatgttggccaggctggtctcgaactcctggcctcaagtgatccacccaccttgacctcccaaagtgctgggatgacaggcatgagccaccgcgcccagcccagagagtggactctttaacaatcaggctttatagtgcttcaaaatttagaccaggcctaagcaacagggtagtagggtaaggttgcaagtgggcaagcagaggtaacaacaggcaccttgtcttccaaacacacggagtagactaacttggctctagccgacagctcctgacagaggtgttgccagaacccgagctgaagtagaggcaagcctggagtgaggatctagataagttatgagcaactaaaagatgctacccttttccagctttctttcataaaaatcttactttttacgttatttcttctaaagctttctcattatgctgctagaaacccttctaaagatatattaccttaataaactagtgaaacaatgccagttttgaaaatgtgatcaggctgagaacccccttctccttctccccacttatgcttcaaagaagtggagaaaaggactgctctacctatggagtagccattctttattctttcctttcctaataaacttgcacacacacacaccacacacacacacacacacacacaagaagtgtagaaaagatctgaaaggtcaggttgtgtttagattctgaagggtttcctagtgctaggccaaattatttgtagtctatataatgcactaagagacgcagagaggaggtatgtacagagtagggaaagaatgaaaccagggtttcagagacattaatgtggttgggctgtgtgggagagaagagcagaagagaagagactagggcagaataaaataaagaagtgataaaatcccaaaccagggaaataactgaggcagaaagatccactggaaaaaaaaaaaaaaaactataataggaattaatgaaggactatctatggtaatctaggtgaaagtcatggtagaagttgactctagtggccaaggctgggtgacagagacaatgacagaaatgaagattatttttttaaaggagcatcagtggttttgttttcctgaccacaatattttcttgaagaaaaagatggcattcttctcttcctcacatctcatatttgtaaccccagaatatctcatacaatgcctggaacacaatatatgctcattaatattattgaagaaataggagcttgatttgtcatttagttgctgtcaatatgtctctgatactgtgatactgcagtggtaaattaacaatgaaaactaattttgtcaagcatttttcaggatatgcttttcaaatagctgccttcatctatagcatagagcatttctctactgcctcacatcttaaaatgttactctagcaccatctctagtgcgacaaaattacacacaggatacaagctcaggtgaaatcgttctgtcaatttcagtaagcttatacttattttctagactcctctgtgttctagcccctaccaaacagtccagcttcatctcttgctacttcaccttatcgctaaccctaaattcttctatctagccacagtgactcttctgatttctcaatgccatgctgttttctttgggtccttagttataggtagccacctttgcctggaaatgtttactccacttttacctttatgtggcacagtcctgctctttttaagcttttagctcagttacttccttccagaacttcttgtactcctacatatggggtaagggcctcccttgctcccatgatactctagcctttcttcacatagcatgtaccatactatttaattgcctgtttgtctacattcctcctgtatgaaccatattcttgtaagccccaagcatatatcctggttgtattagtccattttcatactgctataaagaactgcacaagactgtaatttacaaaagaggtttaattgactctcagttcagcatggctgggaaggcctcaggaaacttacttacaatcatggcagaaggtgaaggggaagcaagacaccttcttcacagtgcagtaggaaggagaagggctgtgcaaagggggcagggcgccttataaaaccatcagatctcttgagaactcactcattatcaggagaacagcatgggggaaactgcacccatgattcaattacctccacctggtctctcccttgacacatgaagattatgtggatgacaattcaagatgagatttgggtggggaggcaaagcctaaccatatcacttgtacttagcagttgctcaataaacattgtgaaataagtattgtgaagtaaacactacgaaattaattaatgaagaaaataaatgtaaagtatgttggttggcaaagttagaagtatttgttaaaaagtccattaatgatcttgtagaatcacgtaaacatgttgatatattagtataaatatattgcctacagattggcatacagtacagtgaaagtactacagtaagctgtacttggtctattttatgctccctttttcttcccaggaaaaaagagaagaataagataatggctatcagagaaagaataattggaacaccttagtcttaaataggtttgtttgacaagagtatgattaaaataatttcacatatagagtttaataaagcaatgacaaaagaaggaaaaatatcttcatatagccaaagagaacaaggaatttgcaaaattcatgaatagacatgaatagatgagaataaatgatgattggatatttaactattttggccactgaagatattagtaggcatttgcatagaaggcaaagcaaacattctttgctgatgttaatattcaggtttacaaatcactgtggtaagcacagttctgcccaggaacacaaagtgtgcgttcaacctacacagttgaaggcagtggctctggttctgccctatttactaggccacaattgctctattccccaaattgttctaatttacttaaagttactatatagtcaaaagggaatttcttgaattgtaacatttaattattttagacccgagatttttattttagtgtacagaaatactagtttagattccaataagtctgggacataatttcctttgtttactagactataatttgtgcttattagactggtatattattgaaatcaaataaacactgtaaatgaactctgtattttgtaaataataaaatattgataagaaaattcaaaacagtttcaaagtcattaataggtatattgcccaaataactccacttgtccttaaggttaaacctgtgttttgttgagaaagcctgctatacccccaatctgaattagctgctttgttttgtgcttctacaatactttgtacatacattattgttttagtcttccttattaatagataacttttaagtttcaaaagttacacctgcatttctgaaacaaatgaaaacatagttgtatgaaaagagataattttgtggattttcctccacatgtttctctgtcttggacatatttctatccatgctgttagcacactgacttaaaattgtttgttttagatccccctcttccattgaatctcacctcacccctggctgcaagttagaatcaccaaggacatttttcaagacactcaaatataccaacatttcctccctaaattctgatttcaatggtctgaatgaggtgaaaaccaggtgttacatttttaaaaccaccccaggtgttcttgctacttggtttatctctgtattccccatgttttattcttcctcttcttgaagtctcataagaaaatggtacctatagttgttaaataaattgattgtttttaaagagataaaattgccttaattggactagagaataccaaatctatttctaatttgcatacagaaatgcctcaccttaggcaaaaaaaaaaaaggcatcagaaaaattgaaagcaaaatgtattgccaaaaaataaattacattttcttatagaatttatataaagttggggtatattttagatggaaacatttggctctaacaagttaaattataagttttgaatatttcaagtataattaaattatggttcaaaattaacctgcacactcatctaccaccagaaaaatactagccattatttataaaaatcaaaattactcagtgatagttacttctccagggaagaaggtgagtcggtaataagctatgcccccataaccttacaatcacgctgggaagcagcagccagtagccaaactgcatcctggtggcactgactgatccttctgggaaccaagcccatgaccctagttttgtttcaaactcaaacacagaggatccctgcaaatccggttactcactgatgtgagaattcattttttcaaataaactgaaagctatggagtcttttttgggcactctagtccattacttttagctctttcatctaaaggaatttattctgcactttgttgcttattctctactgctgtttcttgattatttgctgaaaggtacctatcctgttgaggatggctgttgatattgcgtatttagtatttgtcctacggtttttatcctaatataaaaagcctgttctttcttctgtgctctccccgtctctctacctccgctgagcttcagattgcttttaaagggtgacctggcacacttctgtgtgcatgcactggtattacaaaacacaccttcccatttacttgtgagattaaatatatatatatatttatttatttatttatttatttaaagggattatgcttatatttaagaaaagaatttatgtctatataaaggaatatccatatcaagtattaggtcatatttatctcaagatgggaaataggacatattttaactacatgggtgagtagagaaataagtagtttaaactgctgttgtttgacttcccaagctggccacccctaagtgtattaaatcaaggatttttctcagcctagaaagttaaatagcaggtgtagtacttaatgaactgcagcgagttggacttattggtgtggcaaatagattgcgatatttctttccaattaaagttcttttgcaaagatcaatgaagcacattttcacaaattgaattacactaaactaataaacaaaattctcccattcccactgatggcaaattattgtttccttaacatttaaaatcccatcacaccattaattataaaatgcaagggctaggaaagatcaaatatttatttgctcatgtgtttctattttacttccaattttataagaaaggtaagaaacattatatgtaaagaaagctgcataagaataattttccaaacttgaatttttttggtctttgatccataagcactttttatttactaaataacatgcatgtcctaatgattaaaaggtctgatctttagtaaattagaaaagaatctgctatagagtaacctttaattaatgaatgcatggaacacatttacatcagaaacaatgggcttgatagaaaaatgaaaatagcttaggactttgcctctagaatcagtgagctgcttcagaaaaattaaaatattagtttagcaaccttaaatgtcattactttactcaaataatgcataaatgttatgatattcattttctaggacctcctcacccttcacctccccttgatatttcttttcaagtatactttggaagaaagtttatacttttatgtagttttcattttaaagtttttagtatttcaatattgatgcaggataacgaaaatggagtaacctcagaagcaaagaataaagctttaataggaacttctgttttcaaaccacaaaaggcaatatttggtgaagatgcacatgcaagatttcctctctaagaatatcctaggacttaagaagactttcccacaccgtggtctactacttcaaaattttcccagttgctcatgagaggatctgtattttgtgaacattcctagcatgatgaagagcctatcaaatagtattcccaagcctagtggcattttggtgacttgccaacccacgtctgtgtagcatctccaaagagatccagcataaagggaaaaaaaatagaaagaaaaatgtaaagaaaagtttctgatattccatcccaccccctcctttctcctcctctactaactccatgtttctctttagtggctcatctatgcagacgacttttggatttttatgggtcatttgatttaatttaaacagaaaatatgctgtgggtgtttgtcaaatttattttgcaaataaacaaacatacacacaggcatgctcaaaggcatgtcatttgtgacatacagttgcacacagaatgtcaaatgcatgtcataaatgaccatctgctaccattttatgcaggaaatgacattttaataccaaaaatagtagaaaacccataatatcagaaaaaatatttctttaaatgaaataagtttagcttcccaaacttacttatttttctcatttcttcatacaatggtgatgtttgtcataaatcaacataagcccacaatccagcttttgagaactacaataccaaatgccgtggctcaaccctttgtactaactagaaaggatctgaattatttctcaaagcataatatgcctactacttaccagggatcttgttaaatggacgtgctggtttggtaggtctaggagttgcctgagactccttatttaacaagctaccagatggcactgaggatgctcatctgtggaccaaacttttagtatcaaggaacaaaactgttttcttcccagtgttaatagctagcctgtcagccaaggcattattctttttagaacttttaagtatgtgtgttgggggttagtgggttggttattataatgagaagccttaaaaacccaaataatttaatctgtaaaaatgatgtaatggggcatcatttggagggataatatcttcttaatctagtaacctaaaccagaccaaacttaatttgtttacaaattatcttgggtcaaatcatgccacattaagtatcattattcttattctagttggcaatatcctcaccaacatttgtttctgattaaagcttctttaaattatttccagactattccttattattgattagctttttttttttacatgtattccagttacagatgaagcatagtattcgtatgacatccaatactttttcactggttagcatactgagataaaaagcagaaaaggaaatagagatattgattttaaaggaaaagtaacttccatttttgtagtattttatgatttccaaagggttaaccacaattaaactgccctccatgagcataggaatcatgcctgtttctccaaaactagccctagcacacaagaccagtgcctggccaataatataataggtatagtggattgaatagccccttccatcctataatgtgtcaatgtcattttatctgtatatagtggattgaatagcccctcccatcctataatgtgtcagtgtcattttatctgtaaaaagcatctttttagatgtagttaaggatcttgagatgggatcatcctggattacccaggtgggctctaagtctaataaaaagtaaccttatatgagacagaaaaggagacaaaacagaacagaagaggaggcaatgtggaagttgaagcagatactggagtgatgcagccaaagccaaggaaggctgcagccactagaggatggacgaggctaggaatagaatctcccctagagcctctgaagggagcatggccctgctgacaccttgattttggacttctaaccttcagaactgggagagaagcaatttgtgttgttttaagccatcaagtttgtgaaaatgtatcatggcagccacaggtaactaataacagtaaaaaagccaatattcatggaatgactgaacagctgaagtaggacagatatgagaaatcataataagaagagagaaattcagagtggcagagtaagttgcctaagtttgctcagccccagcatgatagaggtatttgtcaaatatctttttttaaaaagtcacagtacttccggccgggcgcggtggctcacgcctgtaatcctagcactttgggaggccgaggcaggcggatcacgagatcaggagatcgaggccatcctggctaacacggtgaaaccctgtctctactaaaaatacaaaaaattacccgggcgtggtggcgggcgcctgtggtcccagctacttgggaggctgaggcaggagaatggtgtgaacccaggaggcagagcttgcagtgagccgagattgcaccactgcgctccagcctgggcgacagagtgagactaagtctcaaaaaaaaaaaaaaaaaaaaaaaaagtcactagtattctgtatactagtgttggtctactaaaacttataaaatctgactagtttttaaactcttacaagccatccacagaagacaaaatgttagataaaataagattgtgaatatctttctctagagtaaaattaagcatttttataaatacctttcagcatccagtttttaagaagtttaagaattataaaatgttcacattataatcaaactggaccatgtttgtgagacatcagtgctcctgatcgtttaaacaatgagttagtccaattgcatgataaaaagaggaagtagttaagaataaaggtgaggcaggaaatttttgtcagaagacagacaaggatttgaatcatggctctaccatccaggtgcagtgagactttggccaagttacttaacctctctgtgcctcagtttcccaggaataaaaattataattcttttgggacatgtaaagattaaatgagaccacatttcaaggctcagactctggcatattgtggccattactatctagcaacaagcacacagtagaatttgatcagcatttgttgagtgtatttattcaaacctgcagttggactataataaactaagataatttaactgccttttggttgctcgagtcatctcagggcaatagtatactttttaagtgcaattcaaactattaacttagctacatgaagtcatataatgtgcagattctagatatcaaattttttttttttttgcatcctctcttgggtcatgagactttcaaaggactaccattaagagatcctgcatttgagaataagaagaaaaactttggtatagattcttttttattcaaatgcccattattctgaaattgatttactcttcctgatggaaaagtataaaatttgttggcctgcaggggaatttgcaaaaggcctatctggttaataagtcacttatctaattgatactagagtatcagcagggtgggttatgaaatcatgaaacaaatgatctgacagtcaattaattctgtttcatctttgtgtatgttcctagaggctctatgataggatccagtttataaataaaaaataaagagatgctttttgtctaggttaaacttgatttcattctgaacttatattgtacagttgttcatgagcatgagttaattgacaatgtttagcagtctttttttttttttccttttttgagatggagtctcactctgtcgcctaggctggaatgcagtggtgcgatcttggctcactgcaacctctgcctcctgggttcaagtgattcccctgcctcagtctcccaagtagctggggctacaggcacctgccaccatgcccagctaatcttttgtgtatgtattttttatagagatggggtttcgctctgttggccaggtcggtctcgaacttctgacctcaagtgatccacccgcctcggcctcccaaagtgttgggattacaggcgtgagccaccatgcccaacgtgtttagcagtctttgagaaaattttggttgaaggacattgtgttggatccaagtatactttggacacctgagctcccgcaatttccttgcatgagctactgaaagatagaaattacacacttgggcagtgcaattggattgaaatggatttaaatctcgtatctcaaattctatctatctttaaatctattattttataaaattatatagttcaaaatgcacatgagaaaaaagtgtctattaatctgacaattttcaatttatcttttgatgatgttattaaaactatccaaatctacttttggttgacatattctcttctaacttcttcatgaaagcttcaattcatgtacatgtgataataataataaaagttaacattcattgactacttattaggttctaggcacgggggaaggcactttatgtatcatttatttagtgtatgtggtttttttaaagcttggagtgactgttcaggaaactagcctaaatttttcattatatacataagaaaactgaggcacagagaagctaagttacttgattagccgaggatacaaagatggttagaatgtaactttgtagcatcatatctttgtgacaaaaagaacaatagccaatctgtgacgcaaaaacaaaggcggtttctcattccattctgtgcaaggcagagctgctcagagaacaaagctgtctttgaagctggggatggctccatctcaaatcagctctgtggggtgcagagtatgacaagatgcagccaacacagcagaaaatcaagttcaaaacactcaagttatttacaatcctttggtgccaaaccttaaagaaagaattcttattatgttttatgtatgtttctaacttgtcttcattagcttccctttgatatttttggcaaatcagtttaaccttcaaaagtcttcatttattctacttgattaaatcaaacaaatgaatagataacatagaatcaaatagcagtattgtctgttctgagaaagcaacagcacaaagaggtaaagaaaatgcaaattgaagctagatgattgtatacattactttattgaatgtcttaaatctgctcagatttggatggtggggaaagaaatacaaatgtttctagaatctacagttgaatatttgaactgctgggcatggaaggtttaaaaacaaaagctagttagaaaaaaagattgaaaaggtaagtttcagactctggcatttttgtcttttttaagttagtttctgttgaagccctaccttcaggattttcttcccaagtactttccctagagtatataaatcaatgcaacagtaccctgtaatagtatcttaacctggagaaatatcacaagactataaaaaaatgcttttagcaaaggtgtcaactttgcccctatatcatcgatgaaatgtcagcttgaaagtctaggtatgttggaaccattagagagaaaaagaagggaagacagattaaagaggccagaaagtaggcaatttaaaatgaaaagtttaggctgggtgcggtggctcatgcttgtaatccctgcactttggggggccatggcaggtggatcacctgaggtcaggagttcaagaccaacctggccaacatgatgaaaccctatctctaccaaaaatagaaaaaaaaaaaaaaagtagctgggtttggtggcgggtgcctgtaattccagctactttggaggctgaggcaggagaatagcttgaacccgggaggtggaggtggcagtgagccgagatcacgccattgcactccagcctgggtgacaagagtgaaactctgtctcaaaaaaaaaaaaaggaaaagaaataaagaaaattgtatggcacggcacaaacacagctagaacttttagctccataggaatagaattgaagaagttgaagataaattaggaaatggaaatgttgcaggaaaatgaaagggcactgttttacttcaggttccccaagaaatactctgagatgaagatctgcatccaggagtcttattagaaagtgctcttgggaacacctgtaagagaatgagagaaacagaattgtacagaaggagaagttacaatgcagtggcaacagaagctcagttgatcctacggaacatctggagctgggatggctcttcatatttgtctcaaatcaaagaaagggtttgaaactttgacccctacatcaacaagtcattctctgctagctggccttaggaaagggacaaactcttgagcaaggtaacttctttcagctgagggctattcctgacgatagacccaggtgggggccaaaaggagccaacactttctcagctgggagaatgaatgttgtggtgccaaatgagggatcaagtggggtatcacagcatccattagggctcaaccctgtgcttctcagatctccttacttcatgcagtcaattcatatcatctgggagcagcacctcaaagaaagattttggttagtctttgtcctgaagaaacttacaggagaaagtttcttttagacagactgtagccccatgtagcagttgttcctgaggttactcattgattctcttcttaactttcattctgtatttccatcaccctgggctatcatctatgtaggtctggtgaagtgacccaaatcctaattcctggggctccggcaactggtctctatgcccttttcaggctacagtagcattgcttgttcatttactgtcaaaattgggcagagggagaaccatggaatggcaaagtggatcacctgggtcccaaacatactttttgctgtttgcttctatagcaaacataggtaggtaggtagatgcctagctcttcctgatcatcaaggtcagttactccagccagggtaatgactcctctgcttttcttctgggccgttggcatgatgagcctgaagtgaccaggtggcaatcacagcttaaagtttaatggaactcttactgtgtacccagttgaagtgttttcccctgagaatacatccacattacttaaagttacagagacagaaaggaaaaattctgcaatcgggcccttgggaagtacgtaaagctacttctacttctatcatttggtctctggatttatatattcctatccactgggaacaaagcaccatataatagtcattggtttagagtgtagattgaatgctggagaatggtaccccgtccaagcaaaatattctctctaatctggcctcctcaaaaggccatcccagagctttctcaggtagacagccttggcatcatcttgagcacatttctacatctgcttttctgtgaagaaggtctctaggtctgagattatcttaggtgttatgctatgccatttgaataaacactctgtaagccttctgataatggagctggctaaagctttgtgtgcagaaaatgcagacccatacctggaaaatgtatctatttcagataagaagaaaggctacttctgccaggatagaaagtgtctaataaaacaattttgggatgggcacagtggctcatgcctttaatcccagcactttgggaggctgaggtgggcagatcactcgaggtcaggagttcaagatcagcatggccaacatggtgaaatcccacctctgctaaaaatacaaaaattaactgggcatggtggcatgctcctgtgagcccagctagttgggaggctgaagcacaagaatcacttgaacctgggaggtggaggttgcagtgagccaagatcacaccactgcactccagcctggtcaacagagtgagactctgcctcacaaaaaaacaaacaaaaaaaccattttgtcacaatgttgctttgtggaattctttgaagaatttttctgtatcagtgacccaacgttggtttcttttaatggtatgttgtgctgttttgtccacacacagctctgttcctggcaccacagctactggggtggctgatggaagatactggctgttgtcaaacggctaagtcaatctgtctattgacttgttggtacctctttgatggtagatgctctcttgaagacattagcatgtaatttacaacacagtggttccatatccattacatgaggctatgttcctctgttctatcagaggtaccacatctgatacctcagaagcattagggaaaatattttttggtgttttcagtgctacaccataatgaatcaatatctgtctcatttttgaagtgatcagattagttagttaaatggggatattatggagactaccacgctccatctttttatctttttaagggtgactctaatctccaaaaatcaccccctcctcacatttgatttttcccattatatagttcagaggctaaggaactaatataggggttctgtcacctaccaggtagctgaaaatgatcactagatacgtccatggccacatgtaacctggaatggggataggagttccttaattaccttgcctttatatgcccatttgcctcaattttaacaaagaaagttatgatgtgatgctttagtctcgagatatcaatgtcagcaattctcaaatggtttaaatatttcttttttcccattatcggaggaaatggctgtaggacccttttaagagaggaccaagtgaatgactactgtataccccttccatgatgttgcaaaatctttctacaagggaatcatgcctttccttttaaaatatcatagatctgagaattgactcaagtctggttagttagaaaagagatcttggctttttattggtgcttctgagttcagcttctcgattatatatgcttgatttccttggattacatagattgagcaatactctagttggctatctatcttgcacctagcaaagctatgttttaatcactttctccttaatgttctgcatgtcatgccaccctggctacccactctaatctttccactcgttaacttaattgtgcccaccttgcatctgacagtctaatatcatcacccactttctactttggaattcgatcatcctccttgcttactgaaaactcagttctgtaactatctatcttactgtcagtgctggcctagaaaggacagctgccactaccttcccagtgtcattggtgtccctctcaccggaacatttctcaacactttgatgaatggaataccctgtgggctcttccagagaacataatcaggagatagatttcctgtgcttaggtaacataccactctgccatccccacactgagacttggaggtcagactgggtattggagctccagagaaggtggaatcctcagtctttagaaaattggctacaccaaattcagggctttgaatgggaagaaaaaatgagacccaaagaattgagatggaaacaactgagtcaaagcacttataaattctaaatctccagatttcaccatgtactgcggcagtggcatttgtgagtatttattgtaggttattgctttttactcagtcttccaagaataatcctagtagtatattattccattcttccagggctattgccaggttgttaatcctttattacaggagagtgctcccatataggtaatctctcccatatccaatatgtcccatgccccttgacccagcaccctcagaaagcagccatttatataatcctgtagggctgagggatacatgtcagttacatcatctatctccttcggcatgcagttcctcttctaacagattcagcacttctctaggttgatcacgctctgatttaactctggtattggccaggttgccaggaggggagctatagatagatcctgaggggggcacatattgccttgcaagactcagttctttgaatcatctgcgaataaggggagtactaaatttaagaaaagcatgctccagttttgataacccagaaggctcagaggaatctggggatttaggatttttaattattttcacccagatgtcccatctgaattctttggatcccaattttccttcccattcaaggttctgaatttggcatagcaaattttctgaagactgagaattccatcttctctgcaattctgccacccagctttatcctcagtttgtactgccctccagttggtggagttgaaaatatcataggttgtcaaggagatcctctgattagttaccctcagccttttattatctccaatgtatccctggaatccagcaatagccatgaggtttcagagtccttctaatggctatttctcaaagaactgagatatgccctgcccttctttcatttccagattgcttactgtcactggaatttccattttatgtcaccactgataacattttaacaattgcaaagcttcaacatgtcaagagctctttgtacaacacagcctaccagcattaatggggtcctcattgccaactggtctatgaataatctagatccacaatctcattttaatgtttgctttctaggacctattctggtaccaaatcttttaaaattgggttccagggaaatagactttgaggcagagatttatatgtcaaagagttattagggatgctcgcaggaaaagaactgtcgggagtgagagaagcaaaaccgatgaggaagaacagtaatgaacttgcaacagaggcctcagctgatcctataggaagttttgaagctgcggtggcccttcataactgttccagatcaagaatgtgaccaggtcctgtaccctcatatgaaccagtcagtggatgcctaacaatgagcaaggaagctgtctttggccaaataaaatttccagtgatagagcctagttgtagccgtcagtagccaatactcctagcaactggagaaataagtcttccattcctgaaagaacatctctgtgacgccccgcagcatccgctacacactgaacacagaatattgaagtgaaggaactgcctaggtgaataaaaaataactatttttatttattgaaacaactatgggttgtttcaaataagctttctaaattaacatggaggaatatatatatatatagatatatatataatttcaacctttccacatttaagtaaaaactgtacatgattattttagtgacgatgctgatgtgctgacgatgctgatgtgtgtatttaagttccagctatatatttctaacagtcttctggcctatagtccagttataagcactaaacttggatttatgtagctctaccatcccgtttatggtgtcatataaatgtttttctttcctgtgttatgtttagatatcaaccatatgtctattattttattattaggattcttttttttttttttttttttttgagatggagtctcactctgtcgccaggctggagtgcagtggcacaatctcggctcactgcaacctctgcctcccaggttcaagtgattctcctgcctcagcctcccgagtagctgggcctacaggtacccaccaccacaccccctaattttttgtatttttagtagagatggggtttcaccgtgttagccaggatggtctcgatctcttgacctcgtgatccacccgccttggcctcccaaagtgctgggattatggctgtgagccaccacgcccaagcctattattaggattcactttacataaagtactcattagtagttgaacacatggatttagttatcttgttgcaatttgaattggctattggaaggaagacaatattaaaagtgtagttgaaaacatttttatggtgagcttcagggcatattatttgaagttctttggtgcctttttattttttattatttaatttggacaaagaagattctatatttattatattttcctttgaaatgggtggggtctcaaatcaccctttggagcataatccagttaaattttaaaagtatttgctaaattggagacatctggacactctggagttaaaattaaataggtataaacaaagaataattcaatgaggaagactaagtaacacaagtatagacatgtcaggccctagtgtatacctttttggagattagaaaaataggttgaagaacacaaatgaaactagcttagaaccaggataactgatgcaaattttcaaacatgtatataaatataatagccagtattacaacttaaggcatttttgaatactttggagaaggctcattaaagatgatataaatgtaggaaactacactgtacacaagactattcaatattagaaatattgagccggataaaggctgaggtgagagttacagtttgagttagatagctgtacagtttgggttacataaaggaatatcaaatgcatagaaatagagtgtttttgttgtaagcttttacttaaagaaagtaatgtaatgatatatctctacaagtaagatttaaggtaggagaaagtttttataaatattcagaaaggattaatgttagatattaattttctaacagtataaagactaagagctaggagttctctgctgttgaatgaggcttctagactacctcacttcttccaatataactgatcaaagacaagtttacagagacagaaaattgaagcaaaacagtcacttgcctgcaggtacttgacgccagtcccccatttctgaaagaacaaccttatcatactgggactccattggaacttctaagaaatcatggtgccaatcctttctgtatgaataattgctaaggttattgctgtgtccaaactaattttttctctttcgtagtaaagttctctcactggaaatgggtaaaagagactacaccatttaaagaaaaaaagagaaggtttaggaagcttgttgtaaaaatactgaagtcacaaacttattaagaaatccactccctagaatcttaaccctgacctaaccattagacacctctcacacagttttttctgtcaaatgagactcaaaaaattgactttgaagatctccacaagcatgtttcattattttcttgcagatatcagggatgtagatggctgtttctgaatcacagctgcagagcagctacatgataatggcagtcatatccatttatatttcaaattaacttaggagtaccatgaggatataatgttgtttgggccctgttaaaatcaggtctaccattctgatattctagggagagaacaataaaaccaacagacctcctatgggtattttttacaggaaagtgcatggctataggggatgatccaatgctggttcacatttggctcatgagagccaattgtgacatccaattctgcattaagggatattacgttggtaggttgattttcagccatagtgggaatatttatactttggtaatcaacaaaccctaaaactcagggcttcctttctgtcttttatcttctttttttaggcttagtgttaaatatttctacttgaaaacaagacaataaaccaggtgactaaagaattactcttaagaccttaattttttttttctagcaaagaacttggattcctgctagaaattcctgctagaaaggacatgactagtggtagagatgatgagatatttatctaaactggcggaaataacatactctttttttagaagttgaagatattatccactttaaaaattatatataggtgaaacccaaagttagctaattctatttgtaagccattcagtttagcatatccactacaaatagggaggaaacaaaatcaagtttatgcagaaaatcaatagaattcattttgaattgatagtatatctatttcctgtaacttttaagaaaaaaatatcctcagccaagtgtggtggctcacgcctgtaatcccagcactttgggaggctgaggcaggcagatgatcaggtcaggggttcaagaccagcctggccaatatggtgaaaccccgtctctcctaaaaatataaaaattagtcgggcatggtggtgcatgcctgtagtcccagctactcgggaggctgaggcaaagaatcatttgaacctgagaggttcaccctggagatcatgccactgcactccagcctgggcaacagagcaagactccgtctcaaaaaaataaaataataaaatttaaaaaaaatcctccagtggtattcctatggttgtgaaattagattgctggtccttctatcttttgtttctctctcttctgttgattctctctgggacctttattatcaacatagcttctaaataaggatgctccataatagaatgaaaaggtgagccacaattctatcagctttttctacttgtaatgggttcttaaaatggtttggtagaaatactgtaacatatttcaagaatgtctataattatctgaaatcctaactatttatgattctccagtgcctctgtcccaatgtataatattgccactacagaatagttgcgatttttgttgtttttaattatttctttggacaactttgaactaaagtagttacatcagctatgtattttgacacttgatagcatccagttcaatgttttattaacactggttagtactgtcttcatttttgatatttataaatgatatttctgccaacagaaagcatttttgatatttcataagtattcaaccacagcaatcagaagttttagggctagtaaatcaatagatacccaatcaaatgaaactgataattgcttatgctcaaagagagttagatttaagtaaggtgctatttagaggttgattgcattattaagaaattgcctgttaagtttgggttaacagctcagaggtgactgagttacctttttggtaatataaagaaggaaaactacttctccttaattacagaaaactgaaaagacaagtccacacattttttttcttcaaatatctcttgttggtctataatcaaccaggcactagattaaatgatgacagtaaggcaaaaataactgagatgactaattttaaaatgtattataaaataaagtaagtatagtacttaggctggatgggccacctgctgtttaagtcaaagcaatgttgtaatttaattttccatcactatttcatctctttttaagacagccaaaccatcctagggaatgtttgatagaaaatttgttgtaagggagcttctcaggagtagaacgtctctatttcagccaaacaaagctttctgctcagcttgtagtattagaaaaacatgcttatttgttcttacttgcacctattttatctgtcatttcctgcaaaataaacttctcaatataaatttctcacttttagaaactgacactttattattaaaataccaccttgtctttttaaaattccctcctttcaatttgggcagaacttgtgattgtgatgagatattactctcttgattcggttatgttactggacaaaaggggttttgtagatgtcatttagtttatttatgagttgacactgagttaatctaaaaggagattatccaggtgggcctgacctaatcacagcctcagccagcaccttaattgcagccacgtaagcccctaagcaaagaatccatctatgccatgatggactcctgacccacagaaactgcaagataataaatatgtgttacctgaagttgctaagtttgtggtaatttgttacacagtaatagaaaaccaatgcattctacatgcaagggagggaaggattgaagaaagaacaagaacgcaagagagtaagagacatgtgtccctcatctctcatgggtgtcttccatccagatccctgttccttaattttctttgacgatagacccacactactcattcttctgctccaacctcttactccacattcacagcatatgggaagggtacacacgtatacatcctttcttcatacatttaacataccctttcacctgccccagcgttatccatttttgcatcaggagcttttaaaagttaacacagaattcctggagggttgccaatttctttttagaataatttatgaaattttaaatgaatctgaatataacaaaatagggcagtttccaagtatatgtagaatattgcaacattcttagagggagaggaatatggatgtgagtatttgagttgtttctgctggattccagtgccctgccccagagcatgatgggccgtgggtgaactgcgcacctgctgctgctccagcaggcctgatgtatgttgcttggttcttcctcttaccacaaacttagcagcttcagataacacatatttactatcttggagtttctgttggtcaggagtccattatggcatatatggattctttgcttagggccctatatggctgtaattaaggtgctggctgaggctgtgattaggtcaggcccacctggatcctgctcactccacatccaccctctctgccccactgggttttcatctccactcagaaacagtcttctttaactggcaaccagataaaatcaacctaagtgaaggagtcacctttctccatattaatggtgcatcatcaggtatagaaagggaactaattaacataaagaaaatatcaagataataaaagaaaatttgttcctggaggacacagatcattggaaaacagagagatcttttaaaaatttaagtaatacactcagaacaatttgtgaatacactggtgtcccccaaaaaatttttttgcatagtgcctaaaagggaacaacttgaaaaagaaagaaccgtcctaggtggaaagctatgattgctaaagtaaaatatttaactagaaagagttgaaaaatacatatttggaagcctaaaaagtgaaaaagaaagacagaaaacaagggatggaaaatacaaaagacaccaaggatcaactcaagaggtttaatattcattcaacagcagttctagaaagaaaaaattaaaagagagggaggatagcaaataaatgataaaagaaaattcctcacaattgaaatacccaagcctttagattcaaagagctcactgaaaactcagcatattgaatgaataagagactcacagatagaattacccttgaactacaaattttcaaggagtctgcagagaaggaaacttgtaaatgagaacattctaaaaagcttctgagatttcaaaaaaatgacttgcaaaggaatgtgaatcagatgagagtcttgagttctcataagcatctgcagattctggatgaaaaaaaatgaatcaatgttttttaagttctgagagaaaatactttcaatctagaattctggagccagccaacttatcaaccctgaagcaatatcaggataagcacattttcagacatggcaaaaagttgatgttcaattcacttttttccttagcaatatgtttagaaatgtactccagcaaaagaacttcctcttaattaaacaggaaactagaaaacaactgactcattccaggatggcaatgaagaaatcttctagattaactttctgcagacctagagaacaagttccaaggtctaagggctctggcagggaggtctccaaggcaaaaagcaccgttaacagaagactacaagataaaactgactaaaagttctcttttttagttggggatgtaataaagaaaaaacgctacaagaaaaattagaaaaaaatgagaaactccaagaaaaaaaacaaaattgctcaaaaactcatgatctaaatctggtataaactgattttaaggaacgattttaagtaattggttatatgtttaaaaaataatttatttgactttaattccaggaacatccttctgtaaatgtcctaaagcaggggttactaaagcaggggttcccaaagcaggggttcccaaacccatgaccatggactgatactggtccttggcctgttagaaactggaccacacaacaggaggtgaaaggtgggtgagcaagtgaagcttcatctgtatttacagctactcctgtatttacagtacattcttgcactagtgcctgagttctgcctcctgtcagatcagtggcagcatagattcccacaggaagggaaccctattgtgaactgcctgtgtgagggacctaggttgtgtgctccttaggagaatccaatgcctgatgatctgtcactgtctcccatcatccccagatagaaccatctagttgcaggaaaacacgctcagggctcccactgagtctacattatggtcagttgtataattatttcattatatattgcaatgtaatagtaacagaaatagagtgcataataaatgtaatgtgcttgaatcatcccaaaaccacccccagtggaaaaattgtcttctgtgaaactggcccgtggtaccaaaaaggttgggaaccactgttctagaggttacaaaatccttagaaaagaatgcaatctatttggcctattattaaacatatttatacgttcataacatagtcataagcatatacacacttttcattatccattattagactgaacatattaataaagttgggtgtactgtttgaagccatagcattgaatgtaactctccacaaccctgacaatgaaaaggttagctggcaaaagatgagatttgggagatgatggaaaaaaggggtgaaggcaacaggcagggaattgaaggaaagtcaagtctttaaaatgtacatgttacaaaatgggaaggccaaagatactgccaaaaatgccatgttacaaaaaaaagtataataactattttatttaaaaatttagggtactaccaaacattagtggaagtagaaagaagaggatgttgtaagaaaaaagtcctcatcttatatatggaggaattaatagatacctcattaagaaagcaaatcaagaaacagagttgtacacaaatggagttgccaaactggctgtaaaactaaaagtagaaactggagaatcagatttttaaaagagaggtgttagaagacctacttttaataatagatctttctatattattttatttttaacacacatgagtaatgagggtaaagcatattattttaaactggattgtatttggtcataggaactgatagaaaaaaaattaaaattgaaagccaaagtataaaatacatggcaaaacacttcaaatcctgaaatgtttatatatgtttttacaaataaggtatatttgacaaaatgttaacataggtgttatatgtcagtaattacactattatccctagcaggttagggagctgacattaagccaactaagacaaacttagacacaatggggaaatagatttaaaaattaattaaaagctatttccatttagttagtctagtttctacccaagaatgtcttctgaattaactttcagacttcaaataaaccataactgaaataactaaatgactcccaatgcagtaaataattttactgagcataattaataaaattgaatatctggcttactgagtctggaataataaagtagaatgaacaatggaatagaaagaacccagcaatgatactaaggtgagagtacatatttagaatgcagttctgggtctcaaactcaaccatatgcgaatggacttgtgaagaacaaataggttttttgttctcttaccttaataatgatgggtgtccatttctacaatataacttttcttttttctcaaccctcatactttcactgaaagcacattcatcaagtaccatttattgaaaatgctgttctatattcaagagagagtatcagtatgtattggaaaaaggaggtatgtgtagatgttgtgcatttgaatgactattcaaaaccttactttcttgtgtagaggagataacacttaataaagtcaaagtcctttcaattgtttaactttttaaaatcagaaagtcatggctttgaagtatttgaaataaaaactggctttcctggtactacggaagcttcaacttgactctgcttttcaaacttcaaaaatcaaaagacttttatttggggtatcaaattccttgcttttataaatatgaattgcttggagaaattatcatttttactactgtaatatgaacttttgacaggttcttttgaaaattttttaaattgaatatgattgtgtgttcttcttcattagccagaagcaaggtcaatattttgaaagttcagcgtttctataattttttaaaaataatgaaaatcagggtcaaacttggaattttttaacatgatcttatctaaagtgtgacctaaatcataattcatatatggattataacatgggaatttaagatcaccaattctataaggtatgttattctctgctcctgcagctgaataacgttcgaaaccagaatcactgaaacttgttgcagtttcagactaagaccatactctggcatcatccctctccacagagaagaaaataaacacaattctgaactgtcagctccagaagctattgctcctcatctcatatggttttccttagttctagtaactgggctcttcattcatgcacatttgaccaagacctccccttgtacctcagttcaaatgaatgagtattttttttccttattctcagatatatatttattcattgacccatttatcaatttttattgcatgcctattatattccaggccacacaatatgatgggaaacaatcgttcttacctttagtaaacttaaagtccaacagaagaatgaaataggtcagtagtcttatttgactactgaacccggtatcccagatttgcttccctaacccagtcttcctaaatgcttctagggctggagtcctacccagagcccagtcactccacagttggattttgacagctttttgcaaagactttgttgaaattgacttgccatttgcctggacttgacatttggctaatatctgctgttggtccctggcctgatcacagacacagaccccatgaatatttctgatttcttggatgtgctaattcccattctgtctgtcttagtgacaaacaattcagcccgctctcatctctccctttgtctccttccccactgtctttgccttaactcagactttttttaatttcttgcctaaacaaaattttcttctaaaacaatttttctgtcttattttcctactccaacatataaactatctgctctatttaaaaagacaactattacttgcatcaaaaatgttgaaacccgaaagttctctgaattataatttataacataaatatacccctgaaaccactactcaagtctaagaatagaacattatcagcacctcaaaagccacccacaagcccactcccaatccctttctgctccctcatctccagaggtaaccactatgctgactgataacaccatacgttattattatattataataacaggccactattattgaactgtaaacaaataaaagcacatcatatatattctgtaccctggctcttatgttcaacatcacatctgagagattcatcatgttttcacatctaggaatagttcattcaggtttgttgctatgcaggataccattataagaatatactactaattattcattgtattattggctaacatttgaattattttcatattagcttattacaaataatgctgttgtgaacattcacaaacatgtaaatgcatatatgctgggttataattaggtgtgaaatttttctcatagagtacgtgtgtattcagctttaataattgatgccaaacagttatccaaagtagttgtgccaaacatagtgtatgagaatatacccacatgctttcaaaaacagttttgtcagtcttgtaaattctaacccttccagggagcgtgttgtagcattttattatagtttaaatgttcatttgtaaattctaacccttccagggagtgtgttgtagcattttattatagtttaaatgttcatttctcttatgactaatgtggctgagaactttttcaagttaattgactatcttggtattctctattatgaagaatgcctgattcaaatctcttgttcatatttgttttgggttttgtaatggttctatatcttggtgacaagttctttggcacttctattgaaagatggggtctatgtcccctcctcttttctttggcactcctattgaaaggtggggtctatgtcccctcctcttgaatctgtagaagcttgtgatttcaataatagaaaactgaggaaataacgctatgtgacctgggactaggtcataaaaggccatgcattagccacattgctcactggaaaacttgcttttgaagccctgaaccacaaggtacaaagctcaattcccgtgagactacaattttaaaggggccatgtgtaagcacttctgctaaataagcccattcttccagccattcccaacaaagcatcagacatgtcagtgaagctgttctgaactcacaacactagctcattctccaaatgaaactactgaatgatctctgtcgacatcattaaaaatggaagaatcatctatccaagccttgcctaaattccctattcataaaatcatgaatcataaaatggttattttaagccattaagtttggggtttgtcatatttcagtagacaatgttaacagaatttggtacctgaaagtaagataagtgttataataaaaccaaaagtatgtggcatcggtttggagatgaccagcagccttgaagatgctattggtaaaggctcaaaagaaaatgagtacactgttattggtggtggaagaaagcagaccctggctacgtagctgtggaaagtttggcaatactgttgcctgtggtaacataaaaagttgtcaatgtacctaataaacttaatggtctagctaaggagacatctgagcagagtgttgaagatgctgcctggcttcttctagctgcctataataaaatgagagatgagacagatgaactaaagaacaaaatattagggttttttttttagtagaatttggaaaaaacataaaggctcaaggtagtcttatatcccacaaaatatccataaaataaaatatagctgcaaggcaaagatcaaatcctgggcattaccagtaaaatattaccctggggaatccaggtagggctgaaagtttctttattaagatgttagaaggacttaaggtggcgcctcatagatcacctcagttaaacaagagtcttaagtaatgttaagggcattatttaaaactctctgctagaccatagtgcttctaaaggtattatcctgacgatattatcacagtggtgttatgagttggggaggttactctcaaaaaggtttgtgagtgaactttttgtctaatggagtagctcataaattgatatataagcaacctaaaggaattatatcagcttggactagaggggatagacagtacaaaatgaaaagaggcatttgaactctgaacttttatgtacagggagtaagctcagaaaaccattcagctgtgaacacaagctactctccatggaaaaattaggactccaaggaaagcatcaagacctcagaggacagagccaagattcatggagaatcattcttagaggggcagttctgggtcctaagcaaagaattggcaacacacacttgggaaattctaggatcactacggaccagtgactgctgtgcaccttttatctcccacttttttgagcagagtgtctactgtcactatcttatgctgtcccaccattgtatacgggttgtgtggagggcagataacttgtctgtttcacaaggtgtcacatgaagaggagtgataacctagaaactgaacctaaagcatctccttcacacatggacataattcagattatgagacaagattgtgaaccttgagccacacaggataagactttgggaagggagtttaaaagggatgagggtgtttttcacatggaagaaatgaaaatgatttgcgaccagaggttgggctctgacaattttttgacatggccataaattctttgacattccttcaatcaaatagcaagatcattgttttcttcctttatatctttgagggcttgcagctgctttggtcaatagagtatgattagaagaaattctatgtgatttccaggtctaggttaccaaagttatgaagctgcttttttatttgctgaaatgttcacttttggagtcctgagctgccacataagaagcccagttaccgtgagaacaccactctggagaagcaagtgcaagtatcccatctcagctaggcttagccttccagccatccccaacaaggtgacagaaatgtaaatgaagctgtctcagaccctccacaccagctcatctcccagcatataccaccagatgactctgttggtgccacgtggggcagaaaaatcccccaccgcaccctgtccaaattgctgaccaacaatatcatgagctataagaatatggtagtgggtataagcctctaagttttggagcagtttgttacacagtgatacataaccagaatagctgtcttttccaaattgttttgttagtgttctttatacattctggctataagaatatacggtcatctttatttttttttacttttacaattaaatttacaattcacttgatctatttgcttatcctgaataaattcaacactaattattgtaactcagtaatgtcttggtatcccactttattattattcaatattatcatggctattattgatcctttgcttttgcatggcacctacctgcagggagcagactccctgcatgtgtacattcaaggccaaatagccaagtccccagaatccttgaattcccttaccatttcctgacaaaaagaacaaataaaatgtgaaaaaagaaggaatgaaactgttaccacttgtagcaaacaagattatgtatgtaggaaaactatagattcattttgcctaaaacaatttcatataaatgcagtcatacaatatgtaatcttttgtgtaagtcttcttttattcagcataatgttttgaagattaatccatgttgttgaagtttatttcttgtcattggtgagtttattatctgaatatattatagtctgtttatccattctcctattgatggacacctgtgctatgtccaacttttgggcattttgaatagttatgaacactcttgccaaatactttctgttagcatatatcttcatttcattggtataaatgcatggaattgatatagctgggtcataaggtatgtgtaagttttagttttataagaaactaccagagcattctccaaattgttagtatcattttatgttctcaccaccaatgcacaagagttccagttattctccttcatatcaaaatgtagtgttgtcaatcttttttgttttagttattctaatgaatgtggatggtgtctcactgtgattttaatttgcatttattttatgacgaataagttattttttcatgtgctcgttgagcatttgtgtatctatctttatgaagtgtctgcaccaatattttacttacttttttgagttataggggtgctttctatagtctcagaaccattcctttctcagatatatgtgtagtgcatattttttcctaccccttggtttgcttattcatttcttagcaaagctaatgttcctctcaaaactttatgagaactgctattcttctgtatgtaatttgtcctttttttcctggctacttagaggatttttctcaataactttgaatatcagcaggttgaccataatgcaaggttttctttttatttaccctgttttggttttactggtttcttacctctgaaacttatatcttccagcaaatatagaaaaatgtcaaacatgaactcttcaagtactttttgcttcattctctctttcctctcttctcggactccagttgcaaatataatagacactttgatattgtcccacagggacatgtctccgggctctcttctctgtcttctctcttctgctcttaagccaatacagtgaatttttatttcagattgcatttttcagttctagaattttcctgtctacttaagcctagtaaacaggctttaaagaaccatcttgagtagataatatatcttttgatatgtaagagacacaggattattatctgactcctacctagagaaatctgataccaagaggctatatggagttggcaggaaaagaaaaagaagcctgagttgggagtgagctcctctcccatacagtgaagcaatggtgtgtatttccccaggtctacatgttgtccccttggaaggctcagattcatcataaaagggattctgcctaagagaatctcatggagaccatatgatcccaccatagtaataagctcctagaagcctagaagctaaagagaaggttgttgacagctagcaggagcaaaggcaataccaggtgaatggatgtgtaataggagatctctaaacaggagatctctaaaaaatttctaaaatgaatccatgaaaagaaagatatcttcctctgagcataacctaaagttgccccaaaacatcagctaaaaggcaacttggaataagaaaagaaaatagaatttgaccagatattccacctgacttcaagcatccagcctgttgcaggctaagctggacaagcagagaagcattaattggatcagagtggagattgtaatactacttgggaatgaggatgtatgatcaatacactagaatagattttattgtaatccttccgtgactagaaaacctatggggtttaatatttaatgtaagggctgaaaaaatattaatgcagaaagcaaatttgaaattactaaaagagaaagaataaggttagtatctgcatatgtgtatctgtgtgtgtgtatgtttgtatgtattcagtagcattgtaggatcacttctgtcatattatatccatatattaaagttatctatcaattatatgccttcatggtatatttatacacagataggattgtctgtgtgtctgtgtgtgtgtgtgtaaaatacttaaacattggccgggcgctgtggctcatgcctgtaatcccagcactttgggaggccgaggtgggtggatcacgaggtcaggagatcgagaccatcctggctaacacggtgaaaccccgtttctactaaaaaaatacaaaaaattagccgggcgtggtggcaggtgcctgtagtcccagatgctcaggaggctgaggcaggagaatggcgtgaacccaggaggcggagcttgcagtgagccgagatggcatcactgcactccagcctgggtgacagagcgagactccgtctcaaaacaaacaaacaaacaaaaaaaacaacaaaacttaaatattgacagtgatgcatgggaaaattgtatcaattttttttttagtttttagattttttaacttctacaatgaacgtatattctatttgacacacaaaaaaaatatactgtctttttcaatggactgtgagtctcttagtctgtttggtctgctataacaaaataccatacactgtgtagcttataaacaacagaaacttatttcctacagttctggaggctgggaagtccaagatcaaaatgccaacagatttggtgttggtgagggcacatttcctaattcataggtggtaccttcttgctgtgtcctcccatggcagaaggggcaaacaagctgccttgcacctgtgttctaaggttcctattgccattcgtgaagactttgccctcatgatcctatcacctcccaaaggtcccacctcttaataccatcacattgggcattataatttcaacatatgaatcaggagagacaccaaacagagtatagcaatgagttagtacttttcagttaacaaacaagtatctcagatattctaatcatgtcctcacagttatcatcattttcaaagttttgattttaatggtttgacacattagagagcaagtatttcagtatatttgaaggataaatcacatttaattccctttattaagtgatacacttgaaaattcccaaatactattgtaacattctccttaaggaactgcctttatttagactttcttcagtcttgaaattccattgtgatactcagcctcagagctgtaacatttgtcacacagataatgctttttgtccttgactttttttctctgtgtgtgtgtgtgtgtatgtgtgactatctcctaacatttttttttcatctcttctcttccctggatattgattacagcattgaagcatctgcctaagtttttactttttgaggctgtttgacatttaaagtatacataaaaaattctggtaaatctatgtgctttggtcattctttttttatttatatttttgctcttttactgctggctacataaactaaactatttacactccctcagtttttatgctgcctgtgagctaatcatttaactttaacatacattttattttgtcattgaacttgctttcaattattttctcctaacatttacagagagaccttacacatagttactatactgtcaccccatgttaatagctctctgctgtgggttctagacataaatgggtgtgtcagggtcctccatttctatttttcccccttacaaataaatgctttaatacattgaatgtgtaacttgctgccctttctacttgcatcttctctggttcttttaattattttatatcaccctgttacaaatgggtcataatctaaatatttatttggtctaactatcaaatgtttctttattgaataaaattcacaaaaatctgtggaaaaaatgcagtcaagaaagagggaggtaactttaccaaaaggctaaaaatcaagctgattaattcaacatttcttaagtttactactaaatatatataaaattactgaggaaaaaaaatcgacagtgatttccttttctaaattctgtgataatactatgcatagagagatcagtgtaataaatttcttaagctcaaaagataatcaaggctaaaaaaagaagtcatattttcaaacctacaatttagtttagattggtttaaattatagaatgttctggtacccagaatcaatctgcaagagatgtagcaatcttgatgaaggtctcagtaaattctttctttacttctagagggagtttaacagatcacatactgcctttacaaagtcctgtatttcataggtaacaaaatacccagtcagtcaaggatcaaatgctaatatgtggtgtttaatcacccaggagtgaaagatgccattgcataaagatatgattcctcccctagatttcaaagatatttaaacttctcctgcatctcaattctcctttaatcacaagaaaatcaccatgttatttatacggtcagtgtaacccgtaattgcaattattatcacatgaaatatatcaaagccactaatttccaacctgcttctatcacacttgtggttcaagtatggtagcatgtgttttgcagtgactgaattgtattaatgagaaatatacatctgaaaatataggctgtagaaaccaattgtcttcactgatgtcagtctcttcccattcatgctcctcaataaagatatacacaaaggataaatacttgaggggatagatatcccattttaagtgatgtgattatattacacattgcatgcctgtatcaaaacatgtaccccataaatatatatatgtaccccataaatatatatacctactatgtaccccaaaaaattaaaataaaaaaatcaaaaaaatgatatacatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcagcattatttctgagggctctgttctgttccattgatctatatctctgttttggtaccagtaccatgctgttttggttactgtagagttgtagtatagtttgaagtcaggtagcatgatgcctccagctttgttcttttggcttagaattgacttggcaatgcaggctcttttttggttccatatgaactttaaagtagttttttccaattttgtgaagaaagtcattggtagcttgatggggatggcattgaatctataaattaccttgagcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatctggctctctgtttgtctgttattggtgtataagaatgcttgtgatttttgtacattgattttgtatcctgagactttgctgaagttgcttctcagcttaaggagattttgggctgagacagtggggttttctagatatacaatcatgtcatctgcaaacagggacaatttgacttcctcttttcctaattgaataccctttatttccttctcctgcctaattgccctggccagaacttcagattaaagacttaaatgttagacctaaaaccataaaaaccctagaagaaaacctacgcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacaaaatgggagaaaattttcgcaacctactcatctgacaaagggctaatatcaagaatctacgatgaactcaaacaaatttacaagaaaaaaaaaaaacaaccccatcaaaaagtgggcgaaggacatgaacagacacttctcaaaagaagacatttatgcagccaaaaaacacatgaaaaaatgttcaccatcactggccatcagagaaatgcaaatcaaaaccacaatgagataccatctcacaccagttagaatggcgatcattaaaaagtcaggaaacaacaagtgctggagaggatgtggagaaataggaacacttgtatactgttggtgggactgtaaactagttcaaccattgtggaagtcagtgtggcgattcctcagggatctagaactagaaataccatttgacccagccatcccattactgggtatatacccaaaagactataaatcatgctgctataaaggcacatgcacacgtatgtttattgcggcactattcacaatagcaaagacttggaactaacccaaatgtccaacaacaatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattaacaatgagaacacatggacacaggaaggggaacattacactctggggactgttgtggggtggggggaggggggagggatagcattaggagatatacctaatgctaaatgacaagttaatggaaatgacgagttaatgagtgcagcacaccagcatggcacatgtatacatatgtaactaacctgcacattgtgcacatgtaacctaaaactttaagtataataataataaaatttaaaaaatgagaaaaaaataaaaagaaaaaaagaaaatgatatacattttactcctgaagtaaacatgttaaataaacacattgcttgtccttttgatcaatgtcagaaattgtggggaaaaaatgagaaaaacattttcctacataggattgcatgcaagtgatcccaattgacacaatatggaagacagtggagaaatatctaggctgcccataatttatcaatcttctctctgccctcttctctgtagtggacatttggtgtctgtcaaagaacaaaacaactatgtatacagtacttgcaaaaaattaatgttttctaaagcattttaagtttttcttttcttattttggatgtactgaaagccccaccccaaccatatttctctcttaattcatagttatatactctattttgcttcttctagcagttactctagaaatttcaacataaacatttaccgtaaagataatccatgttaactcttcagaaccatgcaagaacctataagcaatttatctcacgccacagttttctctcttggctaaacttttataaggtgatattttagttctatcttattttttaacactaaaaattatgttaaaattttaataatgattttgtattacctacatgattactatgtggttgtctcaagttttcttcttctatctcatacctttcttttgtggtcatttgtattctggaaaatgttactggcagtccattcatcccaagtaatctcagtgtttgtctctaataccctcattttgcctattgtcttcaaagtcttattaatatggatttgtagggaaccattttctttcagcagtttgaagacatccttctgtctccttctgtcttctggctcccactcttattatggagatatcacttttaatctaatagtcaccccttgaatggtccctgtcatttctttggctactttatgatctcctttgtatctttggttctctgcagtttcactatgatgtgcccaatatgaatttctttacatttattattaagattggtgctttttatcaaaagcaccaatggattattatgtcattttcttttggaataatttctctccatatcctatgatctcctactgaaatgccaatgagaaatatcttataccacttcacactattctcctttttgtcaactttaatattcccatctctttgtctctctgggctacatcctgttcaatttcttttcatgtatcttctagtgtattaagtctccctttagctatgtctaatctgctctaccccctcccccagtcttctgagtttctcatttcaattcttctctttctcctttgtggaaatgctattttgttctctctaaaatgtgactagacatttgtatagtctcttgttccttcatcattttctgatattgtcctttattttttaatatattcaatgtgcttattttagtattgataatactattatctacaatctttgtgggtctgacttgcagtccattattttttataactctccttcatgtggcttgttaccttatttattttgtaattgtatttattgtgacctctgtttcataataattctttgagaactggatttaaagagattcctctagggaaggcttattcatgcttctgcaggtatctagggatgtttggattcaagtaaaatgtcaaactattagagtcagggcttttcaggtcacataattcatgtgaatcctgggtccaaactcttaggaacgtgagtttatgattaacaattttcctggattttaaaaaacaaaatcctgtttcttgtctacccagaaccatgctggaacctgcacatattcttgatgtatctttctgaagtgcaagtttttctccaatttactcaatgttggcgtctcccagagctgcaatattcaacttcagtgggtactattcacattgtggtccatgtaaaaagcattccctggaggtgtgtagtgtcttatgcgatgctcttggtgtcaccatttggacatcccagttttaaatgagcatctctgatccgacccttgcatctacccaagcttggttttctttccccagatcacttgatccattaaagtacacggttttctaggtcaccagaaatgagcagatagatcctttgggcaaacgccacctttagtgataccttatctttagaaattttgcttattagttttccctcatgccaaactatagcccactctcccatgcatgccaattaatgaattttaaaagatttctcacataatctgtacattattgttatatgttttttactggaaggggttctctggacatttggtttatcatattatcaaaagcagaacctatggaatctaccactgaaaacagagacctaatcactcttctttctgcttctcataccacccctgtaggcagaagagtcattagccatggtttcagataataggagctctgcttgttgcagtcttctgtactctagtggctttctttgatcatggagagcctccaaggactcgaataataatgggagttgggggttgaggggcacacagttagaaagggagaacaggaggaaacttgtacttctaacttgtcaggttgatcatttgttcctatgtttggtattcttggcttccccttgtcatatacattgttatttcatattataaaataattttgcctactgcatttagaacctatgacttcctaataaggaattcattgatattaatttgctacctttttttccttctaaaaaattactgactttcttacagtttcacagagttataagaggaaagaaaggatcagttattgaaggcataatataagactctgctgtgtactatgtatgagttatttttattattcctattttatagagaataataacagcaacaatagtaatagtaataagagctaatatctattgtcaggcactgctctaagtatttgacgtgtatcaaatataatcttcacaacaacctgtgggttaagtgctatttctattcccattatatagatgagaaaataatcttagagaagttaatttttcaagtttgtataggtaatgatgataaattgggggggtttaaactcaggtctgcctgactgcagatcctatacccttactatatacaaaataggctactctcctaaaatcatattgggcatttgggaaggcagtatttttacttgacaaaacaacaacaaaacagcatttttggtgttgctaaagagttaatacaactttagagcacgagagagaatattttatcaaactgaaaaaagtttaatgctttggcttttcaaagagcatttaattctcataggcatgcctatcctgtatttcttcatcaattgcagatgaactattaactttcaaattggtcactgcagggttctatttacatctttaatagagtaaatatcaaaggaacataaagtgtaggttaaatctaagaggattttcaagagaaataagtgatgagagcaacagaatgtatctcaatgccctatatatcagtaaagaattaattaaatgtattaaggaaaatgtagtgtcaatttgctctaattgagaaaatttttgagataaattattaaaaaaacatttaaatgaagaaggtttggtctgcataatctgcaggaaacttgtctggccaccaaggacttttttgctaatgagctttgacttggttacagtccctctgagagagaagatttagtctacaattggcttactaatgagcactgtcaacatgtggattggtctcagatgctctactctaaaacaaggtggaagttatcctctcaactaaacttgttgaacagaacttggtcagcaattttccctaccaccttcagtcagctacaaatcaccacaattgtgtaatattctggacaggatataacgaataattattgtaatatgagatgaattataatttttgaagcatcaggagtttccctttaatagctctcccagccaaataactgatggattatgaattttaaagatcaacattattagatatttcctagatttaacatatattggaatattatttgagcaagaaaaacaaatattttctatatttaagcaagtctctttaactcttaaatagctatactcagtctgggtgttgacatgtcattttaaccaaagagaacaaattgaaaagcttaactttccaccaacttcacttttataaacaagttctaagataatttgaaataaattttgaaagctctaaaattttcacagaaacaaaattctatagtttaccatattgttaagcaagattgtgattgtcattttttctgagatagatgcaaatccatttatcctaaaagtttatcactatgcagttatatacttaattagtccactagggccaaaacttttcaaaatagatgaaatcactttagtataatagtgttgctacaatttaaaattatcctttgctctgtactagtgcagggaagtttaaactttccctctgaaggttctataattgaatctgctgaaataaactgacaatagacaaattagctggaggcaaggcttacaaatttattatgtgcaagcacaggggagtcccaaaatatatgagactcaaataagcgtcaatggttgaagcttaaataccctctttctggggaagaaaaaagcgaggaatgtagtcaattttagaggaagagaaaatgatttttaggggaaatgaatgggcccccaaaaatctaccacagcctgggacaaggttcatctggactctgagtgtagtgtcaactctagtcttccttcttgcacgacattcatgaatttctttcagttaacaagatatgtggagaagggattcacaactgaatatattctggaggatccagcttttaggtagatagggaaacttcagagaaagccttttcactgcatttgctattcacgatgttctctcagcttgaagtccaaaatggcatatattggggtatcattttatgacccccagtgctagttagaaatggccaataatttaatattaatcggtaatattgatcagtaaaagcactgatgtgtgctttcttgatttgcttcaatcttcttattgcgcaagtggttgggacactaaccattatttagaaatctagttatcaagtaaatgaaaattcttaggctacattctacacataaacacactcatttatgttttggcctttgtttctaagcttatctattattatagagtcacattaaatgtgaatggttagtctaaccgtgagatcactccttaacctaaccttagttctccctgcagctatctttaggaagagaaactcaaacacttcatccaggttgttttgtttaagcatataaccaattttaaagtttattttagtagagatggttggacttacaacttttgtgttgctttttaacttgtaaatttagaaggctctgaagattctggaaataaaattctacttatcagagacaacatccccacttttctttttagctcctgtccttttatgtctttttaaaacccaactccaagtagaccctttcttctgtgaagccttttaattatttacttcacctgtttccaatcattttgcacagcattcaaaaattcacctcaaattatatttcacaaagagataattgcgttatgttattcttaaattgttttattgttgatatcttatctgcagctagggtgaatgtttatcaggcaataggcctttcatctttagaactgaagatatctctgataactacttctcttctggagagaaggattatcagtcaggattgtttactgtggtaacaaacaatccccaaatttcagtaacctacaggagcaaagttttatttctcaatcacataaatgttcattgcagggacttagattctggttcatgtcatcttcagcactggatacaggttgaggaagtagctactattctggtatactgttcatttcattataaggagaaggaggaaactgataaaacatgtcacttccacacttatttggtcaaagtaagtcacagagtcattcctaagtacatcagaatgtggctgtacacttcttccacattgaggagctgaagcaatcttatggccaagcctgaattccatgtttaaggaagaggtcatacatgatactttgaatttaaaacaataatgctttctaccacagagggaaaatatagaaagataatgaacgtatatcagtataactttatctagctatttgttctaaatgggtgaattaacttgatatttcatttttcacaattctttttttcttaatgcggggaatcctgacaatctcgcatcctctccagcctcatagcctaatatcttgccaattgtttcctcctcactgtggctagttgataaagcattacataacaaatatatgtttaacaattactatttaatgagacagctgcaaaaataccttatatcagttcctcttgaaattgcaattcaccaagcatagttccaagttcattaaggaaacacaagaaaactcaacatggtacttgatattaagcatcttataattttataggaaagttaaagtacaaatagctgtaattcagggtggaatgtgatgaatgcttaacaagaaataaaaaaatgccataataacacaagataggaaccattcactcacaaatttggagccacttaactgccccaatttttgtcatttccatctctaaagttccattgattcatatttgtcttccttcaatgttcttgaactattctttaataccaggactcttaataccattttcttcttttgcactgcagggtcaggttcatcatttcttccctctctcctattactttaatctctacctttttgttattatgttttctccaacttaccacttttcccaagttttcttccccatcaataattcttctgaacatatatttcactttccttatagttctaaagcttcttgagctagaagtctcgatgtactacctgtacttctgcaattctcattcatgactccaaccactgtaatctgcccctgctatcatcctcaaaaataaaagggcttctcgatggctaaatccaaaaatttacatttctgcccttcactattgaaacctgttgaccgctccttatttctttaagcaatattttctcttagtttctgagacatctctagtctcaaagtacatatttttaaatcaatttccatacttttaaatattattttaatgttgatgtgtcctgtggacccacatttccgtttaccacatggatatcttacatgcaattaaaatgcaataggttaaaaactgaccctgtcaacctaaaaagaaactcactcagagagacaagctctccagaataaatgaatttattttggaatagcagagaatttcaattcagagtacacaagcaatggcaggtcatgggcatatgcaggggggctgaggaaagagggcatcttttaaagacaaagaaaagaagttcatgtaagctattttgaaaccaaaggttacaaagaccgaaggtaataggggttacagaagttggtgttagctaatttctaggtgagtatccttgggcaagcaacttacctggaatgctacaatcttgaaaaagttcttgctataagttttgttcacagtttatgtggaggaatgtcttttgagaagtcctgttacaaacattcaagcatgggagcttctttctcatggcctctctcaactctattttgttagaatttgacacaagtggctccgttttacaacccagacgtattctttctttagtattctctaatttgactaatgggttcaccatcccttctaatcaagaaacccaaaagatttagtggactttttaccaccttcacaccttctcatttctaaagagtcaccactatcttttcattctattacaacatgacttgtaattcttcctgctcctttcctctactctactatagtatccccagtgactagtaatgtcggacatataccagattctcaataaatatttgttgaattaattaactcattaccaccttttgatgtttcttccatgtaaaatgtccttcatttgttgtacttgtacaaatagctcaagtcacgctttctccttaaaatgttccctgactccaaaaagaggtacttactcctctgtgttcccatagtactttgttaataagtctattataggtgaaagttatttaccttttatgttatatttatgctactgtttgccttatttttcccattagacattgacattcttaaggacagtcatcagagtgctatttatttttggtatcctcaccgtctttgcaatgtttaggtgaatcagcacagggttggatattgggatggatgtgaagttactaaaagcttcaccgaagagacagcatttaaacagtgctgttttcaaagtggtttctgattaaactgaaagtaaacagcattttctaagagtgcccagaaggctaccttagctgaaatacagggacactttggaggaagaattcatggcaaataagggtggggtggtagatcagagatgattgtggggtctcctgaatgacagataaatgcattccttttttttcctttgggcagaggtgaactatatatggtttgtgagcagagaggtgtacctttctcaaatttatagctttaggaagttattcagatgtcagtatgtcatgtgaaatggtacaaagcctgcaaaggctattggaaaaatattgtgacaatccagaagggaagaaatgtgtaaatgagaagtaaaaaaagagaatggtaaggagacacattgtaaaggtaccttccaaaggaccaaggaatgtggctgctagaggataaggaagagagacgataactgagatttcaagcctgagtgacagaaggcgcgctcctgcttttaacaagagataggaaatacaagaggaagcatgagtttgtgggagaagattatgagttcaattttggatatagtgagtttgaagagcaaatatgaatctgaacgtgaatatcagcacctacttaaactcttcatatcaggattgctttcctttccctattaagtgacttgaagaactgtcagttggtcagatattcaagaccaaattctttctgctaacagcagcctttaataatgactgccattttgactgattggaagatgctatcctaatgtgatctaacagttgaagcataaagtaccactaccagtgaagtgaataacaaaattacaagacatcagaaatgtaaccctatgaattttaaatagaagagaatgcatgcttcaggattatttttatataatatgagggtagtgttaagaaccaaatggaaaaaaaatccttgtttccccaaattgattaaaattttgatttttcacagtatttccattatgatataaaggtgactgatgctcatttcctatactttagatcttttgaaatacattaattttccctgctgtgaaaaatgacattcaaaaacagggttgtagggagagatgacaactttattagtctgtcgtataaaacaagttcttcactctcttcaagatctgtttctttctacaagtgacagtctgacatattctattatcaaattctaagtagccttgataaagcaccaataaatttatccttacaactaaaaataaaaaggaattctataaatgcatacctaggaaaaaaatgttaagaggctggtcatcagaacgattctatttgccaggttttttttttttttttgagacaggagtctcgctctgtagcccaggccagagtgcagtggtatgatctcggctcactgcaacctctgcctcccaaattcaagtgattcttctgcctcagcttcccaagtagctgggactacaggtatgcatcaccactcctaactaatttttgtatttttaggagagatggagtttcaccacattagccaggctggtctcaaactctgactttgtgatcctcctgcctcagcttcccaaagtgctgagattgcaggtgtgagccactgcgtctggccttgccaggtatttttaaaggactcttacactgtgattcctgtgcatgactgatactgtgactatggtcgtagcaggtatagagcttctaccagtagacttttccactatggaggagagttttggtacgacctacttttgtaaagcattactcagactagaaatatttttaaattttcttagagaacgattactcaacgcagtgtaaagtgatggtttaaaaacatatatgtttctatatattatcatttatggattatatccatttataatccataaacgagaattccagtagataactctggggattttggaatttaatgaatgtgtatcaaattaagatctgtgcattatatcatttatgcattgaatatgtttgagttaccataaaatcaaccaaacatggtttgattgctgcctgaatgagcttctaatcattggaaaacaattggaacacagcagggaaaggtaaatacacaaagagaaagtaatggaattaaatgcccagtgcttcagctcctgccatctgctttaacttagactacatgtagtacctaaacagcttgatatagttgaaaaaaaaacacatttgttagcatgaatgctgcccccaagtaaactttcctagcctgttacatcccaaaatctgttatactcttttcagatcgaagccttaaactctgaagcccaattacacagaggtggtaaggaaggagagagctatatctactattgctcttggcctctctccaactgcacctctttggtcaccctagggaggagggttcctgtggggaattagtgggggacaggattggaaagttggcagagacaaaattcttgttgctttaaaatgccatatcaaggaattgaatttgtaatatcttaatgctttcatacagaaaaggttaagagtgatgaaaaaaatatttaaaacaaatttttaaaaaccaaacggctagactctcaagagtggaaagtttggaacctactataacaattcatgtgatcaataaacttcacatctattataacaaggcaaacgattcatagttagctgcacttgtactgactgatttcctgtaaagcatactttcattatctttcatgcatgtttgaaaccacctattctggtatgagagggaggaagagtttcataacattaaagaaactctacatcaaacttaactgaccctaattagcctaatggattaatgacattttagtacttatgatttatagtaaacacctaaaagcggaaaaggcttctatgatgtgtgattggaagtagcagttctacagggaaaagatgaaaactctctgaactcaaagaagattcttcaggaaacatagatagactacataaaataatgcctttactcccaacatactttttaaaaattctgtagacaaaatgattttgctgtttcatataaatatactcccaactctctcatgccctttttccctaccacttgtccagtgtgacacattgtcttctgattataatcatgctgtatcacccagctccactttttttccttgaagaaaattctgttgctggattgtcattctaaatgttttaattctatcaatttctatctcttcccacaataaacatcattctcacaatatatgaacatttttcccccaattctctgacctatatcttgaaggttagaataatataaacacatgataaaaagctttgaaagcttttgtgcagacatggtggttagaaaaaaatgttctccttttaaagacaaggatctcaatattgagtttttcctatcacagcttgaactttctatgaagtctacggagcctcctctttagttacataagcaaaccattaaaatgctctctatcagtcccttgtcattagcatatttttgaaatcacttttttcatcatcgcactagttatatgtttctttcctaaaatgtcacatctgttcagatatcccatgttcttctttactcacacctgcaacccacatttcattctgcttccaaccctatcttttcctgtcttttcttatcaaacttttctactataatatctcctctgatttcctagtctgtggtcaagaaaaacctctctacctctttgcttcattaatacttggtgttctctcacaataaggcccaataggtcattttcacaagtagagacttcatttttcttttctcagcataaggagaaatttatttttgttctatttcatcctacctcatgctactcatctcaggttagcataaagtagttcaccctgttttgaagcaaaatttctacccatatcaacttaatctcacctcaatcaacaacctctgggccatccttccctatttttggaaaatagtacctagtccatagttaccctctttccactattactattatcctgaacgaatgtaaaagatggtccatctactttgattagaatctaattcagtctttgattcctcgtactccaatgacagaaattcaagtcagtttagaaactaattcacataatcacaccatggacctttgtaattagctgaaacccttatacctctaagaatctaaattctgaaattcccatttctgcctatatcttaattttacaattctttatcacctctactctctttcatatccccttaatcaaaaatcttcaccagaattcctcaatacttatgttgttcaacttcgcccttttggatttgcttctcaccttccacaacagaaccccgtactttaattatttcacgtgctgttgcctggccccttagtcctattgtatatatatattctcatttacagattatatccatttataatccataaatgagaattccagtggacaactcaggagattttagaatttaatgaatatgtatctaattaagatttgtgcattacatcatttatgcattgaaaatgctgtgttcctttatcatgggcacacctcttggcaacctctcaccttgtatcaaagtactgtctcaacttaaagactgtatatgaagaaaaagaagaagtttggtctaacatggaccagaatcttcttctgcaactcactactagttttgtaatgctgcgagcttcagttttcttgtccgtaaaatgaagataacttttcttttcatattataggaggttataaaagccacatgacataaataccctggctcagggcagacacttgataatgattctccttgcttctacctccttctccacttaaagagggtctgtaacctactcacattttaactgtatctcaatattcttcctcggctctttttctcattctctacaataatttatttcaatgttttctttagacatatgcccccacacctggttcctgattctcaacatgtggcatgccctctttctttcctttttctagttaaaagactctaaatcatgaggttatgaactccctcaattttctttccacacttatttagatattttcccctgctatctcaggggaagaagtaacttcttttcaaggtcaaactgtctatcactaatattgattttatcatattttgcctctgctaagatgatattctatcaatgatttcttctctggcattaataatctctcacctctggatcatgtccccactcaactaatctgcttcatcctttaaaagaattaaaaataaaaatatacatttctacccctcacctcagtaatgaatgttgaaaactcttttttcaaaggtcaaaaatgatctggtcattggcaaatgctgacccttcatttggttcttatctctgcagtttcccacaatattgcccagaacctctcttttaactatcttcccatggtgtctataatgcttcccttccaggtttatttgccccatagtttcctgagtaaccttgtttatccatctttaccaggtcctcttctgcaattccaccacaaatctctccatattaaactgacattatgtaaataaaatggaattctacccatttttttcagtagagttgtttttagaaaaagaagtcatgacaaaattttaaagttattgctatgtgtccactcccatccatgtccttaatccagtctctaccatgtctctcattttgattgctgtgctgtgtattaaaacagcagtgctcaccataacatgtattgatcttttttcctatgtttattgaggtataatagagaaattatataaatttatggtgtacaatgtgatgtcttgatatacatacatattgttaagttattaccacaatcaaattagttaacacatttaacacctcaccaagagagtgagagagagtgtgtgtggtgagaacatttaaggtctactctcttggcaaatttcaagtatacaatacagtattgttaactatagtatgatctaacatatatgtaatgttaaaaagttgcattcatagaagcagagagcagaatggtagctaccaggggctggggtggaggaaatggagagacgtttgtcaaagagtacaagctttcaattttaagacatatttctctttgtttatggatgccattttattgaaaaatctaacgtgtttatttctcataggcatacgttagagcaaactataataacacaattctgttgaagggatgagcaaatgaagtcatacttgggccaagtctctatactatccctaaacttcttgatactttcaggtctactcgtagctgaatgttccacttccaggcttttagtccccatcctctgtgcttgctccagatcgcattagagtcctggagggattttcactttaatggaggcattgtcagtttcagagattaaggtgggctattactgggataatgcatcacatctgattggaggtctccagaatgtagactaacgttgaggacattcttcagtgaggttgctctaatatatatactcgacagggaaaatgtgttgtccctgtgtaatgacagcctactcagtgttttaagaagcatatgttggccgggcgcagtggttcacacctgtaatcccagcactttgggaggccgaggcgggcagatcacatgaagtccggagttcaagaccagcctgaccaacatggagaaatcccatctctactaaaaatacaaaattagctgggcatggtggcgcaggcctgtaatcccagctactcgggagtctgaggcaggagaatcacttgaacccgggaggcagaggttgaggtgagccaagattacaccattgcactccagcctgggccgtaagagcacaaatccttctcaaaaaaaaaaaaaaaaaatagtatatgttgctcattagtatttgcttggtttcaggaagataaattcatataagccaacaatataaattataacacataagatatgaaacaatatagattataaaattataaatatatagttatagataataatttttttttttttgagactgagtctcactcagtcgtccaggctggagtgcaatggcgtgatcttggctcactgcaacctccgcctcccgggttcaagccattctcctgcctcagcctcccaagtagctgggattacaggcacctgccaccacacctggctaatttttatatttttagtagagacgggatttcaccatgttggccaggctggtctccaactcctggcctcaagcaatctgcctgcctcagcctttcaaagtgctgggattacaggcatgagccactgcacccagccgatatgtaatatattatgaattatatatatcttatatgtagttcattgctagaccttctcctgtcttctctttgggaatatttcagtctcattgttctctcctattgggtctctcctcttttgcataaaattgatatatcaggtaacagattcatacagcaatcagatattagtgattctttacacaggagatttgatgttcaagaatcatatacaaaggtgattagggacctaaatttcatgctgtattatgtttcgtctctattatagaaattgtataaacagcctgcagtgtgttctatttcctttccatggccaaatgggacaaatagtgatttcaactttccttgaagcatcatgccagtgtaagaaacaagtctctatcatttaagctgcaaatttaaacaagatcagactttctttcctaaaacaaaaaaatcaaactgtatatagtcaaggatacaacaaaagcttgagggaaaacagaataaaacaaggaatcttcctgtttaacattatttgaaatatatctctgggaattgttttaaaccaaattttaagactccaattttttgttgagaatacaaaggtaggtgtcaaggtcagcacataaggcctttctctgtgctatttatccgcatgcctggagaggattacatggatttcagagacttagtcccaagaaatttacaattgagggcaaaagaatatgtcatttgactatgtacagtgttttataatatcatgacttcttgataaaaggattaaggaaatgggatatatgtatatattttgccaacatgtagtagaaaatcccaactcttcctctgctatcactgttcacttccccccaccccaaataaatgccatgacattctgtcacccaggctgctgtttttaagattagaaataaaacttgtattgaaatggagctattcaaatatatgtaccagcaaatggggctacctgcatttcctgatgctctgcaatgacaaagcagtattcacaagggaaggaaaaccatgatgaatattttaggtagctccaagtctctgggaaaatcagagagtataccaaagaatgtagtaaaattgtatgtttttaatatttatgaaatcctggtgaggttaaatatgcctccagactggtactttcttaatacagggaaataattgcttcagaaaaaaattgctttcagaataaactataatactgaggaatttgtttgggcaattttataatatctttaataaaatgtcactttctaacaaccaacagatacaaagataatagggcagtgctatatggcaaagcaaaaatatagaattacagttttcctttcatgatgctactgattacatgagacataactaaaaggcaatgaaactgatcacaagagccacacattgtatagttaaaccttataatgcagattatcctctcagaacaataccaaaggtagtgtatttgtgtgtgggatcaaaggtaataaattatttattaacgtgagaaatagaaatatattaaattgttaaataggctgtccatggcagggaatgttcaatttattaattatccatgtaaagaactagagagagagaaatcttagagcaaagaccccaatctatcagaacaacggctcttacttcctaatttaaaagctctttcaatgagggagatgattttgctgatgggagtgcaaactgggaaggagaggccttctttaataaagaggcagaggtggagaaggtgagcaatttacttttgctgcatacctttttttatctgcttccaatgatgaatggaaacagaagatttttcagattttactttctcatagcaacagtatcataaatcatggttatatttgaaagaatgtgaatgattccttcaactaaagatcatttagcaacaatctttgagcgcacactatgtgcacaaaactgaaccatgttccagggatatggaggcaagtaacacagacatggtttttatccctgagcttgtcagtctaatgaaagccaaagctagaaaaattagaatatagtaggatctaaggctataacagaacgtagaaagtcagtgaggagcagtggctggcaatggggttaagaaggtaggttgaggccagcttggcaaagaacctaccttgagttataggataaagagattggattttatgttatgggcaacttgtaaacactgcctttatgccaattatgttaaatgaacttccaaaagtatctgcttggcagcaatataccaggaagggaatctagaaatgactctaaaaaaatccagaatgattttcctcagatcaaattcccaagtaagcaaatttgtccaaaatctatttgccagaggttaaaattaatccttacaataaaatatatctgatgatacactgcacaggacagggaattttaggagttaccagcttatgaacatgaacctctcgatatttcatgaaaaataaaaagtatgcctgttcacattcatcctttaccagctgatacctctagctcttgttgccttacaaacttgtttttctaaaatatttggtatcataaactcttttatcaaatagaacggagtgaagcagaacagcaacaactctaaatttctcaaaaatatgcaaaatgctggagaggcagcctgcacctgcagccccaaaagcaaatgtgttgaataatcagggatcccaaacagagctgcactagagtaatttactcagctaatcattatatgaaatagaacattagatttctgcaacaaagttgcatcaaagtagatgcatacctcattcgattaactaaaacatcacaaaatcatttagctcattagatggtttttaataagcactccttcctgggagagggcactgtgtcttttatttatttcttgtgcttgacgtttctggcacatggagatgtggtctgcatgattcaatatcctcaactattcatctcagtccttagtatcttgtagaaagatcaccgtgctttcagatatttaaaatacccttaagataagcatggtatttgtttgtcagtaaaagtttgaatttgggtcttgaacatgtgtcagaacagggtatctcaccttaatcagccacagaactaattttcaggcaggtacgtgttaaagattagggaaggacagcagctttagctcacttcctttagctcacactaactgacctttccagacctcaaccaattttgaaacagaacttcaatttaaatggttttctagtgtaaataaaagtgcttgggtttccaagaaaaatatgtgaaattgttagaaaatgtggaagttgaagtgtctctaaaatgggcaatggtagtattctggaaacttattacagttgccaataaccagtttacgaagtagggcaaacatttttctcttctattttttcgttaccttggccttcaaattctcagtttattatctgagactagtatatagcttttcatgacatctcctacagcgaatagtctctcaaccagtatgagagtgcacgctagacacctgtccatgcccacctacaacacacaaatacacacacacaaacttacttatacactgcatacaagaaaaaatcgctgtgcagcaatactgttcctgaaatgtgaacgtatatggtaaagttgtggtaacttagtgaagaaaaggaagagtaaaccaggtatgctttgttgtctaacactgtatctatagatttgaggtatatagatttctagccatggagagttgggaactatatggcatcatacccactgtgcttttgtgtttgtttttttcttttttaacatatctacagttggtaatgaactaagcacagtggttacctctggaatgagagaaatggagaaggaagatttcactatgtttgtattgatttcacaagttaacatttctacaattggaaattgttttacaattgatagtgtgttggtttaattggaaggttttttttctttcttggtggcacataaaataacagtgatcttaagatctatatgcttcagattctgcaaaatactcagtttttaaagcagtagcatatgggtgatttttgctttcttatgatcttaggtgtttttaaagtttttagataaaaaagaagaaggaataaaaaataataaaaggaaaatatgtgacaaattgttgagaaacaaaatagaagccgatagtggaacaattcatggcagaattaaatattataaggtgaattaaatgtatttaacttattagtatacctgtctcgtctcaaattagaatacaagagactgtgaaatctaaatcacctttgaattgcctctgggatacagcaccttgtctgctaacaacttagtaacttagtaaacattggttaaataaatggattatgaagtaagttaacttttaaatatactgtgcaaaatcatttagaccatgttttctatttctcacattccttaagcatttcttcaaactctgcctgcttgacctaaggaaaccaaacctatggcaatctaaaaaaaaacagttcaaaataataggaccaaaatggaaattgtttggtttgacactatattttcttgataataatcttgtattgtactgacattatctttgatatctctgattaaaaagagcttattacagtcagcctaaccaagcatttagggtgagggttcttctctgtgttcacatggcactgaacattctctgacaagatctcccaacgacttgtctgtttgacctttttgaaaagggaaaaggtttcattcatctttgtaactgagatgcttagtacaatgcctagcaatgagtgttctgtaaatgttgagtaaatcacatgactgaatgacacagtttcacaatgtagtatcagttgaccctggaacaacacaggtttgaactgcctcggtgcacttatgcaaatttattataaaaatttaaaatttagcaaaacatacacatgcaggcacttacagaccatacatggtgccattcccaatggagagaaatggaaacaaatgtaaagatacagttttaaataataactacctaaagttaactctagaacaccctgtactactgtaataatttcatagccacttcctgttgctattgtggtgagctcaagtgttgtgagtttccacttaaaacaccatgtgacactaaccatctccccgtgagcagttcatctcttcggtaagttgcagatcccaataaaaagtgatgtctcccggttccagtgtatttttcattgtgctttctgcaatatcgtaaaccttaaataacaccgttggacccatacgaagtgccactagtgatgccaaaagttctcccaggaagcagagaaaagtcttaacattatgagaaaaaagttgaattgcttgatatgtaccatagatggaggcctgcagctgtggttgcctgccatttcagacagatgattcatcttgtacacagacaatgtgaatttgtggtattgataaatacagtacagtacagtgaaggtattttctctttcgtattattttcttaataacattttcttttctctagcttatggtacaactacagtatttaggacatataacatacaaaatatgtgctaatcgactgtttacgttattggtaacgcttccaaccaacagtaggctattagtagttaagttctggggtagtcaaaagttaagtgtggaattttcaactgtatggggtcagcacccctaacccctgagtattgaagggtcaaccatacttgatattagcagtgcttattggtagcagaccacaaagatctctcttaggaacgtagccatacagctatgttaagcaggtgtggcaagcacaataatggcccctcaaacatatccctatcttaatccccagaatttgagaatatgttactttatctggtgagagggatgtttgcagatggattaaattataactcttgaaagattactgtggattatccaggttggtccaatatgatcacaaatgtcctggaaagagggaggcaacagtatcagagccgagaaaggagatgtggtgacagaagcaggggtaggagtgacacagggccgtaaaccaaggaatgcaggctgcctgtaggagctggaaaaagcacagaaagggattcttctctaaaacttccagatggaacacagccctactgatacactttagacatctccagaactgtaggataataaatttgtgtcttttaagctactgaatttgtagcaatgtgtgacagcagcaattggaaactaatatatcaggcaaatcgttggagataatttggggcttcaaatggcaggaaactcaaactggtttaaataataggatagcaagaagatgcattggcttagatattaggatgtctaacatggggcagaatgagttgctccattggctcaatgatatcatcagtgatgccacttaatttctgtctctatctctgccctgtatttctgtttcactgatgttatcctgaaactggttcccttataagtttgggaaggctgccagtagcaattggagttaaatttgtccttgttcacttttatcaggaaagagcccaccttctcataattatctaccttgatagacttgcactaatcaggacccatccctggagctccccctaagggctacctgtcacagggcccatgcctgaacaaaatcagggtcctattaggaaaaggagagagggggtatatgccagacagaatatttgccatgcaccacaaagaatgtcacagaatcctgtgccaagaatgtgaagggataaataaaagtggttaaacaaattgcagggacactgtgccctcagtcacagacctaggaaacaagttccagcttttacttggcaatgtttccccttgctctataaggacagttgtataatggaaggagcagcagcagttagtaaaacctcatgactcgttctgccaggcttagactggcagttagactggactttcttccacctggggaatggcaacgtgcccagcaccttggctcatcataccaccgtctggcttacctgctgcaggtcactgaactctggagtagattgacatcagatagcctcttgtgaattatccctaaaatgatgggtttcctttgaaaactgctaactcttcatacatttctacatatactttactgcattcttctgtgattgaaatttgcttcttaatatgttttataaatatccaacatgacagttcagaggaatttcctacccaaccaactctgtagtcaaagtaacaggaagaaaaagagacagatgggaaattatttcatttaatctccaacttccaatgaattattttctctaatattacagaagaggaaatttgagaactaaggaactaagctgcaaagcctataatgtcagagctgttattagccttagggaaatatgattcccaagcccatgctcttccttttgtattccttggagtcactccaagagttggatatatgtataaagttgatctacaagaaatgtctccttctaatactctccatgtgacttaaggcttattccagaactggtcctcatgtcctacagggaggctaagaagtctgaagacatcggacattctccaaatttatgtaaattagagatagaggtgaggaaagatccctctagactagttccagaagaaagcaagagtagatcaagttgcttaatgatctccttaggcctgttctttcctttaattgtaagggaaatctaagcacagtcacattgatcatcagaattgattagggtaatttggcttgccaggtgggcatactaaccatggccctaagcacttgcagaggactaacaaacaccaaagagaattcttcctcttcattatctttctgtttctgggaatcctttgagaaacaacacacaaatcaccccaactcgtgtatatagctcaggatagcactggtctccaggaaacagctccagacttaatggacataaataagcaaggctctaaggttcatgagggcacactgcattgtatacacactgcattcttagttccagacatagtgcctgacccctggcaaatcactagtgttatatgaaggaggtaagagcaggatggtgagatggtggtgaagtgcactagatttatgtcattattcaagaaaaattacagaaaacttttccttaaacaaggtagaccaaacctatagtaatggcctttaaaacagtgcaaatttcactattgttgttcacggggtagaaactagaggcctttttacccaataagatcatacgaattttcaggttttgcaaaatgtttgttagcatttgaaaagcatttccagttactggcaatcttcaagaaaatgcctaaaacaattttcagaaatgcttctattgaactctactgaaattacattttatgtagtcctgtgtgattgcttctgccttattgttcaagaactgttaataatgagtgagagttttaatatgcagaaaatgagcaacagaatgggacccaaagttcttttattttattttttaataaaaatttaaagaccttgttagagtcagtttccaggaataatttactggcatgtatgttgtttaatttatttctaatttaaagacaaattaattaacacataaagaacttaaaacagagcatatcttcaaaatgagatggctcagaagcattcaggattcacaaaacgttttttcacggcagttgtgaatttaaatcacagaatagaaatgataagcaccacagcatgtcgggcagcagcagtatgctgaacatggacaccactgtttgcatcactgtttccagtggacattttccacgatgtgaagtcaattattgcttccacttctacattagtgtaattggtttttgctctccagaggagaatttattaaggcaatttcagtaaataagggaaagggggtccaatttgctactgaatccattgggtatggataatcacttcgattttcctccagatcctaggggaattcttggtcctgctgcatgtattaaaaccctttttcctctttgcaagggaaagcagaatgctacctttttttccccaggaaagttggtatgcttgatgaagacgattctacgaagcagtacccctgaaagtattgattagcatgattttaaagaatactcagggcttgtacagagaacagttcaaaggaatgtacaaagcatgcgccttctctaaacatttttaaatgcttagttcttacgaagaaaacacatgctaaagctaaattttctaccgtttctgcatcaaatcagatccttgatcaaatcaagaggtgcttttctttcattaaagtaactctaagtatgaaagagcaatgatacctttccatgtgggcaagttctttctgcatagagcataagacataatgagatataattcataaagatgttgcctattttcagccaacatttttcatttacagtaaaatatttttggaatgcccaggagatttcattatttgaataggaggctggaacatcacatttacagcatgtttggcaaagtttggaatataatgtagaaatcagaattatctgcaaaattgttgatgcattcttcacaaattctgatgctgagtgcagctggattctatgggtgaagctcagagactccaggtgaagagcaacatcactatctgtgccatgtccagggagacattggtgactacagtttttctggccctggagaccccaattcaaagtagtagtcaatctgttacttaatccaatccaaacaaagcaaagctaaagaaaacaaaaacactctattagatgtctctgcaaatacaccaagggctagaacaccatttaattcaggtgaggacaagcagttctgcccctattatctggagtgttgctttaaccctcagctttgctttgaaaaccaggcctcgctttgcatcctcagtgcaatattaattcagaactgacttggatttgttccttgggcaaaaggttaagtgatccataaatttatttccctgtagatttggaaaaagaaaagtaaatatcacggtgatttgttagccaagttttgcagcaacagaatcattgaatacccctccagtaaccagagtcaatgctgtgtgatgaatagaaaataattaaaatatttatggctcacccacgtgaatgatgccaatgaccagaaagatcaaatcctcacagaaatctgattaatgagaaatgagtctaacctgcttcatgtttgactaagaactaaattccatcacaaatgtgcaaagaagcataattcatccctgcataatggctttttgttaacataacttcactgtgaagaaatgcacagtatctctaaactacaacatatttgttgcaaaatagaacctacatttttcaaaacctgaccttagattttgtgggcccctatccagtgactcaacattagtgtaataagtacgtttataactcatggcagctggtgccatgtgcagcagatcttgtttctgcaggtaatagccttcagacttaagctctttcacggaggagggtgtgcttgaaaagataatagtggtggagagattcttagagatggcaccatcctctctcagcaacaatagctcagttattgagtatccatcaagtatatgacattagtctatgctcactgaaagtttccatattgaatcctagtctcctttttctaaatgaagagcattgctttcatgtccctttgtgtctccaaataattgttcaatatgcagccagacaataggctttttcttttgagagtgatggaaagatatgccaggtacagagagcatcatggagtagaaggagcttcatgagatccgcttgtttgggcttctgcctctctaagcatgactgttgctgaagcgtttcataaaggagctctgaatgtcacacaactgaggccatgcctatccccatgcctgtacctttgctcatgaagcccccaccctactttcatgcccctgcctcactctcctgtcccacaaaagacaactccattcatctgaaagctgctatcctcttaaaacatactatgcttgtccctgagaatagaggtgaaaaaacacatttcaaccttcactgaacttataatccaatagggaagataggcattatgttaagattatcacaaataattaagtgattacatattgcatggcactggaaagaggttctgatactatgaaggcatataataaggggtcctaagcatagtctaagaaatcaaaagaggcccccaaaagatttacttagactacactgggcacagtggctcacctctgcaatcctagcacttcggtaggctgtggcaggcagatcacctgaggtcaggagttcgagacaagcctggccaccatggcgaaaccccatctctactaaaaatacaaaaattagccgggcatggtggtgcacctgtagtcccagctgcttgggaggctgaggcatgccaatcgctggagctggggagacagaggttgcggtgagccaagatcgcaccactgcactccagcctgggcaacagagtgagacttcatctcaaaaaaaaagaaaaaagaaaaaaaaagacatatttagactagaagttgaaagaaatgtatttaatgaggataacaaggtgtttagaggaaagaccattccggccagacagaatctaacttgttaaggctgagaggtgggagttgggtgagggcaagtgttgtgaaaagtatatgggagagagattatgtaaaccacaggcaaaatgggaagtcatcaaaagacaagtgatgacatgatcaaatttagatttcttaaaactcattctggctattgtatacattattgttcagaaaaagataagtttctagaccagagcagaggctgttgcaacaattcatggacatggcaaacctttaaatctctgttgataaaacaactttgcccatcagcctgttatcactgacatattacttttttactccaggtgattaatatatatttaagacactggacccagaacgcttatgatagcattgttattttgaatatgagctactaaagtgtccaagaccatctcagaatatttcaatttaaaaccaaatctgttttttaatgaatatacctattaaaacacttaacataaagtacacttccccttaatcttggccactgaagatattggagttgtctgaaaggacttgctattcatgaaggcatgacaatgcctatctgcactgtttgttataatgctttttccccaatcatttttgttttataagtggaattttcctttcctacttaaatactgttggtacttattagcacccatttttccctagagatgctacagataatcctgtgaaacatgaggtgaagaaagttaaatataacagttaatatgaatgtactaccaataatacctatgtctccagtgtgacattttactcaggaaactgtgttgggtttcagagtagtgccatatttcatacaagggaggaaggtctgacaaattttcctctccacaaccagtatctctgctttcttcctccctatcccatgaataatgtataagaatttcaagcatcttggatgtcctcctggataaacaatctgtatccttcaccaagcaatgggtatgtacttacaagccagtggcagaacatgttttccaggcagcaaaactctttttcatttccctaatttctgcaataggtcatcaaacatgccatctgctgagctgttttccaaagcatatggctgctgcttcaagtggcaatgtagaagaataactaaaagaagtcatatgtaggagagagtaactaaagcacatactattgagtcactcgtctccatgtccttaattctatccctgagtcaagttgaattcctaaagtcctcatacttgaaacacattagatttctcctttccatattcactgtcaatgagatccattttaacattatattttcaccattgacaaccagagacaaccatagaaaacccatggtatgtttactatcaaatggtattgaaaatgtgcttagtcctgtcataacactaatagtcattagataggaagtgagcatgatgtgctacgcacagctttcattgttccagacaagcagcatagctagtagttcagtacacagttcagccaagacacctgggtacgggttctgaatctgtcactcaatagttgtatgctcttgagagttaacttcttagtgcctcatttgtaaaatggggtgaaagataacagtccctacctttgggattagtgtgaagattaaatgacttgatatatataaagcacctagatcacttcccagcacacggtcaacattatgtaaatcttatatatcagtatctcatttaaaccacatgcaatctctatttgatatatgaagaatctgagtcacagagggctaaataactaccaccaaggcattctgactctagagcctatgatcttaacgagttctttatataaagacttgtgagagaatatttttatttttagggttatatctttgttttattaaaactctaggccgggcacagtggcttacacctgtaatcccagcactttgggaggccgaggcaggtggatcacatgacgtcaggagttcaagaccagcctggcccacatggcgaaatcccgtctctactgaaaatacaaaaattagccgggtgtggtggcacgcacctgtagtcctagctgcttgggaggctgaggcaggagaatcacttgaacctgagaggtggaggttgcagtgagctgagattgcaccactgcactccagccttggtgacagagcgagactctttctcaaaatataataaatgaacaacaacaaaaaaactctaaacttattttttgagttggctgacaacaagcacagatccaaatctgaagttcaacaataaagtcattgtattgaatttgctggtttccatttgctttcacatggtctctttttcgggatcttgattttctattaatattccaatttggctctcacatattatctgccttttataataaccacctcataaaacgacttaaaaagacaaaagtagggctgggtgcggtggctcatgcctgcaatcctagcacttcgggaggctgaggcaggctgatcacttgagcccagaagtttgagaccagcctgggcaatagggtgaaaccccatatctacaaaaaatacaaaacttagccgggcatggtggcattcgcctgtaatcccagctacttgtctacttgggaggctgaggtggtgggatggctttagctcgggaggcagaagtggcagtgaggtgatgtcacagtgagccaagatcacaccactgtactccagcctgggcaaaagagccagatcctgtctcaagagaaaaaagaaaaaagcaaagacaaaatttatgaacattgttttttaagaaacatttttctctgtggagtcagctaaatatggaaatatggaaacaaagtttatcaaatagataaatgttgttctaacaaggaccactgaagaatgaaaatgagaacactgtataagactatgaaacaggccaggcaatgtggtacatgcctgtaatcccagtactttgggaggctgcggcagatagagcacttgagctcaataattaaagaccagcctgggcaacatggagaaaccccatccctacaaaaaataaaaaagttttagcctggcatggttgcacacatctatagtcccagctactcaggaggctgaagtgggaggatcacttgagcccaggaggccgaggctgcagtgagccaagattgtgccattgcattccagccttggcaacagagtgagacccttgtctcaaaaaaagagaaaaaaaaaaaacaactatgaaatagggagaactactttgcttttgacagttgcgtaacttttctatctcagcttctaacagtcatatacaggcacactgcactccaaacccaattaatttaacttctccaagtcaaatttcttgacacattatctttttacctggagcatttttactacttccttctacccagattgttttctgttcagtctttttcccttcaacttccttttatattttaagatttagctcaaaggtcatctcctctgtgaagtaagcattgtctgacaccttagccatttgatgtctctccctcttttgtgttcttaagatgccatatatataatattggtaaggcattctattgatttattttttattcttttaacaaatattcattgaatttctgctatctaatactctatattaaagtagaattatcatatatatgttatttccacttttaaaaatagggcgatgtttgatccatcaggaacctgaaacagagcagcatctcagtatataactgttgagggaaagaactgaccaaataagataattttatgatttatagtcacattctaatttttaaccaaaggtgatattattccaattggacttttactttccaccacattctaaataccttttggtgctttcaaaaaataaaatctacccttagaaatattcaaaagtgtggtatatgtccatcctcacgctgctaataaagacacaccagagactgggtaatttatgaaggaaagaggtttaattcactcacagttcagcatggctggggaggcctcaggaaacttacaatcatggtagaaggggaagcaaacacatccttcttcacagggcagcagaaaggagaatgagtgcccagtgaagggggaagccccttataaaacatcggctctcatgagaactaactcactgtcaggagaacaggatgggggagccaccctcatgattcagtgatcttcacctggtctctcccacagcacgtgtggattatgagaactacaattcaagatgagatttgggtggggacacagccaaaccatatcatgtggttataccataagttttacatttctctccaagtgatgaaaaaaatacctactattgctatatttttaatatatattttaatcataaaatgctaaaattatcctagtacatattttttaatgtatttgatacatttttcctgttggagagattcacatttttggaaatgctagaacaaaaagaatgcacatattccagatctactgacctggaaaaatattaacaaatatttttatattttatattttattaacaaataacaagctcacaaatagatacaggtttggtagagcctggcacataaaatagcagggtccctatttaagaaaaaaaaattattaatagaaaattgctaggtcctctccctcctaaggccttggaagggcctatacaagtgaggggccctaaagtacatggttcattaatgtcatggtatacctgcctgtgtctgttatgtattgttaaagggaagaggaaaagttaaagaatatatatgatctttacatcctcctgaaaataattaaaccactttatgttatgtatatgttttatgggcaaatgaaaactctggaataatgcagaaccaaattattaaaatcaccttcatcaagacagaattaagtcagagggtaagataaagtaggagtgtgtgtgtgcatccacgcatgtgtctgatcattttttagacacctttattttcattattacagcaataatgcactacttttaaatttcaatcccaaaataaactttactgggtggggaacaaaagcatgtgcatgtgaaagaattccaaaaaaggaattttttggatgtctttggaataagtccatatcttcccaaagttactatatgaatataccacatatattggtttctgaaattctgctatatttgatacaaaattagccactttcttttctgagaacattgcctgtattaatagactgttccccaggcctctcataaacacaagccacaagacaatcagataagaagcgagaacgtaaaagctcagtgacctaccaatggggtgccaggtaaaccatctctggtaaataaaagacgcccactgtatcaccctgaaatcacttaaatcaatcatgttttgaaatcaagagaaatatttctctatagataagacaaacataaaatgaatacaaaggcatatgtaacccacaagaataaaatataatcaagacaagtcaagccaaaaatatatctcaaaacatccatgcgggaaccagttgattgtggcagagaaaaatccaatatgtatttcaaaacaacttatcacaaaaagaaattaaggcaaattcacactaggaaaaaaatgtttttcaaaataactagttctaccaaaatttgtgcaatctaacgtgtgtgacagagttgtgccaacagtattttccagcaggagactctatggttccaaaaggcagaatttcatagcaatacagggctaatgattgcaatgtatgatggtagttctagcctcagctccaagcatgaaagcagatacctttctcttaggtgttctgacaggcagatattaaagagcagcatgtgtcagaagatgtaggaaatcaactggcctctttgacagattttaatgtagaatgtttgtactgccagggcagtgggtatgacaaatttgagagatgacagtaataggagtgtttaagtaagagaacaagcttaatagagatgccactattgacaataacttgcttatgttaaaggaagagtccttgctttcattttccactgaaaatcccaatgccaattttttgaatccatttttactaaatattacaaaaataccttttagtcatttgcaaggatagaagactaaactgccagttatattgcctcatctgtttttcaagatacctcattccatcatatcattgacattcttcagttagggcattagtctggaccgaggcagaacctatgtaaaacgttgaagtgactgtgaaatgactgcctattttttgttggagtgcacttcaaattaaccttggagcccaagctcaggaatggttattaaccaacgtttgtactgaagcccgacactatgtgtaggataccttgtaattatcttaagccaattgtccagttattctgtaccacaaataaaatgtatgaaacaatacaatttttctctccaaaaatatatacacattttgtatttcttgcatttctctagtattcaagttaattacagtttcaatattatacctccagtaatggcctccttcctaggtatttgaactcctccagaaatgttttactctaactctgtatgcatggtcagtggtagagcatttgggagggtgaagtgccagttgtgaattgatgctaaatgaatgggtatgcttttttttttaaaaaaaaaaaaaaaaaagtccttttcactcatgggctttaatacccatgtaattataatgatttcaaattctctcaaggctaaaattaaacttggcttcctggatggccaaacaattgactattcttctacaccactcagctcccactttatctcaggctcactttgagcacaaactggttaaaaacagtcataatccaaatgctgaattaaatatgactaaaagatataaactgaatgggcagtttaaatctagtatcatccaattagaaccatagtggagcattcatcccctttccacctccccacactcccaatggagtgggagaggcaggggagcacagcctgagttctaggggcaagtgtgggtcatggtgctaaagtccaactggatggaatatgtagagccaaggggaaagttactagaagcatagttccattggagagcaagatcaatgtcacagagatgatctgaaatggagctgccagtctatagaaggcttggcaaaagagacaaggccatgtacaaaattgataggcagaaacaaggagattttcatgagaaaggagtcttgaaacaagtgcagagtaaaaccaagaaatattgctaaggttgtgaagaggcagctgggtgggcaagaggattaggtatttgtgacttcagatgtgatggttcttagaagatcttaaggacagtggaggacactattactacaccagagatcacaaaatcatgacctgactgttgacaggctgtttgcatatggatttgagcagagacactgaacccaaacatactgggtatgaatcttgaccctactacttactagttttatatgatacaaggcaacttccctaagctttgtagcttcaatttcctcttctgtaaaattgggataatcattagaatgattttgagcagtaaattggttaatatatgtaaaacacttaaggaaaatgaaggtcaaagaaggaaaaataaaaatatttttgcttcatctttttcattcaaaatttcattaaacgtatttcttctgatctgatgaaataaattttaaactatattcctaaaacttagattacctaatttattgaataaaatataaatgggaaaattggcactacattttatccaccaaaatgaaaatatcacattgaagaatgggttaaatatggtcaattaaatgccaaagctttaataatagtaaagaaggaaatgggtagaaacacacaaggccaaaggaaacacagaggatacaacagagggaaagaaatgtcagtggaaaacagatcatggagcggtaactgacttaacagagtgggagaagtagggactcaaatgcctaaagaagacgacttccacataaatgagctaatttccaccactgagctccctagccattctggaattgatgtcaccagctacaaagaatttaagaatgaagtttggatctgacacattgtataaagagcattctaagcccctagatcttctctccaaccctgctcaaccaggcaactggttctatttgaaccacaattatcaagagaaaggaggtttgtccttcagaaaagttaaatcaaaaggggccctggactcaggaatacaaggcacaaaatatgaacacaacgcagagatttggaccaagagaattctgtccatctttccccttatccagttcctggaacacaggtcaccagtgagcaaaccacaagattcattgctgaagaaattgaatagaacccaaagaaaatgcctacagatactaacatttgagggtcacacattaaaaatgtcagcttgccactcagtctcagaattttttttcttctttttttgagatagggtttcactcccatcacccaggctggaatgcagtggcaggctcttggctcactacaacctctgcctcaagcaatcctcctaccttggcctctagagtagctgggactacaggcaccagccaccacacctggctaatttttgtatttttattagagactgagtctcaccatgttggccaggctggtctcgaactcctgacctcaagtgatccacccgcctcagcctcccaaaggctgggattacaagcaagagccacagtgctgagcctcagaatcttatccctgtactcacccttcctcaagaacccccagaaggtgagcttttcccatgacagcaagcccttgtttgggaggtagagtctttaagaaataatcttaaattcatcaaaatcatcaaaatgaatttgatgcatttgacctggggaagaatagtattgaaagaagttttatagttctgaagaagagtttaggagtaattagtgacaggtagatagaaaaccaacctacaaaggaaaaaaaaaaaaagatcatggagtggtcactgacttaacagagtgggagaagcagggacccaaacgcctaagagaaatacttccatagaaatgtgtatgcatatttacaataatatagctactaatttgttaacactgaacctagaattgtgttctaaattagttgaaagaatgaagagataataactgggtagaattacataagagtctaatattctctcttaataggaagtccatagaaaatgtttaaaattgatgtattaagaaatactagtggaattcattattatccaagcagctaaaataatttaaagtaggtattgctgggaatgaaacttcgtggtggaagggtttaaggcagaagttatttttcactatagttctatagaacttgatttcttaaaccatgtcatatattttctcaacaaaagttaaaattgaagcacaaatatcttgtatgaaagcagtcatctaatctcttttcttgaaattagattaaacatattttcgtgaatctcagacagtttatagtgggtaacttatctttgttttggttgaatgttacaatagtttatgctctgctctttggctatcagcccctgaaggaaatatacaaaatttggctttgtcttgccatgtcccatctatcaccaggtagggaagttttgttcaatgatcccctgaattgagtttaatatgttattttttaatgttagactagtccactggataataaacataaaaggcaagatatttatttaagtatgtactcaatggaaattagtattttcaggtctaaaaaatttttatgaatattttcccaaaatagcaaaataattaaactaaaatataattatataaaatataattaatgaaaataaattgttatacatatcaagatcatttaagtcaaaatgtgtgtgtcatctgtgcaaaattaaacatgatcctatatctcttttgcgtttgattggaacaaaggatattttagacccccaatgctttacaacactcataatgtgaaattggaaaaacaaaacagaaaattgttatacatgagaagtaatgaaggtattaatttctagaaaaagaaacacatcaaagctttagatttgctctaaaaaatgttttgaagggtgaatattgtgctattttgaagagactcctaatttagaaagctcaaataatgtctattttttaaaatggaatctttctccagtcataggaaatgtaccaccacaactatgtaatcaatgtgaagcagatggtggagcaattatctggtgtatttgggcactaccattggccaatacacagaatatgggccaggaaatttattctgtgttttcaagctgcttttgggttgtgatggatagtgttgcttaatgaaaatctttgtattaatttagtttccattttacagtcctcatctaaataggcatctctctttgtctctgtctctttctgtctctatttctctctctgtgcctcttttttctatgtggctttttttctctctctctttctaagtcaagtaagatctatacagtgatgattttagaaatctaataatttgagctttatttttaaatatcagcatagcttgttactttttttttgaggaaatagctactccctataccagtgtacaaatctgagttatttcatttacttaaaatcatctagagggttcacaattgagagaagacactattttgctgattctgattatgtaattgagtaaaaaaactttaaaaatacattttaaagcacctactttgagcacttaggataatatcatcctaagagatattttacctttaattccaactaaaaattagctattaaactcatattggtttcaaacttttattttttactttgtctttttagatcagttttagtttcacagaaaaattgaaagtacagagatttcctatatatcccctatccccacacatgcacagcctccttgattatcaaaatcccctgccagagtggcacatgtgttacacctgatgaacctaaatgacacatcattatccttcaaaacagttcacttttggtgtggatttggacaaacgtataatgacgtatatccatcatgatactatggtatcgcagaatagtttcactggcctaaaaatcctctgtgctctgcctattcatccctacctccccacaactcctggcagccacagatctttttattatctccatagttttgccttatccaacatgtcacataataaaaatcagacagtatgtagcgttggccgattggcttctttcacttagtagtatgcatttatgtttcctccatgccttttcatggcttgttagctcatttctttttatcactgaagaatattccattgtctggatgtaccacgctttattaattcacttactgaaggacatcttggttgctttcaacttttggcaattatgaatgaagcttctataaacattcttgtacaagtttttatgtggacataagtttccacctctttgggtaaatacaaaggaacactattgtgaaataattggcaagagtatgtttacttttgtaagtaaactgctaaaccatcttccaaagtagctgtaacattttgcatcctcaccagcaaggaatgaatgttcctattgctccacattctcaccagcatttggtgttatcaatgttctggtgtatgtggtaccttactgctgttttaatttgcatttccctgatgacatatgatgttaagcctcttttcatatgcttattcaccatctgtctatcttctttggtaaggttgtttaaggtatttgacccatttttaaatatttttatggtaagttttattttagtttcaatgtgcagatttgtgatataggtaaactgcatgtgacaggggtttggtgtacaaaatagttcatcacccaggtaataagcatagtacccgataggtatttttttctgatcctcttcctcctcccaccctccaccctcaagtaggccctggtgtctatttttttttcctttttgtgtccttgtgttcttatcatttagctctcacttataagtgagaacatgcagtatttggttttctgttcctgtgttagtttgcttaagataatggcctccagctccatccatgttgctgcaaagacataatctcattctttgttatggctgcatagtattccatggtatatatgtaccaatttttctttaaccagtcttcagttgatgggatttatgttgattctgtgtctttgctattgtgaatagtgctgcaatgaacacacgtgtgcatgtgtctttatggtagagtgatgaatattcttttgggtatatacccaataatgggattgctgggttgaatagtaattctgcttcaagttcttctgcgactcatcacactgctttccacaatgttggcccatttttgaattaggttgttttcttattcttgagttttaagagttctttgtataatttggataatagtcctttatgaggtatgtcttttgcaaatattttgtaccaggctgtggcttggctttttgttgtttattttaataaagtcctccagtttgtttttttaatgattatatttagtatcttcatttatcactcactattttgctctgcagttgctaaaagtacttagacacattgtatatatacctagttttagaatactttgtgcttctctgataattcaaaattttgagttctatgtataagaaatgactacatggtaataatggtgatctgtaattaatattttttaatgttttattgtttttattttccaagcatacataaaagtgaagaaaataatctaataagccccatttgtccactacccaggtttgacaactgttaatattttgacagttttgtttcattgatcccttcttcttacatgttcatgtgttttgttcttaagattctgaattcccaaagaatatatttttaaatttaaatattgacaacagcaaaatagtatggtttctcaaaatgattccacaaaataatttttatctatttggttgtttatgttcttatatattattttaaaaatgatttctttagaaataactgaaatatttagtattcagaactttttatagatctacatcaagatcttttgaacatgtgcaaagttgccactgaaacataaaatgtatcatctttgataaatagcccttaaaaaaagcacttttctttagcttttttcctaaaaatactgggatttactaggaaagtataaaaactatactgtatgtttctaattttagagtttataaaaattttattctgtttaatataataaaatccagtgcagcttgctgtaattgttgattttggcaagatactctagtgtatgaatgccactgagatattaataatcatagtatctagttaatgcaaaaaagcttgaatttatataaattttttaattttcttttttttttttttttgagatggagtctcgctctgtcgccaggctggaatgcagtggtgcaatctcggctcactgcaacctccgcctcctggattcaagcgattctcctgcctcagcctcccaagtagctgggactacatacaggcatgcgccaccatgcccagctaatttttgtatttttagtagagacggggttttgccacgttggccaggatggtctcaatctccggacctcgtgatctgcccgcctcggcctcccaaagtgctgggattacaggcgtgagcccccgcgcccggccatatttttaaattttctaatgcagattgcttgtcttataggtgttcaaatttttctattccttcgcaactataattcccactttacccctaccttccctgcagtttatccttgggagtttttgcatttaatagcctcactgtagatcaagggaccccaaacattggcagtctatttaacaaaatacttgagctgatttattgataaaactagatgcaatttatttgcataagagtcttttaggaggcaagaggatagatagatagtcaaattaaagacaatagaaggtaaagcacagttttcaaggcctacaatgtggcttattatttctttgttttcttctctaatgcaaaaattggctctgaattgcacatctggaatgactatctgaagtagaatttttttaaatgcctagtgtcattcctcctaaaatgacagcatcttgttcttcatttgggtagttctccgtatgcactctcacttgttctggtcagcacttaatcctggcctggtgaattagtaaatcacacccttccgcctgccagccacatgatccaagctaaccaataagggaaaatttttaccccttatgagactgctaggcaatagaggtactctttccatggaatttgaatttggtaggccatgagcctgaacccagactaccaagtggacagagtctgcctcagtatggatttacactgctggaatcagaatatagagacaatgaaagaaggcatcctaataacatcattccaacctcttgatccagccattattggagtcagtttatttgaatttctgtgtgataaatatatttgttaaactttaaaaaaatttttccctttgccacattgagttgactttccttcacttgcaactgaaaataccctaatattccatttattcagacaagtcacactccatattttctaataattgtacttccaactttgccatttttatgcctcctgtatatagctaaatcatgcgtgcctcattactttaactccaagtactcatcagtgcccttgatctcaaattgtctactagctttcagcaaaagcccatttgatccaagtgggctagcagatgaagaggttaacagtgagaaagtatgatggagagaggctgaataaagaacaaactaatcacatgttgctttaaattttctatgagatataaagccaggtcatcggaatgtaatattatagaatgttagctgaaatttccataaagatgccttcacagaattattagttaatataaatttatttagcagttcatgtagcagccaaattagcttaactttctggcataactacttttgtttcccctcaggctgcaggatagaggaaattttatagacatacttggttggcatccttgttcaaatcctaactctgttatcttaatggaggtctttcatgtctctatgattcaatatctttctctgtaaaatgaaaataataatgttgcctttgcatttgattgtaaggattccataataaacagatgtgaaatatttgggaaaaagtgagataataattgtaagctagtggttctatcttttattatcaagcacttcaaattatttaaaaggaaacctccattaggtattatgcctgtggggcttactcaggtaatatatagtgacatatataaaattcagagctaatctatgatttcagagagtttaatattttttaatcatccgattatactacatactacatttaaactaattaatttagccattcccagttcatacaagaccttcgcatttgatattgcagccattcttttgctcttgtgaggagggtatccatctcaattataattcttttatcacatatttgcatatcttttttttactataactattaatggtgtagtgatgctgatttatcacttagcctcttttacctaacaatgttgccctgaagtaggaaaggatgaagttctaaaattaggatgtaattattaacaattcaccacctgaacattaactaacagaatctgacagtggctttccccacagacaaacctccacattcaagaaagaggattcctttataatgaagttagttctgacaccaatgtacattaagagaacaactcccaaaatattataactctgacttttagagtcttaaaatgtagttatggtttcagtagtaaaatctgagcaatactaagggtggttttattactttacaataagacaaaaatgattaatttcttaattaaatttttgatattaaatataagcccttggttcctttgcctatttctaaacaacaaagaagaatatatcatagtctatgatttgctatgaattatgttttgtgatggcttatcgaatcctcagaactgaactggaacttgcatttcctctgttatcagcaaaagcttttctgaaatgtttgcaaagctccagatatatggggttcctgaataaatattatcccaacactgatcagctgcataggtgaagaccaagttaggaaataggtctacaaggatttcttaatgaaagcaggtggctgttgatattttaaatagattcaataattaattagaacatttttaggactttaggtgcatttcacaagggatttctgtaatattcagaaggtagcccatgtaggaaagcacctggttcaagatcatcattcatgctctcctaataggggggaaatatttttaaaactccacacaggccaaaagttctgttcctagcaaggtagacttaatttttttgatatattcacatgctatagtttaggaatttctggagaatcaaagaactgccttcctaagaaagacatggatttcatgttaaagacagaaaaagatgatagttggccccatgtagctgcagattttgcaatcacagattgaaccaatcacagattgaaaatattcaaaaaaaagtataacaaaaataatataaaaatataacaactatttatgtagcatttatattgtattaggtattataaataatccagaaatgatttaaagtacacaggaggatacgcataggttatatgcaaaaactctgccattttatagaagggacttgagcatctgaagagtttggtatctgtgggttgggaaggacctggaaccaacaaccccatagatacagaggagcaacttatatttgtttaaaaccatttttggcaaacttctaaaacagactctgtgcaataaaattcacttgcttaataagtcacattccataccaagttcacataatggtagattatcctcaacttccatgtgtttgatgtccattcaatattttatgttttctaagtaaggtaaacaaatctgttgactagagctctgaagatactgaaggcttcccttccttctctgttaccatttttgtgatatgaacttctaccaagataaatttaaaatgcatttgttttatactctatgttttacactttgacatcaactaatctttgctcacaaaagaaaagttaggaccctttagcattaatatacatagtaaaaaatgctggaaaagtttttaaattgttactagcacttaggtaagttaaattcgcaagcaatatttttttctgaaatgcattgatcagcagtaaggtacaaaataaactaaatcacatttcatatctcctttctgtggtgtttttgaaattctgagtaatgaccctggttgagccattaatgcaaatcctcaaaacttaagtagtttcttgatactttccattttgaggcatcttttaaagaaacagcagatgcctctccacatgcattcaaaaaatcaataaaattaatcaataacactctccacaggtaatatatgttcagaagcatttctgcctatctatattgatttagagaattgcttcaaatctgttctgatgtgtataaaaatcatttccttattcatcaaagtttctcttccctgatatgttatttcatatatggcacacaatgatttttgtctctattcttgtatatttgtgataaatttcttatgatctgtgtatgagactcatttgaataaaatataaaatgagtattttgtttctttggagaaacctattgctcaaaatttaatcaaagaatgaataatcatgagaaattactgaagttattgtaatgagaaacgtaatgatgtatttcattcacatttttattatttataataagcttaaaaggtttgagtttgcttctatttcttataacaaagctccattcctgcagacacattcctacaatccagaatgacactattactgactatataaataatagaaaaatgcatagttttagccaattgctgactcatagtattgctagaaaatgtaacatgttcaaacctataagtgaattttgtaacctttttgctagtgtatgtgttacgtgtttagacagagtaataagaaaaatagatattctgaattttctgaacataaagaaatttaaagttttgatagatataacatttaataattctcattaaaaatgactgtatttaattaacccaaccaacttatatatccacagttaccttaactaacagtacctgataactggtggctcactggggaaactgtatttgatcaattaaagagtcccccaaggaaacacaactcttaactcttgatatattaactagtgttgtgaattattcctctaacaaaaaatcaaatatttctgtcaacattatttaataaatttcataactaacatagggtgctccattacaaaatgacatcatttggccagttaatacaccaccacagtaagtgtgcctcaaccagtatcttcttcaaacttggatttattaacaagtttcatgcctctcagtggtttttccttggaatttcagggaataggaattttcatattgacaaccgaggtccaatacctctctctaccttagaagattttactttaccaatctatcaaattaattttgtcttttcttaattcttaaattaagttgagatctttcagcaaaacaagaactgttttttttttcaggaacaattagtgtaaagaattggataaaatatattcactgtattcaaaaatattatttgggtgaggctaaggggatgtttgccaacatagaaagcataagcattggaaagaaaatataatctggtttgtttcccctatatcaaaaattaaatgacaatttttaaataacatcttaatataaaatacttacctaaagatgtggaagtgttttttctgcccactaaggcactgggtacattggatggtctccagaagctctaaaagaatagggcagccttcctgagtttgtcacttattcccaggaaactagttgtacaatcagattcttggaatcaatagatgccactagggcgaccatgaatataaaatttttaaaatatttcttttacttatgtaaaaattaatttaaatatattcctagagatgagcatagattcacactggaaactggagtggcacactcaagagagattttgatagacacatctctccatcatgttgtgttttagtaagggcagctgaatcaaagtggaagggatgacatggagccaatccaaaaaaaaaaaaaaaactcatctgggcatatcataaaagataacagcatgagccttggagtcatatagacctcaaatccggatgccatcacttacaagctgtgtggccttggagaagttgcttttctttctaaacttcatttccctcttctgtaaagcagagtatatgctagtattttctaataaaaatatgtgatatgtgatatactatgataatagtatgttgataattttaaattttctagtggacacatttttaaagaacaggtaaaattgatatatttatttatatatttatatttatatatgagatatatatttatacttattaattatatacatataaaatatatgttaaaatctataaaatgtacccaaaatggtatcatatcaacaagtaatcaatatgaaaatgagtaatagcctattttacattctttcttcgtttgaaacctggtgagcattttacaattacagcacattccaatttgtactaaccacatttcacatgctcaatagctacatgtgtgtcatagctgctataatggatattacacgtataacctaccccatagggttattgaagaataaaatgagataatgcaagtaaaggacttagaacagtgcttggcaaataatatgtactacaaatggtagtgtgaaagctgctactattatccactgatattgattatatcttccttgctctgctgggggaatggaaaaatatatggcatggcccctgttcctgagtaatcacgaagttaagaatgtaagacaaatatatagttaactagaatttttgacatcttattatcacatgaatggtatgaatgaaatgcaataagtgctcagaaaaggcagatcttgtactaggaatcccttgtaccaacttggtgaagaaaatcattttgaactaggatttaataggtaggttgatttttgttaggaagtaatggttagggaccatgaggacagctaggaaaaatattccactatagggaattacagaagaaacaatccaaaggtagggaagtgaaaaatacattcaagaaatgagggcaaattgtttgatggagagcacagagttcatgtaagagtgtacttgagttagcaaatgcagatttgtatcagagtgtagagatcttaaaagccatgctaagatacttggacattattcagtgtctgaaagaaatagtaaaaaagagcactgatttaggtgccaaagatctgatttcagccatattctgcaactgccacacgtgcattttcctaccttggccaagtcacttcagctcagctgttttatttgtaacataagatggttggatctaaaacaaaacaaaacctgagaacgtcagagatgaaaagggcctctttgttgttgttgctgctgctactgcgatcattgttctgtttatatttgtggtattttaggatgaggataacattactgaagaaatgcctcaggaattaatataggtagatttaaaagtaaaaatatgaaaatgaaaagatcattttgagaatcatttcagtggtcctagtgtctttaaaaaaaggattttaactaatattgtggacataacagttggaaatattaataaatggctgggttggattatagaaaatttgtttaaaaaaagaaagaatggctaggacttggattgaaggtggagagggaggcaaagtgagaaatgaattttattacagtttggagtctagaaaaaaaaataattagtattcataatagaaatggtagaaccagggagataatttggctggagatatgggaagggatgtaaaatgagtgtttttagttatcgggtacaatttttagtacatattatatatgcattagaatgtatgtatttagagattaatggatatatatagtgacttttgcaagaacatgagtattttagtttcagagtttcacaaagtagtagaatcaacattaaataaaacaattatgagattaacatgagcattaaagttaagaacttatgcaactagagaattcagtgatattcataaagaggccccaaagtgtgacacttatctgagtcttttttgcttattttttgttattattttagagacagggacttgcgctaccacccagaatggagtgtaacggtgggaatagctcactgcagccttgaactcctggactccagcaatcctcttgccttagcctccacagtagctaggactacagatgcatgccaccatacctggctaattttcttttaaattttttgtagagatggagtctcactatgttgtccaagctgctctcaaacttttggcctcaagtgatcctcctgccttggcctctcaaagcattgggattataggcataaacccagttggccctaaatcttaatttatgaaagaaattctaaagccagtaaatgaagcaagactttttgagtaataaagttttcaattcaaatcccaaatcaaggctgggcacagtggctcatgcctgtaatcccaacactttgggaggccaagatgagtggattacctgaggtcaggagttcaagaccagcagggccaacatggtgaagccccatctctactaaaaatacaaaaaattagctggccgtggtggcaggcatctataatcccagctactccggaggctgaggcaggagaatcacttaaacccgggaggcggaggttgcagtgagccgagattgcgccactgcactcaagcctgggcaataagagtgaaactccatctcaaaaataaataaataaagaaaatcccaattcaaccttctgtgagtctccttcttcattttctaggaggaaagaatagctacatcacagtgttgagtgaaaaacatgtgatgtaaaaaagaaagctctagacattcaatgaatgagggctaccatcaactcattccagtaaacctggatgacaaagaaatgggctcaaaccctttctatttaaaaatgtcataaaggtttttgtgctcctacttgtaacacactatgaatcttcaagcaacaagcacatattaagtactgataagtcaagttccatgatcataaaaaaaattgcaataataagcagcatgaatctcaaccttaaggagaacttggctacatgagaaggaaagtaagtattgaaaggtttaaggtaactcctggttattctaggtgtacactgtcaaaatcaaattgacttctcacacgtgtttctaaaattaatttaaaattcaataaaaattaatgaaaattgattgaaaagttttaaaaattgtagctagaaaaagtgtcaatattacacattttattagcatgagagtaagagtttccaaactatgctagtttatataaagtgatttttacatccagataaaattttaccactcaatttgtatggattaattcattctgtaaacttcttcaagggattctattgttaataatgcttaaattagtaagtatattcaaatattcaagtttttataacaaattcaattgaaactgttatgcctaagatattagtgaaactacttattaaaataaatacagcatataaaggaactatattgtattaagaaagttataaatttatttggaactaactttgaaagaccctctaatttataaaattagattgaatcatttaatagcagagcaatactttgaggttaggagaaatttaattcttgtcttcaaagccaaaaggagttggcaaattcatccaacagagtgaaatggacagcaacatatgctcctcattgagtcctattggtcaacagaaaaggtattgatttactaaacatgaaaatattctgaaagtcttggcagataaaaataagtattgattatatattttaagacatatgaaggagtcataatcactcagtgttgatatatactgagttatttgtataaaaaatagcagttacaaaattaaatcaatcttctccctagactgtttattttctttccattctgtgaaaagtatgacatccttataacttgaatgttaacaaaagaaaaaaagcaaggcattttttacataacagatgtttaaacatttatctgtattttaaaatacctttataaatcaattttgaccatttttatttttaacctattggtaaactactctgtttttaatcacaaatttatttcatgtgatttttatggaatgtgtgtattcataaattgttataattattcttgttaaaatactaagctaaataacaacttaataatctgttcagaaattacatgttacaagacaatattttgcttttaatattttaataaaagatttaaagtaaaaataaattatttaatttcacattttttaaagagacatatttacttcaatatgaacattattagttcaggtttcacgtaagttctcatgacgctatttaaaattgtatttctaccatattttcattccattgaccaagttctgatatagttaaatcttttatcctccctaaatttgtcattaagaccctgacattcagatgacaagtgatttgcagtgtggtttgtttttcattgccaatcaccaggagatttaaaaagatacccatgcacttctgtataaacactttctctataaatgctccactttgtggagatgctaccagtaatgagactatggcattttttattttctttctgagagtacctcttctctctcaaaccaattggatactaaagtactaatgtagcaattgacacaccctggtaagtaattttgaacattttctaacttagaaagaggttagcatccctgttcccagcaaaactaatttttaagtcacacattacatgccgtgtaataatccaatatactgtaaatgaagttgaacatgattataaacttatattcattttaggaattagttacgatacgtactcagtcttgcaatcttctgaaaatgaattcaggtaaacttgaaaaaccgcataataaatttgctgaccaaaatctgttcttgaaaaaacaaatttttggaacacctgaggcatggtgctgttgaattaatatgaggttccaatatcattttctgtattttatttaacaaactttcagaaattaccagagccttcataaatatttccaattattatttttagagatgtgaataatgatttaaagctaaatatttttctttttctttatggacttggttctgtttcgttttgtttggtttcacaaatagaaatcagtgtttaccccacttttcagctgttgtataaagactacaagaaaaaaagttatttgggaaagtcacaaacagcaattgcctatagagtgaggttggaagtgaaatccatatgtaatgcctctgtcagcaaagacttagtagaaaatggtttataataaatattcacatctgctgctttggacactctaatccatcctaaggatctttgctgtgtcaggttttgttctagatgaagaagcccagtagttataaaggtttgcaaataggttgtatttatcatggttagctttacttttataacttttctctgttttagaggtattcatgatgtttgggggtaaaatttgtgattaaatatttcactatagcttttatggtgatataattctagaattcttattataaaatggaccaatgctattttcacaatatatcacttacctaaaatctgtcaagaaggcatcattgataacaatgctatgctggctgtggaaagcaatggctaaaagcccaggctctggattcgaagtgctgtgattaaatgctagctccttctatacctagggtgtcattatgagcaagttacttcgcctttccaagcctctatttcttcacctacatagaggaggcattttttacataacagatatttaagcatttttaaatagtactaactatttaaaatacagataaatagtactatttaaaatattaaatagttaatactattaatactaactaatatattaaatagttaatactgttagtactatttaaaatattagttactactattagtactaactatttaaaatattaaatagttaatgctattttctttatcattagattactgtaacgatcattcagaattatccatatcaagcactaaatataaggatcatacggaattatccatatcaagcactaaatatagtatctatcacattaaaagagtttaataaattttaaatgttattactgaaacaataatatgccttctaagtatgattaaataatcccatggatagtactaatgtcatacttatttacactaagtactgagcttatgtaaacatatcctattgttttacttaactccaagtcccatgatagtttgttactggacttccttaataaaaatattaattaaaattggatccctgatttgttttcactttgaggaaatgagccactaaaaaatatatgatacaaaaattatgcaaataccctgtgctgtatttagccatcttatgtaaaaaaaatttaatttatcaaaatttgaattctaagctagagtaaaaactctcaagtcattttgaaatggaagtatttatttccacttcagcttcaaaaaaatttgttgagttcatgagtatcacaatttttaaagcaggaatgtatattgagttgtaagtaatgattagcataattattataaataagtttaaagaagaatacaaatgttttccataaattttgaaagctatgccttttaaaactttctaacatataatttatttgaaaaagaaagttgccttgcatagttgctttcaatctcatctcctcgaaatgctttattaatcacaaatataaaagaatagtaggatgtttgatgaaatctgcatataaaggaggtagaccattaggctctatgtcccaattagaaaattttataacctaattattgatgtgtcttaattttgactcaacttatttcttatacctacaggagctactgcatatttaataactgacccctaacacagaatgataattgaaaaaaatagaatgcttcattgcttataaactgtgaacacttgaaataaaactttgattcattctctctctctctcctctctgtctccctcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctca

SEQ ID NO: 1365 - DNA, 71130 bp, Homo sapiens
ggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgaggtgggcgcggggctgggagtgggtaggttgtctgccagccgtcgctcgccgctcctcttcccgtctccccccttccttcaatcctgtaacctgggcggagccgccccgtcccggcctgaccaggcgcgtaggtgtggtctgcattctttgctggtgagcaggacccgccctgcaggcccgctgtgactgcccgcttgtcctgcctgcacgtctgctctagcccttggtcggcgagggctccgtggatcagatacctgggagcagcagtctgccctgtactgatctcttttgccacatttacttagaactagtcttcacttttttgggtctctaactgaagcttcccctttcgccccatttttccatcactgtctttcttgggccacattttgatttcataatagtagttgcttgaaggcagtgggggaagtgggggaattgggacactggaccaaatgtctgatcagctcatcacattgtccacatgaaatggaccgtcttcctcagttcaaaataatcaaatgatagatggagaattctgaaagttaggagctacaactatttgaaataaaactctagttacatagttgaaccgttcaaggtaggttgtttaaaagcagtttgttcacaaacagatatatacacagtagagtaaatttgttattttagcaaacgcttatttagctcatgctgatttaatgagggttcctttcatgatacttaatagttataagaacattttttacgattttatagttaaacatttcttttgcataccttgttaatctcgttttctccgtatagtatattctacttgtttcacaggagaatcacaattgtattccaatccaagtagcagaaacccaggctaaactagcttgagctaagaaaagacttattctgccgggcgcggtggctcacgcctgtaatcccagcactttgggaggccgaggcgggcggatcacgaggtcaggagatcgacaccatcctggctagcacggtgaaaccccatctctactaaaaatacaacaaattagccgggcgtggtggcgggtgcctgtagtcccagctactcgggaggctgaggcaggagaatggtgtgaacctgggagacggagcttgcagtgagccgagatcgcgccactgcactccagcctgggcgacagagtgagactccatctcaaaaaaaaaaaaaaaaaaaaaaaaaagtaagacttattctgctaactgaaaagtctagggatattccttccttagctttaggtatcactggagatcgtcttgcctccgtgatgcttccctcgaaagctttgttcatgtattgagagggatggctgtagtgtaataacaatcgtccgcaacactcagtatcttacagaagggagtgcttttctccttagctctggtggaagtccatgggaggctcctgggtttgtttgcacccatttatgatggtgggaaatgggctaagttaattgcccttatctgagtcatccagccggtttaatttctccttaccccatggatcaaagcaagatgagtccggactggggaagggttggttctccgaaggaaggggtactgaatagattgctcagaggaattaagaccccttggtgtcaaattttagagctacaactgttgggctgcaaggatcattagtctaatagcataagcattttttttaaagttaacctagaaatacttagccattctttagaattaacataattaaacaatttcaaggtaatttttatgtaggcatgaatagcattcagtgaggattttccattagtaatattaagaaaacatagttgtggtataatgagccctgtgataaaaatcttgttgaatatatcaaatttggttccagccctcagatttggggtcttcagaagcacttggtgcatgggttttaagctaacagacatgggaggttggtggataatggtttggatacggttctcctgtcaactttaaaacttaattcatttgttccttcctttattctttttaccagacttaaatgtgtgaactgttcctaggtagtggacctgttgtagatatagtctctttgaaactaaccatgtttctttagtcacctctgtataatcccctcctgccacattaattcaacaaatattaagtattttcactttttgggcttctagaggggttagggtaagcttggagatattactaaagtttataatggaggtaggtacaaaagttttgtaggtatatacgctgtaaaattagatgtgaatcagttgtgtgatgttcattcaaatccggcagaatatcttatttttaataattatgtttggataattgtgtaaacttaacattaattttttaacttaatgaactttttaaactaatgaactttgaaaaacagagtttaaactaattcctaaataattgaagccagcttgataagtcctgatatgcagctccatatattgctccagtgatagacttgttttcttattactaacttgtaggtgttctattaaaatttcctaaaatatacatttatgcatattataataatgagaatgagtacttaaaaactcatttgttctgggtgtggtagcatgcactcataattccagctgaggcagaaggatcactagagcccacgagttggagaccagcctgaactacatactgagacgctgtctcaaaacaaaacaaaacaacaacaacaaaaaacccttttatatgatacttcttcctttataaagtggcttttactaaaaattgattagaccttggtaaatggtgacctagggtgatcaaatgggaaccctgctggttttttatttttattttgtattttatttgaagctccagatataccatttaccagcattgtgtaatttcttttgtggtgatcagtttctttagagagaaagcttctagtcttccatgaaaaagtctgcttatcagctttctaaattttatcctggggaatggaggttggggatcttaacaatcatgtatgcagtctatcaggtacatctatttttagtatgacacctgcattagggttaggttcatttctgtgtggtagatcccaaattatctgagttaagattttattttgtaaaaagttggcaggtaggtagttctggtagcccagggctggtgtagtgtttctgtggagttaattggggctcagattcctttcagctttctgctgtttgaaacctagaatattgttctcaggtccaggttgcaatcatatccaagttccaggtagtaggatggagaaaggcacggggctcgccctttagggtgtttcctggcaactgttccacaacaccctgcctatatgttaccggccattttgtgtgtccttctgataggatgctaggaaaaggaattttcattatgagcagctgtatactcagctaaagggacacagttttgttaataaggaataggatagactgataatgatgtagtcaattagcactccctaccccacttagcagtgcttgatctccaccttagttatatttgatatctctgacatttttttcttttttcttttttttttttttgaggtggagttttgctcttgttacccaggctggagtgcagtggcatgatctcggctcaccacaacctccgcctctcgggttcaaacgattctcctgcctcagcctcctgagtagctgggatttacaggcatgaaccactctgcctggctaattttgtatttttggtagagacgggctttctccatgttggtcaggctggtctggaactcctgacctcgggtgatccacccgcctcggcctcccaaagtgctgggattacaggcgtgagccactgtgcccggccaatctctgacgtttttttgagagtgaacctaccttcagagtagaggatctgggagcctgaagttttctttgaaggattttcaaccataccttctcgttccagcctcacattgaactaccttcagaggtacctcatgtttcttaattcagatccttttctggcttctctggcatgatttggcttctgctttggctcccttccctcttagccagttagattttggctttctctttttcattcacttttcaccttttagtaaattttgttgaaacctcttatatcctgtgtgtcatttcccgttctttttgtccatgttcatgtacatcttttacatttttaaattcttgttttagtgggttttggcggggagcaaagaaggatgtttattcagatttatttgtttaactgtaagaggaacttgtttgcattttcagctctccacagtgcttgtaacaatttacattctcatcagcaggtatatgggagtactttattcttccatatccttgctaatacgtactgattaataatttaatttattgctttttgctaaactgatgggtgagagatagtacctttagtttgcattcctcttattttactgaggttgaacagtttttgtttactggccactttgtttctttttctgtgattgcttgttcttttcttttgcccattttctattgagttgttttttccttactaatttgtaggagttgtagcattttctggatatttatacttttttcattaggtatgttgcaaaaatcttccaatctgtttcttgtctctcaactgtgtttattctatcttttgtcacatggaagttctcccaaaagtgttgtcatctcataatctgtagttaacattttttttcttattcctaatgttgtgcatgtgttatgtgtgattttcctccctcagatttgccaaaggtttggagccaccttttctttgtttaaaaccaaggctttttggttggttttctgcccttgtcattcatttttttaaaaaatgttctttgttccttttttctatctttttgtattgattggttagttttccatctttttggtttttctaatatattttaggactgtgtatttttttctcagtctgtattggttgcatcctactgactttttcatttgtaaaatgaagttgatggaatactcttttaatttctgaaatattttctacatggtagtgttttatagatcagtaaagaaaatgttctgttttacttcataactgttgtttggattctcgttgttggtttggtggtgaacatactctttgcagaacttttccttgtcccacggccatgaaaatttaggcttgcaaacggtttgaagggtgagtaaagcagggttttattgggtgaaaaggaagaaaagggggaaacaggaactctcacaaagctagagtcccagttagagcacatcccgcctgcagcttgaatctcaggttccgcacaggaagaggaggggccagtctcctccctatggaatttcccaaggctccaccttagtgaacaggctggttggaatttctccagggaccccctcccacctggctgtctcaatattgagataatattagcacaatgacgttgctacaatttgttaaccaaatactaatggagagtctgtgtgaaccatactgtaggagacaatgtggaggatataaagatatacttggtccctggtctcaaggaatatctgtaattggcagacctttttggctccgtaattttattccacataggtgaataaacatatgggaagatttaaaatctgatttgtttttctgtgttttgacttttctggtgtttagtaaatcttatcaggactatcatcattctgtgtatctgtaagaagaatcttctgaggtgctttacacaggagatttaagcccacaaagctatctttatggcagaactggactaagatcctgacctcttgattccccagctagttactttttgccatactctctgctgcagtagtgcttgattaatgatttttcatgtgttaaattgggtgaagaaagaagtgtgaaaataaagttcacaaagaatctatgaactccagccaatatctctggcccagcttttctgattctcttgtttcatcctctagttggtggtctggagttgcacatccctaaatacagattgcagctgaatagggttgtgtgaattagcattgcagtattattttggccatgtggattggttgttcttgatccccacaccttccccttaaattaaaaaattcttttccggccgggtgtggtggctcatgcctgtaatcccagcactttgggaggctgaggcgggtggatcacgaggtcaggagttcgagattagcctggccaaaatggtgaaacactgtctctactaaaaatacaaaaagttagccggtcatggtggcgggtgcctgtaatcgcagctgctcgggaggctgaggcagagaattgcttgaacccggaaggtggaggttgcagtgagccgagatcacaccactgcactgtagcctgggcgacagagtgagattctgtctcaaaaaaaaaaaaaaaatttttttttcctttttaaaaattaaatatagaatttaatctttatttaaaaattttaacatttttgtttttttaagacagggccttggctcagttgctcagctgcccaggctggagtacagtggcgccacaatagcctactgcagcctcgatctcctgggctcaagcaatcctacttcaacctcccaagtgggtgcatactaccatacctggctaattattaaatttttagtagagaggaggtcttgctgtgttgtccaggctggtcttgaactcctgaactcaagcagtcctcctgtcttggcctcccaagtgctgggattacaggtgtgagccaccatacctggccaatttttttttttttttaaactagaatttctttttttgttttttgagatggagtctcactcggtcgcccaggctagagtgcagtggcgcgatcttggctcactgcaagctccacctcccaggttcacgccattctcctgcctcagcctaccatgtagctgggactacaggcgcccaccactacgcccggctaatttttttgtgtttttagtagagacggggtttcaccgtgttagccaggatggtgtcgatctcctgaccttgtgatccgcctgtctcgacctcccaaagtgctgggattacaggcgtgtgccaccgtgcccagcctaaactagaatttctaatgggaatttgtcctgtacctatttgtggtatttcaaagaaatgtatttatttcctagtttctttttccccatgagatttttaagttgagttattatatatttgtgccaaagtggttgagttttataaaatactggagaacatatataagtacttctccattgttgcaaaacagtaatctgtaactaccatttgtcatacatgtactcctgtgtgtccaggaactattttaagcacttcatatacagtaccatttattcctcacgcttaaaggaggtattattactctttaggaaaggttcagagaaattgaataattttttcatgatcacatagctaagagttgggattcaaactcagggctatctgacttgaaagactgtgacattataccttttaaatatatttgggattttatagttttggttaaaaaaattcgcttatttctaaaatagaatctatgaagacaccaatttttttgcaccattattttccacaatgtgctagtttttgccaactcctggcttagcatactggctttccctgtgcctacttatacaaaacttgcagcctaggtctactttgttagagatacatcctaggctagagtctgctgctatagtaaagtgtacttaaatgttaaagagaagggtgtggtagattctcttgtttctgtggattccctatctagagaactttgatgcttgtgatctgggctgaactatgagggataataccttgtggaattatattgaaggagtagcttatggtagttggatctcctggaacagattttgctcatggtaactgcagttagcaatggctgctttcttttgtaaagcatttgttgatctctctcattttgttggggttttctccatgctgatcagacattgttgatttccagtgattgccctcctgttgtacttttatttcaacttctataatctgtcctaagatagccattttactttgagggtttcatcacatagcttctaatcattcagttacaggatataaatgccctgttccccccatacagctcaggttttgttagttggcctcaaaaactttggggtgaagagaatgggtataaaaattttagtgcattcagtttagccattcttcttttcctcacccatttgcagaggaagtaacctcatttcctactactcccttccttgtttactttatagcaagggtcagcaaaataaggcctgctcagctgcctgtttttgtatggcctgtgagcaccactccagtgggttagcattgtgagtgttggagaactagcttagctgtttgcctctgttccattctcccctttgcttctagctcctgtcaccctggccagtggccatgctttattgctgcccagacttactgtggtgctgcctacaccagagtaaatattctgcttggcgttggcttggcactaaatggtataatctcagtctggaaattggtgactcagcaaattatctcacctacggccccctggggcaggtgcccacagtagactctccctgagaattttgatctcattggggtagagtaaaactgaccatgttggtcactcctcctgtctccctatggctcctttccatcagacaggtactttttctttggagaatgtctccaggatggcacctgggcagccgtgtgccacaattttgggatggcccaacctaggcaaaaaaggtacagggcagggcaggggtttttcctcttgttatataagtagttacatacttattatatgcttgatttagcctttttcccagcagagtctagaatatcactgttcagaaaaagtttgccagtcctggctttatagccatattggcctccttgctgtgccaagcacacctttaggcgttgttgcctcagacctttagcacttgctgttcccttcttatgggcttgttctttgatagctcctgttcattcacaaaccagaattttaggttttatttttcagagatagaagaaaactttgcattttaccgattcatttgcttggggctagcaacaaaacagagagcaaatagatctagtctttgctttcatggaatttagaatcctttgagagaaaagacaataaacataatcccaccaataatatatcacaaattgtgttaaatcctatgaagaaaatgttcagggacctgagagattataaatggaggggcaactaattttaaaaaggggttacattgactgtatttttttgagacaagatttcacgccatggcccatcctggagtacagtggtgggatcacagctcacttcagccttgacctcctgggctcaagtgatcctcccaccttatcccgctgcatagtccctttgggggactgtaggcccaccaccacacctggctgacgtgtgtatgtatgtgtaaagatgaggtctcactatgtgcccagggtggtctcaaacccctaggctcaggtgatcctcctacctcagcctcccaaagtgttgggattacaggcatgagccacagcgcctggcctagattaactttatcacttctgctgccaccgtggactccattgatccgtgctagcatcatctcttgactggattactacggtagcttcctaactgatctctctacttctgctcgtgcacacctgcagtcagttttctacacaacagtcatggtgactgtatgaaaataagtcatattgctgttttgtccaaaccttttgatgattcacactcttacactatatagtaaaactcagaagtcttacagttgcactcaaggcatcattacttctttgacttcatcacttactattttctcccttgctcactctatgatcatattggtctccttgccatgccagatacattcttaagtaccctcttgtcccagggtattggcacttgattttccctagattggaaattctcagatatctgcttggctcacctcatcacctttttcatgccttttatggtcatgctgttttagagttaaaactttttttcatgtagtcaaatgaccatgttatttaaaacgacaaccttcttacctctcctcatatattcactttattcctcttgtctctttattctccatggcacttaccactgtcttctatataatatttttgcttttttgtcttcccctctaaaagcttcacaagagcacagatttttagatgtttactgctaaattcttaatgtcctaaaactggtgcatagtaagctcttagtatatatttgttgaatgaatgaatgaggaaaactttctttgataacaatgtcagcctagacaatagtgagaaatggtggtaaaaagagtgaaggccctgagcaaggagagcctataatttagtgactcgaatgtatagtgaatatcctgagatgaggctggagagttggatgatagccatatcctgtaagaccttcaacatttttggatgtaattttaagtgtaatgggaatccaccaaagggtttcagtacttaatacttcagagtttatttcctgagtacaaagatattctcctgtataaccatagtacaactttcaaagtcaggaagttggcattgattcattattaccatttaatctgtagaattcattcaaatattgctgattttcctaatattatttacaggttcaggatctaatctagaatcatgcagtgcatttaattgttacgtctctttaatctccttcaatctggaccagttcttcagtttttctcgtctttcatgaccttgacatttttgaagagtacaggctaattactttttagaattttcctcaataaaggcttgtctcattttcttgtgatttctgcatttttgcataggagtaccagcgaagtgatgctgtgttctttctagtgcatatcaggaaaaataagatgtggatttgttctgtagtggtaatgtttatttttatcgcttggttaagatggtgtttgccaggtttcttgaccttacagttaataagcttgttgtactaattagtaaatattttgtggggagatactttgggactatgtaatatcctgtttcattacacacttttcattattttatcatttattgatgaatcttaccagaattagatattatactctgaaaggtaccaaatggtaatttttctaatttcatctagactatggtaccgtaggatagagttttccctattcacctgtttatttacctccgaatggtggtcttttcctcaatgggctcttattttttactgttattttatttagattggttcagtgcttagccattgggagccccttaaagctacctcctgtgcccttttgacatgtcctcatcattttttgagtacttccttaactttctggcatagcaagatgttttagacttgaatattgaattttttcagtctcagcccttgagtcagccatttctctaaggagcacttggctcattttaatgcaaaagattatctgggcagtaggtgtgcttattgctactgtgaagtgttactgcttataggccctcttagcatatacatttaggaaatacatagttacacatttatacttgtttttatttctctctgctacctttaaaaaatgagttaaaaactagctgggtgtggtgacatgcacctgtagtcctggcagctcaggggctaaagtgggcagattgcttgagcctgggagttcaaggttaccgtgtactgtgattgtgctactgtactgcagcctgggcaacagaatgataccctgtctgtaaacaaacaaaaaaagttcacattgatatctccagttccagtttaaaactgtggagttattctaaccttctgccttctcatgtttgtggatttttttttttttttttgagacaggttcttgcccaggctggagtacagtggcgctgtcttggcccactgcagccatgacctccagatcaagtgatcctcccacctcagcctcatgagtagctgggaccacaggtgtgcgccaccatgcctggctaatgtttgtatttttagtagagacagggttttgctgtgtttcctaggctggtctcgaactctgggctcaagtgatccacctgcctcagcctcccagagtgctaggattacaggcgtgatctgctgtgcctggccctttcaggtatttgtatctctgaccttgggaaacttggcttccattatcttcaatgtatttacttaattggatagtttttcctgtttataaccaaactcatagccatgccagccaaaagcttggtctcagatatgttgcccactcctgctgaaaatttgcccccagaaataatcattacaaaaatacccctgatgaaggggtgggggaagtataagggaaaaaggaaaggaggaaagattagaggccagttagaaagcttggcctgacccttttctcctcctttccctgccagacttgctgactgacagctcaccctgatggggggaagtctgctttatattttgtgatcattctggctgctatgcagaaaacaggtcggaaagaatgagaaaggagatggagaggttgtctaggaaacttttggatttctagctgaaagacagtggtagctttgatgtgctgtgtggcagtgctggagacagatagagatgggcttacccaaaacatttaaaagtcggtaaacctgtttttaattggcagtttaccagagatactaatttgtctaatggatacaaacttatttattttagtaagaaatagtatttttaagaaatattttggttttcagagcagatgttagtttgcttttagccaataacagttgataaatatttttctgtggtggtgggtatgactttttgttcatagtttttcactgcatatattttttaagcttctggtttacgtattaaaaaactttttttcatataaaatagctgctcaaagtaagcatgaataatttttgtatcattttaaaccagttgtaattacataaatgcatgtaatatttagctctggtaattattaattctgctctattttttagatattatgatcagatttgttctattgaacccaaattcccattttctgaaaatcaggtaagtcattaattctgtcttaaaattatatggtaatagcacccatttccttctgccaatatcttcactgtctttagagttttatgagatagtgttataaaaataggagcttttagatctgtctaatgcgaatatatgtgcttctgaagaaagaatctcctggaattctgttcatgtcattcttcagtcacttctggggctcatgtagagcaatggtttgtttttctttggacttcattttatgtcagtaggatctgttgactgattaatctgctgtgtcctttcctttgactttttcagaattaggaaggaaactgcacaattcaggaattattagtctcagtttatgtgctttaaaaattattcgcacaagttacatttgcatgtaaaagttgcaaatgctgttttgattaaatgttaattacatgaatgtcaactattttctccttaaaggctagatgttgaaaatgctgataatttcttatagttttattttggagattggataaagattttaaaattagtgatacttttaaattttaaaatagttataagaaaagtactttaaacattcttgtactaaagtttttacaggtgaaataattatatgttgagatttcctttaatatattcctggaaaaaaagtgtaggtggctggaggcagggcaaattgggaggtagatgaaccaagaagggcaaaagactaaagctgctgatggatgtactggagttcattctctttattctctttagtttttctgtatgtttgaaaatttccctaatcaagagtttagaaatttttgtattagattgcaataaataatttaaatgaggtttatttctttctaatctttgtatgtgataatacatatttcaggagcagagagagagttttttaataaacatttaattttcatgtagcatatggaaaagtgaacaaatcacgggtatagcttgaatcttacaaagtgaatatgtctgtataaccaccacctagataaataaataaaatattaacctattccccaaaataaccattctcctacttttgtcatcatggaatagtttttaatttcatcttctaggaaacctgtagtacttacttttatttcccttgcttcacttagcttatttgacaaggatctactacttattttgttccgttgaagtcattgtgtgtttataaagatgaataagatagtgtttatgattaccaaggcagaatgaccatttgaaatatcccagtgccagtattttactttttttagatttcaatttaaaaggagaaggaaaggaagttgggtggttataggagataatattttgagcttttgtcctttttttcatggtggatttttcttcaaagaagacttaatatttaatgagattcaggaaggttacctaattttctgttttctttcattctatccagatctgcttgacatttacctggaaggatgctttcgataaaggttcactttttggaggctctgtaaaactgggtatgtaatttttaataaaagtgataggaaaattggtctaactactttgcattgtttttagtttttaaaattgttatcctaatgactctttgtaaatactaaagttttttacatttcattctctttttagcttcaacttttaatgcaattttgaaatatttgtagagagcccatgccttgccaggcactgtcctagttataaaaatgaataaaaccgatgtacttagtttttgggaagatagttgatcatttaaaagtgtaatatgtaatagcctatgaacaaactcatggaagcatatatgaggaagaaagtaattctaccttttgaaagcagacaatgtttgagttaggccttgaaggatggatttgtagaaaataatattacagatacaaaatcataaccataggtcagaagggtgaggacatttgatctaccagctccagcaagataacctctctgtgccttaattttcttatctgtgaaatggagataatactatttctctcattggattctttttttttttttttttgagacagagttttgctcttgttgcccaggatggagtgcagtggcacgatcttggctcactgcaacctctgcctactgggttcaagtgattctcctattcttctacctcagctgggattacaagcacccgccaccacacctgggtaatttttttagtagagacggggtttcaccatgttggccaggctggtctcaaactcccgacctcaggtgatccacccatctcggcctcccaaagtgctgggattacaggtgtgagcccctggcctattccattagattcttatgtggattaaatgagtgaatacatgtaaagtcctaagaacagtgctttattagctgcaatgaataattatattattatataacattgtaatgtatatgtgatatatgtatatttcatgtatatatgtatatttcatgtatattatatgtatatatgtattatatatgcacatataatgtgtattatatgtgcatatataatgtgtattatatatgcatgtatgtatatatgtgtatataatgtgtattatatatatgtatgtatatatgtaagtatataatgtattatatacatatatgtatatatacttacatatacacacatatatagtatatttgtatacatatatacatttatgtgtatgtatagtatatataatatgtatactatatgcatgtattattcatatacatatatgtatatacatatatacatatatattcatgtacacatatacatatatgtatatattatatataagaaatatgtatatatacacatgcattatatataagtatgtataatatgccttatggtatatcctttttatagtatacatatacattaagatatgctataatatatactatataccttctaagatatagatgtataatatgtattatatagtatgtgcataccatatacatacatgtatctatatatcttatataaggtttatacttatatataggtgaggaaatggaaatatatattttatagtagatattatatataatgttaatttaataataattattgttatggcttgtaaccataggttgaattggggattatggagggtgatgatattagaaagcagattgtggagagttgcaaatattatgctcctgactttgtacttttccctcttatataataatagtgcatgtttattgggcatttattttacccaggtactctggaagggacttcataaatagtcttactgaattctccaatagcttaatgaggaaaaggcactattattgccagttgaacaaactggtttagaaagattacgtgattttctgaagtcatatggttaggatttaatgaagctgggatatgaatctagaaggcctaactcccgggactagagagaaacagaccagtgaggagactgatgagagatgatgaggttagacaagctagtgtgtgcaagttacagaagagagggatttcagacttttcagaggtgaagttgactgaatttgctgactaccagtcagaaggaagagtaagagttgaggcttgactctgagatttaataagttggtttgacctgttggatatttattcctctttagtagaaaggttgactctgatttttctgtgttatgtctgggtagacatttctctggcattttgaaataaaggatttaaagctcagaagagaaagatatacattcgggaacaattattaggtgataataaatttattccttctggcagataattgactgagaaaagtatcaaagtcagagctaagtaatataacattcaggggaaatagaggaagaggttctgggaatgaggttgagaaaaagctttcatatcttacaggaaccagggtaaaatagagatgtgaaggaatgccagaagagtttcaaaggtgatgtggtccagtggttcccaaacctggctgcgtattagtattacctgggaaaaatgttaaaggtttatctttaaagatgaagatacagagtgccagatgtgataggagaaagttttggagtagggcactggaattagtatctttggaaatatctccgggtggccgggtgcggtggctcacgcctgtaatcccagcagtttgggaggccgaggtgggtggatcacgaggtcaggagtttgagattatcctgaccaacatggtgaaatcctgtctctactaaaaatacaaaattagccaggtatagtggcgcacgccttgtaatcccagctactcaggaggctgaggcaggagactcacttgaacctgagaggcagaggttgcagtgagctgagattgtgccattgcactccagcctgggtgacagagcaagattctgtctaaaaaaaaaaaaaaaaaaaaaaaaagaaaatatctccaggtgattctgatgatcatcccaggtccaggctggaacatccttgacagagtcattgtggcagaactcaagtcatgtaaggttggagaagtcactggatttagcagagagaagtttctcttggagtatcctgaataagcatcagattgaggggtgaatgggaggtgagggaatggaaacagtaaatgtgggttgctcatttcaggaaatctacagtaaagatttggggacaaagggagcatcattctgagagggagccaaggtgcagaaaaggatttttagtattgttatgacttaagaaatttggtaggctgagaataaggagcagatggcaggagaactaggagacacttgagtgatgaactcaagtatccagaagaactgggaagcaaaaaattagatcataaacaggaggtggttcatcaaggcatttctagtagcaaaaattggtaattaaatgtccttcagtaatgtcttggttaaataaaaggctactcattcatttgaatattgtgtacttttggaatactaagaataaaaatgcatatatgtatttgttgatatgtaaagttatatcaatggaatattgaataaaaggcctgccttagttcagagttgttgcattgtacaactctagggtccccggaattgggctccttgggacactcctcatacagaactcagagtaattcctcctccctcgagttgtgcactccaggcaactcgagtgtggtatagtatccactttgtgaaaagttatgtgtgtgaatgtttatgtagttatttgtgagataccaaaaaataaattctggttaactctggaagatgagatgttgggtgatttttaattatttttttgtagtttagaaaaattgtttgaattttagaaagctgttattttcatgagttattttcgttttgaaaaacttagaggctggaagtggtggctcgtgcctgtaatcccagtacttggggaggccaagacaggtggatcacttgagcccaggagtacaagaccagcttggggaacagacgaaactctgtctctacaaaaaataaaaaaattagccagacatggtggtgtgtgcctgtagtcctagctgtttagggggttgaggtgagaggattgcttgagcctgggaggttgaggctgcaataagccatgatcacgccactgtacttcagcctgggtgacagagtgacaccttgtctcaaaagaaaaaaaaaagataaaagaaaaacttaaaagagagcaagtaagaaacaagaatacagttaaatacttagaaaggcatctttgaaaaaaaggaaaattaaatattgttttgaaaacctggtttaagtttagatggatagaaaaaaataaaggaaaaaaagataaaatagctcttatatgtaaaatctcataaaagctcttatacatgacaaattgtcaaaataaaatgagagactacagtctggtatgataatatttatgggcaacataatagactgagatatgtatccaatatataaacagtttacttttatttcttgtttggaatatatttcattcttgttttttttttttttttttttttttggagaacagtcttgctctgttgcccagggtggatggagggcagtggcatgatctcggcttactgcaacctctgcctctgaggttcaagtgattctcgtgccacagcctcctgagtagctgggattacaagcatgcaccaccacgcctggcgaatttttgtatttttagtagagacggggtttcaccatgttggccaggctggtctcgaactcctgacctcaagagctccgcccaccttgccttcccaaagtgctgggattacaggtgtgagccaccacgcctggctgatatttaattttgttccttgctctctcctgccacactggcctaatgtatatatttattgaattaattaaaattatattcagaacttgaagatattgatcccttgcttttttttttttttttttttttttgatagggagtctcactctgacgctaggctggagtgcagtggcacgatctcggctcactgcaacctccgcctccaaggttcaagcgattatcctgcgtcagctttccgagtagctgggactacaggtgtgcgccaccacgtccagctaatttttgtacttttaatagagacagggtttcaccatgttggccagaatggtcttgttctcttgacctcgtgatctgtccgcctcagcctcccaaagtgctgagattacaggcgtgagccactgcacctggccaatcccttgccttttagtatctagtgttactgatgaaaagtctgatttttgttattttataagtgatctgtttctttgctcttgggaatatttttacagtcttctctttatctttcatgtttagaaatctcaaaagacttaatgggatttcattttattcgtgtgtagggcatttctttttggcccttttagtttgaacacttatatctcccttaagctctgggaagttttcttatatttctttgataattttcttgtctcttttgtctctctttctttggaatactttattagatgttggttgttctgagttgttcactcgtaatttttatattttttcttgactttctgttctttctgagattgcctagatattaattttaaaacttgaaaaaaaattttttttccttcctccgcccttaaaacttttgaaaaaaatttaacaatcaagtttttaatttttaggagctttgtcttattaatttaaaaaatccttttcttttatggatgtactgtctttgaatctctttaaggaatgctaattgtgatatttggaatataatcttttatgactggaattgtctttatttattttgggcttagtttttcagttcgcattgctcttcctttattttgctgcaggcttttttcacaacctggttattttggattttccatatgtttaataaagtaggttagagtagctggtgtttatgtctgctttagtttagaatgaggagactagaactggtttggaagcaagttgaaaactggcctttattacctaggaggccaccaaagtactgtaacaaggagggctttactttatggtacaactctgtggcacaaacatacaaatgtagtgttgttctgattctcctagattggtttgttcagtgttttttgtaaggagccttattttgcctagtggtcaatgccttgcacattatgcaagatcttgaattccaaactgattgaattctgtgagtaatagggagctattgtagattcttttttaaaagttatttttcaattgtgatacaatatacacaatatgccttcttaaccattttaagtgtacacttcagtggtattaagtacatttacattattgtgcaaacatcatctcgagaactctttttcatcttacaaaacaaactctgcccagtaaatgataacttcacagactgggggcggtggcttatgcctgtaatcccagcattttgggaggccgaggtgggaggattgcttgaaccaacgagttcaagaccagcctaggcaacatagtgagtccctgtctctacaaaagatacaaaaattagccgggtatggtggcctgtgcctgtagtcccagctactcaggaggctgaggcaggaggattgattgagtccaagaggtagaggctgcaatgggtgtgattgcactagtgcactccagcctgggtgagagaatgagaccctgtctcaaaagaaaaaaacaattataatgtcccattcttccctcccccctcaacccttggcaactagcattctttcagtctctgaattaaactgtaggtacctcatacaagtagagtcgtagactgcatttaaaaaaaatttcacaacatgaaatttattatcttaatcatttttaagtatacagttcactagtgttgggtgtatttcatattgttgtaaaatacatctccagaactttttcatctagcaaatctgaaatattgtactaattgaacaacaatccccctccccctaccaccatccctgataaccatcattctgatttctgtctctatgaatttgattactctaggtaactcatataagtggaatcatacaatatttgtctttttgtgactgacatttcatttagcttaatgtcctcaagattcatccgtgttatagcatatgatttccttcttgttcaaggctcactaatattccattgtatgtatataccacattttgtttatatattcatcagatcacagacacttgggttgctttcatgtttggctttgtgaataatgctgctatgaacatgggcatacgtatatctctttgagactctgctttcatttttttgggggtgtatactcaaaagtggaattgctggataaaatagcaattctatttttaatattttgaggacctgccatattgttttccacagcagttgtactttttctaatttttattttttattttgagacagggtcttgctctgacgctcagggtgaagtgtagtggcatgatcatagctcactgcagccttgaactcctgggccctagtggtcctcccgcctccgagtagctaggactatagacatgcaccaccatacctggctgtttaaaaacaattttttttttttttgttgagatggggtcttgctgtgttgctcaggctgacctcaaactcttggcttcaagagatcctcctgcctcagcctactaaagtgctgagattacaggagtgagccaccatgcccaaccacgagtttgcgttcctgccaacagtacaggaaagttccagtttgtctatatcttcatcaatgcttattttctgtttgttttttaataggagctatcctaagtggatgtgaggtgtgtagattttttttttttaatcagagttgggttttagcccagctaacctgctagccctttgagaaatgtatttgcatgagggagtaaagcataaggccagctaggaggtaattgcattgacttagatttgtggtaatgaggaattggtttgattgtggtgggacaatgtgattttgagaggtgacagaaaaatggaaataatttattcaaatttaagaaactgagagaaatgacatgaaaatgacttttacatttgaatttgattgtaatagaaatgtggaagtaaagggaaggagagaaagaataacttactgttcttcagcgttttgggtgatgggaatattgttgtggaaataaatgcctgtaagggcagcttgaaatatgggagcatatgacagcaagaaaacaggtctggaaacttgtttttgtgagagtcagcgggatgagagaggtcatagtatttctctttgaaacatttgttttctttagaaaaaataatctgatgaatttttccttctcaattttttacagctcttgcaagcttaggatatgaaaagagctgtgtgttgttcaattgtgcagccttagctagccaaattgcagcagaacagaacctggataatgatgaaggattgaaaatcgctgctaaacattaccaggtatgctgaaaagtagttactacaataatggtcaacactaaattggattaagtggaaaataatttgcatttaggtttatagatacttcttacgcaacagatgttttctaaaacgaatgcacttttaaaatgaatttattcttactgttaaagcccttagataaactgtctatagaccaggtctgttattcctcattgttttataccgagcacctagcacagtgcctggcacataatagaggctcaataattgttggttgaagaaattatgaaatgtctgagatttcatctcaggcatttagggtaaatccattttaaataaattacctaattaaaaaaaatttgtacattattttcatatgttttcttagagtgagacacacttgaaatttcactgttgttacaaaaataaagacaagaaattggcaagaaaataaaattttaactttgagacttgtggagaggtcatatttaaatatggtcagacacataatgttcataagttgcctaatctgttttacgtactgatcatttactaatatggcatgttattttgtggcagtttattttattttatttatttatttattttgagacggagtcttgttctgttgcccaggctggagtgcagtggcacaatctcggctcactgcaagctccgcctcctgggttcacgccattctcctgtctcagcctcctgaatagctaggactataggcatccgccacctcgcctggctaattttttttgtatttttagtagagatggggtttcactgtgttagccaggatggtcttgatctcctgacatcatgatccacccacctcggcctcccaaagtgctgggattacagatgtgagccaccatgcccggccagcagttgtttattatttattcagcttttttttgttttggttaaaagaacagtaaatgattactgttaaataatatatatataatcatgttgtcattttatattactttctaatttacaaagtgttttcatgtacattatttgactctcagataaaccttgtgatgtatgtcatataatgtcattccgattttacatacgaggaggctaaaggtccgaagtcttaataaagcagtctatttgggtttcaatagttctgattccaaatttcatgtaattccaaatgtccttccactgtttcactcccaaacctcccatgaaatttgcttgtctcagaggtagtctgctttttcccgttgtttatgtttagggaagaggtgagtgatgctgttctgagaaagtaaaaggaaaatataccgtaagcaaacaacacgctccaaattgtggcttgccttacagttttgaatgggcatagatgacaaacataatgcatacgctatttctttttgaggctatacatggcaaatattttaaaatgtgaaaacgagctgggcgtggtggctcacgcctgtaatcccagcactgtgggaggctgtggtgtgcggatcacgaggtcaggagttccagaccagcctggccaacatggtgaaaccctgtctgtactaaaaatagaaaaattagctgggtgtgatggtgggcgcctgtagtctgagctactcgggaggctgaggcaggagaatctcttgaaccgaggaggcggaggttgcagagagctgaggttgtgccattgcactctagtctgggcgacaagagcaagactctgtctcaaaataaataaaataaaatacagtagtgaaaacgaagtaaaattttatttagcttttggttaactgtaactcagttagttagtatatgagattttagaaaggtcattctgaattatgaaagaaacattccattctgtgagggttcacagcagggcacctggtatcatggaaagataactggtggtattagacctaggtccttgtctaggctgcttgccacccagaagctttgtgccgttgggcaagttctttaacctctctagtacctccagttccttatctgtaaatgagagactcagacactttgctgttgtagactttgattcactagtttactgaacaagttcagttgttcattcctagcagatactctagtgttataatacttactgactgcagaaacatgctgttcattttaatacatttgactttgagttttctctgtgttgtctatttatctaactcatgacacctttttttttttttcttttttgagatggagtctcgctctgttgcccaggcaggagtacaatggcgtgatcttggctcactgcaacctccgcctcctgggttcaagtgattctcctgcctcagcctcccgagcagctgggattacaagtgtgtgccatcatgcccagctaatttttgtatttttagtagagacggggtttcatcatgttggccaggctggtcttgaactcctgacctcaggtaatctgcccacctcagcctcccaaagtgccgggattaacaggcgtgagccaccgcacccggccaactcatgacaccttttaatcccagactgatttatttctttttcttagtataatttgtttcatgaaagcaaagttattttagtattaacaaaatataattgagatgaaaaatctgatggggaacatttcactagtgagctctgaaggccagacagaaatcactggcaatgggtagtaatgctgttcctcagaggactaggtgtatgtactacctggggtgtcccctaactacggcatgtttaattatttgaaagatgaatttgtttgggaccaaagcaagagcattgcagtactaaaaatattttaatgtttatccccgcctctattctcatgttaattttgaggaagtatatctaaaaatagtttaatcagattgttccattagtttactttgtttttccttgtaatttacttttaatctttgttaaatctcttgttacgctatagagttttagaaagataaccttattgtctgtaggtcagatgttttagattggttttgcataatataaaaatttaaatatattaactgttcactgagttaacatttgaaatgacttttatatgtaacagtaggaaattaagtcttgctgagttcctataaagaaattctttttcccccctttagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagaggtaactccaatttatctttttgttgcatgtgaaaaaaagtgataaggcttttaaattaagaaagtgattagaatataatatgttcaatgtcgagctgtccttcttgaacttgatacatgaattatggaaaattttcagctatccttttctgaatttgtggcacaaatttacatttaagaatgtaggctgtgtttgaagtcatgaaatagatctttagtaattgtctttaaacactccattctggaatagtatttatgtatgtttttaacatgtcagacatttattcgcaaatatttattggatacttactctgtgccagtcactgttctagtttctagataaacggagttagaaaacaacttaggttttggcgacgggagagatgataagcaagaattaagtagacaggataatttcataaataattgctataagatttcagaaataattgctataaaaaataagagaattatatgatagtggctggtggtatggttatgggatagggatataggggaagctgggctaattttagattcattagtcaagaaggctttctttcaggaggtcctctttaaagtagacctaaatgacaagaaggagtcatccaggcacagtccctagccctgggaatgagggaataagaataattcttataaggcatataagttagcatgagagattgaaaatgggctgaatatgtaatatgggctgaaactgaaaataagagataagtcatcatgtggaagaaataggaattggaatacttttttcttttaaaataacagcttatattgagatagaatttatatacactcaagttcaccctttctaagtatacaacataagatttttagtatattcatagagttttgattaccactatcttattttagaacattaccatcatcccagaaagaagccatgtacccattagcagtcactcctcactcccctttcccccactgctggcaaccactaatctattttgtctgttctaaattttgtgcagaaaatgtgatttcatcaagaaagatgttttcagatgcgtgtacaaacttgtgacctcagtgtttatactgagacatgtcagattagctcatatttattttaattataatggtcatattgtattccagataaaatgaaagatgccatcatagctaaattggctaatcaggctgcagattattttggtgatgctttcaaacagtgtcaatacaaagatactctccccaaggtcagttattgtttttataaacacttgcttactttgcatgtgaaatatttagacttttttgtgtataagaagcaagttgaaacttataaagaaatttgaagttttaatagagttatctgaagtatatagtagaaatagtttttttttttttttaatttaagatgcatgaacaattcttttatgtttaggggatgcctttgtctttaccttttactaaacttgtttttccaagctagaactctttctggaaaatgttgaccatctgttttcaatacttttatcaaatcaaggcattgtgtagttctgaatcattggtgatttggtacaagcatgtatacttgagcatgttgatgattcacacttttaattattgtcctgttttcttaaagatgagccttaaagcgcaaaaacagacataaagaaaaaaggaaaagaaaacttaacaaattcatctgatactttgattagaattcagttttgccaacagggataaaaaattgggctgctaatggacagctaaggaaagcaaccatcttaaaccacatatcacaggaagtataatgttttaatgtaaacctttctgaagtgacaattgtaaagactattcagtgatgatcatttgttaatgacaaagcaaatcactagtaaatttggaatgattaataaagaaaacttaaagattgagtgaaatatatgtttcaactacttccttcagaaatgttcaaggaattagtttcatcatatggtatctgttacatgattttttttggtaggggaatttattgatttgtaagtcatattcaggaatctttgtacattaaaaaattgcagacaacttgggggtgaagtaaaaatgcacataagtgcattaacagtacttattactcagaaaatgatcaataaggaattaatgtgacgattcctggggatttaagatacaccaagagcctagtagaaatttgcccaggattcttgggtattaacagccttcctcttaaaaagagacttgggatctcctctcatgtttttttcatctgaaagacctcatgttcagctgcacagtgttccgttacatcctgttgggccattagttcagtcctgtcatggagagaagaaagtcacctacaaagacttggaagctacctctgcagcattcctggtattccttgaaaatctcctgtttcagaaccaagttgctccagccttaccttgagaactggcatgagtgtagtttgaaatttagatgtcttttattttttcctttttactaataaagctcataaggtattttcatattctagttataaaactgaaaagtctgcaagtagtgatccaggaaggtaggaaattattccctgggagacaggaaagcacacaaggtagtaattcagtttttgattctcttacattttttgtttagatagtgattgtctagcctaattccttggatttttttaatatcatatacttcctaaaagcagtgaggttacaggttagattttgacgttttggaagagccaccactagtataattgctttcctgctttatgtctttggatcttttgaaattaattttgactggaattattttcaaaacaaataggcaaaataacactttatcattatcattggtcatatacttagtgcatttgtctatgatatgtttttgagtatatgacactgaaatattagtgtatctatgatactaaatcatttttatatggctaaaatcatcttcagtaagaactctcttaggatatgaatttaagtgaaaatttactgtcttttttttaaaacatgatgaaacagtaatctatagagcaatttcattagtatatgtgagtaatgatggtttagttaactctacaggctgggtaagggctcataagaaagcttctaaagctctgtgctttgtgttcctctgtgaatgtccattctacttctctttctaataatgcatgcttttctttttgtaaacaaaatgttgacttcatggatcaattaaagagaattgtaaaaacctaaattggcttcagttaacagttaaaaaaaaccccttcaattggaagaaaaaaaatttaattcatagatttcaatccacacaaaatcatgtcgtcttctctgtttacacctaatgactaaccttaatctctaaaccattaatggggtgattctaatttctgtcttcttttcctttttcttcctgcatcccatgttgtctgtggtggtttgtgtggttggactctcccctggtcagtatttttatttccaggaggtgttccctgtcttggctgcaaagcactgtatcatgcaggccaatgctgagtaccatcagtctatcctggcaaaacagcagaagaaatttggagaagaaattgcaaggttacaggtgagtctcttggtaataaatatttaagtaactaacttggatctctcttttttttcctagtgagatttccaagtttgcccataaaaacctttcccgttcatcacccctatcagcagggacaagtgattgtttttatctttagactttactgcatgtttttttgaggtctcatattttatctaaaaaatagatgcaaaatttgcattcaattctcttttttatccatgtttattttaatgtaaaaataattctaaattaattgccatctccagattgtttttgtctttagactttactgcatggttttttgaggtctcatattttatctgaaaaattcatgcagaatttgcattcagttctcttttttggtcatgtttattttagtgtaaaaataattctaaattaattgccatgctccaggagtatgtgtagtgtttaacttgtggcctggtctttgtctaaactggggcatatacttccacaacttgaggacgacagtggagagatgtgtgtgcatatatatatatatacacacatatatctcttgtgaacagcagagtaccttctatgcagttgtgttcatactgttggcattggggttgtcagaaacttgctgtgacattatggcacctgaggcaacttgccagcaggagcaagagctgtttgtatgagttgtttgtgttttgagtattggtagacagaggatagaaagatgacttatggcatttgagttagggaagtttaaatatgtactgatttttagaagatactatggatgtcttggttcattttgtgctgttatagcagaataccacagactgggtaattgataaagaacagaaatttgtcacaattctgaaggctgagaagtcgaatatcaaggtgctggcatctggtgagggcctttgtgttgtgttacctgtggtgaaaggtagaaaggcaagagagtgctagtgagtgagagagagcaagagggagccaaactgctcaatgaagcccctctcttggtaactaaccctctcccatgataatgacattaatctattcatgagggcagagccctcttgacctaatcacctcttattatgcccccacgtcccaacactttgggattgggaacacatgaactttgggggacacattcagaccataacaatggaaatgttgtttaggaggttcagattaattaattagccttttcatgggaaaggatctcacagtgaccaaatcagagaaagtctttttaaaaaagtcagacccagatgtgtctggggcttcactttgattacagtaacttagatttatatataaaaatgattctgaacaaggaatttgtgggaaggattctttttttaaggctagcatatttaaattgtaagtttagtttctttattttctggtttctgggactattagatttaagtaagcccatatttagtctctataaatcagtcagagaaagaactccttttgaaatttaatctcatttttaagtacccctgaaaaaggaaactatttcagattcacacaatgggagggaggtaaatacttttcctcagttatagacacatagattttgcagctttagttttacagctttagttataggttaaagttaagacagaagttgggtgtgatggcacctgcctgtagtccagctacttgggaggttgaggtgggaggatcgtttgaagctagtagtttgaggccagcctggacaatatagtgacaccccttctcaaaaaaaagttaacacagaacacactcactgatccatatttcagaggacagttattctttccggtaggcatgaaatattttttaattgatttgcactcccaagaagacaaacagaacagacaagaagttgaccaataaaccatattcgctgtagtttctcacttagtagagaataataccccatgattctgacggagatcttaggaggtcacactattaaaccaactttctagttatggctactagcaaagagaaataacttattggtcctgtgcaaaccagaaatgaaaataaaatcacaatcaggaaaatcaaaacaatagataaaatggcagcaaaggtaaaataactgcttggaatcaatcacttctggggccaagaaaaattgtacctgagcttaatacagctcatgagttgcacttcttgaacagtgcagtttatgtggccccagaagatggatcttcttggtcatcttggtggatcttcaaagatgatgaaatacagttttcaaaaagatacagaaacacacacacacacacacacagatataaaaacatgactcacatagaatgactacatgtcaaagatttatttgactcattaatgagggacctagcaagattgtaaatctgattttgtgcaagtattgttttcttagttatggtactaggttgtaggtattaaggagattgtcattatagaatacttgctgatgtgtttagggatgagggcttataacatctaacttcagtttcatgtagttctgcaataaaagaaaaaatagtacttaattatgtgtttgtatgggaaaggaatagataaagcaaatgtggcaaaatggtaattgttgaacctagctaattattttgtgggcttgaaatttttcaaaattgggaaaataggtatatataaggttatatagttcaattcctgttcctctttttccctctatcctgttccctccatccattattcctactgccccatagttaatttccattaatttcttgttttttttctttctttgaaatagaagcaaatatatacatagacagcacacacacacacacacattgcacattctcacttgtcattcttactgaagtggtagtatgctattaatatatacagtgttgtgtaccttcttttctcatataacaatgtatcctgaagatctcttcatcttaattcagcaacagggagaccatccttagagctgcattgtacttcactgtgtaagccacagtttattgctgtctcctgttgctggatacttgaatgtttccaagatttcactgttataaacaatgctacagtaaaaaatcacgtacacaagttatcttgtacttcagcaggtgtcttagcttaggctgccataagaacaccataaactgggtggtttaaacaacagaaatttattttctgatagttctggagcctggaaatccaaggtcagggtgccagtatggtcatattctggtgagatttacagatggccttctctctgtgtcctcatatggtgaacagcaggaggaagccctctggtgtctcttcttgtacgggaactaatcccctatgaggccccaccttcatgacctcatctaaaccccattattttccaaaggtcccatgttcaaataccatcacattaggagttagggattcaaaatacgaaatttggggagcacagtcccgtacatagcagcaggtatatcttaaataaattaatagaaatgggattgccaatagcaaaatataaatatgtctgtaatttgttacatatttggattgttgatccacttggaatttatcctgatgtgtggtgctagatatggatccagtttttaaagtcttcttccaaatggctagcccattgtccccaaaccatttattttataatagccttgtttacctcactgatctgacattctgactttatcacacattagattcacggtatatattgggatctatttctgcttttattgtttcattgacttgtttatctgttcatactccagttccatatcattttagttatttatacttgagactgttttaatgtctgataggtattatctctcattttttgaatttttctgcctgtccttgcttgtttcctaaattttgtcattttctgggttttcctgactattcttgcatgtgtttcttcatatgaattttcttttgtttaactatgatggaaaacatatataaaagtgtagttgtgtaactatgatggtcaaacatatataaaagtatgaatcattgaacttctgttacccaacttaagtgattatcagtatttcgctattttgtgttttagttatttctcctttcctcatttttttggagtattttacaactatctcacgtatcatttcattcttaagttttttagcctgtgtctctaagagataaagatttaaaaaaattaaaaaacaaaaatttaaaaaattaagaaattttgctagatgggtcattatcccaatctagcaaaattaatattaatattaattagtagttaatagtcataatccagtattatccacatctagtttagttttccctgatttttttctcaggggtcttggtttgttcaaatcaggatccacacaaagtcctcactttgcatttgattgatatgccctctaaatctttaatttgtaacagcctcctccttcccaacttctgtgttgttttcttcactttttcttgttctgtatgttttttactatgatttctgtgatgtctgttttcccttttgctccttgtataaatgtctcagtcttgctttcttaaataaatttgtatttttctttacttttgtgagttctgtcacttcctgtttcatattcttttgctatttggctatcactcactctggtttgggccatccagtcctctgttcttttggtactgtcattgtgttcttaagtgttttagtttagtttagtttttagcatgctgttttcatctgctttgcggcaatatttctttggtgagctttcattatctactggaaagatatactgcttgttttcagttttttccttatggtttttttgtattgagagatgagttgacttttcagttacttaggtttgaatgagattgattttgctgggggttcctgtgcagggaaatgggcaggggttagctttacaagcatcattgtgttaagggctccctcctaaggtccacttctctggctcttaaagcctaccctggattaggaagaatcccactacctctgtacctgtgcttccctgaattcctcacagcctttgcatttcaagttgatgcatctacttttagggtttatattttgctggcattttctgagtgcttatgccctttcttctccctccctacttttctgttctctctttctgctccccctagcaaccctgtctttttagttaatctgtctacttctttttctcaccagctctcttgggatgaggcccctcagcatcacatttttttctgtggtcccctggtggcatgataggggccagttggctttgcctttaccgtcacctggcaaggttttctcatcctgttttgttgttttcagatttgcttaaagtaattttaacttagggtggcacccttagcacttccctttcttccccctctgtgtatagcgtacctacggttctggtactagtgtttgctatttgggggagggttcaaccacatttacaaatcaaatttgatttacaaatttaaaaagtgatttaaatttgtgcaatttcccgtttcctagtttacactgaagggtagcttttgttttgttttggttatctttctctaagcatgataccagctttggaggttaagatttttatcatgttaaggaactataatttctattttacgaagattttaaaaaatcaagaatattgaattttatcaaatactttttcaacatctatggagaaatttgattttttaacttattattttggagaattatataagtagattttctagtattaaaccatttttgtattcttgttattttggtgttttagacttgccttatctcttcatctggtcattttatagatgtagatgctttctatatgcctgagaatataatgtgttctctatttgtggagtctagtgttctctatgtctggtaaaccaaactcgttaattgtgttgctcaaatcttctataatcttacacttttttttaatctggtccagccattgctgagacagatatgttaaaatcttccactttgattatgggtaaatgtgtcaatttctcattataattgtttatatagatactattacatgcaaaatataagaaattttacatctttctggcaaattggcaaatattaaaagattatgtattatatttatccctaataatgctttttattttatatggtgtcactatatctaataccacctaaatttgtatgcggcttatgttcatttttttataaggccaaacttaaaaaaaaattcttattgatgttgacatgttgttcacttcctgtgttgttggataatttttttcagatccaccctttcactgagagttaggccgtttgaggttcctgccttcatgtgaaggagtgaaagaggtgcatctcaattctctgtgttgtgtggtttccagacccttgtttcagttctccatgagggcctttaataagttttaattgctaattctttggatgtagaaataacccaacagccagacagggcacagtggcgcaagcctgtaatcccagcactttgggaagctgagttgggcagatcacttaagatcaggagttggagactggcctggccaatatgatgaaacccgatgtctaccaaaacatacaaaaattagcttggtgtgggggtgcacgcttgtaattccagcttcttggaaggctgaagtgggagaattgcttgaacctgggaggtggaggtcacagtgagccgagatcgcgccactgtgctccagcctgggcgtcacagagtgagactctgtctaaaaaaaaagaaggaaaaaaagaaagaacccaacagccagctttcttcaatgtcagtttatactgatgggctcatggatttcttttattatcttgataatctgcctgtgtgtttatagagatagctgttatgtattatccttcagttttcgggtattttgtgatcggagaatttccaggtaaccctgtcagccacattgctggaaatgcaagtcttcagattaaagattttttttttgaaaccaatgcttaaatacttggtggggaaagagaaataaaatcacctccctcttttttttttttgttgttgacgtttttctttttagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactggtatgtcagttattcagacacactttaatctcatttttctctagtttactctgtttttcctagctaaaaatcacataattgctgttgtatgctttgaatataatttgtattcatgttgtttaaaatgaatatgagaataaatattgtgccagtgcaatgttaagatggaaagtaaacaataataaagcatatgtaaagtatacaatagttagaagacttgaaactgtgtgtttgattaagactgtagcacttgtcattttgttaacttttgttatttaagatgctgccattaaaaataaacaaatatggctggatgtggtggctcacacctgtaatcctagcactttgggaggctgagatgggtagattgcttgagctcaggagttagagaccagcctgagcaactggcaaaaccctgtctctaccaaaaaaaaaaaaaaaaattaactgggcatggtggtgcatgcctgtggctttagctactctggaggctgaggtgggaggctcgcttgagcccaggaggtggaggttgcagtgagctgagaccgtgccaccatactccagcctgggtgacagagagagatcttttctcaaaaataaataaataaataaataaaataaatataaaaataaaccacaaaaatatatatttttttcttttcttttttttttgagacggagtatcgctcttgttgcccaggctggagtgcaatggtgctgtctccctcactgcaacctctgcctcctgggttcaagtgattctcctgcctcagcctcccaagtagctgggactacaggcgcctgccacctcgcccagctagttttgtatttttagtagagacggggtttctccgtgttggtcaggctggcctggaactcccgacttcaggtgatccacctgcctcagcctcccaaagtgcttggattacaggcatgagccaccgtgcccggcctatttctttaaacatgtaaacttctggagtggtatttgtatgagataaatacatgttattatattgtagatgtatacaacagatggtagcctctagctgagattccaaggagaatattctgttactgggaaagggtgattatatgtttatttagcaaacacaaagtgtttaccatgtgccaggcactctttaagcactttacaaatattagctcatttgttttcagaagtgccctgagatgggtactgttattatccctatttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctgttgcccaggctgtggtgcagtggtgcaatctcggctcactgcaacctccgcctcctgggttcagacgattctcctgcctcagcctccccagtagctgggactacaggctcctaccattacactggctaatttttgtatttttagtagagatggggttttgccaagttggccagactggtcttgaactcctgacctcaggtgagccacctgcctcggcctcccaaagtgctgggattacaggccttagccactgctcccggcccctcattcagtttaatcaacagatgaacagtgtcactgaagatccctcaaactcagtgatgaacacatctgaaaaagaaagaaaattaagttcaaagaagaaacttttcattgttgccgttgtccatgaatgtagtgatctaaaaattctctttatcattgtgctttaaatagtgatttagttttgatctttaaatgtcaatagacaataaatatttatagactatgtgaatattggaaagaaaatataaacagtcacttttacagttcgggtttttgtctaaaaattttgttgtaatttctcttcctaattttagatctgtttgagaagatggttcccgtgtcagtacagcagtctttggctgcctataatcagaggaaagccgatttggttaacagatcaattgctcagatgagagaagccaccactttggcaaatgggtaggtagagcttaattttagagcctaaagttttccgtttggttgttctttagtttatgaacattttagtttctgagcttagagctaaatgtcaagagtatataaaatagaaaatgtagacacacacttacaactatttttgttggacactgtatttatgaagctctagcaaatatagttggaagaaattatagaaacaaggtgaggatatgaggactaaaaatttgtattttaagaggtatttatttggaaatgagaagtagaaatgaactcagatacatggtacatttagtgttctgaaccaatttttgtttctgatggactgaatactaagaaaataattcattggtttaaaaaatttttaggtatattttacacacacaaaatacacctattctaagtgcacagttcaattattatatgtatatgtgtgtgtgtgtgtgtatgtgtatatatatatatttatgtatatatatatattttttgttttttgggacagggtcttattgtcaccaggctggagtgcagtggtgtaaacactaaacatggctcactgcagtctcaaccttctgggctcaggtgatcctcctgcctcagcctcctgtgtagctgaggccacaggtgcaagccaccacacctggctaattttttgatatttttatagagacaagatctcactttgttgcccaggctggtcttgaactcctgggctcaagcgatcctcctgccttgacctcccaaagtgctgggattacgggcatgagccaccatgcttggtcatttagttagttttgataaatgtatgtacccatgtaaccggcactatgattaagttagagaacattactgttaccctaaaaaaattctctcatgcccctttcccagtccttcttcttttagcccctggccgctattgatctgctccctgtcttaagtttagttttactttttatacaatttaaaacacgtgtaatcattctagcatatgcatatacagtacttacagtatgtacagtatatacttagaatgtgttttgctttttttcacttagctactgtttttgagattcatctatattatgtgtatcagtttcagtcttttctatggctgagcagtattccattttatggttatagggcagtattccattttatggttatacggcagtattccattttatggttatagagcagtttgttaactctttcacctgttaatgggcatttcagtttctgtgaacattcatgtataaatcttcgtgtggacatattttagttctcttgggtaaatacttaggagacaaattgttaggttgtgtggttagcatatttaattttatacaaaattgccaggttgttttccaaagtggttgttccattttatatcctatctgcactgtttgaaaatacaattgttctgcatcctcaccaatacttggtatgtcagtctttttagttttagctactttagtgtgtgtgtagcagaatctcactgtgatttagtttgcattctcctaattgctaatgatactgagcagcttttcatgtgcttactagccattcatatattttctgtaaagtgtctattgaaatctttttctcagtttttaaaagtgagtttttcttaatagttaaagacttctttacatattttggaggcaagtcctttgtcagatacatataattgagaatataggtgaccctgaacaacatggggttatggatgctgacccccctgcacagtcaaatctgcatataacttctgagtccccaaaacttaactactaatagcctgctgttgaccagaagccttaccgataaacagtcaattaacacatactttgtatatgtattatatagtatattcttataataaataagctagagaaaaaatactattaagaaaatcataaggaagagaaaatatatttactatgattaaatggaaatggatcatcataaaggtcttcatccttgtctatttcaagtttgagtaggctgaggaagaggcggaaggagggttggtcttgctgtcttacaggtggcagaggtgaaagaggtgaaagtccacaggtacacggactcatgtagttcaaatctgtgttgttcaagggccaactgtatttctcttgtagttggcttgccttttcatgtttttagttttgattaatgcatggattttaccatcatttttctctaacaagaaaggaatgtaagtttactctagcatatgataaacaggcagtctgagattttacagagcttattttctgaggagttcattgtattacatcatttcatttgcctttttgtcgttacatagtagatagggatatgtacctcccttcgccatcatgtaactgaaataactgaggaattgttattgtgctacaaaactgagaacagatgaagattctgtaatgaatacttagatcatctattttctgttgacattttgcctagatgatgtgaaattataactattgattctgttgaaagagagcaaaaaagaaaaaaataactattttgtgtattgtttctgacttgttagagatgctgtaacaatcaaaagtataaaagactgcttttttaggatagaatttttgacttttaattacttagactgaaagaagtttgaactgtaagccgacgatacctaatatattttaatgcggtcatagtttttcttattttttgacttttttttttttttcccccgagacggagtctcactctgtcgcccaggctggaatgcagtggtgagatcttggctcactgcaaccttcgcctcccggcttcaggtgattcttgtgcctcagcctcccaagtagctgggattataggtgctcaccactacgcctgactaatttttgtacttttagtagagatggggtttcaccatgttggccaggctggtctcgaattcctgacctcaggtgatccacccgtctgggcctcccaaagtgctgggattacaggtgtgagccactgcaccagcctattttttggcttttaattctgaattgtgggcttcattttttaatgattttggtttaattttatcaatcactgattttttttgtttttctgttaatctttgctttgctttttttttttttttttttttttgagacggagtttcgctgtgttgcccaggctggagtgcggtggcgcgatctcggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcgatctcctgacctcgtgatcctcccgcctcggcctcccaaagtgctgggattacacgcgtgagccaccgcgcccggcctttgctttgcttttaattgatagggcttatccagtttttctgggtgctaactccattgctgttgatttggttatagaatactaaattaaataaagtaagtattgatgaggagttaaattgttttagacttcagtataacatagtatctcattttttcagggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgaggtatgttttataagatttgcttttcaagtataaacactgtgatcccttgatgtccagcagggattgggactggagacttcctcatgctagtacagtgtagttagtattcatcactttggtgaatttactgtggcccagagccttctctttagcataagagaaattctggttgagtgagaatgggtttcattcttatcttaagggtaagtaagtacacactaatgaaactcaaatgaccactgtgtaaaactagtatactgtgagaaatcaactgtcatacaaactgttcagtctttgtaattattgatttattttatgcatagcatgtagcaagatttttctttttaatttaatttgtcttaacctggaaggttaaaccctttaatttatccctaatttcttaaaatatattaaatatatttgttttatattatttatcttataattccaatatctgtagtttttgtgggtttgagtctatgatttgtaatttttgctgattcttgcttatggtggcttgttttctcttgtgttcagtttttttgttactgttttttaaaactttaaaaaatagtttcagatttacagagtctttgcaaatttagtgtagaaagttcctgtatatttttcacctagcttccctgaaagttaaaatcttatgcggtcatggcacatttgttaaaactaggaaattgacattggtacagtattattactcagattttaccagttattccaccagtgttcctcattctgttccaagatccagtacagaatactgaattgcatttagtgttcagtgagttttgattgtgcattcatatttcctgtacttatttgtgggaattcattgagatctgggtttaaggtgaattctagaaagaatttgtgtttgcttctgccataaaaaggcattatatacctggtacctcctcaaacttaagaggttttttcctttcttttataatcttttaattatagtagtaatttatcttaagactttgtgtcacacagatagtgcggtttctagtcccaagttcaggcttttgatcaggaatctcagataatacttcttgttttttcttttttctttagagccaaggtccagacaggcatgttttcttttgtagggcagttttctgttttaaaaattcatccactgagaatcacctgtttggaagtataccagtttgagggtggagagtgcttttgatctgacctctcaccttttattgtccctacctatgtttcttgttgacttttcatgttctaaattcacaatccaagtcaatggtgaactacacagctggtgaactatggatggtgggccagtgctagcttgtggcctactttttttgtatggttcactagttaaggataatttttatcttttttagagcattgtcaaaaaagaagaattctatgtaccgtagactgtggcccacaaaacctaaaatatttactctgtggtgtttgacacaagtttgctattctttgtcctaagctatcagggattgtcatacattgttggtgctagcactgtgtctactggtagattagtatttccttgtgtttctggccccctactatcctgtcatcttatctgtgcattaaaaaggcatttaaaaatatattaaacataattttctgtttgttgtattggaatgaaagtctaaattttatattttttaatgtaattgatcagttttccccttttgtttatggcttctatttatttattttaatcttaaaactttctttaaattgatatatggatgtaaatagtctcttatttattcctccttttttttttttttactgagaaaggtgatagctaattcacccttaaatttataagactttttgttaaatgcattataacttagatgtctgcaagaaaaaagtcgatttatattctaacctagtattcccatctcaccaaattctcacttatattgtgtatgaacatttattaaatgtattaaagtttttataccagaaatgacatttcagggttctttttgcttccttttaaagtcattaaggttgttggatgaagaagaagcaaccgataatgatttaagagcaaaatttaaggaacgttggcaaaggacaccatccaatgaactgtataagcctttaagagcaggtaaaaatgtgtataaatgaccttcatttgaataaattcccaatttcgacccacgtttttgcttgattaaattaggctcagttgtaaattcatttttaccgaaactgtttttcctcagttttagtataaagattaaaaaagttcacaaaagtaatctgccaattgtcagaagtacagatttttaagaaaggtatgaagtgaaaagttaaaatgatcctccaactttcattttctgttccaaactctgtgcatattttattttatttattttttttgagacaaggtctcgctgtgtcactcaggctggagtgcagtggcaggatcacagctcgctgcagccccaacctccagggctcaggcaatccttctacctcaacctcctgagtagctgacactgtagacatgtgctaccatgcccggctgatttttgtattttttgcagagacgaggttttaccatgttgccctggcttgtcttgaactcctgggctcaagtgatccacctgcctccacttcccaaagtgatgagattacaggcttgaaccaccatgcctggcccctgtgcatattttaaaaacataaatgagagcatattacatttatggctttgtaatttttttcatttagtagtgaatcctgggtggtaaaaaaaaaaatgagctttaagttattttgaggccaaatttatgcttcttaagactttgattattaagattttgtgcttgctgagataaatgctatcttcatggtggctggagattagttttatttatctttgtaaaaagttcatatattattgagatttttctaaaaatcttttttttttttaagtcacattgctcttttgacagaggaatacttttaaaataaatggaccagtttttggagagaatgatttcttcttcattcatgagttataggaaaagattaatattaattaacttttatttggcagatagtaaccaccaaatgtattttaaggtatagctatgcttttgattttataagtgattttgtcatctttctaaaaacgagaacgcaaagactgtcaggagctgtttttattatgaagtgaattggggtctatagaaggggaggataagtaaagttggagactagaactcaacatataaccagccgataaacgttgctgttagaatcacttctgtgctctgcaaacttttattttctcccagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggtaagaaggacactttgatgtaggttgtcatctgcttaagaaaaccacattcaagccattttatataatgaactgccaatttcttattgtcaactttaaaaaaatgcagaaataaattggggttgttatatttaaagtagtatatagactgtgtaatagataattatactaatattaactgtcctgtaatagtaacttccatttattgaatgcccttttttgaactaaattttagatacttcataggtcaacagtatttaatttgggttttataaaagagagaagcttggaagtatagaaatttcctgaaatgaaaggactgggtatagccagatacacaaattctttatttcttacattattctatactcctttccaccttgtttcaccggaactacctttgaaaggaagattgacaaggtgtgcatgttaataaatggatagcaccatcatggtatttctactgatgacaggaaagagaaaattgaatagtagggcatctgatttggaaagtcctaaaagaagagaaagtgcaagtataatttaatgacctatcacagggagatagggtaagttagtaggaaaagatagaggtcccaaatctctgcacaggaaaacaagcgaaagggcaagaaatactgctgaaaacttcttgaaaaaagtgaatttcctgggatagtaagttttgaaaagtttgagttttgttccttatttgtctttccatagaagcattttatatatttcatgtatttattccaagacctactggatatctgctctgtgtaaggcactatggtaggtacattggaaaattaacatacaaattacacacaggctttaccctcaatttatgatccattgtggaatattagtcatgtacaaggatgactgtaatatagggaagaagtttaaaaatgtcacagggaaagtataggaagtatgttacgaggatttagatgaagtacttaaatttcagtaattttggagtagttctcttcagaggcttcttaagagattggcacattatgagaacagagtggataggcagaaaaagtaaacgtgtaggatcggagaagggctgagtagtggctgtgtctagagagttatccgaggtacagaggatctgcaaagacagcttttactcctgatttcttgtgacagaaggtttacagacatgttgagaatggctggaatctgtttgtttatttatttattcactaagtgtttgaaggcctactattccagaacagtgctgagcaccttggtccctaacataaagagacaaaaaactgctctgggttacctttagtgtagagtaaatgcacaggtactgggcacctctcaaagggaagagaaggctacatagttgaatgtgcattgaacctggatctaacgggggaacccaatggaacaaggaatgtgagttattgttttgaggacataggggagaaaaggaggtggtcagaagattaacttgtgaagaacaacgaacctgaagaagaaactgcagacccttcgaacagcaataaattttggtaccttttttattttagaaaaagatttctggttagtactttctttgtattctttttggtgtcttgtacatgactcagaattatgtggctttcgtcctttgattcttctgctttcagtagaaaagcaaaaatggtttgtgctaagcaaaatctgcattagtatgcactgatatattgctattttattcagttatatcagttttattaatccttacttgtgttacacaggagaaaggaacttttatagtcaatacgaagtaattttatggaagctagattttcttgacggggtaaccacaaaaatttcagtactctctgtatattcgtttgtcatgtgccttaatcaaataaggcaagcatcaggtttatcaaagctatttcagactggttataatagttgatgacggattttagccagaatttttatgataaaaactcagttttttgattgctgattagagtgatgcaaatgtacatgttttattaaaaagtccaagtttgatggtagggctgttttttcttttattgtgaagaagcctactgtctggttacttattttcagtctctttggacatctggttttagacattgagatactctgacaaattttgcagactagtggtaatttgtatttaaagatttttgtattaaatacctaggatcactgcttgtgattggttgcctatgatgtactgtggcctgaagtccagtctatggttggctggccaagccttggccctaatgtatatggggctgagtctagccagaggaaggaacatgtatttttttgcacaaggttgatgttcagttatactcaaagtgttacatctgctgggagtaatggagggggtacctttaaaaaaaaaaaccctttacctccttacaggtagagcataaagagaattgtttaaaactgtgtgccctcccagaggagtgccttttttggattcacagactagtggaggatctgcaaacacagcttttactcctgatttctcatgacagaaagtttatagacatattgacaatgactggaatctgtttgtttatttatttactcaccaagtgttttttgaaggcctactattccagaactgtgctgagtaccttggtccctaacataaagagacaaaaaactcctctaggttacctttagtgtagggtaaatgtatcaagtttctgcgttcgttgctgtagacatagttgcttatttgccttttctgaaaataaaatgacaaggttataaaagtaaaatagaagattttgttgagggcatttctttctttcttttttttttttgagacggagtcttgctctgtcacccaggctggagagcagtggcgcaatcttggctcactgcaacctctgcctcctgggttcaagcaattctcctgtctcagcctcccgagtagctgggactacaggcatgtgctactgtgcccagctaatttttgtatttttagtagagacggggtttcaccatgttggcctggatggtctcgatcgcttgaccttgtgatccacccaccttggcctcccaaagtgctgggattacaggcgtgagctaccgcgcccggcccattgagggcatttcttgtctcatattgtacttggtgctgttaaatgccacagaggattttaaatctaaaactggggtcaggaagctgtggcttgtgggccaaatccagcctgcctcttctctttgtatgttctgtgagctaagaatgagttttacatttttaaaatgtaaaactctactttctacttcattttttaaatggctgaaaaaaagtcaaaagaatgttttaatatgtgggcattatataaaattgagatttcagtgttaatacatttttgttgaaacatagctgcgctcattcatttacacattgtctttcacactacaaagcagagttaaaagagttgcaacagagactgtggcctactgaggcaaaaatatttcctgtttggtcctttaccaaaaaagtttttaagttcctgatctgaaagacaaagtattgacaacctaggtgatgccattcctgccattctgtttgacctcatctcctgttctgccttttgtttactatgcttcagccagagtggcgtttttttctttcctttgatcctgccaagcttgtgcctgccacaggacttttacatttgcgtttccttctgtgcagggctttcttcccatttccgtggctgttacctctttttcattagtcttagatgtcacctcttctccatctttgtcattgtctacccacattattctatttttgtgtatttgtttaatcctcccctttgcatatttatttaatcctctctggtccccaaatgaaggaaaagactgtttttgttagtagttgtgtccatagcatctagaatggtacccaaaacaaaagtatttgtttgaatgatcatcactggcagcctaacttaataaagggatacatttaattgcagttgaaaggtagctggagttgtgtataagaaataaatatgctaggattctaattatttatatactttgataacatgttaaacctcaaatttgaatttataagaaaatttaggcagtggttttcttattatcttggtcattcatttgtggaagcagtttaattcattttctacttcatttactctgttaaaatgaggccagtgccttataatctgaaatatgttaaactagtgtactgcatatgaatttttttaaaaagatgttcataatataagggatctctatctttgtgtggtagtccacaagttcgttcataaattcgttgtttgaaatggcatttttttttccccagaaagttagaattattgcatttttgaatatcacagaatttgttaactatttgaccctctctgtatcagtctggttggataccatggaagttgtggttagcttttcttcctaatctaagtaatatgattgaatacttaccctttgttagaagttatgttgagcactttatatagattatctcagtctgcacaacagtcctgaaataggtactattatgcccattttgcagttgtgaaaattgaattttcttagtagtaacctgtccttgattgcacagtaactaagtccattatggtctctaagggagtatagtcagagttgaagtgttttttattttctatgtaattacatttttttatgtaattacgtttcactttgttagacccatttgtttccatattcaagttttgaacttaatctcgttttttgagtgtgtaaaaaatgttcatgattcaaaaggtacatacagagaagcctcattccttttccctctacttctttcctgtatacttgctgtaagtaaccatattcgttagtttctggtttgtccttactgattttctttttgcaagaacaacaacaaacaacccccaccccaaattatgcatacatatgtatacatatatacatattatgtatatgtatatttattttctgattttccttctgtcttactcaaattgcagcatactgtatatgcttttgtatcctttttttctcatttaataatatgtcctggaagtcacttggaaggaaacttttattcacatcgtctgatatcaagttctgctaggtctttaaacagactttgtcatatccacccacgtatgattctttctcctcctccttccttttagagtttctgtggtttgatgctttctagactctaggaatcatatttctttctctttccacagccttctcccctgtaccctcttctttccctccctccctttctccttcccttcccccttccttcctctcttccgcccctccctcttctgttcctttcctttccttccattttaaaattaggatgtttaggagatatggatgtaaacaaggccaaaaaggaaattcacctacatttagcagaaacctcgagtctctggtcttcacaaagggatgttactttggacattcctatcaaggagctaactaagactgtggaagaaagagtagaataggaatttttagaaacaggcagttggtaggggaatccatgggaattggaattgctgctggtagtgagaaagacaggggtggagacagggctcgtgatgtcctcttcttcctttgtctttcccccagttttctttctatgagcatcattggggcaagcagaatagagagattgggttgatgttcttggtggtcttagcaaagtatgaagagatgagtgaaaggggcagcttgaaagtgctcattagaaggcacttgaacactatgaatatgaaggggtatttatgaatcaggtgggtataggtcagagagtgtcttgactgaatacaagagataaatctctgttttgtttttgtattttgttttgagacagggtttctctctgtcacccaggctggagtgcagtggcatgatcatggctcactgcagccttgacccactgggctgaagcaattctcctgcctcagcctttggagtagctgtgactgcaggtgcacaccattgcacccaactaatttttttttttcaatgtagaaatggggtctcactttgttgcctaggctgatctcgaactcctaggcttaggtgatcctcctgaagtgctgggattgcaggcatgaacctctacatctggcctaaaactcttaatggtatgaagagaggcacaagaaccctctttccttttcctctcccagtatataaaataaatgtggtatatacacttatatctgtatctttctctatttctttctccatctaccatgcttgcttcatagctgtctctatttctgtcttcacctctgtttctctatatctctctcagtctctctaggcaaaataggatatctacttacctagcaaaatcataccttcccctgcttcacagccatgattgggagggagtagaatgtagagtggctaagagattggttttggaactagtcagacttaggtctcaaatttcacctctgccccttagtagctgtataaccatgtcacttaatttttctgagactcgttatccctatctttggaatagaggtcataaatatatataccccatggggtattgtaaggaatatatgaaattatatttctgaagtgttttagcatggtgcctaacacataagagttcagtaaattgtagatgttggctattgttattaatgctgcttttgttttaatatgagtcaactgaaggtacagtgtctatctatataaacctgacgttcaatttatatttggctctctgagaaatcatctctctctcagcccgaatgaacctttatatattatttccttctcgaaattggctttttttttttttttttttgcagttaaactaaggtgtcttttttgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtgaaatttatatatttaataagatctgtgttttaaaaattacagaaaagatatgtctggactaaacctatattcagttaggaaaatgacattggagaatatctgtagttaagagtagaacttaatacatgtatattttgtaaaattaaacttggcacatcagttttatctatgaaacaaagtcacttcttttttttttttttttgagatggagtctctctctgtcgcccaggctggagtgcagtggcgcgatcttggctcactgcaagctccgcctcccgggttcacgccattctcccgcttcagcctcccgagtagctgggactataggcgcccgccaccacgcctggctaattttttgtatttttagtagagacggggtttcaccatgttagccaggatggtctcgatctcctgacctcgtgatcctcctgccttggcctcccaaagtgctgggattacagacgtgagccaccatgccctgcagaaacaaagtcatttctatggctaaaatgttgcatattacttaggagtgcttgatacttcagatatttttcatggttccaagtttttaatagctttggttttttttccatatgggaggaaaatcgaaattagttggaattactgatacctttaattgtatggctaacatacatacagacttcagtcattttttaaaaaaataatgcaaagtaaatatgttgagaagtttgaagttagttttcgtgtttacagataggtagtttggactaacaaatacttgaaagtttgcccttttaatagttaatatgcaaaattaaacatatatttctactcctaaacattgtatctatatatgatataaaataactccaaaaggtaaaataattttcatgttatattttttacaagtgttatatactaatagaaatctgtgatcattattggttgttttgactcctattggatttttgaaatttttacttaagaaagatttaaagcataatgaggcttcaaaagagtgtactaggtattctagtaattttgcatatgtatttaattacatatgattttcataattggaaaagatcaataaaaatgttatgagctatattaattttataaataaatgtaaatatgtaaatctttcttttaacaaggtctcacatcaggaattttcaaaaatgaaacaatctaataatgaagctaacttaagagaagaagttttgaagaatttagctactgcatatgacaactttgttgaacttgtagctaatttgaaggaaggcacaaaggtatgaagtacatgcaaaaggaaccatagctagcaagtacagatgtgaacgcatagtttggaagttaagtggtatttccagttgaaccaaattgctctttgcctagaattttagctttaatgccattgctgctgcgaagtttgttataggagggagaaagcttaatgaaggtggcaacatttcatgggaactttgaagaatgaattgcatatttcaactggcagaaaaggggtataaatattccaggtagcaggaattagcagagatgtcaatgacacctttttaagggataggaagttgactaatttgatgaattttgaggggcaggagtagtcaaagctgatttgtgatggaaaagcggaggggcatgacttttatgttctctgcggtggtttgctgaggacagacttgtggcctgcccaagtgtcagaaggcttactgaatatgtaagtactttcttgccttgtcctttaaaaagtttagggaattcgcttatatttctttttaccaatttgtttttgagggaacagtgatttttaagttttttcagatgcataattccttttggtacttaacttcataataatcactgaataaagttaccttgatataaatacagtaggtaaaatgtaaaaccctctgaagagagggtgaaaatactgcaaagccttccaaatagagaggatagtaaaatgccattttaatttggtttaaaatgctttgtttaaataggtaagctgagaaaaccctccagagagcctttagaaattcttttaagggtttctgaagtatgcttgcatttctgtagtgaatttgaaaacctaatccttccacttaaataggtttaatgttattaaacaattgacttttctctaggaattaggaaggttttcatgatcatgaatcttttaacttgttacattttttatgataatgttctgtaaaaatgcttttattatttttattttctttaggagtcttagatcatatttaatattaagttgttgggcctagtaaattgtataaatgtatctcatgcagatctcagttcttcggctctaactatcattgacaaattagctttagatcacattactctctggattaaaaaattgttcttgttccttacttgtatttgttctttgcttatagttttacaatgagttgactgaaatcctggtcaggttccagaacaaatgcagtgatatagtttttgcacggaagacagaaagagatgaactcttaaagtaagtctgttttgtgtaccaaattgtacttaaagaattttcttttaaaaaatcatgtagagacttttggtatgaacttggtagtatgagatagcaattttcctcttctcatggaagaaggaactagatagagtattttacaaagcaacaagtaaacagctgcataatctgggaatgaaaggatgaaaagaagcagaaactctagatgcaggaagtacagtgaggtcacagaaatgataaaaacagttcaggtggcagatctcaggaagtgccagtaaatacaagcaatttattttgaagtggcaaataggttccttacataaaactagagctatagaacatggaggagacagcatgaatagctcagagaataccagcaaaatcactttcagaaggaggctgctgagaaagcagggccagttaacatacgactcatttcctgctgagtaatcaatacagagtagcacagtgctgataaaaggtggaaaacattaacaaaatttaataaaacttcatagatgaagaacatttaccaaaataatattgtcacagaataggtgaaaattatgagcaaacatctgaccatgagctaaacaaaaacaacaacaacaacaaatgtaaggaggcaatcattctaaggccggggtccccaatcctggggccttggactggtactggttcgtggcctgttaggcactgggctgcacagtaggaggtgggtggcagacaggcgggcagctgggcgagtattactgcctgagccccacctcctgtcagatcagccacagcattagattctcataggagcgcaaactctattgtgaactgcccgtgtaagggatctaggttgtgcattccttatgagactctgactaatgcctgatgatctgaggtggaacagtttcatcctgaaatcatcttccgctcccctgtggaaaaattgtcttccatgagaccggtccctggtgccaaaaaggttggggactgctcctctaaggaacactttgagcagaaattccagaactgcaggaatatggtaagaaaacaggaagtgataagatgtgaggtgtcagaattcaggaaagaagtagaagggaagaataaaaccgtgacatgggaaagagcacaaagggcgaataaacactaaagaacacacaggaacacagagtagaaatgaggaaattaaaatgaaaccaaagtcaagaaagaattagagagaaaatgggcacagaagatctaatataggcaaaactgaatttctctcagaagaaaaaccagatagaacagttatttaacgttctgtaaacagaacacttatttaatgatactcaagaacattttcttaagtgaagattgttgaaagaggatatcatatggtaggggaaaatgacaagaactgtcagcatcaaggcatataaattattggccttaaaagataatggcagaatcctttaggcagtcaggcaaaacagtcaagccagtttataaaaaggtgaaaaaaattaggctggcagctctgtatgccagaagagagtggagtgattgctgtaatctcaaggatagtaaatatgagctaaagattttatatcatatagtaaatacatgctaaagattttatatccagactgtcttttgggtacataaaaagccatatattcattagtaataaatataaagagctgaaagagtcttataccgatgaccctttcagccaactagatctttattcatctctctgttcatattcatgaacagagaatgaacatgttcatgttcattcacctctctgctcatgttcatgagagaagttattttcttctacctctaacaaagagcaggttagttgtttttagaatatttctactaaacctataaaaagcaaataattagaatgttttaaaaatggttctaaatgtttaaaaaaaggtgatttttttttagatggagttttgctctgtcgcccaggctggagtgcagtggtgcagtcttggctcactgcaacctctgcctcccgggttcaagcagttcttctgcctcagcttcttaagtagctggcattacaggtgtgcaccaccacgcctggctaatttttgtatttttagtagagacagggtttcaccatgttggccaggctggtctcgaactcctgacctcaggtaattggaattataggggtgagccacccccccagcctaaaaaaagatgagtattctccatattagtcttaatgataaaaaaacctaacaaagattaatacaaaacagtctacagaccagtttcagttatgaatatggatgcagaagtcctaaataaagtatttgccagtaatagtcaccaggacgttaaaaaataattattgaccaaggggaggggggcatttattccagtttcagtattcagtattttcacatcaaaggaaagatcacaggtttgtcttaatagatgaggcagaagcatttgagaaaatgagtgttctgatactcagtaaaataagaatagatagaagatagatgcttccgtaacatgaaaatatatatatgtatgtgtgtgtatatatttctgcccaaaactcagtatagtgattaatggagaagcactataaacagttccctctgaagtcaagaacagacaacaaatgtcactgtcagcactatttttaaatactatactgcagtaccagccaagacaatcacatgagagagaaattaaaaaattggaaaggaagaagtaaaactagcactatttacagacattatgattgtacaactacttgaaaacccaagagaaccccaaaactctgcaaataataaaattattattactgaagttgttgatcataaaaataatttgtagaaatcagtggctttcatgtaaataaacctatagaggataagatgaagagacccacttacagtagcaacaaaaaggataaaatataaaatataagtttgtcatatatgagacctatgtgaagaaaacagtatttcaaaaagaaggcttgagcaagttaaaaaacatgttcttggacaggatgactcaacttcataaagatgtcaattctaagttaacttatgcatcaactgggcgtgatggcatgcacttctagtcccagctacttgggagattgaagtgggaggatggtttgagccctagagttctaggttgtagtgcgctatgattgtaccgtaaatagccactgtactccagtctgggcaacagtgagaccctatctctaataacaaacataaataaagaaataaacatatgcggccaggcgcggtggctcacgcctgaaatcccagcactttgggaggctgaggcgggcggatcacgaggtcaggagatcgagaccatcctggctaacacggtgaaaccccgtctctactaaaaatacaaaaaactagctgggcgtggtggcgggcgcctgtaatcccagctactcgagaggctgagacaggagaatggcgtgaacccgggaggcggagcttgcagtgagctgagattgcaccactgtactccagcctgggcaacagagtgagactctgtctcaaaaacaaaaacaaaacaaaacaaaagaaataaacatgcattcatatgcttttgatatgcaaacatgcttttgatatgcaaacatgcttttgattaaaaaaaatcagcagcttttcatttggaattagacaagttgatcctaaagttcaagtagaaaaagaaacaaggtcagccaggaaaacaataaaaagagtagtgaaggaatactagttctaccagatattaaggtatataataccatatttaattaaaacacagtggtactggtacatgattagacaaagacagaatagaaaatagaaatagattcaaatacatacgtgaatttagtgtaaaagatcttcagccaaccagaagaggtggacaactgcccagccatttagaaaataaaagttatctttataccagagtaagttctgagtggaccaaacttgaaatttgtaaatgaaatataaggtgtaaaatagaatggaggagaattccgtaataaagctgggatgagcaggatctaataactcctacttaaaatccagaagccattaaaaaaaaagaaaagaataagtttctcatagaaatatgataaacagagtcaggatatgacaaattgggaatccaatatttgaaacttattcacaggcaaaaggctaatttactttatttagaaaagaactcctagaagtgaacgagaagaaaacccaatagaaaactgaggagaagacgcaaacagaattttgcagacaaggaaatacaaatggctcttaaataaatgaaaaaaaatgaataccctcattcattataaaatacaaattaaaattagtctgaagtaatatttttcagattggcaagaatctgaaagtttgataatatgctttgttgtcacatgttggagaaatagatttcatacattgccgtgagaatacccaatggtgcaatccttgtgttgggcattttagctgtaaagaataataagactgcaaattcaaacatcctttaatccagccattctgtttttgggagtctattctgaggatatattagaatatgctagaaatgacatatttatgagcttattcatttctacattgcaaatagcagtaaaaaagtagaaacaaagtgaccagggctggtgaaataaagctatacttgtatagtgaaatgctgtgcagctattttaaaaatcagggtgttttcaatttactgatatggaaagatctccaagatagttatggtaaaaagacacagaacagtgtgtagagtatgttttgtgtaaaaaggaagaaaataacaaatatagaaattggcttgtttacgcacaaggaagctctggatattctaaggaagaaagattggaatatcgtcatttaaaatattttatatttcatatatctaatttaaaaatcaggtttgttgtaaacaagtatatattttatttacacttgtcaagtattttcagctcagtgattgaaaggtgaatgaaagatggaaaagtaggccatataataatattagcttttgaatatctgagagtttattttgttaaagtcgttgttaatactgaaggccaaaatcctttgaaatcttactggatataatgtataccggaaaagtatacataagtgtgtatcttgttgaatgttcacaaactgcgtacacccaggcaaccagcacttaaatcaatacacagaaaattctcagcaccctaaaagcattgttaatgcatccacccagtcagtcagtctttatctttcttttccagggcaaccgctatcctaacttgtaagaacatagattactttctcctgtttttgcattgtatataaatagaatcacatattatgtactcttccatgactggcttttattctacattatatttgtgagattcatcagtatagttgtgtgtatttgtagatcttttattctcatttctgcatatattttattatgtgaatgtacaagttatttattctactgttgaatattttgagtagttgccagttttgagcttttataaatagtgctggcatgaatgttgtaaatcactgctgtccagtattgctggtagcagtaaaaatatggaaacaagtcaaatgtctggttctggttaattaaataaaactacatctatatggtgaagtactatgcagtgacatatgcaattgaaaatgtaaaatttgtagtagccgtagttaaaaaaaaaaaaacaggtgaaattaatttcaatatttcatttaacccagtatgtccaaagtattattttaacatataatcaatgtaaaattacaaatgagagatattttactttttttcacactaagtcttagaaatctaatctgtatttttttttttttgtgagatggagtcttgctctgtcgctcaggctggagtgcagtggcacgatctcggctcactgcaacctccgcctcctgggttcaagcaattctctgcctcagcctcccgagtagctgggattacaagcgcccaccaccaagcccagctaatttttgtatttttagtagagacgggtttcaccatcttggccagactggtcttgaactcctgacctcctgatccacccgcctcggcctcccaaagtgctgggattacaggcgtgagccaccgagcccggcttaatatgtattttatacttacaacacatctcaattcagagtagccacatttcagatgtttgatagtcatgtgtggctaatggttactgtattagacagtacatgcttttggtgagcatgttatatgcagtgctgttgggtatatatcgaggtcaaaggatatgtgtgtatgctcagttgatattgtcaaatagttttccaacgtgattgtactaatttatattcctcctagcaatatatgagagtcctggttgctccacatttttgcccttagctattctgctgggtttgtagtattatctcattgtatgattttaatttttcattttcctgatgactaatatgtcctttttatatacttattagctggaggctttgctttttaatttctgttttcattgaaatctttcatcagaagtttaaagcgtttaagaagaatgaatattttactctgagctttactttcttttgactaatggtttgaatactactgtcaggttgttgggcatagtactagtggcattttattttatatctttttgctcttttacattattgattttatttaatagcattgatttatatcttttataagtggctaggaaattatcatttgctctataaatgtgttatttactgcaaccatccctagagtttatcaaaggaaaagaaaggtattgtgttaaagctttataatatacgtatatattttagatatttcaaaatctggccttttagaattttgatattgattaaaaacttatttattttataagcagttatttacttaagaagtagttttgttttttttttttgatgaatgtatactagttttctttatgtctggagtgactggggcccttcttgagagggaaggttggatgcggacagtgtggggctttgctgttaattgttaaatcagggcaaaaggtactgtctcagatgttttgggacatgtcatatttacttctttgtgtacgttaatcagtgcagtgaaaagatgattgacatcatgtattacatggagtgcattttaccttaggtattgtttagtgtgattttgggataaatttcaatttactgttagaggagacagaattttctaatatttaatactaaattgtaatagtattttcagcaatatatctttcatgagtttatcttagtgacaggtgatgtgttatcttttaatataaaatatttcaacgccacatttctttgaatatcttcaggaagtttttatctagaaatttgcataatggtttgcataaaaggttagccttttcacctgttttattttgtataaacactgatatagtgattaaaacattagctacataactatgagtcactgtagttttctgataacttttagatagatgatgttaggagttttttaaatccagggactaccttttattagagggtgggcagtcttttaggattacttgcccagtttgacacgtttcttactctagctgtaactgtgatctctgaaaatgtttactttttcccccagtcttcagaaatataaaaaagatacaacttcattttattaaacaataggaagaaagaggatttagattctagtcaagaataaaaatgtagtatattttgtttttttcagtttttgttatattgataaataattatacatattatggggtacatgtgatactttgatcatgaatacaatgtgtaataatcaaatcagggtaattaggatattcatcacatatttgtggggcacatgtgatattttgatacatgaatacaatgcataataatcaaatcaaggcaattaggatattcatctcaaacgtttatcatttctttgtgttgggaacattccaaatcttctagctattttgaaatatacaataaattatcattaactatcatcaccctatgctgctattaaacactagaacttatttattctctctgactgtatttttgtacctattatccaccctctcttcatccccaccccctactctttcttgactctagtaaccatcattctactctgtctccttgtttttagctcacacatatggaggagaacatgcaatatttgtctttctgtgcctggcttatttcacttatcatgatggcctccagttccatccatgttgctgcaaatgacagaatttcattatattttttatggctgaataatattccatggtgtatatatactacactatatccatttatctgctgatggacacttaggttgcattcatattttggctgttggaagtgctgcaataaacatgggaatacagatatctcttcagtatatggatatcctttctttaggatatatacccagcagtgggattgttggatcatattgtagatctagttttagttttttgagggacctccatactgttttccatagtcactgtactaatttgaaatgtagtatattttaaaataccatcattgtttggaatccattttctatgtttcatgtatgaagaaaagaaaagctgatattttatgtgtgttaatttttttctatcatgttaatttttaacactctgtctttgataagggacttgcaacaaagcattgccagagaacctagtgctccttcaattcctacacctgcgtatcagtcctcaccagcaggaggacatgcaccaactcctccaactccagcgccaagaaccatgccggttagtaggcaaataaatattttaaacagaggttttacattaacgatgattacttgttctaacggataaaacatgatttacataggaaggatctagtggttaccacctgcatcaggtaaccaaccttctgatattttgcaatatgtagaacacagcatcattcaagaattcttgacaaaaaaatgcttaacctgaatgtaatcaagcccttaaactttctgtttatagcaaataaaacaaatgataaaataagaagttaaattatgctattaggaaacaattggacaaatctttcacatgggacatttatatgaaataactgagttgatcatttctaaaagtgaatgtcatagattttttaaaaaagaggcatattctagatgaaaagagatgaaagtttccttataatcaaatgcagtatatgaactttatttgcttttggtttataaaaatagctatatgagcttttttgtgttaattaggggaaaattgaatttggagtggatatttgatgacattggggaatagcattagttttttaaggatgaaaatggtattgtgattatgtaggagaatatccttatgagaacttgagtgctgaagtctttagggctagtgtcatgaaatttgcaacttactttcaaatgattctgcaaatatatatggatgtagttatagataaagcagaaatgacaaatgttaatagttgttgaatttcattggtagatgtgtgattattttatatactattttttacaaattttctggtgtgtgacatttttcatgtaaagtttggggactaggaggagatgatggtagtaaacagtacctgtgctgcttccttccacctcaaatgtccaaccactggaggaagcagtaaatgattaaatatgaggcaccaggaaaagagcagtggctatggagtttccacaggttggaaaattattcaactatgatatatttctatagtaataagccggtatttaagaatgggaattaaaaatatatttggttggattctagagtttctcatatgtccttattaattttaattaatagcaatttgagagaaatatgaaacattttatagtcaatgctgactttttcttatagcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtaaggctgcaacattgtgtatcccaagttggctaatgttgtttctaggctctggctaacctgttaaaaacagggtcatcccttctccaaatggaggtgtcatgaatgaataagctacactgtcagcttatccagaaatgaaaataatgttatggtcacttacatgaataggatagctatttcctaggcttttaaaatttatgtttttatattttacatattgggtttatattaaataatcttttctgtattatagagtttagtaggtgtttccttggactttaggtgataaacaggtaccttttctgagcgtagcatagcaaaactgataaggccttgtttacgtccctatacttagaatacttggcatttaataaacagttgaatagaaatttatctaattatgggttgcactttcttaaaggttaatctctgtggtaatttcttaattttaaaaatccaaacatttgactaccttttaagatgtgctctaaattttacttagtaagtacatgttgtctgccaaatattagaactttataagttgtaaatttatgtatatcacagtgaatattgaatattgtggaagaggaatgtatttagatgactagttttgccacgttaaaatgaagggtctccattttttttctttctttaatactcgaatatttaatcttattttcttcagtatttatttttggatagtattaaacacttggtactcttttgttttaattaataacaggataggaatgcttttctctgacaagtgccttgaaacagtttttttcactccactgttctttaatagactaaaaaatagaaatgactttcatgaaaaacgtagttctagaatgattattgttttattttttagtatttgatttaccaatcaagatttttctgttttcttctatcaggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggagtattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctta

SEQ ID NO: 1366 - DNA, 71130 bp, Homo sapiens; identical to SEQ ID NO: 1365

SEQ ID NO: 1367 - DNA, 41066 bp, Homo sapiens
ttcaattggaagaaaaaaaatttaattcatagatttcaatccacacaaaatcatgtcgtcttctctgtttacacctaatgactaaccttaatctctaaaccattaatggggtgattctaatttctgtcttcttttcctttttcttcctgcatcccatgttgtctgtggtggtttgtgtggttggactctcccctggtcagtatttttatttccaggaggtgttccctgtcttggctgcaaagcactgtatcatgcaggccaatgctgagtaccatcagtctatcctggcaaaacagcagaagaaatttggagaagaaattgcaaggttacaggtgagtctcttggtaataaatatttaagtaactaacttggatctctcttttttttcctagtgagatttccaagtttgcccataaaaacctttcccgttcatcacccctatcagcagggacaagtgattgtttttatctttagactttactgcatgtttttttgaggtctcatattttatctaaaaaatagatgcaaaatttgcattcaattctcttttttatccatgtttattttaatgtaaaaataattctaaattaattgccatctccagattgtttttgtctttagactttactgcatggttttttgaggtctcatattttatctgaaaaattcatgcagaatttgcattcagttctcttttttggtcatgtttattttagtgtaaaaataattctaaattaattgccatgctccaggagtatgtgtagtgtttaacttgtggcctggtctttgtctaaactggggcatatacttccacaacttgaggacgacagtggagagatgtgtgtgcatatatatatatatacacacatatatctcttgtgaacagcagagtaccttctatgcagttgtgttcatactgttggcattggggttgtcagaaacttgctgtgacattatggcacctgaggcaacttgccagcaggagcaagagctgtttgtatgagttgtttgtgttttgagtattggtagacagaggatagaaagatgacttatggcatttgagttagggaagtttaaatatgtactgatttttagaagatactatggatgtcttggttcattttgtgctgttatagcagaataccacagactgggtaattgataaagaacagaaatttgtcacaattctgaaggctgagaagtcgaatatcaaggtgctggcatctggtgagggcctttgtgttgtgttacctgtggtgaaaggtagaaaggcaagagagtgctagtgagtgagagagagcaagagggagccaaactgctcaatgaagcccctctcttggtaactaaccctctcccatgataatgacattaatctattcatgagggcagagccctcttgacctaatcacctcttattatgcccccacgtcccaacactttgggattgggaacacatgaactttgggggacacattcagaccataacaatggaaatgttgtttaggaggttcagattaattaattagccttttcatgggaaaggatctcacagtgaccaaatcagagaaagtctttttaaaaaagtcagacccagatgtgtctggggcttcactttgattacagtaacttagatttatatataaaaatgattctgaacaaggaatttgtgggaaggattctttttttaaggctagcatatttaaattgtaagtttagtttctttattttctggtttctgggactattagatttaagtaagcccatatttagtctctataaatcagtcagagaaagaactccttttgaaatttaatctcatttttaagtacccctgaaaaaggaaactatttcagattcacacaatgggagggaggtaaatacttttcctcagttatagacacatagattttgcagctttagttttacagctttagttataggttaaagttaagacagaagttgggtgtgatggcacctgcctgtagtccagctacttgggaggttgaggtgggaggatcgtttgaagctagtagtttgaggccagcctggacaatatagtgacaccccttctcaaaaaaaagttaacacagaacacactcactgatccatatttcagaggacagttattctttccggtaggcatgaaatattttttaattgatttgcactcccaagaagacaaacagaacagacaagaagttgaccaataaaccatattcgctgtagtttctcacttagtagagaataataccccatgattctgacggagatcttaggaggtcacactattaaaccaactttctagttatggctactagcaaagagaaataacttattggtcctgtgcaaaccagaaatgaaaataaaatcacaatcaggaaaatcaaaacaatagataaaatggcagcaaaggtaaaataactgcttggaatcaatcacttctggggccaagaaaaattgtacctgagcttaatacagctcatgagttgcacttcttgaacagtgcagtttatgtggccccagaagatggatcttcttggtcatcttggtggatcttcaaagatgatgaaatacagttttcaaaaagatacagaaacacacacacacacacacacagatataaaaacatgactcacatagaatgactacatgtcaaagatttatttgactcattaatgagggacctagcaagattgtaaatctgattttgtgcaagtattgttttcttagttatggtactaggttgtaggtattaaggagattgtcattatagaatacttgctgatgtgtttagggatgagggcttataacatctaacttcagtttcatgtagttctgcaataaaagaaaaaatagtacttaattatgtgtttgtatgggaaaggaatagataaagcaaatgtggcaaaatggtaattgttgaacctagctaattattttgtgggcttgaaatttttcaaaattgggaaaataggtatatataaggttatatagttcaattcctgttcctctttttccctctatcctgttccctccatccattattcctactgccccatagttaatttccattaatttcttgttttttttctttctttgaaatagaagcaaatatatacatagacagcacacacacacacacacattgcacattctcacttgtcattcttactgaagtggtagtatgctattaatatatacagtgttgtgtaccttcttttctcatataacaatgtatcctgaagatctcttcatcttaattcagcaacagggagaccatccttagagctgcattgtacttcactgtgtaagccacagtttattgctgtctcctgttgctggatacttgaatgtttccaagatttcactgttataaacaatgctacagtaaaaaatcacgtacacaagttatcttgtacttcagcaggtgtcttagcttaggctgccataagaacaccataaactgggtggtttaaacaacagaaatttattttctgatagttctggagcctggaaatccaaggtcagggtgccagtatggtcatattctggtgagatttacagatggccttctctctgtgtcctcatatggtgaacagcaggaggaagccctctggtgtctcttcttgtacgggaactaatcccctatgaggccccaccttcatgacctcatctaaaccccattattttccaaaggtcccatgttcaaataccatcacattaggagttagggattcaaaatacgaaatttggggagcacagtcccgtacatagcagcaggtatatcttaaataaattaatagaaatgggattgccaatagcaaaatataaatatgtctgtaatttgttacatatttggattgttgatccacttggaatttatcctgatgtgtggtgctagatatggatccagtttttaaagtcttcttccaaatggctagcccattgtccccaaaccatttattttataatagccttgtttacctcactgatctgacattctgactttatcacacattagattcacggtatatattgggatctatttctgcttttattgtttcattgacttgtttatctgttcatactccagttccatatcattttagttatttatacttgagactgttttaatgtctgataggtattatctctcattttttgaatttttctgcctgtccttgcttgtttcctaaattttgtcattttctgggttttcctgactattcttgcatgtgtttcttcatatgaattttcttttgtttaactatgatggaaaacatatataaaagtgtagttgtgtaactatgatggtcaaacatatataaaagtatgaatcattgaacttctgttacccaacttaagtgattatcagtatttcgctattttgtgttttagttatttctcctttcctcatttttttggagtattttacaactatctcacgtatcatttcattcttaagttttttagcctgtgtctctaagagataaagatttaaaaaaattaaaaaacaaaaatttaaaaaattaagaaattttgctagatgggtcattatcccaatctagcaaaattaatattaatattaattagtagttaatagtcataatccagtattatccacatctagtttagttttccctgatttttttctcaggggtcttggtttgttcaaatcaggatccacacaaagtcctcactttgcatttgattgatatgccctctaaatctttaatttgtaacagcctcctccttcccaacttctgtgttgttttcttcactttttcttgttctgtatgttttttactatgatttctgtgatgtctgttttcccttttgctccttgtataaatgtctcagtcttgctttcttaaataaatttgtatttttctttacttttgtgagttctgtcacttcctgtttcatattcttttgctatttggctatcactcactctggtttgggccatccagtcctctgttcttttggtactgtcattgtgttcttaagtgttttagtttagtttagtttttagcatgctgttttcatctgctttgcggcaatatttctttggtgagctttcattatctactggaaagatatactgcttgttttcagttttttccttatggtttttttgtattgagagatgagttgacttttcagttacttaggtttgaatgagattgattttgctgggggttcctgtgcagggaaatgggcaggggttagctttacaagcatcattgtgttaagggctccctcctaaggtccacttctctggctcttaaagcctaccctggattaggaagaatcccactacctctgtacctgtgcttccctgaattcctcacagcctttgcatttcaagttgatgcatctacttttagggtttatattttgctggcattttctgagtgcttatgccctttcttctccctccctacttttctgttctctctttctgctccccctagcaaccctgtctttttagttaatctgtctacttctttttctcaccagctctcttgggatgaggcccctcagcatcacatttttttctgtggtcccctggtggcatgataggggccagttggctttgcctttaccgtcacctggcaaggttttctcatcctgttttgttgttttcagatttgcttaaagtaattttaacttagggtggcacccttagcacttccctttcttccccctctgtgtatagcgtacctacggttctggtactagtgtttgctatttgggggagggttcaaccacatttacaaatcaaatttgatttacaaatttaaaaagtgatttaaatttgtgcaatttcccgtttcctagtttacactgaagggtagcttttgttttgttttggttatctttctctaagcatgataccagctttggaggttaagatttttatcatgttaaggaactataatttctattttacgaagattttaaaaaatcaagaatattgaattttatcaaatactttttcaacatctatggagaaatttgattttttaacttattattttggagaattatataagtagattttctagtattaaaccatttttgtattcttgttattttggtgttttagacttgccttatctcttcatctggtcattttatagatgtagatgctttctatatgcctgagaatataatgtgttctctatttgtggagtctagtgttctctatgtctggtaaaccaaactcgttaattgtgttgctcaaatcttctataatcttacacttttttttaatctggtccagccattgctgagacagatatgttaaaatcttccactttgattatgggtaaatgtgtcaatttctcattataattgtttatatagatactattacatgcaaaatataagaaattttacatctttctggcaaattggcaaatattaaaagattatgtattatatttatccctaataatgctttttattttatatggtgtcactatatctaataccacctaaatttgtatgcggcttatgttcatttttttataaggccaaacttaaaaaaaaattcttattgatgttgacatgttgttcacttcctgtgttgttggataatttttttcagatccaccctttcactgagagttaggccgtttgaggttcctgccttcatgtgaaggagtgaaagaggtgcatctcaattctctgtgttgtgtggtttccagacccttgtttcagttctccatgagggcctttaataagttttaattgctaattctttggatgtagaaataacccaacagccagacagggcacagtggcgcaagcctgtaatcccagcactttgggaagctgagttgggcagatcacttaagatcaggagttggagactggcctggccaatatgatgaaacccgatgtctaccaaaacatacaaaaattagcttggtgtgggggtgcacgcttgtaattccagcttcttggaaggctgaagtgggagaattgcttgaacctgggaggtggaggtcacagtgagccgagatcgcgccactgtgctccagcctgggcgtcacagagtgagactctgtctaaaaaaaaagaaggaaaaaaagaaagaacccaacagccagctttcttcaatgtcagtttatactgatgggctcatggatttcttttattatcttgataatctgcctgtgtgtttatagagatagctgttatgtattatccttcagttttcgggtattttgtgatcggagaatttccaggtaaccctgtcagccacattgctggaaatgcaagtcttcagattaaagattttttttttgaaaccaatgcttaaatacttggtggggaaagagaaataaaatcacctccctcttttttttttttgttgttgacgtttttctttttagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactggtatgtcagttattcagacacactttaatctcatttttctctagtttactctgtttttcctagctaaaaatcacataattgctgttgtatgctttgaatataatttgtattcatgttgtttaaaatgaatatgagaataaatattgtgccagtgcaatgttaagatggaaagtaaacaataataaagcatatgtaaagtatacaatagttagaagacttgaaactgtgtgtttgattaagactgtagcacttgtcattttgttaacttttgttatttaagatgctgccattaaaaataaacaaatatggctggatgtggtggctcacacctgtaatcctagcactttgggaggctgagatgggtagattgcttgagctcaggagttagagaccagcctgagcaactggcaaaaccctgtctctaccaaaaaaaaaaaaaaaaattaactgggcatggtggtgcatgcctgtggctttagctactctggaggctgaggtgggaggctcgcttgagcccaggaggtggaggttgcagtgagctgagaccgtgccaccatactccagcctgggtgacagagagagatcttttctcaaaaataaataaataaataaataaaataaatataaaaataaaccacaaaaatatatatttttttcttttcttttttttttgagacggagtatcgctcttgttgcccaggctggagtgcaatggtgctgtctccctcactgcaacctctgcctcctgggttcaagtgattctcctgcctcagcctcccaagtagctgggactacaggcgcctgccacctcgcccagctagttttgtatttttagtagagacggggtttctccgtgttggtcaggctggcctggaactcccgacttcaggtgatccacctgcctcagcctcccaaagtgcttggattacaggcatgagccaccgtgcccggcctatttctttaaacatgtaaacttctggagtggtatttgtatgagataaatacatgttattatattgtagatgtatacaacagatggtagcctctagctgagattccaaggagaatattctgttactgggaaagggtgattatatgtttatttagcaaacacaaagtgtttaccatgtgccaggcactctttaagcactttacaaatattagctcatttgttttcagaagtgccctgagatgggtactgttattatccctatttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctgttgcccaggctgtggtgcagtggtgcaatctcggctcactgcaacctccgcctcctgggttcagacgattctcctgcctcagcctccccagtagctgggactacaggctcctaccattacactggctaatttttgtatttttagtagagatggggttttgccaagttggccagactggtcttgaactcctgacctcaggtgagccacctgcctcggcctcccaaagtgctgggattacaggccttagccactgctcccggcccctcattcagtttaatcaacagatgaacagtgtcactgaagatccctcaaactcagtgatgaacacatctgaaaaagaaagaaaattaagttcaaagaagaaacttttcattgttgccgttgtccatgaatgtagtgatctaaaaattctctttatcattgtgctttaaatagtgatttagttttgatctttaaatgtcaatagacaataaatatttatagactatgtgaatattggaaagaaaatataaacagtcacttttacagttcgggtttttgtctaaaaattttgttgtaatttctcttcctaattttagatctgtttgagaagatggttcccgtgtcagtacagcagtctttggctgcctataatcagaggaaagccgatttggttaacagatcaattgctcagatgagagaagccaccactttggcaaatgggtaggtagagcttaattttagagcctaaagttttccgtttggttgttctttagtttatgaacattttagtttctgagcttagagctaaatgtcaagagtatataaaatagaaaatgtagacacacacttacaactatttttgttggacactgtatttatgaagctctagcaaatatagttggaagaaattatagaaacaaggtgaggatatgaggactaaaaatttgtattttaagaggtatttatttggaaatgagaagtagaaatgaactcagatacatggtacatttagtgttctgaaccaatttttgtttctgatggactgaatactaagaaaataattcattggtttaaaaaatttttaggtatattttacacacacaaaatacacctattctaagtgcacagttcaattattatatgtatatgtgtgtgtgtgtgtgtatgtgtatatatatatatttatgtatatatatatattttttgttttttgggacagggtcttattgtcaccaggctggagtgcagtggtgtaaacactaaacatggctcactgcagtctcaaccttctgggctcaggtgatcctcctgcctcagcctcctgtgtagctgaggccacaggtgcaagccaccacacctggctaattttttgatatttttatagagacaagatctcactttgttgcccaggctggtcttgaactcctgggctcaagcgatcctcctgccttgacctcccaaagtgctgggattacgggcatgagccaccatgcttggtcatttagttagttttgataaatgtatgtacccatgtaaccggcactatgattaagttagagaacattactgttaccctaaaaaaattctctcatgcccctttcccagtccttcttcttttagcccctggccgctattgatctgctccctgtcttaagtttagttttactttttatacaatttaaaacacgtgtaatcattctagcatatgcatatacagtacttacagtatgtacagtatatacttagaatgtgttttgctttttttcacttagctactgtttttgagattcatctatattatgtgtatcagtttcagtcttttctatggctgagcagtattccattttatggttatagggcagtattccattttatggttatacggcagtattccattttatggttatagagcagtttgttaactctttcacctgttaatgggcatttcagtttctgtgaacattcatgtataaatcttcgtgtggacatattttagttctcttgggtaaatacttaggagacaaattgttaggttgtgtggttagcatatttaattttatacaaaattgccaggttgttttccaaagtggttgttccattttatatcctatctgcactgtttgaaaatacaattgttctgcatcctcaccaatacttggtatgtcagtctttttagttttagctactttagtgtgtgtgtagcagaatctcactgtgatttagtttgcattctcctaattgctaatgatactgagcagcttttcatgtgcttactagccattcatatattttctgtaaagtgtctattgaaatctttttctcagtttttaaaagtgagtttttcttaatagttaaagacttctttacatattttggaggcaagtcctttgtcagatacatataattgagaatataggtgaccctgaacaacatggggttatggatgctgacccccctgcacagtcaaatctgcatataacttctgagtccccaaaacttaactactaatagcctgctgttgaccagaagccttaccgataaacagtcaattaacacatactttgtatatgtattatatagtatattcttataataaataagctagagaaaaaatactattaagaaaatcataaggaagagaaaatatatttactatgattaaatggaaatggatcatcataaaggtcttcatccttgtctatttcaagtttgagtaggctgaggaagaggcggaaggagggttggtcttgctgtcttacaggtggcagaggtgaaagaggtgaaagtccacaggtacacggactcatgtagttcaaatctgtgttgttcaagggccaactgtatttctcttgtagttggcttgccttttcatgtttttagttttgattaatgcatggattttaccatcatttttctctaacaagaaaggaatgtaagtttactctagcatatgataaacaggcagtctgagattttacagagcttattttctgaggagttcattgtattacatcatttcatttgcctttttgtcgttacatagtagatagggatatgtacctcccttcgccatcatgtaactgaaataactgaggaattgttattgtgctacaaaactgagaacagatgaagattctgtaatgaatacttagatcatctattttctgttgacattttgcctagatgatgtgaaattataactattgattctgttgaaagagagcaaaaaagaaaaaaataactattttgtgtattgtttctgacttgttagagatgctgtaacaatcaaaagtataaaagactgcttttttaggatagaatttttgacttttaattacttagactgaaagaagtttgaactgtaagccgacgatacctaatatattttaatgcggtcatagtttttcttattttttgacttttttttttttttcccccgagacggagtctcactctgtcgcccaggctggaatgcagtggtgagatcttggctcactgcaaccttcgcctcccggcttcaggtgattcttgtgcctcagcctcccaagtagctgggattataggtgctcaccactacgcctgactaatttttgtacttttagtagagatggggtttcaccatgttggccaggctggtctcgaattcctgacctcaggtgatccacccgtctgggcctcccaaagtgctgggattacaggtgtgagccactgcaccagcctattttttggcttttaattctgaattgtgggcttcattttttaatgattttggtttaattttatcaatcactgattttttttgtttttctgttaatctttgctttgctttttttttttttttttttttttgagacggagtttcgctgtgttgcccaggctggagtgcggtggcgcgatctcggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcgatctcctgacctcgtgatcctcccgcctcggcctcccaaagtgctgggattacacgcgtgagccaccgcgcccggcctttgctttgcttttaattgatagggcttatccagtttttctgggtgctaactccattgctgttgatttggttatagaatactaaattaaataaagtaagtattgatgaggagttaaattgttttagacttcagtataacatagtatctcattttttcagggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgaggtatgttttataagatttgcttttcaagtataaacactgtgatcccttgatgtccagcagggattgggactggagacttcctcatgctagtacagtgtagttagtattcatcactttggtgaatttactgtggcccagagccttctctttagcataagagaaattctggttgagtgagaatgggtttcattcttatcttaagggtaagtaagtacacactaatgaaactcaaatgaccactgtgtaaaactagtatactgtgagaaatcaactgtcatacaaactgttcagtctttgtaattattgatttattttatgcatagcatgtagcaagatttttctttttaatttaatttgtcttaacctggaaggttaaaccctttaatttatccctaatttcttaaaatatattaaatatatttgttttatattatttatcttataattccaatatctgtagtttttgtgggtttgagtctatgatttgtaatttttgctgattcttgcttatggtggcttgttttctcttgtgttcagtttttttgttactgttttttaaaactttaaaaaatagtttcagatttacagagtctttgcaaatttagtgtagaaagttcctgtatatttttcacctagcttccctgaaagttaaaatcttatgcggtcatggcacatttgttaaaactaggaaattgacattggtacagtattattactcagattttaccagttattccaccagtgttcctcattctgttccaagatccagtacagaatactgaattgcatttagtgttcagtgagttttgattgtgcattcatatttcctgtacttatttgtgggaattcattgagatctgggtttaaggtgaattctagaaagaatttgtgtttgcttctgccataaaaaggcattatatacctggtacctcctcaaacttaagaggttttttcctttcttttataatcttttaattatagtagtaatttatcttaagactttgtgtcacacagatagtgcggtttctagtcccaagttcaggcttttgatcaggaatctcagataatacttcttgttttttcttttttctttagagccaaggtccagacaggcatgttttcttttgtagggcagttttctgttttaaaaattcatccactgagaatcacctgtttggaagtataccagtttgagggtggagagtgcttttgatctgacctctcaccttttattgtccctacctatgtttcttgttgacttttcatgttctaaattcacaatccaagtcaatggtgaactacacagctggtgaactatggatggtgggccagtgctagcttgtggcctactttttttgtatggttcactagttaaggataatttttatcttttttagagcattgtcaaaaaagaagaattctatgtaccgtagactgtggcccacaaaacctaaaatatttactctgtggtgtttgacacaagtttgctattctttgtcctaagctatcagggattgtcatacattgttggtgctagcactgtgtctactggtagattagtatttccttgtgtttctggccccctactatcctgtcatcttatctgtgcattaaaaaggcatttaaaaatatattaaacataattttctgtttgttgtattggaatgaaagtctaaattttatattttttaatgtaattgatcagttttccccttttgtttatggcttctatttatttattttaatcttaaaactttctttaaattgatatatggatgtaaatagtctcttatttattcctccttttttttttttttactgagaaaggtgatagctaattcacccttaaatttataagactttttgttaaatgcattataacttagatgtctgcaagaaaaaagtcgatttatattctaacctagtattcccatctcaccaaattctcacttatattgtgtatgaacatttattaaatgtattaaagtttttataccagaaatgacatttcagggttctttttgcttccttttaaagtcattaaggttgttggatgaagaagaagcaaccgataatgatttaagagcaaaatttaaggaacgttggcaaaggacaccatccaatgaactgtataagcctttaagagcaggtaaaaatgtgtataaatgaccttcatttgaataaattcccaatttcgacccacgtttttgcttgattaaattaggctcagttgtaaattcatttttaccgaaactgtttttcctcagttttagtataaagattaaaaaagttcacaaaagtaatctgccaattgtcagaagtacagatttttaagaaaggtatgaagtgaaaagttaaaatgatcctccaactttcattttctgttccaaactctgtgcatattttattttatttattttttttgagacaaggtctcgctgtgtcactcaggctggagtgcagtggcaggatcacagctcgctgcagccccaacctccagggctcaggcaatccttctacctcaacctcctgagtagctgacactgtagacatgtgctaccatgcccggctgatttttgtattttttgcagagacgaggttttaccatgttgccctggcttgtcttgaactcctgggctcaagtgatccacctgcctccacttcccaaagtgatgagattacaggcttgaaccaccatgcctggcccctgtgcatattttaaaaacataaatgagagcatattacatttatggctttgtaatttttttcatttagtagtgaatcctgggtggtaaaaaaaaaaatgagctttaagttattttgaggccaaatttatgcttcttaagactttgattattaagattttgtgcttgctgagataaatgctatcttcatggtggctggagattagttttatttatctttgtaaaaagttcatatattattgagatttttctaaaaatcttttttttttttaagtcacattgctcttttgacagaggaatacttttaaaataaatggaccagtttttggagagaatgatttcttcttcattcatgagttataggaaaagattaatattaattaacttttatttggcagatagtaaccaccaaatgtattttaaggtatagctatgcttttgattttataagtgattttgtcatctttctaaaaacgagaacgcaaagactgtcaggagctgtttttattatgaagtgaattggggtctatagaaggggaggataagtaaagttggagactagaactcaacatataaccagccgataaacgttgctgttagaatcacttctgtgctctgcaaacttttattttctcccagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggtaagaaggacactttgatgtaggttgtcatctgcttaagaaaaccacattcaagccattttatataatgaactgccaatttcttattgtcaactttaaaaaaatgcagaaataaattggggttgttatatttaaagtagtatatagactgtgtaatagataattatactaatattaactgtcctgtaatagtaacttccatttattgaatgcccttttttgaactaaattttagatacttcataggtcaacagtatttaatttgggttttataaaagagagaagcttggaagtatagaaatttcctgaaatgaaaggactgggtatagccagatacacaaattctttatttcttacattattctatactcctttccaccttgtttcaccggaactacctttgaaaggaagattgacaaggtgtgcatgttaataaatggatagcaccatcatggtatttctactgatgacaggaaagagaaaattgaatagtagggcatctgatttggaaagtcctaaaagaagagaaagtgcaagtataatttaatgacctatcacagggagatagggtaagttagtaggaaaagatagaggtcccaaatctctgcacaggaaaacaagcgaaagggcaagaaatactgctgaaaacttcttgaaaaaagtgaatttcctgggatagtaagttttgaaaagtttgagttttgttccttatttgtctttccatagaagcattttatatatttcatgtatttattccaagacctactggatatctgctctgtgtaaggcactatggtaggtacattggaaaattaacatacaaattacacacaggctttaccctcaatttatgatccattgtggaatattagtcatgtacaaggatgactgtaatatagggaagaagtttaaaaatgtcacagggaaagtataggaagtatgttacgaggatttagatgaagtacttaaatttcagtaattttggagtagttctcttcagaggcttcttaagagattggcacattatgagaacagagtggataggcagaaaaagtaaacgtgtaggatcggagaagggctgagtagtggctgtgtctagagagttatccgaggtacagaggatctgcaaagacagcttttactcctgatttcttgtgacagaaggtttacagacatgttgagaatggctggaatctgtttgtttatttatttattcactaagtgtttgaaggcctactattccagaacagtgctgagcaccttggtccctaacataaagagacaaaaaactgctctgggttacctttagtgtagagtaaatgcacaggtactgggcacctctcaaagggaagagaaggctacatagttgaatgtgcattgaacctggatctaacgggggaacccaatggaacaaggaatgtgagttattgttttgaggacataggggagaaaaggaggtggtcagaagattaacttgtgaagaacaacgaacctgaagaagaaactgcagacccttcgaacagcaataaattttggtaccttttttattttagaaaaagatttctggttagtactttctttgtattctttttggtgtcttgtacatgactcagaattatgtggctttcgtcctttgattcttctgctttcagtagaaaagcaaaaatggtttgtgctaagcaaaatctgcattagtatgcactgatatattgctattttattcagttatatcagttttattaatccttacttgtgttacacaggagaaaggaacttttatagtcaatacgaagtaattttatggaagctagattttcttgacggggtaaccacaaaaatttcagtactctctgtatattcgtttgtcatgtgccttaatcaaataaggcaagcatcaggtttatcaaagctatttcagactggttataatagttgatgacggattttagccagaatttttatgataaaaactcagttttttgattgctgattagagtgatgcaaatgtacatgttttattaaaaagtccaagtttgatggtagggctgttttttcttttattgtgaagaagcctactgtctggttacttattttcagtctctttggacatctggttttagacattgagatactctgacaaattttgcagactagtggtaatttgtatttaaagatttttgtattaaatacctaggatcactgcttgtgattggttgcctatgatgtactgtggcctgaagtccagtctatggttggctggccaagccttggccctaatgtatatggggctgagtctagccagaggaaggaacatgtatttttttgcacaaggttgatgttcagttatactcaaagtgttacatctgctgggagtaatggagggggtacctttaaaaaaaaaaaccctttacctccttacaggtagagcataaagagaattgtttaaaactgtgtgccctcccagaggagtgccttttttggattcacagactagtggaggatctgcaaacacagcttttactcctgatttctcatgacagaaagtttatagacatattgacaatgactggaatctgtttgtttatttatttactcaccaagtgttttttgaaggcctactattccagaactgtgctgagtaccttggtccctaacataaagagacaaaaaactcctctaggttacctttagtgtagggtaaatgtatcaagtttctgcgttcgttgctgtagacatagttgcttatttgccttttctgaaaataaaatgacaaggttataaaagtaaaatagaagattttgttgagggcatttctttctttcttttttttttttgagacggagtcttgctctgtcacccaggctggagagcagtggcgcaatcttggctcactgcaacctctgcctcctgggttcaagcaattctcctgtctcagcctcccgagtagctgggactacaggcatgtgctactgtgcccagctaatttttgtatttttagtagagacggggtttcaccatgttggcctggatggtctcgatcgcttgaccttgtgatccacccaccttggcctcccaaagtgctgggattacaggcgtgagctaccgcgcccggcccattgagggcatttcttgtctcatattgtacttggtgctgttaaatgccacagaggattttaaatctaaaactggggtcaggaagctgtggcttgtgggccaaatccagcctgcctcttctctttgtatgttctgtgagctaagaatgagttttacatttttaaaatgtaaaactctactttctacttcattttttaaatggctgaaaaaaagtcaaaagaatgttttaatatgtgggcattatataaaattgagatttcagtgttaatacatttttgttgaaacatagctgcgctcattcatttacacattgtctttcacactacaaagcagagttaaaagagttgcaacagagactgtggcctactgaggcaaaaatatttcctgtttggtcctttaccaaaaaagtttttaagttcctgatctgaaagacaaagtattgacaacctaggtgatgccattcctgccattctgtttgacctcatctcctgttctgccttttgtttactatgcttcagccagagtggcgtttttttctttcctttgatcctgccaagcttgtgcctgccacaggacttttacatttgcgtttccttctgtgcagggctttcttcccatttccgtggctgttacctctttttcattagtcttagatgtcacctcttctccatctttgtcattgtctacccacattattctatttttgtgtatttgtttaatcctcccctttgcatatttatttaatcctctctggtccccaaatgaaggaaaagactgtttttgttagtagttgtgtccatagcatctagaatggtacccaaaacaaaagtatttgtttgaatgatcatcactggcagcctaacttaataaagggatacatttaattgcagttgaaaggtagctggagttgtgtataagaaataaatatgctaggattctaattatttatatactttgataacatgttaaacctcaaatttgaatttataagaaaatttaggcagtggttttcttattatcttggtcattcatttgtggaagcagtttaattcattttctacttcatttactctgttaaaatgaggccagtgccttataatctgaaatatgttaaactagtgtactgcatatgaatttttttaaaaagatgttcataatataagggatctctatctttgtgtggtagtccacaagttcgttcataaattcgttgtttgaaatggcatttttttttccccagaaagttagaattattgcatttttgaatatcacagaatttgttaactatttgaccctctctgtatcagtctggttggataccatggaagttgtggttagcttttcttcctaatctaagtaatatgattgaatacttaccctttgttagaagttatgttgagcactttatatagattatctcagtctgcacaacagtcctgaaataggtactattatgcccattttgcagttgtgaaaattgaattttcttagtagtaacctgtccttgattgcacagtaactaagtccattatggtctctaagggagtatagtcagagttgaagtgttttttattttctatgtaattacatttttttatgtaattacgtttcactttgttagacccatttgtttccatattcaagttttgaacttaatctcgttttttgagtgtgtaaaaaatgttcatgattcaaaaggtacatacagagaagcctcattccttttccctctacttctttcctgtatacttgctgtaagtaaccatattcgttagtttctggtttgtccttactgattttctttttgcaagaacaacaacaaacaacccccaccccaaattatgcatacatatgtatacatatatacatattatgtatatgtatatttattttctgattttccttctgtcttactcaaattgcagcatactgtatatgcttttgtatcctttttttctcatttaataatatgtcctggaagtcacttggaaggaaacttttattcacatcgtctgatatcaagttctgctaggtctttaaacagactttgtcatatccacccacgtatgattctttctcctcctccttccttttagagtttctgtggtttgatgctttctagactctaggaatcatatttctttctctttccacagccttctcccctgtaccctcttctttccctccctccctttctccttcccttcccccttccttcctctcttccgcccctccctcttctgttcctttcctttccttccattttaaaattaggatgtttaggagatatggatgtaaacaaggccaaaaaggaaattcacctacatttagcagaaacctcgagtctctggtcttcacaaagggatgttactttggacattcctatcaaggagctaactaagactgtggaagaaagagtagaataggaatttttagaaacaggcagttggtaggggaatccatgggaattggaattgctgctggtagtgagaaagacaggggtggagacagggctcgtgatgtcctcttcttcctttgtctttcccccagttttctttctatgagcatcattggggcaagcagaatagagagattgggttgatgttcttggtggtcttagcaaagtatgaagagatgagtgaaaggggcagcttgaaagtgctcattagaaggcacttgaacactatgaatatgaaggggtatttatgaatcaggtgggtataggtcagagagtgtcttgactgaatacaagagataaatctctgttttgtttttgtattttgttttgagacagggtttctctctgtcacccaggctggagtgcagtggcatgatcatggctcactgcagccttgacccactgggctgaagcaattctcctgcctcagcctttggagtagctgtgactgcaggtgcacaccattgcacccaactaatttttttttttcaatgtagaaatggggtctcactttgttgcctaggctgatctcgaactcctaggcttaggtgatcctcctgaagtgctgggattgcaggcatgaacctctacatctggcctaaaactcttaatggtatgaagagaggcacaagaaccctctttccttttcctctcccagtatataaaataaatgtggtatatacacttatatctgtatctttctctatttctttctccatctaccatgcttgcttcatagctgtctctatttctgtcttcacctctgtttctctatatctctctcagtctctctaggcaaaataggatatctacttacctagcaaaatcataccttcccctgcttcacagccatgattgggagggagtagaatgtagagtggctaagagattggttttggaactagtcagacttaggtctcaaatttcacctctgccccttagtagctgtataaccatgtcacttaatttttctgagactcgttatccctatctttggaatagaggtcataaatatatataccccatggggtattgtaaggaatatatgaaattatatttctgaagtgttttagcatggtgcctaacacataagagttcagtaaattgtagatgttggctattgttattaatgctgcttttgttttaatatgagtcaactgaaggtacagtgtctatctatataaacctgacgttcaatttatatttggctctctgagaaatcatctctctctcagcccgaatgaacctttatatattatttccttctcgaaattggctttttttttttttttttttgcagttaaactaaggtgtcttttttgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtgaaatttatatatttaataagatctgtgttttaaaaattacagaaaagatatgtctggactaaacctatattcagttaggaaaatgacattggagaatatctgtagttaagagtagaacttaatacatgtatattttgtaaaattaaacttggcacatcagttttatctatgaaacaaagtcacttcttttttttttttttttgagatggagtctctctctgtcgcccaggctggagtgcagtggcgcgatcttggctcactgcaagctccgcctcccgggttcacgccattctcccgcttcagcctcccgagtagctgggactataggcgcccgccaccacgcctggctaattttttgtatttttagtagagacggggtttcaccatgttagccaggatggtctcgatctcctgacctcgtgatcctcctgccttggcctcccaaagtgctgggattacagacgtgagccaccatgccctgcagaaacaaagtcatttctatggctaaaatgttgcatattacttaggagtgcttgatacttcagatatttttcatggttccaagtttttaatagctttggttttttttccatatgggaggaaaatcgaaattagttggaattactgatacctttaattgtatggctaacatacatacagacttcagtcattttttaaaaaaataatgcaaagtaaatatgttgagaagtttgaagttagttttcgtgtttacagataggtagtttggactaacaaatacttgaaagtttgcccttttaatagttaatatgcaaaattaaacatatatttctactcctaaacattgtatctatatatgatataaaataactccaaaaggtaaaataattttcatgttatattttttacaagtgttatatactaatagaaatctgtgatcattattggttgttttgactcctattggatttttgaaatttttacttaagaaagatttaaagcataatgaggcttcaaaagagtgtactaggtattctagtaattttgcatatgtatttaattacatatgattttcataattggaaaagatcaataaaaatgttatgagctatattaattttataaataaatgtaaatatgtaaatctttcttttaacaaggtctcacatcaggaattttcaaaaatgaaacaatctaataatgaagctaacttaagagaagaagttttgaagaatttagctactgcatatgacaactttgttgaacttgtagctaatttgaaggaaggcacaaaggtatgaagtacatgcaaaaggaaccatagctagcaagtacagatgtgaacgcatagtttggaagttaagtggtatttccagttgaaccaaattgctctttgcctagaattttagctttaatgccattgctgctgcgaagtttgttataggagggagaaagcttaatgaaggtggcaacatttcatgggaactttgaagaatgaattgcatatttcaactggcagaaaaggggtataaatattccaggtagcaggaattagcagagatgtcaatgacacctttttaagggataggaagttgactaatttgatgaattttgaggggcaggagtagtcaaagctgatttgtgatggaaaagcggaggggcatgacttttatgttctctgcggtggtttgctgaggacagacttgtggcctgcccaagtgtcagaaggcttactgaatatgtaagtactttcttgccttgtcctttaaaaagtttagggaattcgcttatatttctttttaccaatttgtttttgagggaacagtgatttttaagttttttcagatgcataattccttttggtacttaacttcataataatcactgaataaagttaccttgatataaatacagtaggtaaaatgtaaaaccctctgaagagagggtgaaaatactgcaaagccttccaaatagagaggatagtaaaatgccattttaatttggtttaaaatgctttgtttaaataggtaagctgagaaaaccctccagagagcctttagaaattcttttaagggtttctgaagtatgcttgcatttctgtagtgaatttgaaaacctaatccttccacttaaataggtttaatgttattaaacaattgacttttctctaggaattaggaaggttttcatgatcatgaatcttttaacttgttacattttttatgataatgttctgtaaaaatgcttttattatttttattttctttaggagtcttagatcatatttaatattaagttgttgggcctagtaaattgtataaatgtatctcatgcagatctcagttcttcggctctaactatcattgacaaattagctttagatcacattactctctggattaaaaaattgttcttgttccttacttgtatttgttctttgcttatagttttacaatgagttgactgaaatcctggtcaggttccagaacaaatgcagtgatatagtttttgcacggaagacagaaagagatgaactcttaaagtaagtctgttttgtgtaccaaattgtacttaaagaattttcttttaaaaaatcatgtagagacttttggtatgaacttggtagtatgagatagcaattttcctcttctcatggaagaaggaactagatagagtattttacaaagcaacaagtaaacagctgcataatctgggaatgaaaggatgaaaagaagcagaaactctagatgcaggaagtacagtgaggtcacagaaatgataaaaacagttcaggtggcagatctcaggaagtgccagtaaatacaagcaatttattttgaagtggcaaataggttccttacataaaactagagctatagaacatggaggagacagcatgaatagctcagagaataccagcaaaatcactttcagaaggaggctgctgagaaagcagggccagttaacatacgactcatttcctgctgagtaatcaatacagagtagcacagtgctgataaaaggtggaaaacattaacaaaatttaataaaacttcatagatgaagaacatttaccaaaataatattgtcacagaataggtgaaaattatgagcaaacatctgaccatgagctaaacaaaaacaacaacaacaacaaatgtaaggaggcaatcattctaaggccggggtccccaatcctggggccttggactggtactggttcgtggcctgttaggcactgggctgcacagtaggaggtgggtggcagacaggcgggcagctgggcgagtattactgcctgagccccacctcctgtcagatcagccacagcattagattctcataggagcgcaaactctattgtgaactgcccgtgtaagggatctaggttgtgcattccttatgagactctgactaatgcctgatgatctgaggtggaacagtttcatcctgaaatcatcttccgctcccctgtggaaaaattgtcttccatgagaccggtccctggtgccaaaaaggttggggactgctcctctaaggaacactttgagcagaaattccagaactgcaggaatatggtaagaaaacaggaagtgataagatgtgaggtgtcagaattcaggaaagaagtagaagggaagaataaaaccgtgacatgggaaagagcacaaagggcgaataaacactaaagaacacacaggaacacagagtagaaatgaggaaattaaaatgaaaccaaagtcaagaaagaattagagagaaaatgggcacagaagatctaatataggcaaaactgaatttctctcagaagaaaaaccagatagaacagttatttaacgttctgtaaacagaacacttatttaatgatactcaagaacattttcttaagtgaagattgttgaaagaggatatcatatggtaggggaaaatgacaagaactgtcagcatcaaggcatataaattattggccttaaaagataatggcagaatcctttaggcagtcaggcaaaacagtcaagccagtttataaaaaggtgaaaaaaattaggctggcagctctgtatgccagaagagagtggagtgattgctgtaatctcaaggatagtaaatatgagctaaagattttatatcatatagtaaatacatgctaaagattttatatccagactgtcttttgggtacataaaaagccatatattcattagtaataaatataaagagctgaaagagtcttataccgatgaccctttcagccaactagatctttattcatctctctgttcatattcatgaacagagaatgaacatgttcatgttcattcacctctctgctcatgttcatgagagaagttattttcttctacctctaacaaagagcaggttagttgtttttagaatatttctactaaacctataaaaagcaaataattagaatgttttaaaaatggttctaaatgtttaaaaaaaggtgatttttttttagatggagttttgctctgtcgcccaggctggagtgcagtggtgcagtcttggctcactgcaacctctgcctcccgggttcaagcagttcttctgcctcagcttcttaagtagctggcattacaggtgtgcaccaccacgcctggctaatttttgtatttttagtagagacagggtttcaccatgttggccaggctggtctcgaactcctgacctcaggtaattggaattataggggtgagccacccccccagcctaaaaaaagatgagtattctccatattagtcttaatgataaaaaaacctaacaaagattaatacaaaacagtctacagaccagtttcagttatgaatatggatgcagaagtcctaaataaagtatttgccagtaatagtcaccaggacgttaaaaaataattattgaccaaggggaggggggcatttattccagtttcagtattcagtattttcacatcaaaggaaagatcacaggtttgtcttaatagatgaggcagaagcatttgagaaaatgagtgttctgatactcagtaaaataagaatagatagaagatagatgcttccgtaacatgaaaatatatatatgtatgtgtgtgtatatatttctgcccaaaactcagtatagtgattaatggagaagcactataaacagttccctctgaagtcaagaacagacaacaaatgtcactgtcagcactatttttaaatactatactgcagtaccagccaagacaatcacatgagagagaaattaaaaaattggaaaggaagaagtaaaactagcactatttacagacattatgattgtacaactacttgaaaacccaagagaaccccaaaactctgcaaataataaaattattattactgaagttgttgatcataaaaataatttgtagaaatcagtggctttcatgtaaataaacctatagaggataagatgaagagacccacttacagtagcaacaaaaaggataaaatataaaatataagtttgtcatatatgagacctatgtgaagaaaacagtatttcaaaaagaaggcttgagcaagttaaaaaacatgttcttggacaggatgactcaacttcataaagatgtcaattctaagttaacttatgcatcaactgggcgtgatggcatgcacttctagtcccagctacttgggagattgaagtgggaggatggtttgagccctagagttctaggttgtagtgcgctatgattgtaccgtaaatagccactgtactccagtctgggcaacagtgagaccctatctctaataacaaacataaataaagaaataaacatatgcggccaggcgcggtggctcacgcctgaaatcccagcactttgggaggctgaggcgggcggatcacgaggtcaggagatcgagaccatcctggctaacacggtgaaaccccgtctctactaaaaatacaaaaaactagctgggcgtggtggcgggcgcctgtaatcccagctactcgagaggctgagacaggagaatggcgtgaacccgggaggcggagcttgcagtgagctgagattgcaccactgtactccagcctgggcaacagagtgagactctgtctcaaaaacaaaaacaaaacaaaacaaaagaaataaacatgcattcatatgcttttgatatgcaaacatgcttttgatatgcaaacatgcttttgattaaaaaaaatcagcagcttttcatttggaattagacaagttgatcctaaagttcaagtagaaaaagaaacaaggtcagccaggaaaacaataaaaagagtagtgaaggaatactagttctaccagatattaaggtatataataccatatttaattaaaacacagtggtactggtacatgattagacaaagacagaatagaaaatagaaatagattcaaatacatacgtgaatttagtgtaaaagatcttcagccaaccagaagaggtggacaactgcccagccatttagaaaataaaagttatctttataccagagtaagttctgagtggaccaaacttgaaatttgtaaatgaaatataaggtgtaaaatagaatggaggagaattccgtaataaagctgggatgagcaggatctaataactcctacttaaaatccagaagccattaaaaaaaaagaaaagaataagtttctcatagaaatatgataaacagagtcaggatatgacaaattgggaatccaatatttgaaacttattcacaggcaaaaggctaatttactttatttagaaaagaactcctagaagtgaacgagaagaaaacccaatagaaaactgaggagaagacgcaaacagaattttgcagacaaggaaatacaaatggctcttaaataaatgaaaaaaaatgaataccctcattcattataaaatacaaattaaaattagtctgaagtaatatttttcagattggcaagaatctgaaagtttgataatatgctttgttgtcacatgttggagaaatagatttcatacattgccgtgagaatacccaatggtgcaatccttgtgttgggcattttagctgtaaagaataataagactgcaaattcaaacatcctttaatccagccattctgtttttgggagtctattctgaggatatattagaatatgctagaaatgacatatttatgagcttattcatttctacattgcaaatagcagtaaaaaagtagaaacaaagtgaccagggctggtgaaataaagctatacttgtatagtgaaatgctgtgcagctattttaaaaatcagggtgttttcaatttactgatatggaaagatctccaagatagttatggtaaaaagacacagaacagtgtgtagagtatgttttgtgtaaaaaggaagaaaataacaaatatagaaattggcttgtttacgcacaaggaagctctggatattctaaggaagaaagattggaatatcgtcatttaaaatattttatatttcatatatctaatttaaaaatcaggtttgttgtaaacaagtatatattttatttacacttgtcaagtattttcagctcagtgattgaaaggtgaatgaaagatggaaaagtaggccatataataatattagcttttgaatatctgagagtttattttgttaaagtcgttgttaatactgaaggccaaaatcctttgaaatcttactggatataatgtataccggaaaagtatacataagtgtgtatcttgttgaatgttcacaaactgcgtacacccaggcaaccagcacttaaatcaatacacagaaaattctcagcaccctaaaagcattgttaatgcatccacccagtcagtcagtctttatctttcttttccagggcaaccgctatcctaacttgtaagaacatagattactttctcctgtttttgcattgtatataaatagaatcacatattatgtactcttccatgactggcttttattctacattatatttgtgagattcatcagtatagttgtgtgtatttgtagatcttttattctcatttctgcatatattttattatgtgaatgtacaagttatttattctactgttgaatattttgagtagttgccagttttgagcttttataaatagtgctggcatgaatgttgtaaatcactgctgtccagtattgctggtagcagtaaaaatatggaaacaagtcaaatgtctggttctggttaattaaataaaactacatctatatggtgaagtactatgcagtgacatatgcaattgaaaatgtaaaatttgtagtagccgtagttaaaaaaaaaaaaacaggtgaaattaatttcaatatttcatttaacccagtatgtccaaagtattattttaacatataatcaatgtaaaattacaaatgagagatattttactttttttcacactaagtcttagaaatctaatctgtatttttttttttttgtgagatggagtcttgctctgtcgctcaggctggagtgcagtggcacgatctcggctcactgcaacctccgcctcctgggttcaagcaattctctgcctcagcctcccgagtagctgggattacaagcgcccaccaccaagcccagctaatttttgtatttttagtagagacgggtttcaccatcttggccagactggtcttgaactcctgacctcctgatccacccgcctcggcctcccaaagtgctgggattacaggcgtgagccaccgagcccggcttaatatgtattttatacttacaacacatctcaattcagagtagccacatttcagatgtttgatagtcatgtgtggctaatggttactgtattagacagtacatgcttttggtgagcatgttatatgcagtgctgttgggtatatatcgaggtcaaaggatatgtgtgtatgctcagttgatattgtcaaatagttttccaacgtgattgtactaatttatattcctcctagcaatatatgagagtcctggttgctccacatttttgcccttagctattctgctgggtttgtagtattatctcattgtatgattttaatttttcattttcctgatgactaatatgtcctttttatatacttattagctggaggctttgctttttaatttctgttttcattgaaatctttcatcagaagtttaaagcgtttaagaagaatgaatattttactctgagctttactttcttttgactaatggtttgaatactactgtcaggttgttgggcatagtactagtggcattttattttatatctttttgctcttttacattattgattttatttaatagcattgatttatatcttttataagtggctaggaaattatcatttgctctataaatgtgttatttactgcaaccatccctagagtttatcaaaggaaaagaaaggtattgtgttaaagctttataatatacgtatatattttagatatttcaaaatctggccttttagaattttgatattgattaaaaacttatttattttataagcagttatttacttaagaagtagttttgttttttttttttgatgaatgtatactagttttctttatgtctggagtgactggggcccttcttgagagggaaggttggatgcggacagtgtggggctttgctgttaattgttaaatcagggcaaaaggtactgtctcagatgttttgggacatgtcatatttacttctttgtgtacgttaatcagtgcagtgaaaagatgattgacatcatgtattacatggagtgcattttaccttaggtattgtttagtgtgattttgggataaatttcaatttactgttagaggagacagaattttctaatatttaatactaaattgtaatagtattttcagcaatatatctttcatgagtttatcttagtgacaggtgatgtgttatcttttaatataaaatatttcaacgccacatttctttgaatatcttcaggaagtttttatctagaaatttgcataatggtttgcataaaaggttagccttttcacctgttttattttgtataaacactgatatagtgattaaaacattagctacataactatgagtcactgtagttttctgataacttttagatagatgatgttaggagttttttaaatccagggactaccttttattagagggtgggcagtcttttaggattacttgcccagtttgacacgtttcttactctagctgtaactgtgatctctgaaaatgtttactttttcccccagtcttcagaaatataaaaaagatacaacttcattttattaaacaataggaagaaagaggatttagattctagtcaagaataaaaatgtagtatattttgtttttttcagtttttgttatattgataaataattatacatattatggggtacatgtgatactttgatcatgaatacaatgtgtaataatcaaatcagggtaattaggatattcatcacatatttgtggggcacatgtgatattttgatacatgaatacaatgcataataatcaaatcaaggcaattaggatattcatctcaaacgtttatcatttctttgtgttgggaacattccaaatcttctagctattttgaaatatacaataaattatcattaactatcatcaccctatgctgctattaaacactagaacttatttattctctctgactgtatttttgtacctattatccaccctctcttcatccccaccccctactctttcttgactctagtaaccatcattctactctgtctccttgtttttagctcacacatatggaggagaacatgcaatatttgtctttctgtgcctggcttatttcacttatcatgatggcctccagttccatccatgttgctgcaaatgacagaatttcattatattttttatggctgaataatattccatggtgtatatatactacactatatccatttatctgctgatggacacttaggttgcattcatattttggctgttggaagtgctgcaataaacatgggaatacagatatctcttcagtatatggatatcctttctttaggatatatacccagcagtgggattgttggatcatattgtagatctagttttagttttttgagggacctccatactgttttccatagtcactgtactaatttgaaatgtagtatattttaaaataccatcattgtttggaatccattttctatgtttcatgtatgaagaaaagaaaagctgatattttatgtgtgttaatttttttctatcatgttaatttttaacactctgtctttgataagggacttgcaacaaagcattgccagagaacctagtgctccttcaattcctacacctgcgtatcagtcctcaccagcaggaggacatgcaccaactcctccaactccagcgccaagaaccatgccggttagtaggcaaataaatattttaaacagaggttttacattaacgatgattacttgttctaacggataaaacatgatttacataggaaggatctagtggttaccacctgcatcaggtaaccaaccttctgatattttgcaatatgtagaacacagcatcattcaagaattcttgacaaaaaaatgcttaacctgaatgtaatcaagcccttaaactttctgtttatagcaaataaaacaaatgataaaataagaagttaaattatgctattaggaaacaattggacaaatctttcacatgggacatttatatgaaataactgagttgatcatttctaaaagtgaatgtcatagattttttaaaaaagaggcatattctagatgaaaagagatgaaagtttccttataatcaaatgcagtatatgaactttatttgcttttggtttataaaaatagctatatgagcttttttgtgttaattaggggaaaattgaatttggagtggatatttgatgacattggggaatagcattagttttttaaggatgaaaatggtattgtgattatgtaggagaatatccttatgagaacttgagtgctgaagtctttagggctagtgtcatgaaatttgcaacttactttcaaatgattctgcaaatatatatggatgtagttatagataaagcagaaatgacaaatgttaatagttgttgaatttcattggtagatgtgtgattattttatatactattttttacaaattttctggtgtgtgacatttttcatgtaaagtttggggactaggaggagatgatggtagtaaacagtacctgtgctgcttccttccacctcaaatgtccaaccactggaggaagcagtaaatgattaaatatgaggcaccaggaaaagagcagtggctatggagtttccacaggttggaaaattattcaactatgatatatttctatagtaataagccggtatttaagaatgggaattaaaaatatatttggttggattctagagtttctcatatgtccttattaattttaattaatagcaatttgagagaaatatgaaacattttatagtcaatgctgactttttcttatagcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtaaggctgcaacattgtgtatcccaagttggctaatgttgtttctaggctctggctaacctgttaaaaacagggtcatcccttctccaaatggaggtgtcatgaatgaataagctacactgtcagcttatccagaaatgaaaataatgttatggtcacttacatgaataggatagctatttcctaggcttttaaaatttatgtttttatattttacatattgggtttatattaaataatcttttctgtattatagagtttagtaggtgtttccttggactttaggtgataaacaggtaccttttctgagcgtagcatagcaaaactgataaggccttgtttacgtccctatacttagaatacttggcatttaataaacagttgaatagaaatttatctaattatgggttgcactttcttaaaggttaatctctgtggtaatttcttaattttaaaaatccaaacatttgactaccttttaagatgtgctctaaattttacttagtaagtacatgttgtctgccaaatattagaactttataagttgtaaatttatgtatatcacagtgaatattgaatattgtggaagaggaatgtatttagatgactagttttgccacgttaaaatgaagggtctccattttttttctttctttaatactcgaatatttaatcttattttcttcagtatttatttttggatagtattaaacacttggtactcttttgttttaattaataacaggataggaatgcttttctctgacaagtgccttgaaacagtttttttcactccactgttctttaatagactaaaaaatagaaatgactttcatgaaaaacgtagttctagaatgattattgttttattttttagtatttgatttaccaatcaagatttttctgttttcttctatcaggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggagtattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctta

SEQ ID NO: 1368 - DNA, 28691 bp, Homo sapiens
ggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgaggtgggcgcggggctgggagtgggtaggttgtctgccagccgtcgctcgccgctcctcttcccgtctccccccttccttcaatcctgtaacctgggcggagccgccccgtcccggcctgaccaggcgcgtaggtgtggtctgcattctttgctggtgagcaggacccgccctgcaggcccgctgtgactgcccgcttgtcctgcctgcacgtctgctctagcccttggtcggcgagggctccgtggatcagatacctgggagcagcagtctgccctgtactgatctcttttgccacatttacttagaactagtcttcacttttttgggtctctaactgaagcttcccctttcgccccatttttccatcactgtctttcttgggccacattttgatttcataatagtagttgcttgaaggcagtgggggaagtgggggaattgggacactggaccaaatgtctgatcagctcatcacattgtccacatgaaatggaccgtcttcctcagttcaaaataatcaaatgatagatggagaattctgaaagttaggagctacaactatttgaaataaaactctagttacatagttgaaccgttcaaggtaggttgtttaaaagcagtttgttcacaaacagatatatacacagtagagtaaatttgttattttagcaaacgcttatttagctcatgctgatttaatgagggttcctttcatgatacttaatagttataagaacattttttacgattttatagttaaacatttcttttgcataccttgttaatctcgttttctccgtatagtatattctacttgtttcacaggagaatcacaattgtattccaatccaagtagcagaaacccaggctaaactagcttgagctaagaaaagacttattctgccgggcgcggtggctcacgcctgtaatcccagcactttgggaggccgaggcgggcggatcacgaggtcaggagatcgacaccatcctggctagcacggtgaaaccccatctctactaaaaatacaacaaattagccgggcgtggtggcgggtgcctgtagtcccagctactcgggaggctgaggcaggagaatggtgtgaacctgggagacggagcttgcagtgagccgagatcgcgccactgcactccagcctgggcgacagagtgagactccatctcaaaaaaaaaaaaaaaaaaaaaaaaaagtaagacttattctgctaactgaaaagtctagggatattccttccttagctttaggtatcactggagatcgtcttgcctccgtgatgcttccctcgaaagctttgttcatgtattgagagggatggctgtagtgtaataacaatcgtccgcaacactcagtatcttacagaagggagtgcttttctccttagctctggtggaagtccatgggaggctcctgggtttgtttgcacccatttatgatggtgggaaatgggctaagttaattgcccttatctgagtcatccagccggtttaatttctccttaccccatggatcaaagcaagatgagtccggactggggaagggttggttctccgaaggaaggggtactgaatagattgctcagaggaattaagaccccttggtgtcaaattttagagctacaactgttgggctgcaaggatcattagtctaatagcataagcattttttttaaagttaacctagaaatacttagccattctttagaattaacataattaaacaatttcaaggtaatttttatgtaggcatgaatagcattcagtgaggattttccattagtaatattaagaaaacatagttgtggtataatgagccctgtgataaaaatcttgttgaatatatcaaatttggttccagccctcagatttggggtcttcagaagcacttggtgcatgggttttaagctaacagacatgggaggttggtggataatggtttggatacggttctcctgtcaactttaaaacttaattcatttgttccttcctttattctttttaccagacttaaatgtgtgaactgttcctaggtagtggacctgttgtagatatagtctctttgaaactaaccatgtttctttagtcacctctgtataatcccctcctgccacattaattcaacaaatattaagtattttcactttttgggcttctagaggggttagggtaagcttggagatattactaaagtttataatggaggtaggtacaaaagttttgtaggtatatacgctgtaaaattagatgtgaatcagttgtgtgatgttcattcaaatccggcagaatatcttatttttaataattatgtttggataattgtgtaaacttaacattaattttttaacttaatgaactttttaaactaatgaactttgaaaaacagagtttaaactaattcctaaataattgaagccagcttgataagtcctgatatgcagctccatatattgctccagtgatagacttgttttcttattactaacttgtaggtgttctattaaaatttcctaaaatatacatttatgcatattataataatgagaatgagtacttaaaaactcatttgttctgggtgtggtagcatgcactcataattccagctgaggcagaaggatcactagagcccacgagttggagaccagcctgaactacatactgagacgctgtctcaaaacaaaacaaaacaacaacaacaaaaaacccttttatatgatacttcttcctttataaagtggcttttactaaaaattgattagaccttggtaaatggtgacctagggtgatcaaatgggaaccctgctggttttttatttttattttgtattttatttgaagctccagatataccatttaccagcattgtgtaatttcttttgtggtgatcagtttctttagagagaaagcttctagtcttccatgaaaaagtctgcttatcagctttctaaattttatcctggggaatggaggttggggatcttaacaatcatgtatgcagtctatcaggtacatctatttttagtatgacacctgcattagggttaggttcatttctgtgtggtagatcccaaattatctgagttaagattttattttgtaaaaagttggcaggtaggtagttctggtagcccagggctggtgtagtgtttctgtggagttaattggggctcagattcctttcagctttctgctgtttgaaacctagaatattgttctcaggtccaggttgcaatcatatccaagttccaggtagtaggatggagaaaggcacggggctcgccctttagggtgtttcctggcaactgttccacaacaccctgcctatatgttaccggccattttgtgtgtccttctgataggatgctaggaaaaggaattttcattatgagcagctgtatactcagctaaagggacacagttttgttaataaggaataggatagactgataatgatgtagtcaattagcactccctaccccacttagcagtgcttgatctccaccttagttatatttgatatctctgacatttttttcttttttcttttttttttttttgaggtggagttttgctcttgttacccaggctggagtgcagtggcatgatctcggctcaccacaacctccgcctctcgggttcaaacgattctcctgcctcagcctcctgagtagctgggatttacaggcatgaaccactctgcctggctaattttgtatttttggtagagacgggctttctccatgttggtcaggctggtctggaactcctgacctcgggtgatccacccgcctcggcctcccaaagtgctgggattacaggcgtgagccactgtgcccggccaatctctgacgtttttttgagagtgaacctaccttcagagtagaggatctgggagcctgaagttttctttgaaggattttcaaccataccttctcgttccagcctcacattgaactaccttcagaggtacctcatgtttcttaattcagatccttttctggcttctctggcatgatttggcttctgctttggctcccttccctcttagccagttagattttggctttctctttttcattcacttttcaccttttagtaaattttgttgaaacctcttatatcctgtgtgtcatttcccgttctttttgtccatgttcatgtacatcttttacatttttaaattcttgttttagtgggttttggcggggagcaaagaaggatgtttattcagatttatttgtttaactgtaagaggaacttgtttgcattttcagctctccacagtgcttgtaacaatttacattctcatcagcaggtatatgggagtactttattcttccatatccttgctaatacgtactgattaataatttaatttattgctttttgctaaactgatgggtgagagatagtacctttagtttgcattcctcttattttactgaggttgaacagtttttgtttactggccactttgtttctttttctgtgattgcttgttcttttcttttgcccattttctattgagttgttttttccttactaatttgtaggagttgtagcattttctggatatttatacttttttcattaggtatgttgcaaaaatcttccaatctgtttcttgtctctcaactgtgtttattctatcttttgtcacatggaagttctcccaaaagtgttgtcatctcataatctgtagttaacattttttttcttattcctaatgttgtgcatgtgttatgtgtgattttcctccctcagatttgccaaaggtttggagccaccttttctttgtttaaaaccaaggctttttggttggttttctgcccttgtcattcatttttttaaaaaatgttctttgttccttttttctatctttttgtattgattggttagttttccatctttttggtttttctaatatattttaggactgtgtatttttttctcagtctgtattggttgcatcctactgactttttcatttgtaaaatgaagttgatggaatactcttttaatttctgaaatattttctacatggtagtgttttatagatcagtaaagaaaatgttctgttttacttcataactgttgtttggattctcgttgttggtttggtggtgaacatactctttgcagaacttttccttgtcccacggccatgaaaatttaggcttgcaaacggtttgaagggtgagtaaagcagggttttattgggtgaaaaggaagaaaagggggaaacaggaactctcacaaagctagagtcccagttagagcacatcccgcctgcagcttgaatctcaggttccgcacaggaagaggaggggccagtctcctccctatggaatttcccaaggctccaccttagtgaacaggctggttggaatttctccagggaccccctcccacctggctgtctcaatattgagataatattagcacaatgacgttgctacaatttgttaaccaaatactaatggagagtctgtgtgaaccatactgtaggagacaatgtggaggatataaagatatacttggtccctggtctcaaggaatatctgtaattggcagacctttttggctccgtaattttattccacataggtgaataaacatatgggaagatttaaaatctgatttgtttttctgtgttttgacttttctggtgtttagtaaatcttatcaggactatcatcattctgtgtatctgtaagaagaatcttctgaggtgctttacacaggagatttaagcccacaaagctatctttatggcagaactggactaagatcctgacctcttgattccccagctagttactttttgccatactctctgctgcagtagtgcttgattaatgatttttcatgtgttaaattgggtgaagaaagaagtgtgaaaataaagttcacaaagaatctatgaactccagccaatatctctggcccagcttttctgattctcttgtttcatcctctagttggtggtctggagttgcacatccctaaatacagattgcagctgaatagggttgtgtgaattagcattgcagtattattttggccatgtggattggttgttcttgatccccacaccttccccttaaattaaaaaattcttttccggccgggtgtggtggctcatgcctgtaatcccagcactttgggaggctgaggcgggtggatcacgaggtcaggagttcgagattagcctggccaaaatggtgaaacactgtctctactaaaaatacaaaaagttagccggtcatggtggcgggtgcctgtaatcgcagctgctcgggaggctgaggcagagaattgcttgaacccggaaggtggaggttgcagtgagccgagatcacaccactgcactgtagcctgggcgacagagtgagattctgtctcaaaaaaaaaaaaaaaatttttttttcctttttaaaaattaaatatagaatttaatctttatttaaaaattttaacatttttgtttttttaagacagggccttggctcagttgctcagctgcccaggctggagtacagtggcgccacaatagcctactgcagcctcgatctcctgggctcaagcaatcctacttcaacctcccaagtgggtgcatactaccatacctggctaattattaaatttttagtagagaggaggtcttgctgtgttgtccaggctggtcttgaactcctgaactcaagcagtcctcctgtcttggcctcccaagtgctgggattacaggtgtgagccaccatacctggccaatttttttttttttttaaactagaatttctttttttgttttttgagatggagtctcactcggtcgcccaggctagagtgcagtggcgcgatcttggctcactgcaagctccacctcccaggttcacgccattctcctgcctcagcctaccatgtagctgggactacaggcgcccaccactacgcccggctaatttttttgtgtttttagtagagacggggtttcaccgtgttagccaggatggtgtcgatctcctgaccttgtgatccgcctgtctcgacctcccaaagtgctgggattacaggcgtgtgccaccgtgcccagcctaaactagaatttctaatgggaatttgtcctgtacctatttgtggtatttcaaagaaatgtatttatttcctagtttctttttccccatgagatttttaagttgagttattatatatttgtgccaaagtggttgagttttataaaatactggagaacatatataagtacttctccattgttgcaaaacagtaatctgtaactaccatttgtcatacatgtactcctgtgtgtccaggaactattttaagcacttcatatacagtaccatttattcctcacgcttaaaggaggtattattactctttaggaaaggttcagagaaattgaataattttttcatgatcacatagctaagagttgggattcaaactcagggctatctgacttgaaagactgtgacattataccttttaaatatatttgggattttatagttttggttaaaaaaattcgcttatttctaaaatagaatctatgaagacaccaatttttttgcaccattattttccacaatgtgctagtttttgccaactcctggcttagcatactggctttccctgtgcctacttatacaaaacttgcagcctaggtctactttgttagagatacatcctaggctagagtctgctgctatagtaaagtgtacttaaatgttaaagagaagggtgtggtagattctcttgtttctgtggattccctatctagagaactttgatgcttgtgatctgggctgaactatgagggataataccttgtggaattatattgaaggagtagcttatggtagttggatctcctggaacagattttgctcatggtaactgcagttagcaatggctgctttcttttgtaaagcatttgttgatctctctcattttgttggggttttctccatgctgatcagacattgttgatttccagtgattgccctcctgttgtacttttatttcaacttctataatctgtcctaagatagccattttactttgagggtttcatcacatagcttctaatcattcagttacaggatataaatgccctgttccccccatacagctcaggttttgttagttggcctcaaaaactttggggtgaagagaatgggtataaaaattttagtgcattcagtttagccattcttcttttcctcacccatttgcagaggaagtaacctcatttcctactactcccttccttgtttactttatagcaagggtcagcaaaataaggcctgctcagctgcctgtttttgtatggcctgtgagcaccactccagtgggttagcattgtgagtgttggagaactagcttagctgtttgcctctgttccattctcccctttgcttctagctcctgtcaccctggccagtggccatgctttattgctgcccagacttactgtggtgctgcctacaccagagtaaatattctgcttggcgttggcttggcactaaatggtataatctcagtctggaaattggtgactcagcaaattatctcacctacggccccctggggcaggtgcccacagtagactctccctgagaattttgatctcattggggtagagtaaaactgaccatgttggtcactcctcctgtctccctatggctcctttccatcagacaggtactttttctttggagaatgtctccaggatggcacctgggcagccgtgtgccacaattttgggatggcccaacctaggcaaaaaaggtacagggcagggcaggggtttttcctcttgttatataagtagttacatacttattatatgcttgatttagcctttttcccagcagagtctagaatatcactgttcagaaaaagtttgccagtcctggctttatagccatattggcctccttgctgtgccaagcacacctttaggcgttgttgcctcagacctttagcacttgctgttcccttcttatgggcttgttctttgatagctcctgttcattcacaaaccagaattttaggttttatttttcagagatagaagaaaactttgcattttaccgattcatttgcttggggctagcaacaaaacagagagcaaatagatctagtctttgctttcatggaatttagaatcctttgagagaaaagacaataaacataatcccaccaataatatatcacaaattgtgttaaatcctatgaagaaaatgttcagggacctgagagattataaatggaggggcaactaattttaaaaaggggttacattgactgtatttttttgagacaagatttcacgccatggcccatcctggagtacagtggtgggatcacagctcacttcagccttgacctcctgggctcaagtgatcctcccaccttatcccgctgcatagtccctttgggggactgtaggcccaccaccacacctggctgacgtgtgtatgtatgtgtaaagatgaggtctcactatgtgcccagggtggtctcaaacccctaggctcaggtgatcctcctacctcagcctcccaaagtgttgggattacaggcatgagccacagcgcctggcctagattaactttatcacttctgctgccaccgtggactccattgatccgtgctagcatcatctcttgactggattactacggtagcttcctaactgatctctctacttctgctcgtgcacacctgcagtcagttttctacacaacagtcatggtgactgtatgaaaataagtcatattgctgttttgtccaaaccttttgatgattcacactcttacactatatagtaaaactcagaagtcttacagttgcactcaaggcatcattacttctttgacttcatcacttactattttctcccttgctcactctatgatcatattggtctccttgccatgccagatacattcttaagtaccctcttgtcccagggtattggcacttgattttccctagattggaaattctcagatatctgcttggctcacctcatcacctttttcatgccttttatggtcatgctgttttagagttaaaactttttttcatgtagtcaaatgaccatgttatttaaaacgacaaccttcttacctctcctcatatattcactttattcctcttgtctctttattctccatggcacttaccactgtcttctatataatatttttgcttttttgtcttcccctctaaaagcttcacaagagcacagatttttagatgtttactgctaaattcttaatgtcctaaaactggtgcatagtaagctcttagtatatatttgttgaatgaatgaatgaggaaaactttctttgataacaatgtcagcctagacaatagtgagaaatggtggtaaaaagagtgaaggccctgagcaaggagagcctataatttagtgactcgaatgtatagtgaatatcctgagatgaggctggagagttggatgatagccatatcctgtaagaccttcaacatttttggatgtaattttaagtgtaatgggaatccaccaaagggtttcagtacttaatacttcagagtttatttcctgagtacaaagatattctcctgtataaccatagtacaactttcaaagtcaggaagttggcattgattcattattaccatttaatctgtagaattcattcaaatattgctgattttcctaatattatttacaggttcaggatctaatctagaatcatgcagtgcatttaattgttacgtctctttaatctccttcaatctggaccagttcttcagtttttctcgtctttcatgaccttgacatttttgaagagtacaggctaattactttttagaattttcctcaataaaggcttgtctcattttcttgtgatttctgcatttttgcataggagtaccagcgaagtgatgctgtgttctttctagtgcatatcaggaaaaataagatgtggatttgttctgtagtggtaatgtttatttttatcgcttggttaagatggtgtttgccaggtttcttgaccttacagttaataagcttgttgtactaattagtaaatattttgtggggagatactttgggactatgtaatatcctgtttcattacacacttttcattattttatcatttattgatgaatcttaccagaattagatattatactctgaaaggtaccaaatggtaatttttctaatttcatctagactatggtaccgtaggatagagttttccctattcacctgtttatttacctccgaatggtggtcttttcctcaatgggctcttattttttactgttattttatttagattggttcagtgcttagccattgggagccccttaaagctacctcctgtgcccttttgacatgtcctcatcattttttgagtacttccttaactttctggcatagcaagatgttttagacttgaatattgaattttttcagtctcagcccttgagtcagccatttctctaaggagcacttggctcattttaatgcaaaagattatctgggcagtaggtgtgcttattgctactgtgaagtgttactgcttataggccctcttagcatatacatttaggaaatacatagttacacatttatacttgtttttatttctctctgctacctttaaaaaatgagttaaaaactagctgggtgtggtgacatgcacctgtagtcctggcagctcaggggctaaagtgggcagattgcttgagcctgggagttcaaggttaccgtgtactgtgattgtgctactgtactgcagcctgggcaacagaatgataccctgtctgtaaacaaacaaaaaaagttcacattgatatctccagttccagtttaaaactgtggagttattctaaccttctgccttctcatgtttgtggatttttttttttttttttgagacaggttcttgcccaggctggagtacagtggcgctgtcttggcccactgcagccatgacctccagatcaagtgatcctcccacctcagcctcatgagtagctgggaccacaggtgtgcgccaccatgcctggctaatgtttgtatttttagtagagacagggttttgctgtgtttcctaggctggtctcgaactctgggctcaagtgatccacctgcctcagcctcccagagtgctaggattacaggcgtgatctgctgtgcctggccctttcaggtatttgtatctctgaccttgggaaacttggcttccattatcttcaatgtatttacttaattggatagtttttcctgtttataaccaaactcatagccatgccagccaaaagcttggtctcagatatgttgcccactcctgctgaaaatttgcccccagaaataatcattacaaaaatacccctgatgaaggggtgggggaagtataagggaaaaaggaaaggaggaaagattagaggccagttagaaagcttggcctgacccttttctcctcctttccctgccagacttgctgactgacagctcaccctgatggggggaagtctgctttatattttgtgatcattctggctgctatgcagaaaacaggtcggaaagaatgagaaaggagatggagaggttgtctaggaaacttttggatttctagctgaaagacagtggtagctttgatgtgctgtgtggcagtgctggagacagatagagatgggcttacccaaaacatttaaaagtcggtaaacctgtttttaattggcagtttaccagagatactaatttgtctaatggatacaaacttatttattttagtaagaaatagtatttttaagaaatattttggttttcagagcagatgttagtttgcttttagccaataacagttgataaatatttttctgtggtggtgggtatgactttttgttcatagtttttcactgcatatattttttaagcttctggtttacgtattaaaaaactttttttcatataaaatagctgctcaaagtaagcatgaataatttttgtatcattttaaaccagttgtaattacataaatgcatgtaatatttagctctggtaattattaattctgctctattttttagatattatgatcagatttgttctattgaacccaaattcccattttctgaaaatcaggtaagtcattaattctgtcttaaaattatatggtaatagcacccatttccttctgccaatatcttcactgtctttagagttttatgagatagtgttataaaaataggagcttttagatctgtctaatgcgaatatatgtgcttctgaagaaagaatctcctggaattctgttcatgtcattcttcagtcacttctggggctcatgtagagcaatggtttgtttttctttggacttcattttatgtcagtaggatctgttgactgattaatctgctgtgtcctttcctttgactttttcagaattaggaaggaaactgcacaattcaggaattattagtctcagtttatgtgctttaaaaattattcgcacaagttacatttgcatgtaaaagttgcaaatgctgttttgattaaatgttaattacatgaatgtcaactattttctccttaaaggctagatgttgaaaatgctgataatttcttatagttttattttggagattggataaagattttaaaattagtgatacttttaaattttaaaatagttataagaaaagtactttaaacattcttgtactaaagtttttacaggtgaaataattatatgttgagatttcctttaatatattcctggaaaaaaagtgtaggtggctggaggcagggcaaattgggaggtagatgaaccaagaagggcaaaagactaaagctgctgatggatgtactggagttcattctctttattctctttagtttttctgtatgtttgaaaatttccctaatcaagagtttagaaatttttgtattagattgcaataaataatttaaatgaggtttatttctttctaatctttgtatgtgataatacatatttcaggagcagagagagagttttttaataaacatttaattttcatgtagcatatggaaaagtgaacaaatcacgggtatagcttgaatcttacaaagtgaatatgtctgtataaccaccacctagataaataaataaaatattaacctattccccaaaataaccattctcctacttttgtcatcatggaatagtttttaatttcatcttctaggaaacctgtagtacttacttttatttcccttgcttcacttagcttatttgacaaggatctactacttattttgttccgttgaagtcattgtgtgtttataaagatgaataagatagtgtttatgattaccaaggcagaatgaccatttgaaatatcccagtgccagtattttactttttttagatttcaatttaaaaggagaaggaaaggaagttgggtggttataggagataatattttgagcttttgtcctttttttcatggtggatttttcttcaaagaagacttaatatttaatgagattcaggaaggttacctaattttctgttttctttcattctatccagatctgcttgacatttacctggaaggatgctttcgataaaggttcactttttggaggctctgtaaaactgggtatgtaatttttaataaaagtgataggaaaattggtctaactactttgcattgtttttagtttttaaaattgttatcctaatgactctttgtaaatactaaagttttttacatttcattctctttttagcttcaacttttaatgcaattttgaaatatttgtagagagcccatgccttgccaggcactgtcctagttataaaaatgaataaaaccgatgtacttagtttttgggaagatagttgatcatttaaaagtgtaatatgtaatagcctatgaacaaactcatggaagcatatatgaggaagaaagtaattctaccttttgaaagcagacaatgtttgagttaggccttgaaggatggatttgtagaaaataatattacagatacaaaatcataaccataggtcagaagggtgaggacatttgatctaccagctccagcaagataacctctctgtgccttaattttcttatctgtgaaatggagataatactatttctctcattggattctttttttttttttttttgagacagagttttgctcttgttgcccaggatggagtgcagtggcacgatcttggctcactgcaacctctgcctactgggttcaagtgattctcctattcttctacctcagctgggattacaagcacccgccaccacacctgggtaatttttttagtagagacggggtttcaccatgttggccaggctggtctcaaactcccgacctcaggtgatccacccatctcggcctcccaaagtgctgggattacaggtgtgagcccctggcctattccattagattcttatgtggattaaatgagtgaatacatgtaaagtcctaagaacagtgctttattagctgcaatgaataattatattattatataacattgtaatgtatatgtgatatatgtatatttcatgtatatatgtatatttcatgtatattatatgtatatatgtattatatatgcacatataatgtgtattatatgtgcatatataatgtgtattatatatgcatgtatgtatatatgtgtatataatgtgtattatatatatgtatgtatatatgtaagtatataatgtattatatacatatatgtatatatacttacatatacacacatatatagtatatttgtatacatatatacatttatgtgtatgtatagtatatataatatgtatactatatgcatgtattattcatatacatatatgtatatacatatatacatatatattcatgtacacatatacatatatgtatatattatatataagaaatatgtatatatacacatgcattatatataagtatgtataatatgccttatggtatatcctttttatagtatacatatacattaagatatgctataatatatactatataccttctaagatatagatgtataatatgtattatatagtatgtgcataccatatacatacatgtatctatatatcttatataaggtttatacttatatataggtgaggaaatggaaatatatattttatagtagatattatatataatgttaatttaataataattattgttatggcttgtaaccataggttgaattggggattatggagggtgatgatattagaaagcagattgtggagagttgcaaatattatgctcctgactttgtacttttccctcttatataataatagtgcatgtttattgggcatttattttacccaggtactctggaagggacttcataaatagtcttactgaattctccaatagcttaatgaggaaaaggcactattattgccagttgaacaaactggtttagaaagattacgtgattttctgaagtcatatggttaggatttaatgaagctgggatatgaatctagaaggcctaactcccgggactagagagaaacagaccagtgaggagactgatgagagatgatgaggttagacaagctagtgtgtgcaagttacagaagagagggatttcagacttttcagaggtgaagttgactgaatttgctgactaccagtcagaaggaagagtaagagttgaggcttgactctgagatttaataagttggtttgacctgttggatatttattcctctttagtagaaaggttgactctgatttttctgtgttatgtctgggtagacatttctctggcattttgaaataaaggatttaaagctcagaagagaaagatatacattcgggaacaattattaggtgataataaatttattccttctggcagataattgactgagaaaagtatcaaagtcagagctaagtaatataacattcaggggaaatagaggaagaggttctgggaatgaggttgagaaaaagctttcatatcttacaggaaccagggtaaaatagagatgtgaaggaatgccagaagagtttcaaaggtgatgtggtccagtggttcccaaacctggctgcgtattagtattacctgggaaaaatgttaaaggtttatctttaaagatgaagatacagagtgccagatgtgataggagaaagttttggagtagggcactggaattagtatctttggaaatatctccgggtggccgggtgcggtggctcacgcctgtaatcccagcagtttgggaggccgaggtgggtggatcacgaggtcaggagtttgagattatcctgaccaacatggtgaaatcctgtctctactaaaaatacaaaattagccaggtatagtggcgcacgccttgtaatcccagctactcaggaggctgaggcaggagactcacttgaacctgagaggcagaggttgcagtgagctgagattgtgccattgcactccagcctgggtgacagagcaagattctgtctaaaaaaaaaaaaaaaaaaaaaaaaagaaaatatctccaggtgattctgatgatcatcccaggtccaggctggaacatccttgacagagtcattgtggcagaactcaagtcatgtaaggttggagaagtcactggatttagcagagagaagtttctcttggagtatcctgaataagcatcagattgaggggtgaatgggaggtgagggaatggaaacagtaaatgtgggttgctcatttcaggaaatctacagtaaagatttggggacaaagggagcatcattctgagagggagccaaggtgcagaaaaggatttttagtattgttatgacttaagaaatttggtaggctgagaataaggagcagatggcaggagaactaggagacacttgagtgatgaactcaagtatccagaagaactgggaagcaaaaaattagatcataaacaggaggtggttcatcaaggcatttctagtagcaaaaattggtaattaaatgtccttcagtaatgtcttggttaaataaaaggctactcattcatttgaatattgtgtacttttggaatactaagaataaaaatgcatatatgtatttgttgatatgtaaagttatatcaatggaatattgaataaaaggcctgccttagttcagagttgttgcattgtacaactctagggtccccggaattgggctccttgggacactcctcatacagaactcagagtaattcctcctccctcgagttgtgcactccaggcaactcgagtgtggtatagtatccactttgtgaaaagttatgtgtgtgaatgtttatgtagttatttgtgagataccaaaaaataaattctggttaactctggaagatgagatgttgggtgatttttaattatttttttgtagtttagaaaaattgtttgaattttagaaagctgttattttcatgagttattttcgttttgaaaaacttagaggctggaagtggtggctcgtgcctgtaatcccagtacttggggaggccaagacaggtggatcacttgagcccaggagtacaagaccagcttggggaacagacgaaactctgtctctacaaaaaataaaaaaattagccagacatggtggtgtgtgcctgtagtcctagctgtttagggggttgaggtgagaggattgcttgagcctgggaggttgaggctgcaataagccatgatcacgccactgtacttcagcctgggtgacagagtgacaccttgtctcaaaagaaaaaaaaaagataaaagaaaaacttaaaagagagcaagtaagaaacaagaatacagttaaatacttagaaaggcatctttgaaaaaaaggaaaattaaatattgttttgaaaacctggtttaagtttagatggatagaaaaaaataaaggaaaaaaagataaaatagctcttatatgtaaaatctcataaaagctcttatacatgacaaattgtcaaaataaaatgagagactacagtctggtatgataatatttatgggcaacataatagactgagatatgtatccaatatataaacagtttacttttatttcttgtttggaatatatttcattcttgttttttttttttttttttttttttggagaacagtcttgctctgttgcccagggtggatggagggcagtggcatgatctcggcttactgcaacctctgcctctgaggttcaagtgattctcgtgccacagcctcctgagtagctgggattacaagcatgcaccaccacgcctggcgaatttttgtatttttagtagagacggggtttcaccatgttggccaggctggtctcgaactcctgacctcaagagctccgcccaccttgccttcccaaagtgctgggattacaggtgtgagccaccacgcctggctgatatttaattttgttccttgctctctcctgccacactggcctaatgtatatatttattgaattaattaaaattatattcagaacttgaagatattgatcccttgcttttttttttttttttttttttttgatagggagtctcactctgacgctaggctggagtgcagtggcacgatctcggctcactgcaacctccgcctccaaggttcaagcgattatcctgcgtcagctttccgagtagctgggactacaggtgtgcgccaccacgtccagctaatttttgtacttttaatagagacagggtttcaccatgttggccagaatggtcttgttctcttgacctcgtgatctgtccgcctcagcctcccaaagtgctgagattacaggcgtgagccactgcacctggccaatcccttgccttttagtatctagtgttactgatgaaaagtctgatttttgttattttataagtgatctgtttctttgctcttgggaatatttttacagtcttctctttatctttcatgtttagaaatctcaaaagacttaatgggatttcattttattcgtgtgtagggcatttctttttggcccttttagtttgaacacttatatctcccttaagctctgggaagttttcttatatttctttgataattttcttgtctcttttgtctctctttctttggaatactttattagatgttggttgttctgagttgttcactcgtaatttttatattttttcttgactttctgttctttctgagattgcctagatattaattttaaaacttgaaaaaaaattttttttccttcctccgcccttaaaacttttgaaaaaaatttaacaatcaagtttttaatttttaggagctttgtcttattaatttaaaaaatccttttcttttatggatgtactgtctttgaatctctttaaggaatgctaattgtgatatttggaatataatcttttatgactggaattgtctttatttattttgggcttagtttttcagttcgcattgctcttcctttattttgctgcaggcttttttcacaacctggttattttggattttccatatgtttaataaagtaggttagagtagctggtgtttatgtctgctttagtttagaatgaggagactagaactggtttggaagcaagttgaaaactggcctttattacctaggaggccaccaaagtactgtaacaaggagggctttactttatggtacaactctgtggcacaaacatacaaatgtagtgttgttctgattctcctagattggtttgttcagtgttttttgtaaggagccttattttgcctagtggtcaatgccttgcacattatgcaagatcttgaattccaaactgattgaattctgtgagtaatagggagctattgtagattcttttttaaaagttatttttcaattgtgatacaatatacacaatatgccttcttaaccattttaagtgtacacttcagtggtattaagtacatttacattattgtgcaaacatcatctcgagaactctttttcatcttacaaaacaaactctgcccagtaaatgataacttcacagactgggggcggtggcttatgcctgtaatcccagcattttgggaggccgaggtgggaggattgcttgaaccaacgagttcaagaccagcctaggcaacatagtgagtccctgtctctacaaaagatacaaaaattagccgggtatggtggcctgtgcctgtagtcccagctactcaggaggctgaggcaggaggattgattgagtccaagaggtagaggctgcaatgggtgtgattgcactagtgcactccagcctgggtgagagaatgagaccctgtctcaaaagaaaaaaacaattataatgtcccattcttccctcccccctcaacccttggcaactagcattctttcagtctctgaattaaactgtaggtacctcatacaagtagagtcgtagactgcatttaaaaaaaatttcacaacatgaaatttattatcttaatcatttttaagtatacagttcactagtgttgggtgtatttcatattgttgtaaaatacatctccagaactttttcatctagcaaatctgaaatattgtactaattgaacaacaatccccctccccctaccaccatccctgataaccatcattctgatttctgtctctatgaatttgattactctaggtaactcatataagtggaatcatacaatatttgtctttttgtgactgacatttcatttagcttaatgtcctcaagattcatccgtgttatagcatatgatttccttcttgttcaaggctcactaatattccattgtatgtatataccacattttgtttatatattcatcagatcacagacacttgggttgctttcatgtttggctttgtgaataatgctgctatgaacatgggcatacgtatatctctttgagactctgctttcatttttttgggggtgtatactcaaaagtggaattgctggataaaatagcaattctatttttaatattttgaggacctgccatattgttttccacagcagttgtactttttctaatttttattttttattttgagacagggtcttgctctgacgctcagggtgaagtgtagtggcatgatcatagctcactgcagccttgaactcctgggccctagtggtcctcccgcctccgagtagctaggactatagacatgcaccaccatacctggctgtttaaaaacaattttttttttttttgttgagatggggtcttgctgtgttgctcaggctgacctcaaactcttggcttcaagagatcctcctgcctcagcctactaaagtgctgagattacaggagtgagccaccatgcccaaccacgagtttgcgttcctgccaacagtacaggaaagttccagtttgtctatatcttcatcaatgcttattttctgtttgttttttaataggagctatcctaagtggatgtgaggtgtgtagattttttttttttaatcagagttgggttttagcccagctaacctgctagccctttgagaaatgtatttgcatgagggagtaaagcataaggccagctaggaggtaattgcattgacttagatttgtggtaatgaggaattggtttgattgtggtgggacaatgtgattttgagaggtgacagaaaaatggaaataatttattcaaatttaagaaactgagagaaatgacatgaaaatgacttttacatttgaatttgattgtaatagaaatgtggaagtaaagggaaggagagaaagaataacttactgttcttcagcgttttgggtgatgggaatattgttgtggaaataaatgcctgtaagggcagcttgaaatatgggagcatatgacagcaagaaaacaggtctggaaacttgtttttgtgagagtcagcgggatgagagaggtcatagtatttctctttgaaacatttgttttctttagaaaaaataatctgatgaatttttccttctcaattttttacagctcttgcaagcttaggatatgaaaagagctgtgtgttgttcaattgtgcagccttagctagccaaattgcagcagaacagaacctggataatgatgaaggattgaaaatcgctgctaaacattaccaggtatgctgaaaagtagttactacaataatggtcaacactaaattggattaagtggaaaataatttgcatttaggtttatagatacttcttacgcaacagatgttttctaaaacgaatgcacttttaaaatgaatttattcttactgttaaagcccttagataaactgtctatagaccaggtctgttattcctcattgttttataccgagcacctagcacagtgcctggcacataatagaggctcaataattgttggttgaagaaattatgaaatgtctgagatttcatctcaggcatttagggtaaatccattttaaataaattacctaattaaaaaaaatttgtacattattttcatatgttttcttagagtgagacacacttgaaatttcactgttgttacaaaaataaagacaagaaattggcaagaaaataaaattttaactttgagacttgtggagaggtcatatttaaatatggtcagacacataatgttcataagttgcctaatctgttttacgtactgatcatttactaatatggcatgttattttgtggcagtttattttattttatttatttatttattttgagacggagtcttgttctgttgcccaggctggagtgcagtggcacaatctcggctcactgcaagctccgcctcctgggttcacgccattctcctgtctcagcctcctgaatagctaggactataggcatccgccacctcgcctggctaattttttttgtatttttagtagagatggggtttcactgtgttagccaggatggtcttgatctcctgacatcatgatccacccacctcggcctcccaaagtgctgggattacagatgtgagccaccatgcccggccagcagttgtttattatttattcagcttttttttgttttggttaaaagaacagtaaatgattactgttaaataatatatatataatcatgttgtcattttatattactttctaatttacaaagtgttttcatgtacattatttgactctcagataaaccttgtgatgtatgtcatataatgtcattccgattttacatacgaggaggctaaaggtccgaagtcttaataaagcagtctatttgggtttcaatagttctgattccaaatttcatgtaattccaaatgtccttccactgtttcactcccaaacctcccatgaaatttgcttgtctcagaggtagtctgctttttcccgttgtttatgtttagggaagaggtgagtgatgctgttctgagaaagtaaaaggaaaatataccgtaagcaaacaacacgctccaaattgtggcttgccttacagttttgaatgggcatagatgacaaacataatgcatacgctatttctttttgaggctatacatggcaaatattttaaaatgtgaaaacgagctgggcgtggtggctcacgcctgtaatcccagcactgtgggaggctgtggtgtgcggatcacgaggtcaggagttccagaccagcctggccaacatggtgaaaccctgtctgtactaaaaatagaaaaattagctgggtgtgatggtgggcgcctgtagtctgagctactcgggaggctgaggcaggagaatctcttgaaccgaggaggcggaggttgcagagagctgaggttgtgccattgcactctagtctgggcgacaagagcaagactctgtctcaaaataaataaaataaaatacagtagtgaaaacgaagtaaaattttatttagcttttggttaactgtaactcagttagttagtatatgagattttagaaaggtcattctgaattatgaaagaaacattccattctgtgagggttcacagcagggcacctggtatcatggaaagataactggtggtattagacctaggtccttgtctaggctgcttgccacccagaagctttgtgccgttgggcaagttctttaacctctctagtacctccagttccttatctgtaaatgagagactcagacactttgctgttgtagactttgattcactagtttactgaacaagttcagttgttcattcctagcagatactctagtgttataatacttactgactgcagaaacatgctgttcattttaatacatttgactttgagttttctctgtgttgtctatttatctaactcatgacacctttttttttttttcttttttgagatggagtctcgctctgttgcccaggcaggagtacaatggcgtgatcttggctcactgcaacctccgcctcctgggttcaagtgattctcctgcctcagcctcccgagcagctgggattacaagtgtgtgccatcatgcccagctaatttttgtatttttagtagagacggggtttcatcatgttggccaggctggtcttgaactcctgacctcaggtaatctgcccacctcagcctcccaaagtgccgggattaacaggcgtgagccaccgcacccggccaactcatgacaccttttaatcccagactgatttatttctttttcttagtataatttgtttcatgaaagcaaagttattttagtattaacaaaatataattgagatgaaaaatctgatggggaacatttcactagtgagctctgaaggccagacagaaatcactggcaatgggtagtaatgctgttcctcagaggactaggtgtatgtactacctggggtgtcccctaactacggcatgtttaattatttgaaagatgaatttgtttgggaccaaagcaagagcattgcagtactaaaaatattttaatgtttatccccgcctctattctcatgttaattttgaggaagtatatctaaaaatagtttaatcagattgttccattagtttactttgtttttccttgtaatttacttttaatctttgttaaatctcttgttacgctatagagttttagaaagataaccttattgtctgtaggtcagatgttttagattggttttgcataatataaaaatttaaatatattaactgttcactgagttaacatttgaaatgacttttatatgtaacagtaggaaattaagtcttgctgagttcctataaagaaattctttttcccccctttagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagaggtaactccaatttatctttttgttgcatgtgaaaaaaagtgataaggcttttaaattaagaaagtgattagaatataatatgttcaatgtcgagctgtccttcttgaacttgatacatgaattatggaaaattttcagctatccttttctgaatttgtggcacaaatttacatttaagaatgtaggctgtgtttgaagtcatgaaatagatctttagtaattgtctttaaacactccattctggaatagtatttatgtatgtttttaacatgtcagacatttattcgcaaatatttattggatacttactctgtgccagtcactgttctagtttctagataaacggagttagaaaacaacttaggttttggcgacgggagagatgataagcaagaattaagtagacaggataatttcataaataattgctataagatttcagaaataattgctataaaaaataagagaattatatgatagtggctggtggtatggttatgggatagggatataggggaagctgggctaattttagattcattagtcaagaaggctttctttcaggaggtcctctttaaagtagacctaaatgacaagaaggagtcatccaggcacagtccctagccctgggaatgagggaataagaataattcttataaggcatataagttagcatgagagattgaaaatgggctgaatatgtaatatgggctgaaactgaaaataagagataagtcatcatgtggaagaaataggaattggaatacttttttcttttaaaataacagcttatattgagatagaatttatatacactcaagttcaccctttctaagtatacaacataagatttttagtatattcatagagttttgattaccactatcttattttagaacattaccatcatcccagaaagaagccatgtacccattagcagtcactcctcactcccctttcccccactgctggcaaccactaatctattttgtctgttctaaattttgtgcagaaaatgtgatttcatcaagaaagatgttttcagatgcgtgtacaaacttgtgacctcagtgtttatactgagacatgtcagattagctcatatttattttaattataatggtcatattgtattccagataaaatgaaagatgccatcatagctaaattggctaatcaggctgcagattattttggtgatgctttcaaacagtgtcaatacaaagatactctccccaaggtcagttattgtttttataaacacttgcttactttgcatgtgaaatatttagacttttttgtgtataagaagcaagttgaaacttataaagaaatttgaagttttaatagagttatctgaagtatatagtagaaatagtttttttttttttttaatttaagatgcatgaacaattcttttatgtttaggggatgcctttgtctttaccttttactaaacttgtttttccaagctagaactctttctggaaaatgttgaccatctgttttcaatacttttatcaaatcaaggcattgtgtagttctgaatcattggtgatttggtacaagcatgtatacttgagcatgttgatgattcacacttttaattattgtcctgttttcttaaagatgagccttaaagcgcaaaaacagacataaagaaaaaaggaaaagaaaacttaacaaattcatctgatactttgattagaattcagttttgccaacagggataaaaaattgggctgctaatggacagctaaggaaagcaaccatcttaaaccacatatcacaggaagtataatgttttaatgtaaacctttctgaagtgacaattgtaaagactattcagtgatgatcatttgttaatgacaaagcaaatcactagtaaatttggaatgattaataaagaaaacttaaagattga

SEQ ID NO: 1369 - DNA, 68217 bp, Homo sapiens
ggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtacagtcgcctggccgcagggccacggggccgcctcctccgcttcggtgggggtagggggcgggctgtcacccggacgcgggaaaacatgggcccggccgcgggcgcgcctacctctcgggcttcccggggcccccgcgcccctgccctgcgcgcggccgtggggcgccggtgccctcgcccggagatgccctgccaatgccacccgctcgcaagatgcggcctcgaccccgcctggacccagctaccccaggaaactgcaggcgctcctcggcaggacccccggtgcccagaggggccggaggactcggcgggttcctgcgctgttctgggcacccagtgacggggatccgaaggaagtcagctactgtaaggcaggggaacagacaggcgggtagccctgcgcacatgcacaaccagtgacctggaagcagattatagcccaaaacctttttttaaaaattgaaatggcccaggcctggtggctcttgccggtaatcccagcactttgggaggccgaggcgagtggatcgcttgagcccaggagttcgagaccagcctgggcaatatggagaaaccccggtctctaccagaaaatacaaaaattagccgggcatggtggagcacacctgtagtcccagtttttctggaggctgaagcggatcgcttgagcccaggaggtggagattgcagtgagctaagatggcgtcaccggtctccagcctgggcgacagaacgggaccctgtctcaaaaaaaaaaaaagaaaaaagtgaaatgcatagtgtacaagtggactttaccctgtgaccgcccttcgttgacaccagcttgcctggtctgtgcacccaggactgctggccagaggagcagtgtgctgctgccaacgccctgcagacaggcaagcaaatcaaaatttgccttcaaagagggcatggggtgaccgggggcaccttttcctttaaagtacttgggaaatatacacagttgcagtcaaacccctcttctcgaatgggtcaagggaggcaggcctctggccagtccttgggggaacgtcctgtgggactctggatgactcgagttgccttgctggacctcagttttcccatctgtccaggaaaggagttatactcccaagcttggagattgcttcagtgggacattaatgtctctggaccacaatcatggcctgtgagaatagcccatggccttgcctggtctcaggcctctgcagacatggatccccagagatgcctccaaaccttgcttcccattccttcctctctggcactttctcccgcctccttgtcaggtgcacgaaccaactcatctgtgaacatcttcctctagagggtcttggctttggctatttggggaacaaagattccttgagacatgtgggtgttcctacttagcctcagtttcttcattttactaaatctttgagtgttaccccagatgagtcctctgttaccacgattacggtgaggcagccctgccttcaaggaggtctctaggttgaactgctcctagggtgtggggcctcatctggtgacgttagtaccccctggaccagtgtagaagctgaggaaaattctacacttccttttttaaaatgcctttcaggtaaaggttgttgctgttgatgcagagttgaatgtcttctatgaggaaagtgtgcattttgacagagatcttccagaatttgggtatgtacttgatgtgcatgtgtgtgtgatgggggtgttggttttggggtcctcccgcaaacttttgtattcgcagaccgcactgttgaggctttgccaaatacaggagtggtggtctcggcagacctttcaagcatctttttttcctatacctagagtgccatctcccccatttcttcctaattccattcatccattcatgaagtaagcatcagttgagacctactttgtgccaggtgctaggacctgatggcgaaacaaaaagagaaagctctcccagagcttcccactgagtagtggagactggtatcaaacaaagaatctcacaaaagagtgtttcattataaactctgagaaggcctctgaaggaaaggaactcacttctccaagtgcttattataaaggaatgtgactcagacttgggaggggaagtcccagagcgtctctagggaagtggtgcttaagctagagatcagagtgagtgaagttagccaagcgatggaagggaagttggccaggtgatggaagagcattccaggcagaaggaacaacatgtgcgagggccctgtggcaagaaagagcatggttcattccttcatgcaattgaagaaagccaatgatgctggggagcagagagaggcggaggctggtcagagctccataggccatggtatagagtttgtctttattctaaaagctatggtcagccactaagggccataaggggtaggggtatgggtgaggtatgaatgacaggttgtatttttgttttgaaaatatctctctgggggcattgggagaacagattcggagcattgctggaatggacgtggggaactattaaagaggtttttgctggtcattcaggtatgaaatgatggataggagagagctgagtagtaaaatggacaggtcctgttacaaaattgaatgtgagatgtaagggtgggatttctggctgtccttcagagtggatgttggactgtgggaaagaatgagttttggagagaaagatcatgagttcagcttgggctgccataacaaggtaccatagactgggtgggttaaagagcggaaatttatattctcacacatctggccgttaggagtctaaaatcaaagtgctgggaagattggtctcctctgggacctctctccttggcttgcaggtgaccactctcttgctgtgtcttcacatggtggtcactcggtgcaggagtgcttggtgtctctgtcatctgtatcctaatcttcttataaggacatgagtcatactggattaaggcccattctaatgacttcattttaacttaattgcctttttaaaggccctgtctccaaataatcacaatccaaggccctcggggttaggatttcagcatatgagttttaggggcagagggggcacaattcagtccgtaacactgtggacttgctggttttgaggcaccctcgtgagggcctggtaaaagtgtccttccctgtctgttttagacacacttcctctttgaagccttcccagctgaccctttgtgcacctctcattacccatcacattgtgttgccaactctttgcccccagctaatgcggccccatggagccgaggttagaagccatcttgctttctcacattttttattattgcaggccttgcatgtttgcctttgggtagttggtatgtttcaaggaattggtcttttcaactaagccatcaaatgtgtggccatagtgttgttcataatattcctttatcctccttatgacatctgtgggaccagtaatgatgatctcttgctgttggtcatttctgatattggtaatttgtcttctctctttttttctttggttatcctggctagaggtttatcaattgtattgatcttttcaaagttcaacttttggttttgttgattttcccctgttgttttcttcaagttgtgctctaatttttattacttagtttcttctgcttgctttaggtttaaattgctcttttttccctagtttcctcaagtggaaacttagaggattgatttaagaccttcttttctaatatatgcatttaatgctataaatttctctgtaaacacaaatgctttttatgggatgccttagcagcatcccatacattttgataagttatagtttcattttttttcgttcaaaatattttttagttctcttgagacttctttgactcatgggttatttagaagaatgtttttaggctgggtacagtggctcacacctgtaatcccagcactttgggaggctgaagcaggcagaacacttaaggtccggagtttgagaccagcctggccaacatggtgaaaccctgtttctactaaaaatacaaaaaaattagctggacgtggtggcaggcatggtgacaggcaccgtgtatgctgcacgcctgtaatcctagctagctgggaggctgaggcaggagaattgcttgaactgtggagagggaggtttcggtgagccaagatcgcgccactgcactccagcctggacaacagagggagagcctgtctcaaaaaaaaaaaaaaaaaaaaaaaaaaaaggaagtctggaagtgtgttgtttaatctccagattttccagttttctgttattgatttctagtttaatttcattgtggtctgagaacataccctatatgacttctagtctttcaaaattttaaaatttcctctccctcactctctcttccacttaataagtcagtcctctccactggacatttaaaaaaaggtgtccataaccaaaatatggtattgcttttttccattatattttcaagatattttaaaccagatgcctatagatttagttcattccttccccatcacctcaattgcattgtgggttttctttttacaactttattaaggtataactgatgtacaatactgtgcatatttggagtatacagttaaaagctttaatatctgtattctttcatgaaactatcaccaaaataagacaatgagtatttccatgtcctaaaaatttcctcctgcctctttgcaagcgatgcctccttccccatacccctacccactggcaaccgctgatgtgttttctatcactagtttgtattttctagaattttgtatagatggaatcataattatgtatgcttttttaaaacctttaaaattttacatcacagttttgagattcatccatgttgctacatgtggcaatagttggttcctattattgccgagtagtatttcattgtatgatgttgtatggatggactacaattggtttcacctgatgagggatattggggttgtttctcttttctgttgttataagcaaagggctatgagagtcacatacaagtcttttcgtggacatatgatttcatttttcttggaaatgacataccaggagtacagtggctgagttatacggcaggtatatgtttaacttcttaaggaattctcttccaaagtggtgattttaagaaaaaaaattttatattgttaacaggcattacattgcacttaatatgtaactcaatgaaaagtatacagtgaaaagtctttttttttctttttttctttctttttttgagacagagtctggctctgtcgcgcaggctggagtgcagtggcacgatctcggctcactgcaagttccgcctcccgggttgtcctccattaggaaatggtacatctacacaatggaatactacacatctataaaaaagaacacagaagtttttatgtattgacatgtaaacacagccacgttactgtgaagtgagtaaagcaaagtacagatcagtgagtatagtatgctttctcttgtatgaaaggaggaaaatcagaatattcataccttcctatatttccatgtaaaaacactggaaggagcctggcacagtggctcaagcctgtaatcctagcactttgggaggctgaagcgggtggattgcttgagtccaggagttcaagaccagcctaggcaatatggtgataccctgtctctaccacaaaagtgcaaaaattagtcatgtgtggtggcgtgcacctctagtcccagctacacaggaggctgaggtgggaggatcacttgagtccagaaggtggaggatacaatgagccaagatcataccactgtactccagtttgagggacagagccataccttgtctaaaaagtaaaaaaaaaaactagaaggatacacaacaaattaaagtcatctgtagagaagggacggagaggagagatgagctcacaggtgggattaagacttttcactgttatatggggtttcaccatgttagccaggatggtctcgatctcccaacctcgtgatctgcctgcctcagcctcccaaagtgctgagattacaggcgtgagccaccacacctggccaagttgtcgctattattgccacgcacagatatttatgtcattgaatttcccagtctcttttattgcttctagattttgagtcatagttcaaaaggccttcctcactccaaaattatgaaggaactcacctatgtttttatctagttcttgtaagatttcagctttcttacataaaaatatttggagtttatccaggtacgtagtatgacatttgtatccaactttaatttttcccagatgattcttcagttgttgtaacaccaaccatgtttttatttaatttattttttttatttgagacaggagctggctgtcacccaagctggagtgcagtggtgtgattcagctcactgctatctatgcctcccgggctcaagcaatcctccctccttagcctcccaagtagctggaaccacaggtgcgcccctaccatgaccagctaatttttttgtattttttttgtagagatggggtctcactctgttgcccaggctggtctcgaactcctgggctcaagcagtccacccacctctgcctcctaaagtgctgagattacaggcgtgaaccaccacacccagcctcaaccgggtttttagaagcccatctttacctttaagaggctgaggtgggcggattacctgaggtcaggagttcaagaccagcctggctaacatggtgaaaccctgtctgtactgaaaatacaaaaattagctgagcatggtggtgggtgcctgtagtctcagctacttgggaggctgaggcaggagaatcacctgaacctgggaggcagaggttgcagtgagctgagattgtgccactgcattccagcctgggtgacaaagtgagactccatataaaaaaaaaaaaaaaaagaagtccatctttacctccatgatttgagatgtgaggcttatcatgtgctactttctgtgttcacttaggtccatttttgggcttttgtttttgttccatggtttggtagatctgttcataagccagtaacacattgtttcaattatcccagctctgtaatatgtttgtttgtttgtttatttacttttgagttggagtctcgctctgtcgcccaggctggagtgcagtggcatgatctcggctcactgcaacctctgcctcctgggttcaagtgattcttctgcctcagcctcctgagtaattgggattacaggcgcccgccactggctaatttttgtatttttagtagagatgggtttttgccatgttggccaggttggtctctaactcctgacctcaggtgatccgcctgccttggcctcctgaagtgctgggattacaggtgtgagccattgcacccggcctgtaatatgttttaatatctagaattgttggtcccctctgtttgtttttttttccagagtttccatggctattcttgttctttttcaatatgtacttcagaatcagcttttcaggttccagaaagccaaattgttaatttttttttttttttggacatggagtctagctctggagcccaggttgaagtgcagtggtgtgttctctgctcactgcaacctccacctcctgggttcaagcaattctcctgtctcagcctcccaagtagctgggactacaggcacataccactacacttggctaatttttgagtttttagtggagacagggtttcaccataattggtcaggctggtctggaactcctgacctcaggtgatccacccacctcggcctcccagggtgctgggattacaggcgtgagccaccacacccagcctgttgttaatatttttattgagatcatattatctttataaattaacttggcagaattgacaactttatgagattaagtcttcctgtctaagcacacgttatgactttccatttgttcaagtcttcttttgaatacttcacatgtgttttaatatgtttaacatacagcttttgctcactttggtagattgcacaaatgaccacaatactccacccatccctgtacccacaccctttgcaatgtgactgtaattcctcccatcaaggagtcgtttccctacctgttgatttgctttatccagtagaacaggggaagtggcattgtgccagttctaagcctaagcctcaagcagccttatgtgcttctgctgtcattcttggaactctgcctagccaccaaatgaacaagctcaggctatactgctggagagttggacatatgtggcctagttgccccaacttcttcccctaagagccagccagcccctagctactgttagctacctatgaagcagagccttctagctaccgttaactgactgcagatgtatgagtgagcccagctgagccccatccaatgatagcaagtagaattgtgagcttaatggttttgagccactaagttttgaagtggtttgtgacaatgcagaaattacccaatgtagataattatttttaagtttatttctaacttttttatccttttactactgtaagtggggaagggaggtttctagcagaaacttatcagctgtcttccaaactcatttccctttcttcctaggcactctcctgccttccttgtagttatgttcagccatgtgactgagttctagccagtggaatataagaaaatgtgatcaggcctctaaaagacctagtccatcaaaacctccttctctgacttttctcccatttttggctgatgtgggtgtccagagcaaccttggaagcacatgtggaacatgacagagccaccatcaacctggttcctgaatgactgcatggagcagaactccccactccccactcatgttcctaaccacctactgattgtgctttacatgaggagaaagaaacttcagctgtatcaagccatagaaatgtgtttttccttaactaatataattttttccctcatatcctttttttaaagaaaatactggggccaggtgtggtcgctcacgcctgtaatcccagcactttgggattacagaggcgggcacatcacgaggtcaggagatcgagaccatcctggctaatgcagtgaaaccccgtctctactaaaaatacaaaaatttagccaggcttggtgccgggcgcctgtagtcccagctactcgggaggctgaggcaggagaatggcgtgaacctgggaggcagagtttgtagtgagccgagataatgccactgcactccagcctgggtgacagagcaagactctgtctcaaaaaaaaaaaaaaaagaaagagaaaatactgtttctattgaaatgtaattcacataccataaaattcaccttttaaaatgtacaatttgatggttttagtatattcaaagaacaatatcactatcaccactatgtaatcttagaacattttcaccacctggaaaggaaaccctgtattaattagcatccactgtatagtccccctcctgccagtagtggcaaccacaatcaactctctatctctggatttgctgattctggacatttcgtagacatgaatatatataatatgtgacagccttcttttacttagcataatgctttctttttaaaaaattttcatagctttttgtttatttcaaataccaacttgaaccagatacctggcataatgttttcaaagttcatccatgtcatagcgtgtgtcagtacttcattcctttttgtggttcagtaatattccattgcattgatatatcagagtttgtttttccattcaacttttagacatttgagttgttctgcttttttgctattgtgagttattctgctatgaacatccacatatgttatggattgaattgtggccccccagaattcatatgttggaagcctaccctcatcatgacagtatatttggaggtgaggcctttaggtagataattaaggttaaatgaggttgtaagggtggggctctaatttgataggacctgtttccttataagaaggagagacaccagtgctatcccacttcatgcgcagatgcacagaggaaaggccttgtgagaaggcggctgtctgcaagctggaaagagagccctaaccagaaactgaatttgctggcaccttaattgtggacttctagcctccagaactgtgagaaaataaatgcctgttgtttaaaccatctagtttatggtattttgttatagcaacctgagcaaactaatacaatgtatacgtttttgtgtggacatatattttcatttctattgggtatattacctaaaattggaattgcggggtcacatggtaactctgtgttcaacattttgaagaattgccaaactgttttccaaagtggctgtactattttccattcccaccagtggtagatggtgcctctagtttctctacatccttttttttttttgagatggagtcttgctctgtcacccaggctggagtgcagtggcgtgatctcggctcactgcaagctccacctcctgggttcatgccattctcctgtctcagcctccctagtagctggaactacaggcacccgccaccacgcctggctaattttttgtatttttagtagagatggggtttcaccgtgttagccaggatggtctcgatctcctgaccttgtgatccgcccgcctcggcctcccaaagtgctgggattacaggcgtgagccaccgcatccttgcttaacatttattattgactgtctttttaattacagacggcagccatcctagtggatgtgaaatgcaatctcactgtgcttttgatttgcatttatctaatgataataatgatgttgagtatctttgccatttgtgtatcttctttagagaaatgtctattaagatcttttgcccttttttaaaaaaaaactgtgttatttctcttttattattgagttgtaaaagttttttttaatgtatattctggaaacaagtcccttgttagatatgtgatctcaaaatttttgtcccattctgtgggttgtcttttcactttcttgatgatcctttgaagcaatgtttttaattttgataaagtctaatcttcctacttttttccttttgctatttgtgctttggtgcagtattggttaggttttggtatcaattttatatttacttcactaaaataattggaaaaattttccttcttttcaggtgctctagaacaatttaaatagtattagaaatatttgctatttaaaagtttggtataatttttctgtcaaaccatttgggcctggtgcttttggggcatggggtggctctggtcttccttcttagctggaaatgccagttttgttttgtgtgtgtgtgtgtgtgtgtgtgtgtgtgtgtgtgtgtgtgtgtgtgtttgagacagagccttgctctgttgcacccaggctggagtgcagtggcaagatctcagctcattgcatcctccgcctcctgggttcaaacaattctcccaccttagtctcccaagtagctgggattacaggtgccctccaccatgcctggctaatttttgtatttttgtagagatggggtttcaccatattggccaggttggtcttgaactcccgacttcaggtgatctgcctgccttggcctcccaaagcactgggattataggtatgagccaccgtgcccagccgaaatgccagttttaagttgttaaatacatggcagaatgtctggttacagtttttatctgttttgtgaaggcaacattttttggtgagcttttattgtctgtagtaaaattttgttgctctcttcctctttttccctagtagtatctttttaaaaaatccatattattgagtataatttatgtacaaaaaatgccatccattaaaaatgtataattaaaggtactttgccagatatagacctatagctgtgaaactaccaccacaatcaagatacagaatgtttatatcaccccccaaaagatcgcttttttccctgcttaccgagacaagctcggttgtggagactccaacgcaccagcactagaggaatgaagacaaagacccagaaataaagtgcagtgtgggaatcggctaaaagcctttagagctgagagccacaaacagagttttgcccacatatttattgacagtaagcctgtgataaacattgtttctaaagattatagattagctgaaagcatttcttatgggaaacaaagcattcttttcaagaagcagagaaacaggctgtggctgattatctgcagcaggaacatgtccgtaaggcacagatcgcttatgccattgtttgtggtttaggaatgccttgagtggttttccgccctggatgggccaggtgttccttgccctcattccggtaaaccagcaacctccagtgtgagtgtcatagccatcgggaacatgtcacattgctgcagaaatcctgtttatggccagtttctttaaggcctgtttatgacaggcttagggcctgttcccagcacccactagacttagacaaccactgatctccttttctcagtatagatgaatttgcgtcttctagtctgttcctatataagttataattgtgtacatatgaatagttcatattttttcttgctctgtagtatgatatcacaaatatacaccacgatttatctgttcacttgtttagggacactgggttgactccagttaattattacaaataagtctgctatgaatatttgtgtacaaatctttctatgggcttagactttcatttctcttggctggatacttaggaattgaatggctagatcacatggttatctaatagcatcttggtgtggattctgagcctggttttctctttcctaacacatagttaaaagggttggattttatcagatcagctctttgcactagagtcttctaggggtgaggtgggtggggagagggttccagtcaaacttccaaagcctgtagtccaaggacttgttggtctgttgtgatagtagagacactcttccctccgacgcagcatctctgtgtggctgcccctcctctacctctccaaacctatggggcttgagagggattttataatccaacactgcactcccctagggtgagcctttcttatctagaaggcttctttagaagatgcttctgagaattgccacatctgggccactctgggcaatttgcctgtcttctctttccatctttgcagccctcgtgcctgttcaatcaacagttcccacttggggttggggaaggttctccttcatctggacatttccagagtcatccaccatagggtttctcctggctttgcaatggtctgcctgccctgaggctctggtctacattctctgttgttcttgcaggactcagggtggtgttcatgtgcacaaggatgggctgacggtcacttctccagtactaatgtgggtccaggtaagcgcagggattcctattctccttctatccccaggctgtctcactggcagactcggtgatttgctaggaagtccaaaggtggcagccaatgagagcatctgttgtcaccaggtcctcatgggaaggtggagttggcatgactcctgggatcaggctcagcctcagctggtgtcaacactcccaggctcagaggacttacaaaaaacttccaggtactggagctacagcagatggcaagtcctgccattaaccacctttaaaataacacagagcaaatcttttccaaacatctgcagtcaggccctgtggcctcccttgtaccatgaaatatacaaacatagactgggcatggtggctcatgcctgtaatcccagcactttgggaggccgaggcaggtggatcacctgaggtcaggggttcaagaccagcctggccaacatggtgaaaccttgtctctactaaaaatacaaaaaattagccgggcgtggtggcccatgcttgtaatcccagctactcaggaggctgaggtaggagaatcacttgaacttgggaggtggaggttgcagtgagctgagactgcaccattgcactccagcctggataacaagagtgaaactccatctcaaaaaaaaagaaaaaaaagaaatacaaacatagcccttagggtcttagtgctcagcctccaagatcccttagctccctaatcacctagaatggcaagttatggcctggccagtcagactcatatcaatgccaagccaggcctgcctgctgaggatcaacaggaaaggagaatgcctgtagcaggatctggtgacctagggggccacaggagcagggatgtggacagcatagacaggcgtggtagctccaggggctacctcatcatatgctgcagggtccccgagtccctgaaactggaggccagctaagtgtgtgtcttccaaaagcttttttcagtcctccaatacctatctaaccaattccctatattacattctttttgttcaaaataactggtatgatttcttttttattggtgtaaccctgattcatacactggagaattggggtaaaggatggattttatccagataaactggctagaatgtacttcagagggggctgagccagaccaaggggcagagtgggagggtcgggggttagagacaatggtcagtgtcaggaggtcccagtgatgatgtcgagggcatctcataggccaaggccttcacctggggaggtgagcagtgggtgagaaccaggcttgggggcagggccaaggtgatttctgatctgacgcagcctccaggaccaaacttgatcctagctctgccagcccctgctccggctgcaccccactgcctgcccaaggtttgatgggcacagatagagatggcagccacagccagggctgaaagaagccctcccagcaaaggctgggggtggtggagtcaggcaaaagtgagagagtcttctctgccctcaggaaaacacaggtcagagtgaatctctaattcctgccatgaaatcttaggagggtggtgccaagctctgctgggcaccaccatccatcccactcactgggttttgctagaaaggagggtccaaccagacagtggaggctggaataggggcctggaacaggtggccatcatctctatccactccctccagcctctggctcctggacacagggagtctgggcctgatgctttgctctcacgggagctctctcctttgctcttcacttccctgttgcagtgaagtcagatcactaatatagagggttgaaaatgcaaataaaagaaggcaaaagttggctgccttactttgttagtttttgagacaaggtctcactgtgttgcccaggctggagtgcagtggtgtgatcatggctcactatagcctcaatctcctgggctcaggtatcctccctcctcagcctcctgagtagctgggattacaggctcatgccaccacacccagctaaatttttcattttttgtagagatgggatctcattatgttgcccacactggtcttgaactcctgagctcaagtgatcctcctgccttggcctccaaaagtgctgggattacaggtgtgaggtgatggcatgcacccgtagttccagccacttgggaggctgagatggaaggatcacttgggcctgggaggttgaggctgcagtgagctgagattgcgccactccatttcagtctgggaaccagagcgagaccctgtctcgaagaaaaaaaaatggagaagtaaaatttgaggattggtggtttatgattccatttatttaaaatatttttagcatagttgacctttttatttgattgatgcctacttgtttaattaatgtactctagtgcttacaaatcccaagtcatgagtttcttcatcatctgcccagagtactctgctgtaatggcaggcacttgcgtttcaattctgaggcttgcgtgtctgattcagtggttctgtacagtcatggtgggttctgtttttcttcttaggcactggatatcatcttggagaagatgaaggcttcgggcttcgacttctctcaagtcctagccttgtccggggcgggccaggttcgtttgcagcagactctgtctgccatgtgagggtgactgtcctgggcaatggtgtgggtgttgaagagatggcaacccttggatggggagcggctcattcttgacagccactgcacaaatttcactgtgaataaaaatccctacaactattttactttggagactgtataacttgtctcgttgcaaaaggatctgagacagttcttaggagtaagtattatataaaataggacgcttggtgagagaactgagttcctctgaaggggatggaggaagcaattgacatgaatttattatgactgcttgggggcaccacaattgcttttctatttcctgaaagtaaaagcaaagtcaaaaatgatcctaataatgatagtagtttcagtagaaggaagagtattaataatgatatcagaggacattgactgagcacttagtgcatgccagatacaactctgaggcctttccagatgtcatccaacttaatccttatgattctacagggtggtgctgtggagtgcttggtacacactcagggcatactgtctgggtttgatccctggctctgccatttacaggcagtgacctgggatacgtcatctggctttctggtgcccccgtattctcatctgtcatagggtcattgtgagtgtaagtacatagcacagtgcctcctattaatacgcagtaaacattattaaagcttgggcttctgttattatcgttgatatttacatgaggcacggagaggtgatgtcacttacccaagatcacacagtgctgggagtgggagtcaggacctgagtctatctcattcagtcccttggctgtgctgggatcacttttctccatgctggattactgtattttcaaatcctcactaggatgtaactaatttttctgaagatgcttcttcctccatgacctaacaggaatttattgttttggttcttgttaaacacaacagagattccctgggtgatcttgtccacttctctctcccgaatcccaggcctggacacccatctccctcctagctaatccccgacccccatggctggatatcccacagatgcctcagacttagcatgtcccagactgagttctgtctcccttcagacctcctcctttctgggttctctttctcagggaattctccccatccacccagggcacaactcaagtgtcatccctgcctcctccaccttcccaccccacatccaagggtcctcacgtcccactgatttgtctgtgactcttgactctaccatctcttctccagcgctatctgcttgtcattcttctccaggtctctaccgcagcctccttgcctccagcctaccttccccgtgactcccacaagcctttaatacattcagctctgtgcacgctgctccccctggtaatccagggttcctaccacctccaagataaaccccagcctcctgagcatggtttcaggctcagtgctcaggctgtcccctctctcttcagcccatcacccacccccgacccagcctcaggcccactgcttagaatgccactcatcccgggacttgcctggcgcccctcacctgcagattctctgcatgcaacacacactaggaccatttcctgatactcatgaccacttcctctcatctgtacccgagttggttaggtgcctctgttcccacgaccctgtcactgcagctccatagggttttatagttgtacatttgtgtccttttccctgactcaactccagtagcctgaagaatagggatgaaagtatcctattcatctgtcgcaagcctggcatgatctatgtgcttaataaatgttcattgaatgaatgaatgaatgaatgaatggggtgagtgaataaataaatgaatttcaggtaatattacaagcaatgtctttaaatgcagttttacaaaaggcattaaaatccagaccaataattagttcttggaccttttctataagttgtagggtagacagggcagagttcctccccattttcttgaagtggaaaccaagtcccaggagggtgatgagctctgtgactaagaagtggcaggggcaggtgtggagcccagttctttggcatgtggtctggggtctttctgtgtcttcaggaggctgtgacactggtgtgtggtcatgtgaccatgtgcttgggtttcccaacagcaacacggaagtatatactggaaggctggagcccagcaggcactgacaagcttatcaccagacctccggctacaccagcagctgcaggtaactgtggctacgttgtgtgagtgtgagaaacttctgcagagtcccaagtcctgtgggtcctgaagcctgctcatctcagtgttgcagctgtgctcacgcgccctcaccagaagagctttcaacctcaggcttttggggagagaccccactgggccagttctaagttacagcacaaagggctggcccatgtgtctccaaccaaggtcacctgggaagaagcgtcatgactgccgtgatgggcagtgtgaccgccagccctggggcagatctccaagtcagcggatggagcttaagcctgtgcctttgccctccttcccaggactgtttctccatcagcgactgcccggtgtggatggactccagcaccacagcccagtgccgccagctggaggctgctgtgggtggtgctcaggctctcagctgcctcacggggtcccgtgcctatgaggtaggctgaggatgcggggggtgcagggggtggtctggttgcaagctccggaggcatagtgggtgacctgcctctggggggatcacatgaggtcatggaggtgttgtggagccagcaacaggcactctggcccctgggtcctgatccaggccacctgctgccctgtgtgttcccaggccaggctgggtgtgcacatggctgtgctcctgacatggaggtgctgtgcatgggggtgagggtaccccctcaatgagaaggcacctcctgtcattatttgtaacccggggattacaacaggacttacgttttgggtaggtttgaagctgaaagaagtcagtgcatgtaaggcacttagtgtagtgcctggcaatgttaaaaaaaaaaaaaaaaggaaaaaaaataatagtgtctctgttccacaggttcaaccttgtccccaggggtgattgtgattaggccagcttgggttacatgacctcgctggagtagaagttttggggatagggccaactctacttgggccacctgaaataacaatatgtgggtggggaaaataccccgatccctcacctggtggcttggtcagaacagtcaccgtgctgtgtgaagagcaagggttattcactcagggttgtccagtcctgatgtgggagaggccctccaggaaggcccagaagttactcacttctctatcctgtgggtgcagagccattgtttactgcctgagtatttgattactaaggacattttaaggattcaaaggccaagatcacattgttcagtagatatcaaacagatttaatgcttatttttaaaatatttaattattagaaacgaggtctcactgtgttgcccaggctggactcctgggctccagagttcctctcgcttcagcctcctgagtagctgggattacaagcgcacactactgtgcctggttggggcttacttttaaaagcttttatggtacctactcctatccagagcatgctacattaaactcactttgtggaggtaattgttcattctgtgtaggatttgggttcctaagaatttatattccttttccagcgttttacagggaaccaaattgcaaaaatttaccagcagaaccccgaggcctactcacatacggaggttggttaaatgttcctgtttgattgaaagtcacagttgaattcttttcataatatgttagaatagatacatcttacgtgcagtgactgaaaacattgataagcagacattaacaaatgatatatttgatttgcttttttctcattgtcaggacatttccaaagaggaggggaagaatggaatgtgggaaagagaagtcaggggttctcctgaccagaagggtgagggtgagggtccaggtgggagcactggggactgacgtgttcctgaggccacctgaatggaagatctgagtgtctgagcaggctgtgtctgctcactttcctatgtggttaacgcaggagggctaccaggcacatgattggcatagagtcagtgttttctttggaaatgtataggactgggcatttgtgtccccagctgtggcccttcagccagagcctctgtcacaggaacccaggttcattcctggctccacagttgctgaagccagcacttgttgctgcctgagaaacagccccacgccctggctagtgattttcatcttgtgataaggaaacgatcagctcacattaaaccaaagcacctttttaatcttagaaattaacatgtggtttattatttaatgatttgaggttccagattattctgcagcattagccattaatgtaggctttgggtagaggggtgaaaaccctccctaaattctgtgtgtggaacgaagtttgcctgacagaggacaggaggtgataacattctctccacagttccaaaggcccatgattctcatgtggaagtacagacccttagggtggcattgaaaatccatcatctatttctctggctagtgctcagggtctgtggcttctgaggagccagctttcctgacgccctgagagtgtcctggttggttctgaggccacacatccacttcccttgtaaccagaaggaaatgccaaggagatagaggaaggaaatcagggcacacattccccagcatgtggattccggatggaaatgcagcttccctaagccctttctcatagggcttttggtttttgtctcttttgaacttggcagttttatggcccatcagaaactgtagagaatgaatgctctcccgaggagtctgctcatggtattccagctgctcctatctgagatgcacagtctccaccattacttgggccttttgttcaaagtttccacttccctctccaattttttttcatgctttgtgtgtgtcagaagcattcagtagcgtagggtatgtggaagtgaggcacctctcactgtttctttcctttacagagaatttctttggtcagtagctttgctgcttccctgttccttggctcttactcccctattgactacagtgatggtgagcctcggggtatggggtgggtgcctgggcagtgtgcatgtggcatgtgggtgtgcaagcagtgggagccccacctaccccgagtgggtgccaatcttgtagccctgtcatctgttgccaggaaggaagtgtattcattatcttttaccacataacaaatgaccccaacacttagcagctgaagaccaccgtgtttattttctcacctagtgtctgagagtcaggaatgtgggggcagcttagcttggaggtactggttcgggatctcccacaaggtggcagtcaagctggcagccggggctgcagtcatctgaagggttgactggggctggaggatccatttccagcatcatgcacatgactacaggcaagaggcctcagttcctcacatgtggctgttagtgacactgcagagagggagggaggagacagaggccaagcagaagctgaggagtcttttataccctaatcttgaagtgatgtgccatcacttttgtctcatcttactggtcacacactaggtacggttgacccagtataatgttggggagaacctcacaaggggtgaacaccaggaggtggggatcagtaggggacgatcatggagcctggctcctgcaaggagctattaaagtttttgtttcacatttggtgaactcatgagatttgtgagcttctagaatcaaaaccccgaaaaaaataaattgcagttgatgccagtgaggagggaaagctgggaggaggttgctgcaggaactcttggatgagcctaagtgtgagaagagtgtggacagaatgggggtagagaatgcagggcaggagcccagagccgtggatatggcttcagaatggagcctgggatgctctgagcctcgtgggaattcatgggaagttttcgagggctgttgtatgccaggctttattctggtttcaggagagagagtgactaaggagtgctgttaagcttccctcacaatctggaggaggcaacagggttccctacagctagttctgtagaactcagacaggcagaacagtcaacttggagtagcctgcatgtccacccgttctgcacacctgccacagagctgataaccgcagcagctgttccggggggcattccagaggtttatgttccttagccacagctgggccctccactctgccccccttcactcacctgagatgtcacctcctcatttcacctgggcaggtgacaccatcagcatcccagcccacctctgtctgcctccaccttggcccagtggaggaggagttctctccacccatgctctgggttccctgtcctttcccatcctcaggaaagccttgggagaaggaggatgttttaggaaagagctagtaggttgatctcagtgaccagaaggaagtttagaggactctgagacctttccttgaaaagttagatgagattgagaaatccctgggagctgacctggaaacctaagggacatggagagtggttcctggtcagtgtgttgctgctagttccaggccccctgggaggtctttgagcagcagatttccaagctaactgtagtgtttgagttgatgaggaatatttggaggaggtgtggtgccgtgtgtttccaagggcccctcttgtctctggttctctggttctagaacaacacaagcatatataccttccatgaagaaagagctccaggtacaagttgtggcaagagaattatctgctctgtgccagatttgtgcattttcacaaaaggtccattttcaagattgtctgttgtttgtttccttccttcctcaggttctggaatgaatttgttgcagatacaggataaagtctggtcccaggcttgccttggtgcctgtgcacctcatttagaggagaagcttagcccaccagtaccatcatgctcagttgtggtaggtctcctttctggtgatgtggctcatttaagagctggcagctaccagggaagcactgtagcgcacacacacacacacacacacacacactctgcacacacccttatttgttcactcacccacaggcatacacatgcagggtcttcagtttagcctaagatgtaagtcagtgtctggatcagtgccttgcacacagtaggtgctcaggtacatgccttatggtcagcgggactttggaaaattccactagaaatttattagaatagggataaaaatggcaggtgattgcatagctaaagaaaaagtgcacagagtgctgaaattctagggactactgatgaagcttgaaggaggcagccttggggaaaatagaaataccagcggggctggcacagcacaggccctggcactggacagcatgggactgaattctggttctatcagctttgtgactttgtgtctcggtttcctcatctggaacaaggggaatgatgctattcatcttacagggctgttgtgcaaattagatgagttaatacttttaaagcacttaaaaaatagtgcctggtcccacaggtaatgggaaaaacatttacccatcacagcggccccacccatttgcagtggacactggctgtgaatgccctggggtgttctacttggccagccctgttctccattgtcctgtggggacagtggagtagagagagagagaaaaagatctgggtgctgcccctggggccctttggtgggaaatgcttaccacagagccagaacaaccagaaggaactctgggtgggacagagtgctggtgtgaagaagggacaagggcaccctgaggcctggagggagtcgtgtaactgggaatcttgggccatgtggaggaggggctgctgtgaggacttcgcgttgggagtctcagccacagaagcacttttgttttcttttcagagacagagtctcaccttgtcacccaagttggagtgcagtggcatgatcatagctacggcagccaccaactcctgggctcaagtgatcctcctgcctcagcttcctgagtagctgggaccataggcttgctccaccatgcacagctaatttttttttttttttgagacagagtctcgcttttgtcacccaggctggagtgcagtggcgcagtctcggctcactgcaagctccgcctcctgggttcacgccattctcctgcctcagcctcccgagtagctgggactataggtgcccgccaccacgcctggctaatttttttatatttttagtagagacggggtttcaccgtgttagccaggatggtctcgatctcctgacctcgtgatctgcccgcctcggccttccaaagtgctgggattacaggcgtgagccaccgcacccggcctaatttttttttattttggtagtgacagggtctcactatgttgcttagattgggcaattctgcctcagtctcccaaagtgctggaattacaggtgtgaaccaccgtgctcggccgtttttcttgtatgattcacactgacatgctgaaaacagcctctgccaccatgaggcagaatgtcaaagccaaaccatcagcatccaaagtatgccatgaggccagtgcatggagctgaaggaacagccatgtggccctgtggaagctgacagcacagctttctgacccgctttctgacgcaggtcagaaaggcagagaaagggcagacagaaaacagccaagccaccgggactggtaatccacacacggcttttagttggatgtgaaattcagagcaggctttgtttgccttgtgcgagaacacatgcctccaagaaggagcctgtgcagacaagcagcttgaggatcgggaaagaactgactctgaaaaggcattttcatttgtcacgtaggtgtcacatgtgggggaaccactcaagacccatgtttttcgtcatccctctttttgcaggtagtgctcagatagccctccctgcactctgtcttttttggattactttccttagaacattgctctctgcacgttcacgtccaattattgttaatccagtcactggggtgatagagtgagtgtgtgaggcattatctgctcccatgagtttgcttactggtgtcctgttacctttttttttttaatgctatatccagaatttggagcttataaagcaagcacaagttaggggttggtttgttctctctatcttaaatctcaagatcagcagtttttgaaatgacctcatgctcgtggtttccaaacctgcactggacttctctggcgatttgtgaacaggagggacatgcccagtttgtgacaggaagtgatgtgactccaggctctgcaaaagattccttcaggtctggtgacctggagactgtagcgttttcgtggcctgaagggtgggtggctgtgctgggcaggcgggatttacctcaacagagcacctttgctttgtccccgtccctcagggagccatttcttcctactacgtccagcgctacggatttcctccaggatgcaaagtggtggccttcactggggacaacccaggtgagtatctcggggagtttcactctccagtgagcctgactgggtccatgctggatgtttgagaattccagtccagcctcttggtgaaaccttctgtggtcattcctcaccacccccacccatgctggatgtttgagaattccagtccagcctcttggtgaagccttctgtggtcattcctcaccactcccaccctgcgatctgactccttgtacctgccccatcttagctccgactctgccctcaggagctggtcagtctgctctctctggatgaaaactgcccaatgattatggaaggcagtcgtgcccaccccatccctaacctgtcttttctgtttcaagatgaatagctcaattcctccaacccttcctctaggacatggttttaagtctctgccctgtcatctgatctgcagcaatgacttgtttctcgtccagacacctcatctccttccctagcctcttctcttcctcctcctctcctctgggtagccctgaagccactcctggaggggcccttggatctctgaaggaaggccaggtgggctacactgaataacaacctaactactacccctcaacctcacccccaccccaggaaaagtaagtctttttctaacgatccaccagattagggttacatttaacagtaactagaaaggttaattttaaccttaatcagaaagattaatttctgtcctttcagtcttctttctgtgctcataaataagcattgtttcttttaatcaacctgggcagtatctttctcattttaacagttgtctagagctcagttgtcccagcatttatttcactggtccctgatggatggagggtggtgttgcttcagtgtttgggcagtgcagacgatgttgagattcacattcggtctcgtctctttgttgttataggataagttctcaaaggtgggattcctagatccaaggcttctgacacacacactgctgattgaacctcagtggcagtgtttgagtgcacctgttcctcactcccatttcacctttattcacatgttgattcactcagcatttagtgagtgcctattatgtgccaggccttccttcagtgctggggcccttcagcaatcaaggcagataaagattgctgttgtgagccatgtgtggtagtgtgcacctgtagtcttagctacttgggaggctgaggtgggaggattgcgtgatcccggagttctaggctgccgtgagctatgatcatgccactgcactccagcctgggtgacagagtgagaccccacctatatatctcttaaaaaaaaaaaagattgctgttgtgggctttgtgtctaaggcagggcacagagagtgaacataacctcacccccttcttttccattactgcctttgtctttctttgctgtatatccttggtgtcttgtcttggcctccttgattctctgcactctcggaagtgcctgacagtggagggatgtttggaccccttcagggaagagacttcacagctcaaatcagcggccctgctaacagagacttcaccccgtgacccctatgaccttctcctcttagggcctcctgagcgctcagctcccctgctcctgcctccaccctagggtgtgggtgggggttggaggtgggggctctgcgcctgcctggagagccctgtggtttgctttgtggttcccatgtggccgccagctaaccagaagctcccctcccattctcagcgtcgctggcaggcatgagactggaggaaggtgacattgcggtaaggcgacttcccacacccataggctctttctgtttccacactcacacccacactctgataagtagcagaggtgctgctgagacccagatcccagggtcccagggtctgggtcccagcaggatctctgctacttatcagagtgtctgccggttccaaaagacagtggagggaggggatgggggcgcacatctttctcagaaagtcattgttctttgctagatgggcaggacccctgcctgcttcacagtggccagtcttagtgcatgcagtggcagagggtcagatgtggggccaaagggctgtgagcagcgcagatgaataaggaagacataacccagacattcctacttctagtgggaaagtcatatggggaaccagccatcacccaaaccattatttagatgcagttgtgggaaatcagcacagaagatccatgagatctgcatctggggagctaactcctggctcatctggtatgggagggtcagaagtggctcttagaaagtggccttgcatctgaggtctgcagcatgagtgaagtgacagggttaaggtgggtggagtacagcgcgtcgctggcagagggcagcgtgtgtgggcaaagcccaaggtgcccacctctgcctatctctcctcaggtcagcctgggcaccagtgacaccctgtttctctggctccaagagcccatgcctgccctggaaggccacatcttctgcaacccggttgactcccagcactacatggcactcctgtggtgagcttgggtgttggttggcaccattccctgggtgaggaggtgtgggcaggtctggcaccatcttgaggaccccaagtcattccactaagctctggaatgactccctccactttcccgggctctgctgggcaactgagacccccaaggactcaccagctcttgctgacagcagagctgggtggggaataacccaagaccctgtgtccttcaagcccaggttcaaattctatcctcaccagctatatcctgtgtgaccttgggcaaactctgtagtgtggcatgtctgagccacactttcctcatgagatggggagggtaagagcatttacctcacattgttactgtgacccgtctggcatgtggtggaccctcagcaaatggcgggaaggacatcctgcctcccgacggctctcatggaagggacatgctctgtgctctgaccacaggcctttggagacctgtccaaagctcctgagggaaatggtttctgagctcctaagccctaagaaccattggagaatgtggctagttaatctagccctccctgcctcattgtgcccatggtagaatgtgcagaaacccaagctccctgtctctacctggggctcctctgtgtcagcctcctgtgtaaacagcccaagacaagggcgtttccggcacctcccagggacattcaggggcctgaatctgaggaagagcctccgatacctaagtttcaaagcctgctgtgcactgactaggggtcgtggtccagcctgacctgcagttcctctgcctgagtctcttcactgaaactcatgggtccagtcagcaagcaccagctccctccctcagagctatgccctcttctgcagctttaaaaatggctccctcatgagagagaagatccgcaacgagtctgtatcccgttcctggagcgatttctctaaggcactgcagtccacagagatgggcaacggtggaaacctgggtaggccagttggtggtgcccaggcctgtgaagggtcagcagctgccgactggaggggcagagcctggggccccatgagctgggggagaggagggccgtggagaagtccaggggagtcctgtctgtctgcacttatattccacacatcctacaagctggtgtggaaccctgtgttctgagcaagggtggggctgtaaggctgtccttggcttctgctctgagcagaacatcaggccatagctatgtcttctgtccccaccaagcccctggtgacagcatcagagagggcagcctctaccctggtgcatccccgttcacagcctctgccccaggcacaaggaaaagtccccagtgtctgggcaggcctgagcagggagggtctgtgcctcccttggtcaaacctgttttgatattttaggattggctgggcagctgcttcctattccaggctgccaagtgagagcaggaagagttgtctttgagaaaagctagctcagggctccctggttcccttctatcctgttggagagaaggaactgagaatattcacaggtctcatctgggggatgaaagagccaggggacccagggatatggggtcattttgtcctgttctaagtctgttaagaagctgatcttttgttttttgactaatgacggctgatctcttcctggttttatttcaggtttttattttgatgtaatggagatcacccctgaaattattggacgtcataggtttaacacagaaaaccacaaggtacatgtgctgttggtgttggagttacattggctccatttgtgagtgtaaaatttaacaattgcctatcaaattatgttacttttagggacttcattcattcactcatccattaatatcatacacacttgtggtgtgccagggtgcattctagatcctggggaatctgcaggacctaagacagacacggtcctttccctcagggaggaatgcagaaaacctgagagttctcttcctatttaacaaatgctaacactatcattgtgtatcacagaacttatttccttggcgagttttatcctatacccatcaagaacccatggatcttgagatcatgaatttcctcctggttgaaagagctgctgagcccaggaggtactaacgtttattgagcccatttggtgccaggcattgtgctcatggttttctataccttcctcatttacttttctttttttttttttttaattttttgagatggagtctcactctgttgcccaggcttgagtgcagcgggacgatctcggctcactgcaacccccacctcgtgggttcaaacgatcctcctgcctcagcctcctgagtagctgggattatagatgcaagccaccacacctggctaatttttgtatttttagtagataggggtttctccatgttggccaggctggtctcgaactcctaacctcaagtgatacgccccctcccaaaatgctgggattacaggtttgagccaccatgcccggctatcatttacttttcaaagcaataggcactattgttcctctttctagatggagaggttgagactcagaggctcaggctaaataatctgcccagagtcacaaggtcatagatggtggagggggctcaaacccattcctctctggctctgaagctgctgttttctttctcctccacaatgtgacctttctcgggaaggatttagttggttcttgctcctcaaaattgacattgctgctggagagtcactggagagtcatcaccacattttgggttgtacctgagagatgtttctgaccccagtaaatggggggtttatgtaagacactctgtctggaaactgtaactgtcagagttggcgttggattcagtggcagatgatggcactacatgttggattatgaatggaaagctttgtataaagtaggaagttcatctcaatcttctgatggaggatcagtttggtttcttttgttagagtgagaagctatgcctgttctctttcatgcatatcaatcctagatttgtcaaggagaaagtagtgttcttcattcattcattcaaccagcagatatgtatgattggtgccaggcaccggggacacaaaggagaacaaaacattggtggcccttgctccccagagcctgctgtctaggagggagagggacagtagacgactgaatgagcatgtacatgaatgcagcaggtgctaaggctaggttgcagaagaacagagtgccgcaaaggaaagcagctggtgggcgggttggagacttaccctgggtggggtgatcaagcctgggcgtctctgagaaggtggcctttaggttgagacctgaaagtactcaggatctcaccatggaaagagtaggatagactttcaggcagagggagcagcttgggaactagaagaaggtcagtaaggttagagtgtagctgtttatgagggggatggcggcaggttctagcattggtctcaggtgccagagaagcaggagtgagcctggggttgatgcccatcagtgctagcttgaaggacatgccacaggggtgggatctcagcgtaagctcgtggctctcacttatctagtatgtactgcattttccaggctctgttgtctaatctgatcattgcaacaaccctaaaaaacaggcgccactattacctctgttttgttaagaaaaagaatgatagcaagactaatgtaacttattgaagattgcagagctgaatggtagacagaacttgaactctcagctgcctgagactaagttctgtaatgtctcttgactctcttcaaagtgacatgcatgtgaggctgtgagcttgtgtgcttgagtagtgtgtttgtgtgagtgtgtgtgacaggcaaagatagtggttaaagagcccagctatgagtttcaaatctgggctgttgtttaaaaagatcacacacagacacacacatacacacacgaatggacaatgagagttccttactctgtgcccaccttttcctggagacaggttgcagcattccctggggatgtggaggttcgagcactaattgaaggacaattcatggccaagaggattcacgcagaaggcctgggctatcgagtcagtaagtgagccactggcagcatgtgtcccggggtgggggctcagggccagctcactcgcaggggccagggctagtggggcaatatctactaaagttttcttacagggggacttgtgcaggagggaggtggagcctgacctcagggatggggtgagaaagtgtcaattggcacttgtaggcaagcatagaatagcagacaggttgttcccgcttctcagctgtgtccacaatagcctgaccttttggccaggacctgtaagacttcggaatggtctttctgaaaccctaagctccaagctgcagatgagctgtcctgagctctggactgcaaagacataggcagtgcaaggtctggggacatgaatggatcttggccttctagcctggccaggtcccattgcctgtgggacacagtctgggtctttcagcttggacagggaagagggggatgtagtaccactgtcaaaactcggaagactgatgtcttagttcattttctgttgcctataacagaatacctgttcctgggtaatttataaggaaaagaaatttatttcttacagttatggaggctgagaagtccaaggttgaggggccatatctgaagagggcctgcttgctagtagggctctctgcagagtcctgaggaggtagagggcatcacatggtgagggagctgagtgtgctggctcaggtctcccttcctcttctcagaaagccaccagtcccgttcccacgataacccgttaatccattaacctgttactttgttaacccatgaatggattaatccactcataaagccctcatgacccaatctccttaaaggtcccatctttcaatatgtcatgttggagataaagcttcaacatgagttttggaggggacacatattcaaaccatagcaactggcatggagagggcagacccagggccgggggaggcaaaaggaggagaaagggatttctgacaacttgagctgtagaataatcagcattaggatgtcagtgagttccccttacaggtggcgttggaatggtctaagggtctgtaaggaggttggactggccgcctatagagtccaggtttctaagatgtatttgtctctctgggctatagctgttgtcattagagaagatagtgaagctgctttgcttgagggccttcctatgatactctatggacaatccaagttctatgtaatatatattttatacctttgaatcaactgagtaaaaggatactataaaaatacctattagggaaacctcttagaaaacctgttagacagcatctgctaaagctgaatatacgcctacccagcaatctcatttctaagtaaaggcacaacaggaatttttgcatgtgtttactaaagatgtacaggagaacattcattgcagtactatgctgaatagccccacagtggaagtggcccagtgcccattaatagtagacagaaaaaatgcattgtggtgcatttgtacaacaggatactacacacaaatgaaaatgaaccagcctcagtgatccacaatgaaatgggtgaatctcaccaaatgtaacactgagcaaaagaggccaaacatggacatacatatggcaggggtctctgtacatcaaattcaaaagcagatggcactacaggccaggcacagtggctcacacctgtaatctccacattttgggaggccgaggcaggtggattgcttgagtccaggagttcgagaccagactgggcaacatggtgtgttgcgggaagtcagggaccccaaacggagggactggctgaagccatggcagaagaatgtggattgtgaagatttcatggacatttattagttccccaaattaatacttttataatttcttacacctgtctttactgcaatctctaaacataaattgtaaagatttcatggacacttatcacttccccaatcaatacccttgtgatttcctatgcctgtctttactttaatctcttgatcctgtcagctgaggaggatatatcgcctcaggaccctgtaataattgcattaactgcacaaattgtacagcatgtgtgtttgagcaatgtgaagtgtgggcaccttgaaaaaagaacaggataacagcaattgttcagggaataagagagataaccttaaactctgactgctggtgagctgggcagaacagaaccatgtttctcttccttcaaaagcaaatgggaaaaatatcgctgaattctttttctcagcatggaacatccctgaaaaagagaatgtgcgcctgcgggtaggtctctgaactggcccccctgggcgtagcctgtctcttatggttgaggctgcagagatgaaataaactccagtctcccatagtgctcccaggcttattaggaagaggaaattcccacctaataaattttggtcagactggttgatcccaaaaccctgtctcctgataagatgttaccaatgacaatggtgcccgaaacttcattagcaattttaatttcacctcggtcctgtggtcctgtgatctcaccctgcctccacttgccttgtgatattctattatcctgttaagtacttgatgtctgtcacccacacctattcgcacactccctccccttttgaaaatccctaataaaaacttgctggtttttgtggcttgtggggcatcacggatcctaccaacgtgggatgtctcccccagacacccagctttaaaatttctctcttttgtactctgtccctttgtttctcaagccagccgatgcttaggaaaaatggaaaagaacctacgtgattatcggggcaggttccccgataatggtgaaaccccttctctacaaaaaatacgaaaattagccaggcgtggtggcacatgcctgtagtcccagctactcaggagactgaggtgggaggatcgcttaagcctaggaggttgaggctgcagtgagccatgagaccctgtctcaaaaaaaataaaaaaagcagatgaaactatttactattgttggaagtcgggataattagtagttacctttcagaaggggcctgtggggtgctgtcaatgttctgtttcatgttccatgggtgtgtttagtttttaaaaatttatgaacattataggcttatgatgtgtgcatttttcaggatgtgtgttctaggtcaatacaagattttaacatgtgtaaaatgaccaccatgagcattctgattgccctcatcccaccaccctaagtgtaaaaagacgtttcctaaaggtctgcaaagacttccaagttccctgaaaatgagactgggtgagcagggcagggttggtgctggagttggtggagtgcctggcaggggtcctccggctgtcagaagagaaccccagggaacggaacagcccagcatacagggagaagcagttagggcaaaaggcccccatgggctcaggaggagctgatgggattgtggcattattcccagcctctaaggcatttcttgtgcaaaacagcatagagttacttatcctcttagcaagcttaaatgcagaatcagacctgtcttgccgctctgctgagtgatcacttaaatagacatacttggaaccaacagaggttgcacgcacgtgaggactcattctccaggctgctgtgtggactggccagctctttcgttcttgcccagacatcatctcatttggctttaatagtgtctaagggcaataaagaggcactttgaataaaaatgattattgtgatactaacagctgccagcatttgttgggcactgagtgtgtgcccggcccagttccttagcaattaatctttattaacaacagtaccgctgaagtaggtactgatatgattcccacttcacaaccgaggaaaccaaatcttgcagtggttaaataacttggtcagggctggcagagctgggatctgaaccaagccagtctggctccagatgctggattctcaaccactggctgaacctgctttttttaaggaacaatcgccctcttgatgtttatagacaccatcagacatgatagaaaccagctgggcagggctaataagccatagttttcagtttatatttcagtgtgtttcatgttgtttaggttgattgtaaaaacagtcaaatcttgtaataacaagtttgaaaaataaagaaaatgggcctggtgctcacacctgtaatcccagcactttgggaggtggaggcgggaggatcacttgagcccaggagtttgagactggcaacagagagaccatatcttcacaaataataataattataaatatcccagtatagtggcatgtgcttgtggtcccagctactgggggtggggtggcaggggtggcaggaggccggggggatcgctggagcctgggaggtcaaggctgcaatgagctgtgattgcaccacttcactctagcctgggcgacagagcgagaccatgtctcaaaaaaataaaggaaaatgactcataatcccatcccctctctccaaccactggtatcatttagggacattttctcccagtctcctttatgagcttatttccatacagccatagttttgttcctttgtaccttatatgcaaagggtgtatacaagaaccaaagtttgtcagaagtcatctttgtggtgctgcgtatgatggccaggttacttttcctgcatttgggcactgagggtgttcttgttttttttgtttgtttgttttctttgttttgttttgttttgtttttctggagacagggtttcactcctgttgcccagactggagtgcagtggtgtgatcttggctcactacaacctccgcctcccgggttcaagtgatcctcctgcctcagtctcctaagtaactgggactacaggtgcacaccaccacgcccagctagttttgtatttttagtagagacggggtttcaccgtgttggccaagctggtctcgaacttctgacctcaaatgatccacctgcctcggcctcccaaagtgctgggattgcaagtgtgagccaccgtgcctggccattgttcttggttttccaacgtggaatcacactagagcatcttccatagcttgaattatttccccaggaggatggcagtccttctctcttcccagacactgtcttcacggccagcgatgaagatgggagaagctgagaggtgggggctgaatgtcttcttctggacagagccaaggggctggatggaaagcagcaggtcttaaaaacaactatttgttttaaaatacataacgaatggatgtctttttatcacaaaagattcatgcaaaacagaaatatggaataagaagcaaatgcccccttcatttgcctcccagactcctttccttctttccagactgtgacttccttcctgtgagtttctgtgttagattgaatcatacggaattgccaatattgaagaagttttgatttacaaaaatggcaatttcatatggttcgacctgacacgtgtgtgtgtgtatatatttaacagaaatgctattacattctatgtgttattctgagacttgctttccataacagtatgtacaggtctacctttttgttttctaatgactggcatgaggtctgataaattattttatagccctagttgaaggacattaagattatttcttgttttgttttgtttttgtttttgttcttgttttgagacagagtctcactctgtcacccaggctggagtgcagtggtacaatctcagctcactgcaaccttcgcctcccgggttcaagcgattcttgcacctcagccacctgagtagctgggattacaggtgcgcgccataccacctggctaatttttgtatttttgtagagacggggtttcgccatgttgcctaggctggtctcaaactcttgacctcacgtgatccactcatcttggcctccaaagtgctgggattgtaacctccactttcaccatctcattctatgccctatacccttgtccctagttcattcttgtttgtgtattttttttcccttgagcatgttagctaaaggttggtatattttattaagcaatgttaatattttgttttgtgctcccttttattaatttctaattttatctttttaaatgctttccttctactttatgaattttttctttttctgtatttttaagttgaaattttagctcatttattcctatcctgtattaacttctaatttatgcatttcagaatgctacatgttaactttatttacataacatatctttcatttctaaaaagatagtaattttcatctttttctgcatcagtgagtggtccttcaaactggcccctcgtccttttgacatatcttccatcattccttgagcatttccatagcttctagtataaaaaaagtttcaggctcatcttgttttttccttggatcagccttgtaatcttccatttatccaaggggccctgacttctctgagtgggagagatgtttggatgctctctctggatgctcattgctactgggatgatgctgttcccagcccctttcagtgggctgagctgggaatatgtaaggatatataacaacccctttcagtgggctgagctgggaaatattaggatatatatatacatatccaaatatatatatgtctgtatcaatacacacgttacctttctatttgtctgtctgtctacttctccatgtgttgaaaaacatgagttcaaccctatacactctacttccagtccaacaccatggggttcattctggctttcttccttcccatatttgtatcttatcctaacagtgacaaagttgattcttctgacccctccagattgctgcctccttgacatgcaagccccattttggcttctctgcttacccttacctgtgttgtctctgtgtcgtctctccagcagcctcttgaatctgccccactctggttatgtacttacatgtggcccttgagccacttctgtttgcctatttaatggctttttagagaaggaagaagaaaaaagaaaggtaggaaggtagacaggcaataaatatttttaaagggaagggtccatttacatttaatgtaattattgaaatgattggatttaattgaatctatccatttattttttatttttttaatccatccatttacaaaatggattacatatcaatttttctttttcttttcttttgttctatatgttcttttttctttcttattcttttcctgtcttatttttggattaactgagcaatgtctagtattccattttatctcctctgttggctttttaaggtatacactttttaattgatttttaaattgaaatccttaatttgaaaagtctggtttgcactaatattatacacttgaattttttacgaacatgcttgcactacaagaatgactaaaggatgtcttccgggctaaagggaaaatcataccagatggaaagtcagagcttcaggaaggaatgtagaacatctataaaaagtggattctcttaagttttactttgtctgaaaatgtatttattttacttcatattaaaataatgttttctgctgtggaattctaggttggcactttttactttcagcactctgaaaatgtcatttcattgttttcttgacttctaatgtttcagataagaaattaactgtcattcttaatgttattctcctgaatgtaatggggttttcttctctggctgatttaagatttttctattaatctttgattttcagcagtttgattatgatatacctaagtaagggttttttaattattattttgtatgtatcccctttgtgattcactgagcttcttggatctgtgggttaatgtcttccatcaattttggaaaattcttagccattatttcttcaaatatttatttttccctattccctctttcctttcctctggacttcagttacacatctgctgttgtcccataggactttgattttctattcttttttttttttctctctctccctgcttcagttggacaagttcattttttgttttgttttgttatgttttgtttttttgagacagagtcttgctctgttgcccaggctggagtgcagtggcatgatctcggctcactccaacctccacctgctgggctcaagcgcttctcctgcctcagcctcctgagttgctgggactacaggcaagcgccaccacatctggctaattttttgtatttttagtagagatggggtttcaccatgttaggcaggctggtcttgaactcctgacctcaggtgatccgcctgcctcagcctcccaaagtgctgggattacaggcatgagtcactgtgcccggacttcagatggacaatttctatcacacctctttttattcatgtttctgctgtagacagtctgctattaagtccatctaacaaattcattttggatattatattttttctatttctagaatttccatttcattctcttatactttcttatgtctctgctgaaatttttcatattttaaccattttgtccatctcttcctctgactttatatcatctttataattattataaagctcctatctgctaattcatctcagagtctgcttttatttactattttactgccatttcctgcttcttaaaatgctatttaattttgtttgaatgctgtacgttgtgtttaaaagtacggtgttgactaaagtggctaatttttaaaccttttacttttgagataattgtagattcacatgcagttgttaaataaatagctaatgtttacctgcagaaaaggcttgcccttctatcaggaagtgcgggtgaggtggtggtttttttttgttttttttttttttttttttttacttttatcatttaatttttatttttaaaaatgtatatagtaaaaaagctgggttgcggagatgtcggtcagtggattaaaaattttggttagggtacaggaacatattcaagagatttattgtacaacatggtgatgatagtttataacagtgtattgtattcgtcaaaattgccaagagattttaggtgttctcaccacaaaagataagtatgtgaagtaatgcataagttaattagctcaatttagtcattccacaatatatacatatttcaaaacatgttgtataggataaatatgtgcaatttttattgtcaatttaaataagtaacaaaataagtaaaaaaaagtctagaagcctatataacagcatactaacagtgtaactctggtgtaactagggttggtttttactttcttcattttgtcttttctaattttttgtatagtaacttttatcactgggcttaacaggaatctaaaaaatgtatttttagcaattgttatgttatatccacaacatgatctatatattttgtcagggaggtttattttttgactcagaactagtttgttcttgaaatatgtactttattcttttaattagggcttaaaatgttaaaatatttctaaagaggactattttgggactctacagtgtacctctttaatgagaacacccacagtttaggcctattaaggcatacttcctttattttactaaagaattaaaataataaagatttgataattttctttcttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccatcgtcatcatggcccgttctcaatgagctgttgggtacacctcccagatggggtggtggccgggcagaggggctcctcacttcccagaaggggcggccgggcagaggcaccccccacctccctcccagacggggcggctggccgggcgggggctgaccccccacctccctcccggacggggcggctggccgggtttttttttgtttaatcaggggttggatcagtactagttagttttagttcaccagtagttgcagtgtcttgggatcaggatcagcaggatcaggcccctccctccatcaagtctttgggacctaaccactgagattacagagctctttctctgttttccagctcttcccccacttccacatcactgcttccatagtagttcactggagacatttggtgggtagggaggactagctctatattggagactcttccagatttcagtcctccataccagcccaaatgtagttgtttttcttttctagcaaattttatctgcctgtagagtcttacttcttcatgtctcccatgctgcaggtatgaatcagcacttaagggctcatctcattctggaatttattttatttagacttcttgaatttacaattttttgatagcttcaagcaaaaatatgatgctctggttgttgttgtttattccattctgtcattgttacagcacaaatgtgttctttcttgaccatcatcatcttagctggaagtggaactatatgtcttttattagattaaggtttattattattttactatttatttttatttatttattctaaaatggagtttcacttgctctgtggcccaggctggagtgcaatggtgcattctcggctcactgcaacctctgcctcctgggtttaagcaattctcctacctcagcctcctgagtagctgggattacaggtgcccaccaccacacctggctaagttttgtatttttagtagagacggggtttcaccatattggccaggctggtctcgaactcctgacctcaggtggtcttcctgcctcggcctcccaaactgttgggattacaggtatgagccactgtgcccagcctattatatttttttggagacaaagtctggctttgtcaggcaggaatacacccaggctggagtacagtggtgtgatcacggctcattgcagccttgaattcctgggctcaagcaatcctcccacttcaacctcccgagtagctgggaccacaggcatgcatcaccgtttccagctaatttttgtattttttgtagggacagaatctttgttgtccaggttggtctcaaattcctgagctcaagcaatcctcctcctgccttggcctactgaagtgctaggattagtaggcataagccactatgctcagtcagtttattgtgaaaaatatcatgtatacagtagagtatatgtatcttacagcaagttataaaacatattaatcaaacatctgatgatcagcactcgggttaagaaatagaacatcagccaggcacagtcacttacacctgtaatcccagcactttgggaggccgatacaggcggatcgcttgaggtcaggagttcaagaccagcttggccaacatggtgaaaccccgtctctactgaaaacacaaaattagccaggcatggtggcggacgcttatagcctactcaggaggctgaggcgggagaatcacttgaacccaggaggcggaggttgcagtgagccaagatcaccccattgcactccagcctgggagacagagcgagacttcatctcaaaaacaacaacaacaacaacaacaaaaaaaaagaagaaatagaacactagaaccttggagtcttgctgtgctcctcttccactgtatcctcatcttcccctcatccctgcagagatcatttctatccagatttttgtattataatttccctggaattctttatggttttgccagctgtgtatgcattcctttaaatacattgtggctttttgccctttctgaacttcatgatacatggaattatactacatgcggtgtgatttgctgctttagatcaacgtcatgtttatgaattcatccatgttaatgtgcatagatagctattagctgttaattttcattgtactgtgatattccatcacatgattatacaaccatttatccatttgctatgacctgactgtgtctccccaaattcacatgttaaaaacttaatccccaatgtgacagtgttgggagatgggcctgatggaaggtgtttaggtcatgagggctcttgtgtattaatgccactataaaagtgctttcaggagtgagttcaccattttctgcttttcagccatgtgaggacatagcattctggggattctgctaaacattctacaatatacgggacgatccctcacaaaaagaattatccaacccaaaataagcagggttttattctggttggaagaggaatcaagcttttttctgtgatgagtagagctactttccatgtttgtctccatgcctgctgtgggagctcagtgtcatttcaagttcctcttcactcagtccccccatgcaccctccccagctagtagcccactttcactaatgagcacttctttactttagcttggggacaaacactgctgctgcttctgctgctgagtgtaagggagtggagggaagggtcttgagacccctgctgtcatgaagtcagttgtgtactctcagcagcagtttatgagggttcttattttcccatatccccaccaacacttaacagcaacaacctttaaatctgttgccagtctgatgggtgcaaactggtatctcagtgttagtttaatttgtgttttcttaattaacgatgattttgttttgttttgttttgagatggagtttcgctctttttgcccaggctggagtgcaatggcgcgatctcggctcactgcaacctccacctcccggttcaagtgattctcctgcctcagcctcctgaataactgggattacaggcgcacaccaccatgcccagctaattttgtatttttagtagagatgggatttcaccatgttggccaggctgatctcaaactcctgacctcaggtgatacacccgtctcggtctcccaaagtgctgggattacaggcgtgagccaccgtgcctggccaattaataatgattttgaacagctctttgtaactctggtttctttctctgaattggctatgtacattctttcccatttttctatttgatttcctatctttctcttattgatttgtaggattttattgtatactttgaatattaggtttttgacagttttttgtgttgcagatatctctcatttatctgttgcttatttatagtgtcagcaatttaacagaattttgatgaaattcatcaatttttcatcttccattttatgcttttgagatattgtttaagagatttccccccactccagtatcacagaagtactgttttatgtttctcctgttgatgttacaattttaccttccacatttaggactttgatccatctgaagtctttgcgaatgatgtaacttgggatccaatttgattttttccacatgttgatccagttttccaaacactatttactaagtggtctgttttaccccattacttgtagtgccccctttatcatttatccagtccctatatatacatgggtctttctctgtactccctttcattttttttttcctttttttggagacagggtctcactttgccgcacaggctggagtgcagcggcgcgatctcagctcactgcaacctccacctcctgggttcctcccacctcagcatcccgagtagctaggactacagacaacgtgctaccatgcctggctaatttttaaatagtttttatagaaacagggtcttgccatttttcccaggctggtctcaaagtcctgggctcaagcaatctacctgccttggcctcccaaagtgctgggattacaggcatgaaccatggcacctgacctgcactcctgtttctacttcatgggtttattggtcttgttcttggggcagaaaaactgttgtattattgtggctttgtagtatgtcagtattagttggctagggctgccataagaatgtgccacagaatgggtggcttaagcaacagaaatttattttctcacagttctggaggctaaaagtctgcgatcaaggtgtcggcagggttaatttcttcttaggcctctttccttagcttgtagatggtcaccttcttcctgtgtctccacatggtctcctcctgtgtgtccctgtgtcttcattttctcttctcataaggacatcagtcatactggattagggcccacccctaatgactttatttttaacttaattacctctttaaagaggtaatatctgtctttatcttcaaatacactcacattctgagaaactggggtttaggacttccacatataaatttagggtagacacacttcagcccataataatgttttaatatgtagtatagcaattatcccctccttgcttttctttttaaaatattgtctgagctgtttataggtcttcatttttccacaaatattttataagaaattggtctagttccttaaaagagtccagctggaatttttatttaggttgaataggatgtatacattaattggaaaagattgacatatttataatgttaattcatattcattcaagaccatggaatatcttttaatttatttagatattcttttttgtactttaacaacaatttcaactttttcttaatagagacttttgaattctttgttaaggtattcccttacatgtaagtctaccttacatttctggttgctgttgtgaaagttaatttatatattttctattgtatttgatagttgattattattagaaatgccattgattattataagttgattttgtatctggcaaacttattaaactcttgttagttttattagtttgtttattctttattttttccaaatagatggactattgtctgcaaatgacagttttcttttcctttatttcaatacttatatattttagttgtttttgttatcttatggcattgactggtagatctaatactgtgttaaacagtggactggatactgtgaatctttgttttgtttgtagttgtattagttatctattgccatgtaacaaattatctcaaaatttagcagcttaaaacagtaataaatgtttattctcttatacagtttctttgggtcaagaatttggtttcagcatggttgggtgattctgattgaggatatctcctgaggttgcagtcacaatgtcatctggggctgcagtcatctgaaggcttgactgacgctggaggatctgcctccaggctggctcactcatgtggctgttggcaagaggcctcagtctcctgccatgtagacctctccctagggctgcttgagtgtcttcaggatgtggcacttagctttccccaaagtgagtgatccaagagagcatgatctgtgtcagagcgagatggaagcctcaatgtcttttatcatctagtcttggacttcatacttcatcatttacacaaggttctattgggtatacaagtcggccctattgaatgtgaggggggactacttgaaggtgtgaatatcaggagggagggattatgtggaggccattttggaatctggctgacacaccagtctgaaagaaagtgcttctaaatctctgttaagaatgacatttgttataagttgtggatatatgacttttatcatttaaggaagttcccttctcctgttttgttgagatatttaaaacaaaaaaagtattaaagacagttaaggtgggtggggcagcaaccttacaagcaaatgaatgtgacaggcctgcacacacagagccagctttggatctctcccgtagtcctgtgtgataagtgggaggcattggcccatcatgagccctctgtagctgaagaactctgcaaaaacagccctttctgccttgggagaactggcatagctattttacttttttcttttcccttgcagtgtccaagacaaagattttggccacaggaggagcatctcacaatagagaaatcttacaggtaagcgttagtagtgggccttacaccatggcctctcccatatctgttatgtctaagagccagagactggataggaaggacagcctccattcccactcctgcaggaatggggagctcttagctcacactccaggaagcagctctgttgccttacagctcacactgtgagtgggatctgtctcacatgcaggtgaattctatggctgtgtacaatccactctctgataccagcactgtcctctggagtcacatggaaagtgcctgttcttccacatggcaaaccttctcacatctagtgccagtgttcttgtcttcctcaaggcctctgccttccaatgtaaccatcgctgattctccaaccagtcctcttataacacagttgccagactgttactgtccttctggtccttcattatgccagaaacatatgaccaaaagtagaatcaacctgcagatgtctgacactcagactgtcacctgtggggctgtcagagcctgttatggagacattgtgcatttttgggtgtagcctggggctgccttaactgttagagtaactgtattagctgtttgcttgtgactacctatcttaggtaagatttttctagaaacagagcctgaaatgggaattcttctataagcagtttgttgagagagtactcccaggaagaaggaagtgagggactcagggcagtgcagaggaagaaggataagtgaggatatggtcttgtctggagtctacttcagctccatcctggtggggaggtggggctctggaacatgaattataccacagagctgattttaccttgggacaagggggccaacaggccaccctggggaggttaaatctcctgtgagcggtggcctatgctcagccaaggtcagctttcttgaggaggtagtgctgcaagccattagtagccagtactcacagcagctggggcaggatgcacaatggtccagtgagggggatctgggtcggcatcagtggcatctactacaatatctctggtcaactaagacctcccccaagttctttccatgtgaactcctcttagtacaggtcctccatttgaaatgtatgcaatttatttgtgaacctaaatgggaaacttcaccattatgcccatgaaacatgctcttgttagcttgggtttgtttgggcttgttaatgttagtctaatacccagctgtctccagccctaggtcagtgccatttgctaaacatacttcctaaatcttctgccttgtctttggtgaaatggctaaaaagtacagggacagcctggggagctgtggctctccactacggacttcccccagctcatcctgactctattatcaccagggtagcatgaccaagcatactcctcttaaggcagtcgaggtggaatggaaggggtcagaagacatatgagggagagagcctggaaagtgcatcccacaatgtctgtgttccctctgaggaatggctcaccacagtagaacctctgtgtccttttcaggtgcttgcagatgtgtttgatgccccggtgtatgttatagacactgccaactcggcctgtgtgggttctgcataccgagcttttcatggtaggttgatggagggagacagctatctctggaagtggccaggacatggggtgggctgaggagggtggaaaggggagagtgaggtgtacccagtctttggggacattggagtcttggggacttcagcttcatttttctagctcccagcaggtgagaaccaacccatactctctgttcctttattctttgcttaaagtggagaaaaagaggctgggtcctaactgaatgaggtctggtcagagttaaggtcagcacagggacatgggaaaagaacacagggcatggttgagagcacgtgggcatgagtctggacagctagagggcaggagaggtggacaaagtccagagccgtcttttcagcaagaacagaagttgaaacaaaggggaaggcttcaggcccaagcagtccaggaccctggacagcaccatggagccctgttgccctgttggaggcctcgctaaaactctgggtattaagggaagctccccgatctaggcgagttctggcaggagcagcacctacctgcaagggcagtccttcaagttggatcaatttgctctgtctcctgcttgctcagggagctcctgtagcagcccaggtggttctattcttttcatattcttaacatttaacatacctatttcagcttatatttttcttttcttttttttttttttgagacggagtcttgctctgtcaccaggttggagtgcagtggtgcaatcttggttcaatgcaagctctgcctcccgggttcacaccattctcctgcctcagcctcccgagtaggtgggactacaggtgcctgccaccatgcccagctaattttttgtatttttagtagaggaggggtttcactgtgttagccaggatggtctcgatctcctgactttgtgatctgcccaccttggcctcccaaagtactgggattacaggcgtgagccaccgcacccggcctaagcttatgtttttctatcaacgttgagaattaatcaggcaacatatccttctctcaataattaaccttggccgggtgtggtggctcatgcctgtaattccagcattttgggaggccgaggcgggtggatcacaaggtcaggagttcgagaccagcctggacaatatggtgaaaccccatctctactaaaaatacaaaaattagctgggcatagtggcacacacctgtagtcccagctactcgggaggctgaggcaggagaatcgcttgaacccgggaggcagaggttgcagtgagccgagattgcgccattgcactccagcctgggtgacaaagtgagattccatctcaaaaaacaaaaaaaaataattaacctcttactcatttattctctccccaccccatctacctcaccctgcctcatgccatatcctatatcaagatcacttgggaatttatttccagattcttatattaagtacatttaatattatattggcttttattcacacttacctatgagtctgcctgcctgcctgcctgcctgcctgcctgcctgccttccttccttccttcctctgtttgttactttgtcttttttttttttttaacttcctgacatttcggttgggtgcagtagctcacgcctgtaatcccagcactttgggaggccaaggtaggcggattatgaggtcaggagatcgagatcatcctggcctagagggtgaaaccccgtctctactaaaatacaaaaaaaaaaagaaaatagctgggcatggtggcgcacgcctgtagtcccagctactcgggaggctgaggcaggggaatagcttgaacttgggaggcggaggttgcagtgagctgttgcagtgagccgagatcgcaccactgcactccagcctggcaacagagcaagactccatctcaaaacaaaaaacaaaaaaaaacaaacttcttcttctttctcctttatttctatgctgaggttttgttttgttttgtttaagacaaggtctctgttgtccagcctggagtgcagtggcgtagtcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttgtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctctgctgtccaccccaccaccattccagtccctcatccattctgctctgagctgggattttctagcatttggttaggaaaactggtcctcacatcttcagagggcccttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagagacacagtatctggcctcgtggactttacagctcagcaaaagagggatcttaaaccaataatcactgaaatatatgggcacaagttgggaaaagtgctctgaggaaaagcagatggtgctgagcgctaaggagggcctcctgagcaagtgatggtcttaggtgcatcttagctgaggagaagggaacaggcatgtgaagagtggaaagaacattccatacagtgaaaaggctctgaggcagaatgagtggagagaagaccaggctgtccagaatgtggtgaacgaggggagagaggaggggcaggcagacccttccccatcatatgtcgaggttacccgacctattccatgaaaggcacaaccacaaagagaaagacaagctgggtcctgctggagacaagcctgcacttgccatttttttgttttgttttgtaattttattgaggtacaatctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatgtgcccttttcagaggttgtgaagttagctccaaatcccagactagctgctaccccaagcccgggagcttctcaggtgagagaccatcggaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaatttgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggatagtgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagtctagggtagggtctggctctttcattctatctagaaggaggccagcaaggaggaagataactggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagaccctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgggtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcgggtctacagctcccagcatgagcaacgcagaagacgggtgatttctgcattttccatctgaggtactgggttcatctcactagggagtgccagacagtgggcacaggacagtgggtgcagtgcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacctggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtgggtccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcctcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactgtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacagaaattataacaaactgtctctcagaccacagtgcaatcaaactagaactcaggattaagaaactcactcaaaaccactcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagaagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaatgataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaaaagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacgtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatactactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacagaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggtggggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagtacagttgcttttagtttttcaattataattaagtcttcttagataaaggatttaaaaaaaaaaaaaaccctttcctattctacatgagaatttgacctttggttaactttctagctctgttttccttgagatctcataaaagtggactatcaacggttttactaggcaacattgcttatgtaaaaatggcctttgcttgggaaactgcatctgaactgagaaaaccataactacctggtgagaagtcttcctcagggcctccttgagtgcagtgactcctcctggtcctgcctcctacctactaagttgttacaggagatacttttgtagggcatatgaggttttgaagccagggtcattcttttgtctgtatgatgtggatctcaactctttttttttttttttcttttttttgagacagagtcttgctctgtcacccaggctggagtgcagtggtgcaatcttggctcactgcaacccccggctcccaggttcaagtgattctcctacctcagcctctcgagtagttgggattacaggcacctgccaccacacccagctaatttttgtatttttagtagagacggggtttcaccaggttggtcaggctggtctcaaactcctggcctcaggtgatccacccgccttggcctcccaaagtgctgggattgcaggcatgagctaccatgcccggccagatctcaactgtttgtgcctgggctgtaacctggttgggaggcaaagagaccctctcctggacagctgtgtgaactgctgtatggactgctacatggtcttccattgagaggagcacctcctgccactgtgtttctccaggctgtcttcccttggctcatggtggtcttataagtctgaatgtttagtggtatcaaagaagacccttggtggacttggcatcctacatttaggattatttccttaggagagcttcaccaaagtagaataactgggtcccatactatgggctccttaatacagatataaagtcaagtctatttcccaaagagttgtatcaccagctttcaccagctgtgcaatgaggcagccatttctaggtactctcaccagaatttttttgaaattttgtagatttgatcataaaaattggtttcttgtcataatttacagttttaaaaaatcttaaactgtaggtttgagaactgctagcatttcctcttttgtgaattgatgctttctttcgcccagaaaaaaagttaaattgcaagtaaacgggatttaaaaattttaaattgcaaagtgcaaccagatgtaagaggcattttccccctctgttctaaactgctttttctgcccttctaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttgg

SEQ ID NO: 1370 - DNA, 10165 bp, Homo sapiens
tgttgtagaaaagtcttttattctatcggtcaggccccatctggcccaagaatagctgagcagagcccatccctctacccgctccctcctactccggcttctctttgtcctgcttctgctcctcctccagtgccaaggttcgctcacgctcctttaccagctggacgccacagtaggtgacaaacaggatggacagcgtggtctgggggaaccctgtgtggggagggagtcatagatgctcaggagcagcactgcatcctcagcgacttttgtcttcccacccctctccccgcttgatgggccctcccttctgagtcccaggggtgatgagggagataggaggcattttggaaggtcacggtccttgaggctgatgcctggcaccttctgtatccccacacccctgtccctcacctgtgagtagcaggcgccgggcaaccagctctgtgaatttgaggctgttcaggctcacaaggttgtacatgatgatggcccagaagttcatggctccaaacagggcccggaccctacgggacatctgcactgacagagaggcctatccggtccaggaaagcatgggcagcgggacaagaggccaaaggaaagaggacatggtgggtcagcagccttacccacctggccagtcaggtcttggggctatgtctgggtctcggagagccccaggtcagctctccctccttgttaaacatggggaaacaggtccagagagaggacaaggcctgaccaacatggcaaggcccaggtgctccattcctcatagaagggagggaggggcagattcctacagagtgagccattgctctgacaactaagagggtggtggtgagaaagttctggattaggggccaggtgtttggacaactccagaaagcagcagtgcccccccgccctctatgacccagccagtcccagccccaggtcttccctgctcacctcaattcgtgctaggggcccccactctgccagtttttgcatccagagctcaaagttgaggccaaagcagttaaggaatgaccacaggtagacaatgtcacaaggcccaagccacagtgtggtgatggcaaatgtggccactgtggctgccagctctgggatcacagcggaatgctccccaccaatgtggttatacacatatctgcaggaaagatgggagaagggccactgggagtgtgggaaagggcagggatgagatgggagaggacacacaacagggcgtcctcctcaacactgtcaccctgggtgcattcaacattcctgacctcacgtagcagctcctcctccaaccaacttcaaattgtggcaggctcagcctgggacattatagcttctctatctctgttcgtttacttcccaaatgatctcatccagacccaagatttcaagtactagctctatgacgatgacccctaaatctgtgtctttagcccagtctctcctgatttgtatatgcaattgctactagccatgtcacttgattgacagattcccctatccctgctcaaacccagctccgtcctcatctcagtgaatggcaccaccatccattcagttgctcagggtataagccttggtgccatcttggattctcagtttgcctcatcacccacatccaagcaagccagcaaattctgttggctcctctcagtcctgaccaccactcacctcctctaccaccaccaccctagtcaagatgatcactcttctcacataaattattgcaagagcctcttaagtggtcttcttgtttctgcttttgcccccatggttcattctccacacagcagccagaggcatcttttaagagtgtagctcaggtcacatcacttccatgattaacctctctgaatagctccccattacaataggaataaactcagtctctttactctggctagaagatcccaagtggtctggtttctgttcccttcctgaccaaatcagccaccatgctcccccagttcatcatgctggcctcactggcctttcttacctttacacccacacagttggtttgtgtctcaaggcctttgcccttgttgttccctctacctggtattctctgctccacatctccttatcactcaaatctcaattcaaatatcatctcctcagagaagcctgcctagaccccgactaaagaagcttctaccctgttgtcaacttctatcccattgcaattttattttcttcataacacttaccactctctaaaattatcttatttatgtttgtttacctgtttatggtctgtttctccccactagactgtaagctccatgagttcagggtctttgccatgttcactgctgtatccccagtgcctagaacaatgcctggcacataggtgctcaataaatatttgttaaataagttctgtggaagacccaggaataaccagcctctccattcctcgacctcctcatttccaatggctttttctccactccacctcagccacccacacccatggccatgccccaactttgtcaccacttgaaagttcactcctttctaattcccattctttgcccaactcctcttgacctcctggccccccagcttcagttcttcaatcccattgatcttgtgaccctcccaccttcaccaccgtccttagcaggcttatatccaatgagtcatgactataaataatctaaaaacccttattcctgacttcttccttgtcatccatctgggagagcccaatcacttactttctcctcagctacacccaggcagctaagccccatgggggaaatctcacatcttcacatgctggagttcataagcccaccacctccaataccacctgggtactcagtgccaagatttctctagtcagctgcttctcccttgctctgcaagggccactgtattcttatctccccacaagtatgagtggagagatagtatgagtggggggatccaggctgggttgtgggggtaagcatatatgttgcctctctccacgtccctgtcctggctttctcagctgatggccgtgcctcctgcttcatggacaaggctgaagccttcaggtggaatcccttacttgtctacattaacctgctttcctctgcatccacactggcttctcttcctcctcctcccactgaagccaggcctccgcctggaactagacaccctcacctccttcctcttcagggacctcactccatcaatcacccctgtatcctgcatccccagcttctctgttgaataattcttcttagcatgtcccattctctcctatctttaacacatccctcttctccctcagccactcctgtcttccccctgcagtcccaggcttcttccaggagtcatcacacacttctctactcctcagttgactttccctccttacctgctcctgccttgcccatgaaaggctgaaaacctccatgtcaccagcactaatcctcggtctccagcttccttgaggctcagtggcatctgaccaagctgtccccaccatgcctggatggtcttcccttggcttccagggtggcacatgaccttgattcttctcctgcccctccaactactctttccagtcctttctgctggctccttttccttccaagcagagctcttgcaggctgaatctcggccatccccgtctctcctcttctcacaccactccctctcctgaggacttacccactcccaaagcctaaaaaccacctgcccacactcaggacgctctgagttccatcagtcctctggaccctcagaaacccagaccctcagacccaaccacctccctgaacctccacagggatgtctcctagattgcgactatacatttcttaaactgaagccctctctggaaactgccctccatcctcccaggctgcagacagcaatttgagcgtcatctccttctccttcccaacacccacagttcatggccacgtcctgttcaggctgctgactgtgtgaccctcctcccaccacctctctccacctcgagggccctcacttaaatcctaacttctatatctttcacccagacctctgccaatacctcctcactgccctctttgcttcccctggcccaggggtgatcttttaaaatgtggacccatcttggcactgccctgctcagacacctggcaggatggctgtgaccacccccaccccactcctactcacttgcaaagccagtcgttgatgccacggtcaaagtgcctgtaagaggaaagcagatgggcatgttgccatcaggcgcagagctccccaggcatgggggaagaggctaggggaaggtgtggtcccagggggtgagcctcccccgtcctggccagcactcacgtttccgcaaagacgtagagtgcggtgatgcacttgggaggctggggtgggtccaggtggtcgaggcatgccacagtgttgacaacaccaaagaggacggccgccttcacccagtcatacaccaggtttgaataggctaggccagctgggggcagggcactgtcactgcctggggtccaatcgcctggggcctgcccccatgaagaccctgtcccaccacttccttggggagacaccaggctctgcccgccccacggagacccccccatattgtggaaatcagtcatgcctggtgaagtgggtggggtccgtgggatgctgctctggccccacaggatgaagctaatgccaagacccatgcattagaaagaataagcccctgctcccacgccctcaggtgctgtgccctgcgtgcctcagctcccctgactgtggcaccgtgggggtgcagagggtctgttttcctggggcggcagccctgcccccatttctcttctgtggacccaccgagggcactgtctgggaggcggttggcgaacttgaggtcgctggggatagtgaggatgtagaagaagtgaaagaagatgtcgacggccatgatggccaccacgcttaggcctgcctgggctcggatgtgccacagctcaccctcgcgtctcactggctccacctggctcacctggggggatgcgaagggtctgagggaagaggcaagccctgcctggggagccctgtctgaggggggctcaccaactacttggggcaggaggagccatggctttatccaggagtcctgcctgagggtggagacagaggtcaccctggagtctgaggaggattcacagccagccatgggagacccagttctgtcctgggagccccatttgagtgggaagggaacattcgtggcctgggagtcctgtctgagaaaagagacatgtctccaccctggggtccctgctggaggggaaaggtggccccatcctggggtctgaggagggaggggagacacggcttcatcctggaatcatgcctgaggatggggatacagcctgcttggggaattctatctgagatggaaaccccaatctgaaaagggagattcagccctgttctagaagcccacagggtgtcccctcacctgagcatggaagcgatcaaaggtcatgatgggcccgaagaagaagaagggcaggtagaagttgtacttgagcaggtcagctaaggagtagtggcggtcagggtgggcacagctctccagtgcaaagctggtgcaacgcagcactgtgaagctgctgcccccatgaaacagcacctcttgaagatcaaaagtgcctgttacaaacccgctctggagggggaaagaacaggccaccagctcactagggtgcctcctgtctctggaaaacctattccccactccctagcttcccacaggggcccagcctggtcctgtcccttcctctcttccagagccagttaactttggccactgctctatcccagcaatgcgaggagcaggggatgatctggatagttcctcctgtgatgcaggtgctcaccttgtggccaggacatacccaaaggcttgaagacaggtggaaagtgaagggaatacttggggatacttggggtgcaaggactttggatgaagtgagaggtttgggatcttatccctacaccctctacccctgcaccagttcacacctgccaagagattagggggtccatcttgaaggaggccaggctggccaagccaaggccaagacagagccagggctggcccaaaagcgaggccacatagaggcccacacagtgaccaagcagcagcagcaggtaccaagggcccattgtgcccatcacagccaaggccccgtacacagcatacatccaggagcggagctgtgggcagggagaaggcttcagtttcgccatataaatgggggcgtgaccccaggagggggttcccacaacccttgtggtgaaagaggagctggcagggagaggctgggtggcccaggtccagctcacctttggggcaaccatcgtgcagagtttagcaaacagcacatgtccggagagggcaaagatgatgacgttgcgaaaggaggtgaaccacatcacccactcgaagtcagccacatcctggggcagtccggggcagaaggaggtggggcaggtgagggtgggagaggggacaggacgagctggaacctgggctggtcagagccccagcacctttcccagccttcatgttcttcttttattattatcatttttaaatttaataataataattattttttaccactagccaaacccaacgtgtcctctttatgcaaacacaagagcagtgcctgcaggtctccacactcctctgtgaaggaagtaccgaggcaggagggtagagaggagtgaagggcaccatgggggctgccgggtcgcttgaagctccccctctcctccgcacgttgcctgccattccccctttactgctttgtttctgggaaggaggtgctggaggctccactgaagcacactccactaatgcgacctatttcccaagtgagcagggcccgggcaaacttgatgtcccaggaggatacaggaggggccagtaaagaagctgaaggcactgaagctcaagccagaggccccagagctgtgagaagctctctgttacttgccaacatctggaacagcagagagcagagaagggttcgggatgggagggaccctgggatgtgggggacctaccatcttccggccaatgtactcccagccaggtcgcacagactcccggaaggccttcctgtgggccccatctgagaacagagtgtggcctcagggagaggggccttcacatcccctgccccaccttcccccgtggacaaggctgccccaccctggggagcgagggcatcaggaacggggcacgggtctgagtctctttggtgctgcatctgcttctttctgggtctcgctgtgtgtctgggtccaggactctgtgtgtgtgtgtgtgtgttggggtgtgtgtgtatatgtctgtgtgtttgtgtgtgtgtcggggtccaggtctctgtgtgtgtgtgtgtgtgtcgggatgtgtgtgtgtgtatgtctgggtctaggtctctgtgtgtgtgtgtctgggtccaggactctgtgtgtgtgtgtgtgtgtgtgtgtgttggggtgtgtgtgtatatgtctgtgtgtttgtgtgtgtgtctgcatccaggtctctctctgtgtgtgtgtgtctgggtccaggtctctgtgtgtgtatgtgtgtgtgtgtgtgttggggggtgtgtgtatatgtctgtgtgtttgtgtgtgtgtctgggtctaggtctctgtgtgtgtgtgtgtgtgtcgggatgtgtgtgtgtgtatgtctgggtctaggtctctgtgtgtgtgtgtctgggtccaggcctctgtgtgtgtgtgtgtgtgtgtctatgtgtgtgactctgtgtccatctctctgtcagtgtctctgcatctctgtgttcctgtgactgaacctggctccacccagcctccagtgactatctgagatgggaaccccgggctgaaaagggagatccagccgtgttctagaaggagtaccctaggtctggagcctgtaactttctggctttgctggttggaaccctgaggcctccaggggaagaagggtcctgtccacctgccccggggcacagccattaccttgtgaagcctcaaggaggccccggccagcataggccagggccccactcagcaccagagagtagaggcccagctcagccgccggcaatgctgtcttgatgcccatagcctggacagggctggggagacaggttgggtgagggaattacagtctccagccaagcctagccccacctcatggtcccaccaccccagtggggacccactctgaagagagattgcccctccagccccttggggaccttgtaccatcactctgcctgcccctgtgccccccacagttcacaggccaccgaacaccagtgccccatcccagctgctgctcttgcccccaccccacccatcaaggctcttgcccgcagagccctcactcgcagcctgcctccctcaccttcatttacatcttcataccttccagaggcaccggccccaccctctgccaaaaccgctcctgccaaggcccccatgacctgcgtgcggagaaaccccacctctatcactacagtcaggtttctgcctgcagggtccccacctcgatcagtgagtctcccttagctcctcacaaagccccagcttctctaagaccctttctctgactcccactcccctccctgagatcccatgaccaccccaggtgctgcccctagagccaagcctccatcctcgcattaagcctccagcctgtcactgacccccattcccccaacaagtccctgagctccagcctgtcacatcccagtccctgcctgtgtccgtgaccacactgccccactctctcagcgctctgtgtattcaggccctgggcaccagctggaggctgtgctatttgaggaggtgcccaggagtagcggatgtggggccaggcggggccaggcggggccagggagggcactggctgctgtccaaggtgctgaccagaatcaggccccggctgagtctcaccactccctccagcgggggcctagcttgtcccctggagaactgctgggccgtactacggctcagctagcacctttacccttcctatcccgcttcagcctggctcaggggcttcccaaggactccatggatacagacataggacccaaattaaagggaggaagcagggaacatgtccaggcaactcttgggctgacggggccaagaggtggctgatgtggcccttttgcccacccttgatcctcccctaaatcttcatccccagccctgtagccatctcccctgggccccccagcagccgacggtctcctcgtacagatggaggggtcatgggccagataggggcagggacctgtcaaggtcacatggcagacctgggacagacttctgcctgcctcccttcaggattgggtttctcagtgacccccctctggaatctggggtaagagaagaccaccactgcccctgcccacagcagaggctgccagcctgatggctgtgctgtcggcctgagggtggaggcacctcctcatcagttgggtgggggtggagaggccctggggatcaggttaatggagcaggagcttgaaaccggagcatggtgaagagcccgtgaaatagctttgtcagctgcctcccactcgccactttccaattttagctccccatggccggtgcggggtgtccccagtgaggcctctgcaaggagctggcccccagcctggggcctctcctgatagacccccagaccagggctggcctgtggacacgggggcataccctttcccctggtcctgcctgccccagatgccccgggggtaaagccccttttggggcctgtgatttgggatgagggcctggggtgtgccccacaagtctcaagagccccagagtagctgcatccccagctggcactgaccttgaggaggccgcaagggaccctggcacactgcccacctcaggctctggggtccggcttccaactgtccgtccgtgcgaccggctgagctctggggccacggtggggtgtgtccagccctggggtccccacccccttgaggttatgagcggtgagtggtgacagcgggaggaggagggggaggaggaggtggccttcctggagcggagctgagcagagtggagcagagccgagtgctgcagagctgct

SEQ ID NO: 1371 - DNA, 8859 bp, Homo sapiens
tgttgtagaaaagtcttttattctatcggtcaggccccatctggcccaagaatagctgagcagagcccatccctctacccgctccctcctactccggcttctctttgtcctgcttctgctcctcctccagtgccaaggttcgctcacgctcctttaccagctggacgccacagtaggtgacaaacaggatggacagcgtggtctgggggaaccctgtgtggggagggagtcatagatgctcaggagcagcactgcatcctcagcgacttttgtcttcccacccctctccccgcttgatgggccctcccttctgagtcccaggggtgatgagggagataggaggcattttggaaggtcacggtccttgaggctgatgcctggcaccttctgtatccccacacccctgtccctcacctgtgagtagcaggcgccgggcaaccagctctgtgaatttgaggctgttcaggctcacaaggttgtacatgatgatggcccagaagttcatggctccaaacagggcccggaccctacgggacatctgcactgacagagaggcctatccggtccaggaaagcatgggcagcgggacaagaggccaaaggaaagaggacatggtgggtcagcagccttacccacctggccagtcaggtcttggggctatgtctgggtctcggagagccccaggtcagctctccctccttgttaaacatggggaaacaggtccagagagaggacaaggcctgaccaacatggcaaggcccaggtgctccattcctcatagaagggagggaggggcagattcctacagagtgagccattgctctgacaactaagagggtggtggtgagaaagttctggattaggggccaggtgtttggacaactccagaaagcagcagtgcccccccgccctctatgacccagccagtcccagccccaggtcttccctgctcacctcaattcgtgctaggggcccccactctgccagtttttgcatccagagctcaaagttgaggccaaagcagttaaggaatgaccacaggtagacaatgtcacaaggcccaagccacagtgtggtgatggcaaatgtggccactgtggctgccagctctgggatcacagcggaatgctccccaccaatgtggttatacacatatctgcaggaaagatgggagaagggccactgggagtgtgggaaagggcagggatgagatgggagaggacacacaacagggcgtcctcctcaacactgtcaccctgggtgcattcaacattcctgacctcacgtagcagctcctcctccaaccaacttcaaattgtggcaggctcagcctgggacattatagcttctctatctctgttcgtttacttcccaaatgatctcatccagacccaagatttcaagtactagctctatgacgatgacccctaaatctgtgtctttagcccagtctctcctgatttgtatatgcaattgctactagccatgtcacttgattgacagattcccctatccctgctcaaacccagctccgtcctcatctcagtgaatggcaccaccatccattcagttgctcagggtataagccttggtgccatcttggattctcagtttgcctcatcacccacatccaagcaagccagcaaattctgttggctcctctcagtcctgaccaccactcacctcctctaccaccaccaccctagtcaagatgatcactcttctcacataaattattgcaagagcctcttaagtggtcttcttgtttctgcttttgcccccatggttcattctccacacagcagccagaggcatcttttaagagtgtagctcaggtcacatcacttccatgattaacctctctgaatagctccccattacaataggaataaactcagtctctttactctggctagaagatcccaagtggtctggtttctgttcccttcctgaccaaatcagccaccatgctcccccagttcatcatgctggcctcactggcctttcttacctttacacccacacagttggtttgtgtctcaaggcctttgcccttgttgttccctctacctggtattctctgctccacatctccttatcactcaaatctcaattcaaatatcatctcctcagagaagcctgcctagaccccgactaaagaagcttctaccctgttgtcaacttctatcccattgcaattttattttcttcataacacttaccactctctaaaattatcttatttatgtttgtttacctgtttatggtctgtttctccccactagactgtaagctccatgagttcagggtctttgccatgttcactgctgtatccccagtgcctagaacaatgcctggcacataggtgctcaataaatatttgttaaataagttctgtggaagacccaggaataaccagcctctccattcctcgacctcctcatttccaatggctttttctccactccacctcagccacccacacccatggccatgccccaactttgtcaccacttgaaagttcactcctttctaattcccattctttgcccaactcctcttgacctcctggccccccagcttcagttcttcaatcccattgatcttgtgaccctcccaccttcaccaccgtccttagcaggcttatatccaatgagtcatgactataaataatctaaaaacccttattcctgacttcttccttgtcatccatctgggagagcccaatcacttactttctcctcagctacacccaggcagctaagccccatgggggaaatctcacatcttcacatgctggagttcataagcccaccacctccaataccacctgggtactcagtgccaagatttctctagtcagctgcttctcccttgctctgcaagggccactgtattcttatctccccacaagtatgagtggagagatagtatgagtggggggatccaggctgggttgtgggggtaagcatatatgttgcctctctccacgtccctgtcctggctttctcagctgatggccgtgcctcctgcttcatggacaaggctgaagccttcaggtggaatcccttacttgtctacattaacctgctttcctctgcatccacactggcttctcttcctcctcctcccactgaagccaggcctccgcctggaactagacaccctcacctccttcctcttcagggacctcactccatcaatcacccctgtatcctgcatccccagcttctctgttgaataattcttcttagcatgtcccattctctcctatctttaacacatccctcttctccctcagccactcctgtcttccccctgcagtcccaggcttcttccaggagtcatcacacacttctctactcctcagttgactttccctccttacctgctcctgccttgcccatgaaaggctgaaaacctccatgtcaccagcactaatcctcggtctccagcttccttgaggctcagtggcatctgaccaagctgtccccaccatgcctggatggtcttcccttggcttccagggtggcacatgaccttgattcttctcctgcccctccaactactctttccagtcctttctgctggctccttttccttccaagcagagctcttgcaggctgaatctcggccatccccgtctctcctcttctcacaccactccctctcctgaggacttacccactcccaaagcctaaaaaccacctgcccacactcaggacgctctgagttccatcagtcctctggaccctcagaaacccagaccctcagacccaaccacctccctgaacctccacagggatgtctcctagattgcgactatacatttcttaaactgaagccctctctggaaactgccctccatcctcccaggctgcagacagcaatttgagcgtcatctccttctccttcccaacacccacagttcatggccacgtcctgttcaggctgctgactgtgtgaccctcctcccaccacctctctccacctcgagggccctcacttaaatcctaacttctatatctttcacccagacctctgccaatacctcctcactgccctctttgcttcccctggcccaggggtgatcttttaaaatgtggacccatcttggcactgccctgctcagacacctggcaggatggctgtgaccacccccaccccactcctactcacttgcaaagccagtcgttgatgccacggtcaaagtgcctgtaagaggaaagcagatgggcatgttgccatcaggcgcagagctccccaggcatgggggaagaggctaggggaaggtgtggtcccagggggtgagcctcccccgtcctggccagcactcacgtttccgcaaagacgtagagtgcggtgatgcacttgggaggctggggtgggtccaggtggtcgaggcatgccacagtgttgacaacaccaaagaggacggccgccttcacccagtcatacaccaggtttgaataggctaggccagctgggggcagggcactgtcactgcctggggtccaatcgcctggggcctgcccccatgaagaccctgtcccaccacttccttggggagacaccaggctctgcccgccccacggagacccccccatattgtggaaatcagtcatgcctggtgaagtgggtggggtccgtgggatgctgctctggccccacaggatgaagctaatgccaagacccatgcattagaaagaataagcccctgctcccacgccctcaggtgctgtgccctgcgtgcctcagctcccctgactgtggcaccgtgggggtgcagagggtctgttttcctggggcggcagccctgcccccatttctcttctgtggacccaccgagggcactgtctgggaggcggttggcgaacttgaggtcgctggggatagtgaggatgtagaagaagtgaaagaagatgtcgacggccatgatggccaccacgcttaggcctgcctgggctcggatgtgccacagctcaccctcgcgtctcactggctccacctggctcacctggggggatgcgaagggtctgagggaagaggcaagccctgcctggggagccctgtctgaggggggctcaccaactacttggggcaggaggagccatggctttatccaggagtcctgcctgagggtggagacagaggtcaccctggagtctgaggaggattcacagccagccatgggagacccagttctgtcctgggagccccatttgagtgggaagggaacattcgtggcctgggagtcctgtctgagaaaagagacatgtctccaccctggggtccctgctggaggggaaaggtggccccatcctggggtctgaggagggaggggagacacggcttcatcctggaatcatgcctgaggatggggatacagcctgcttggggaattctatctgagatggaaaccccaatctgaaaagggagattcagccctgttctagaagcccacagggtgtcccctcacctgagcatggaagcgatcaaaggtcatgatgggcccgaagaagaagaagggcaggtagaagttgtacttgagcaggtcagctaaggagtagtggcggtcagggtgggcacagctctccagtgcaaagctggtgcaacgcagcactgtgaagctgctgcccccatgaaacagcacctcttgaagatcaaaagtgcctgttacaaacccgctctggagggggaaagaacaggccaccagctcactagggtgcctcctgtctctggaaaacctattccccactccctagcttcccacaggggcccagcctggtcctgtcccttcctctcttccagagccagttaactttggccactgctctatcccagcaatgcgaggagcaggggatgatctggatagttcctcctgtgatgcaggtgctcaccttgtggccaggacatacccaaaggcttgaagacaggtggaaagtgaagggaatacttggggatacttggggtgcaaggactttggatgaagtgagaggtttgggatcttatccctacaccctctacccctgcaccagttcacacctgccaagagattagggggtccatcttgaaggaggccaggctggccaagccaaggccaagacagagccagggctggcccaaaagcgaggccacatagaggcccacacagtgaccaagcagcagcagcaggtaccaagggcccattgtgcccatcacagccaaggccccgtacacagcatacatccaggagcggagctgtgggcagggagaaggcttcagtttcgccatataaatgggggcgtgaccccaggagggggttcccacaacccttgtggtgaaagaggagctggcagggagaggctgggtggcccaggtccagctcacctttggggcaaccatcgtgcagagtttagcaaacagcacatgtccggagagggcaaagatgatgacgttgcgaaaggaggtgaaccacatcacccactcgaagtcagccacatcctggggcagtccggggcagaaggaggtggggcaggtgagggtgggagaggggacaggacgagctggaacctgggctggtcagagccccagcacctttcccagccttcatgttcttcttttattattatcatttttaaatttaataataataattattttttaccactagccaaacccaacgtgtcctctttatgcaaacacaagagcagtgcctgcaggtctccacactcctctgtgaaggaagtaccgaggcaggagggtagagaggagtgaagggcaccatgggggctgccgggtcgcttgaagctccccctctcctccgcacgttgcctgccattccccctttactgctttgtttctgggaaggaggtgctggaggctccactgaagcacactccactaatgcgacctatttcccaagtgagcagggcccgggcaaacttgatgtcccaggaggatacaggaggggccagtaaagaagctgaaggcactgaagctcaagccagaggccccagagctgtgagaagctctctgttacttgccaacatctggaacagcagagagcagagaagggttcgggatgggagggaccctgggatgtgggggacctaccatcttccggccaatgtactcccagccaggtcgcacagactcccggaaggccttcctgtgggccccatctgagaacagagtgtggcctcagggagaggggccttcacatcccctgccccaccttcccccgtggacaaggctgccccaccctggggagcgagggcatcaggaacggggcacgggtctgagtctctttggtgctgcatctgcttctttctgggtctcgctgtgtgtctgggtccaggactctgtgtgtgtgtgtgtgtgttggggtgtgtgtgtatatgtctgtgtgtttgtgtgtgtgtcggggtccaggtctctgtgtgtgtgtgtgtgtgtcgggatgtgtgtgtgtgtatgtctgggtctaggtctctgtgtgtgtgtgtctgggtccaggactctgtgtgtgtgtgtgtgtgtgtgtgtgttggggtgtgtgtgtatatgtctgtgtgtttgtgtgtgtgtctgcatccaggtctctctctgtgtgtgtgtgtctgggtccaggtctctgtgtgtgtatgtgtgtgtgtgtgtgttggggggtgtgtgtatatgtctgtgtgtttgtgtgtgtgtctgggtctaggtctctgtgtgtgtgtgtgtgtgtcgggatgtgtgtgtgtgtatgtctgggtctaggtctctgtgtgtgtgtgtctgggtccaggcctctgtgtgtgtgtgtgtgtgtgtctatgtgtgtgactctgtgtccatctctctgtcagtgtctctgcatctctgtgttcctgtgactgaacctggctccacccagcctccagtgactatctgagatgggaaccccgggctgaaaagggagatccagccgtgttctagaaggagtaccctaggtctggagcctgtaactttctggctttgctggttggaaccctgaggcctccaggggaagaagggtcctgtccacctgccccggggcacagccattaccttgtgaagcctcaaggaggccccggccagcataggccagggccccactcagcaccagagagtagaggcccagctcagccgccggcaatgctgtcttgatgcccatagcctggacagggctggggagacaggttgggtgagggaattacagtctccagccaagcctagccccacctcatggtcccaccaccccagtggggacccactctgaagagagattgcccctccagccccttggggaccttgtaccatcactctgcctgcccctgtgccccccacagttcacaggccaccgaacaccagtgccccatcccagctgctgctcttgcccccaccccacccatcaaggctcttgcccgcagagccctcactcgcagcctgcctccctcaccttcatttacatcttcataccttccagaggcaccggccccaccctctgccaaaaccgctcctgccaaggcccccatgacctgcgtgcggagaaaccccacctctatcactacagtcaggtttctgcctgcagggtccccacctcgatcagtgagtctcccttagctcctcacaaagccccagcttctctaagaccctttctctgactcccactcccctccctgagatcccatgaccaccccaggtgctgcccctagagccaagcctccatcctcgcattaagcctccagcctgtcactgacccccattcccccaacaagtccctgagctccagcctgtcacatcccagtccctgcctgtgtccgtgaccacactgccccactctctcagcgctctgtgtattcaggccct

SEQ ID NO: 1372 - DNA, 294155 bp, Homo sapiens
tggacacaattctaaaatatttttggtgaatgaacagctataagccatgcccttccattttccatttccattagcatgcagctgaacccaaatgtaaaaaaataattttgtgatgatattcattaatttggaaaagtaatctcagcaagtatcttagcaaagtaaatctttaacataaaaaaatgctgatggcacacttactcagattttggtgggcgacgttctcttggataccagttatattctcatttgaatttcctgtttcttgttttatgtgcatataacttccttttttttccataaaagtacctgaaattggagtgagattcttgtaatgagttttttcttgcaatatatttagatgaacaacaacagtatggtattcctaagatcctgttactcctattccttaatggaaacatcgtgttactgattcttctcccactggaggaatatgctttgaggactgaacttttttccctgtctctctctcgtttattgggaaaacaacgtcatcgtcttcttggattgctgacatttggataaggcagatgaaacaagtaagtgtcctacgtccagatagaaatagcaaccatgcacaaaattttcttataaaacagataatagagtgactataatagagactagaccagaagtctggattcttgggtccaactgttcaatcttaggcttgttctgagatgccggaaaaaaaaaaaaatcactcaagagtcttttggtgcctttttgggctgcacctataaatggtaattatacttttctattatagagttctccaccatctattgtgatgtgtaactatatcaaaggagtagttgacagcttagttaatgcatagagtataaatcacgttgagtttctcacaggaatacaaaatgtacattaaatacaaagtctagcagcatgagaagggaaatagaaactgtgaatcatgagcacaccacttacagatgtctcaagatgtgggttatgtggaatacaactgcagcctgtagttaaaaaaggaaactgatgctactggtgggatgggttgttttctagggcagggctcaggagacagacgagacagatttctaccctcgacttgaaaatgggccattgtgtgagccttggcaactttggtacagcctgcagcgactaaaatggcctggcccctgcccacttctctattattagatagattgcattaacggcccaattcttcatcctttcctgtatccttgcttttttgccatggggttttaagcaactcctacaaagaggtagagtatatttggggtatcttgatttagagtttggccatgtgacttgctttggctaatagaattttagtggttgtgatactaacagatgtctagaaagtgcttgcatgtatttggttttgctcttgctcctctgggatggtgaggggaacatgccctggctaggctgctgaaggatgagacatacagaacagagccaagctgcccaggtgttccagccaaagccaacctagatcaaccatcagccagctggttcccagacatgtgaataagccaaaccaacaggaaaaattgcccagttgtgcttgtcctaaataactgactcccagactcataagcaaaataaatgcttattgttacaaaccactgagttttgagatgatttgttatacagcattcttgtggctatcaatctgatatactttccaacacttccctgttgctctccacacccactccagcaacattagacttatctatttaagagaacttttcatgtaccccaggacaggatccttgcacatgctgttctccctctgcctggagctgtctcttatgcgtctcccctggccccttacgttggccagctccttagctgaaatacatttattcatcagttcttagctcaaaagtagcttccttaggcaagcttttccttccaatccagagtaagtgggctttctttaaaattgcaatatattttcatgtatttgtgttactttatatcagagaactttttactgatgtctctgttaatgaatgataatctaatttttttgtgtgtgtgtgatagttaagctggtctcctccatgaaattgcaaagtccatgagtttagaggctgcaactgttatctgggtcgccactgtatcctaacgcagcagataatatagtgtattaggtacacgctacctaatgcagtgacaggcaccaatttttattgaatgaagatgtaagtcgtatcctccaccttttgtgtgtgatgactgatgagttacatttgtagccttctcgagaagtatgctttgagtaactggagctgcctcattcaaagatacctgagaggtacacaaataagccctctcccccacaggaagcctgtaatcagtgactcatagatgcagctatggagtagtccagcctgcttgcctctgagtgagataacctccgtggtgtaatttatgctctagagctccccgtgagatggggcctaggcttgacttctaaaaccacatctttgccaggttcctttccctgcactaatctatgccctcatcttgctttatgtttctcctgagaacttgacctcaataaatcacttgcaggaaaattcctattttaggttctacttccaaccaaacccaaataaagacatgcaataaatttgagcatttcttgctcaaccaaaaaataaaataaccaaaagaaccctgaaatagtatccattggtataaatctttggatagagaaaaattatagctcactcttctcaaagggtccagaaattcacagacatctgataatttgggggttggttagaacctccatagttattaaagcaaagttttattcattcctggaaatgtttattctcaaattgtaccactatacactaatacatttcttaacagcactattcaagtagagagcatgtttgatgtctgactgccaggattttcatctcccctgtatttgtgggtttctgctttcagaagataatcagagaataggtgatggtggctagaaaaacgcccgtcatacagtcttaaaagaaaaattatataaggctacacatagtgcaatcttaaataataaaacaaatctatccatctctctatctaggcattgaaaaatcaatgaaagaaagcataccaagatgtgaacagcagtagtaaagttctgagagatttttatttcatcttttacaattttacaatcttcacattttaaacagaaagcatgactgtggtttttgaaaaaatatggtttaaaaaaagggtaactcagcaaacagatcaaagagagaacaatagcacttcctccccctccccccaacctcaccccctgcaaatgagctctgtacaaaagtaaatttctggacattctacatcaaatataagatggctttgaaaggtggagaaaatcagatctcctagggatttaaggaaataagacacaacacagtggtgagttccctgggttttcattttgcctcatatatcccagagttggaactgaagaaactggagaaatgccaatgggcacagacaaggaaaccaccaacaaaagcctgttgtctgtagccaaaggaccaggaaggggcagcctaacaaggcaggactcttctatacccactctacttcagtgggacaccacagaagcaacctgtgaccccagccctactgaagcccatgaaggctgattggggagctctgactttcaccctcactagactataaggaggaacccaatctctctgcctgggtggtattagaaaggctgagtagagagttggtttgttgatctcttctagacagtaacaagacttcccacctcctacatggggtcagtggagaacacatggggagcctggccttccacccctgctcagcggtaaagaggcatcccccccaactattcactgttgtggtgtcagaggaggcctaacagacaggcaggacttccaccccccccacccccaagtaaagaggccataactctcttctgtggtgctagtggggccatgagggagtgcagcactaggcattccttgctctccaagcctaggggattcagtcagtggaggcgtaatgaaaagtcagagtgcccacccacccaggagtgataaggagcctcacttcaggtgtgaatgaaggccacctggttgtccacccaacatggcagcagtgaggtatctccttcctcctctgctggagcagagttagaggaagctggctcgaacagatttaaacaagatccaaagtctcagaaagtaacatccacaatgtccaagtttcaatcgagtaacatgctttatactgggaagatctcaagctgaatgaaaaaaaaggtgatccatagatgccaacacggagatgacaggaatggcagaatcatctaacggacagtttaaagcaaccatcataaaaaatgctggcactgaatagttatgaacacacttgaaacaggaacaaaatagaaagtttcagcaaagaaacaggatagaaagaaccaaatggaaagtttataactgaaaaatacagcaaccaaaataaaataaaaatggatgagctgaacagcaaaatggagggcacagagaaaagcatctgtaaactggaagacagaatgatagaaattacccaatttgaacaatgcagagaaaacagactgaaaaagtgaaaacaacatcagggacctgtgggattataacagaagagctaatatttatgtcaccgaactcctgtattgaaaggagaaagtggggctggaaacttgaagatataatagttgaaaatttaccaaatttggctaaagacatacacctttagaatcaagaagctgaacgaaactcacgattttcaagaataagtctgagtatgactatgtaggttatgaaagccaccagataatcactttgttcagattatgaagttgttgtttttaacctgtgaaaaggactcagagaccatcagtgatgctacagtaacagtgttagacagtgtctagccagagtgactagttatgacttcagttagcccaggaagattcaaattaagtgtagaaatgtttaagacactccattgttcaatatttttgtgcatttgatattttatgcattttccacatgtaagaaatatttggattaacaggtcagtgtcctgttttcatacaatctaacatgtatgactaagcatacatgttcagtctaacatgtgtgactaagcacgtgataaaaaatttgcaattttaagttgaaatcttactgagtatgcaggcagtatcagcacatttaagagaacttaagaatttcttgacgatttttaaacttttttgtgagaatttcttaaatggagcggactagcataaaattgaaaacaaaactataacgaaatatattaaatttgtacaggcagtttgcgtatttaaaggagtttcattgtttgaaaacatgaatcaatccccttaaaggtgatttttcaaaattgaatagatttataaatagaatgagatctacaaattcagaaagttggctttaaaatttgtaacttaattattcacatttaaacctctggaagatcttttcaatgcctaaaacctgcccctaaagacataaaatccctcacactaacatatacatgaacatgtggtatgatcatcatctatgggaaaaatcttgttaactttttctagtgtggaaacactagaaaagtggaaacttggtcgggcgcagtggctcacgcctgtaatcccggcactttgggaggctgaggcaggcggatcatgaggtcaggagatcgagaccatcctggctaacacagtgataccctatctctactaaacacactgcactccagcctgagcgaaagagcaagactccatctcaaaaaacaaaacaaaacaaaaaaaccccagaaaagtggaaagttgcattgcttctccaagtcctgtccagttcaagtgagtagttctaagcatgtctggattactcattccttgagtagagattttgcctctatttaatctctgttatcgctgcagctgccatggtgccagggaagagcagatggtagagaaacacgtgtttgaattcaacttaatcagctacattttccaagctctattttaaaatggtgtattctgcgacagtggtcctgaagaggtttggcttccaaggatgaaatgactcagaagaacctgaagctcaccagccatatttgcagcctgagcactcataggatgacaacgttgagcagaatttagccccctccagcactctgttagagtttgggaagaactgttagctgcctggaacatgcttttttgtatactcaggaggcaaagttctgccatgttgcctttaaccagccatgtttttgaggtgctgattgtccttacacaatgcctttttctaagtagcaagcttcacccccatgaaacacctcaatatagatcaacatactgtttgacattcatcactggaacaaaatgtggcataatttcaaatactagaattttagacactgcacttcaaagttaaagagacttacagcaacatgaaaaagtcatcaataattacaacgcatattatagaaaaaattaagttctatatattgaacaaaactgggtggcatatccatgaaatacatgctctttgagaaccagtaactaattatattattccagttaaagatctaaaactaagatgagttttcattctgagacactaaaatgtaaactgagtgagatttttaaatgttatttgaatagatcagctttaaaacaaacttacttgggtttgtatttaccatatttttttgcagtttaatatttatccccccaaaaagtatattattaaaagaacagtataacttacataagttttcacaatcatagaacatttgtaaattagttcaagatctcagagaaatgtgtaaaagcatttgtatctttttaaatttaatatatttatctaataagtatactcttgtctcacttaactttatgcagtgctttttcttttggtaatttttgtctttattataccaatgacccatatttactatagtaaattaatacatataattgaatcagtgtgtctcaaccttggcactattgacactttgggttgaataattctttgctgtggagggcagaccctgtgttgtagaatgttcagcagcatccttggcctctacctactagaagtgaggagtgtctccagtttcaacaaagagaagcgtctctagacattgcaaaattttcccagggagagcaaaattgtccttagttgagagccactaatttatgaaaagaaaacaaagtcacccatttttcttccacacttatattttagtttatattgttatggtcaattttctctatctatacagatatgtatccaagtatctagctataagatattttatatatggaatatatataaacacatttaaaattagcattattacttctcttttgcagcatatattatgaacattctttcacaaaaacgtatatgtttatttcctcatttttaaaatggctacacgatattccactgtttatacacaatattatttattccatttactacttttagatattgaagttattcccaatgtttgataaaagtgtgcctttggttgggtatgatattcttgggaaacacattcttcccctaaaatttttgcagatttgcttcactgtcttttggtatcaaaaatggctgagaagtatgagtccagtaaaatttcttctcctctgcatttgttcatctgcatgtttagtcaaggaacccaaaggattctttctttattcttaaagttaaaaacctttgtctttaaagtatcaacttgctgatatttcctgaaatacagtgtttcttttcagtcttttggcacaatttcacattcatttcaataaacttttattctattatatctttaaaatcactttcatttttagttgctggtcttttctactttaagcacaccaattatccttatgttggattgtccttgtcctatgtattattgtctcctagttcctttaatttctttatttccccctctgcattcatggtgaatcatacaatccactattttatatgtttccatttttctggcatcttcattttatttatttatttattattattttttgagatagagtttcacttttgttacccaggctggagtgcaatggcacaatcttggctcactgaaacctccacctcctgggttcaagtgattctcctacctcagcctcccaagtagctgggattacaggtacccgccaccacatccagctagtttttgtatttttagtagaggaggggtttcaccatgctggcccagctggtctcgaattcctaacctcaggtgatctgcacccctcaacctcccaaagtgctgggattacaggtgtgagccaccaggcccggctggcattttcattttaatgaatccgtaacccacatttattatgttaaattagtaaatgtagttaaattggggtttctcaaccttgacactattgacattttgggtagaaaactcttcactgagggtgggggctctcctgtgcattgcaatatatttaggattcattactttttgtgatttattggtcagttcttgaatattgttttcctccttctccactgattttcttacctcccttttcttctttttctgtttttatgtcagtatttgatcacctttttgtttattaactgaattaatagttttattaagtattacacgaataggttctttagggatttaaaaaatgtttttcttcagttatatgtttttccaaaagggattatttgtctattatgggtggtgccttcgtttttctgcctttggcttacccctctttcctttactgaatagcacagatgccatgttgtttctgtttcttgttttcttggtcatgatgaacacagcagctgtctaccttctctttgttctgatatattgtgtgctaattctctctgatctccttatctgagatcagttgtctacctccctgagagctgggaagtgcatatgcaatactttcctgaggctgtgtgccattggtggaaatgtgttgtgtgtagcggggaggaaaggagagggtggatgggagccgttccgctgggcctgtgtgcagtcttgtttggaagagctgcaccatgctgtctcctctgtgattttgctaagcatctacctagttggaggcgtatgccgttgccatttattagctctggatggtgagaagaaaagacgcccactggctttcagcacagagatttcaacctttgcttctgtcacatagatcagcccaggcattctgttttcctgtttcacctgttcctacccagaagccatttccataccctaaagaagtggcactatgaacatttttgaggctgttaatctgtactaaaaaactgacctccagaaacgttatactgattacatagtaaatactaaattaatgaagagtatctactttcttatatttttgtcaaacttgaatattaatacttttatttttaatactagatttttataaaaaataaaagtatgagaaaacatagtttaatgaatttcaatgtatgcgaatattttacaaatttttttgaaattcacacgcaatattctgaaagtttacaactgtcaatgggtccatacaaattatgtaacatttgaaacaattaacagaaatttaaagggttcttatttaactgaatgtttaaaagttctcttgaaaggaagcaatcttggaagaaattatttaaaacataggataattaaaaatatgtttaataaagaacaataagtaaatgtttcaagatagagtcatgcagttgggaaacaatgatcttttaactagaggtccaaaattcttttaaaaaaataatagattttttattggtatccagggagcaaggttactactgttcttttcttaaacacacaaaaagcaccaattggcaaggtcacctgtttgtatccatgagatcatatacatgaagagtgataaataaaacccaaccaatacttttattaatatacaggaatccccccttacctgcagggcatccaagactcccgagtgaatgcctaaaaccacagatagtaccaagccctacacatagcatgtcttttcctagacatatatccttatggaaaggtttaatttataaatgaggcacagtaagagacaaacaggaataaaattgaacaattatgacaatatgctgtaataaaagttatatgaatgtggtctctctcaaaacatttcattgtactgtactaatctattttctgactgtagctgaccacaggtaactaaaactgaaatgtgaaaccatggataagggaggactactgtatgtgctgtatgtgattcctaatacaaggctatttatttatttaaaacgatttatcattgtgatgtcgtttctgctttttaatacaaggtccttcaaaaattatttgttttgctcagggcaactagttataaggatttaaagcacatgaatgttcaatattaaaaggtaattgaaaaaaaactccaaattgaatctccaaatcttctagtttctcccattgtctgatgtttgaaaacagatgtgttaatgactactacatcatggcttactttcatttttttcttccctagctaggaaaggaattaggagagctcccaataaacatgcctgtatgttgctgcctctacaaacacaagggaggaacaagaacaacaacaacaaaaacctgacaatttccccatagctggcatatacaatttaattaattttggatttgtgaaatttggcataaggtgcctaggaattgctcctggcttacttagaatatgaaaatatgagataagactgccagacctaaacttctccagaagaagggtaaaggctgcacactaaattttctcctaatatgataaaagtgcctccagcctttatctcttctgcccctctgccttttgtcttttggatggtcatggttatagatgttgggaaggcactgagttaaagagaagacacttgggaattagatccctagaaaatggcccttgccttatgccttgtgcaagtcccggaggtgccattcacattgtagtccatatgacctgccagttgcttatggtgatctttctgcttctaaatcctgcttcccaaagtatgagatacacagggcaagcaatacattcaagaacccagcttgctaaatgtctttgcctccaacatcctttcaaatgatcataagtggcataaccttagtgaatttgggtccccatagatacaaaacaaagaccagtggcttttgactcagaagaccaagtttcaatcctgactcgccacatgctagttttgtgctcttggtcatgttacttaaattctcggagttacaatgttctcaccagtaaaacaacaatgacagattcatagagttgctaaagaggattaattaggatagcacaggtaaagttcctggcacacagaaagcacttaatcaatgtgagcctctctgaagtgaaagtaacgcatcctaatactcaggagatttagaccagagagctatactgtccaatatggcagccactagcaatgtgtggctgtcaattaattagcattagactttaaaattcagttcccaggatgctcaatagtcacatgtgatggatgactatatgttggacggcactgatatttaccattgctgtcatacagaaagttttactggacaatagaagaaatgatagaattaaacaagaatccaaagtccagaagccaacatctttgccattaactacgaaactcaagaggagcaactttatctcactttgtcacaatttcctcactggtaaaatggatactgcctttgcagtaatgtggtggggatcaagtacactgcagtcacttttttttttccttgctttagtctttccaagactaaacaatgcatgacatacttactagcaaggatcactttgaggatgagttagttgataggtgcagccctttggtagtttaatattcatagccatgatttggtattattccaatgcacctgtgagcagttaggaacagcatatgttcaaaagtgcaaggagctactgcagacagtccttgtggtgatggaaagacaaaaagtaacaaaactgaattggttttcattggcaagtggccttttgtagactttttgtagctctcacagggtttaaaatggaaagatcaaagatcttatttcctacttttccatttctgtttcactttaatatctaaatcttcctttctcaggtttgaaaacaatactccgttgctgtcattttgggggcaatgttgtatttttttatttatctagagctggggttggcaaaccttttatgtaaagggccaaagaggaaatattttagggtcataaggtttctatcacaactactcagctctgctgtgtagcatgaaagtagccacagacaacatgcacacaaatgggtgtgtctgtgacaataaaacttaatttactaaaataggcccttgggccttagtttgccaactccagatctagaaaaatatgaaagaacatatccttttcacttccccacattgtttccttccccactatgatatatattttctcgcttattttaattttgaacatatagtgtattctacaaatgatcacaatcaaacattcaaatatttactttagtaatgtgaaaaaataatattccttctaatttttatcaaggctttgcacttaaaaaacaatataattcttaatgacattttttttttcctcagagagaaaactgagaggaagagacatgaaaataaaatgtagaagaattgtaatttaattcttggaggaggggataaagcaattaaatcatttatgtgattatttcataaaaggattaataacaagcaaatagccttttattttcaaataagctcaaagccaaaacaatcaaaaacactgattacaactcaagatgagattttgggtggggacacagccaaaccatatcaggtagttaatatgttaaatgtaaacttgtctgagttttttatggcctatatttattgtatagaagaccacaaaaattattgtaaatgaaccggggccagattcaggaataggttactgacctgaaactgatcactggagtcatattcaattttgggaggtgtcttagaattaccaagagaagcttctttccttcctctctccttcctccctctttctttcgtttatttgctcatttattttctctttccctctgctccctctctctttctcttctgaggatgctaaatttgagaacctcacatgtaatggccagcagccattatccacctgtaaaaatggcctgcctgagaataaaacaattagagacaagctacgctaaggatgcaaaaagaacaagctctgatggctttgagcttatttgaaaataaaaggctatttccttgttattaacccttttatgaaataatcacaaaaatgatttaattgctttatcccctcctccaaattgggttgactggaaacatcaatatttacaagtgattcaaacatagtcctcttcagagatcaaaaatttaaaaatgttgtctagttgacataatataggttattttttttactgcaccaactagtgattaagctatcaaaaaccaaaacacaactaagaagacattgttaatattcttcattcattgcatgggcattaagaaaggatgtaagactgatctatccaatagtttatttctccatggcaaacatggctctaaacaataatgactttcatacttttgtccacacataaaatttatgagaacaaagtaagctggtaaaaaaaacaaacaaaatagtttggtctactacatatttatacactgaaaggaaaattaatggtggcaattgagcctcacttaatggaatgagttatactggagtatctccctttgcgttacgcagactgacatcacagttcaacctgtcagacatctgagatacattcctggggttctggtttgtgtataacttttatggattcaataatctcctaacacagaaatgggtatctgataaagttgagtggaactggaataatcctggaatgacccaaattatcaaattttagaggcatacctaagacactaagactagtgtctttgtaaaaaaaaaaaatgtttgaggaataaaattgagtaaaatgagagatacacacagatcttacagcttacaaaacataattttatttaaatttgtatagataaaaatctaccaaaatttaaacaaaaattttatccaaatcctttcccacaacaaaattggacatcatggaaaaaaaaaacacattcaaataaggttcccatctttctaccataaactggtagattctgggaggatgaggagtaagagagaaacgaggagagaagatagtgatactaaacacaatttgatcttcagtgttgtctcatcttgaaatatcttaataacagagatttccataagaatcaggattcatttttgacacaaaaatggaagcttccactcccaaaatcacaaataaggcttctggttttctttttagtgtgaggtaaacagtatattcaatattaaggcaaatggtaaaaacacatggatggtatattaatgcagatattccattattaaatatattttggaatactcacggatttttcaaacatatgttagaattagaaacctgtaaaatctgcagtagtgtgtaatagctatttgcttgaatgtcttagcagtgcctttttagtagctaatatgttcagtgtaatcttatgcctttttagtaattaatatattaaatataatcttgtctgagtttttaaatggtctgtttttctttttcattatgtaggattagatgcccaccaaaattcttgtaaatgaagcaggacttgatttcaaattctgtctatacacacaatatttggccacatagaccactccccaaagtctgcaaaacactgcctactgggcaggcttacagtgacagaaaagtatgagaacacaagatattatttttataaagaccaaaatcagatttaggctgtctagatatcttattccagaaaacacagatttaagatttttcagtgattcttgccttccccctccccttttcttccccaatgagataaccatttctttcacaatgatgaaccatccctttttacggaaaaatggctttctttctccattggatcaggacaaagacatcacttcttggccacactggccacagccttcttggctgcatcctccaggtcaatggctgaagtaatggggagtccgctgttgttgagtatcttctgggcctcttggacgttggttcctagaagggggacagggaacaatcactgaatgaaactagaggtggcgccttatgaagtttgcacaaggacacacaagactcacctgtctacagcttttcactaggaaatgaattaaatataggttctcatcaaggtcactgacagaaaagattatgtgatgaaatttatctcaagctgtggtccagctagaaaagaagatgaaagcaagggcttgcaagagggaaatgaacatattttactgatggaagctgagttgtctgctgataatcacagccatgtggatttaatgcggttttggcccacaccagaagtcacttgtcttaaagccctctcagacgtcatcaggggtttgggctgtgacctgatttgagaaaggaagttccgagaatctgcccagctatgtccacaaatccactgctttggagactctggcgcatccagcatgtccatttctgccttctcctcactctataaaatgaaatgggctgagcccttcaaaacgggcaaagcagcctctgatggcaatctcttgactgttcctggtggatctggagtatcttctggccaagtcacttcattcaaaggtgtgcttggggactatttaacatgagaactgcttttctgccattttagagtgaacaactcctgtaggagaaatgtaatagaatttaagtgtctaatgaaatatctcatcctacatcatttcctgtgcttttatctagttggcaagacagagcctatttataaacaaagaccttgaaatataggccttggagaacttgccttaccacaaagagtgcagataaaaagaggcactgggtcagcacatttcatataaagaggcaaatgctggattaaatagaaatgggtggattgaaaagatgatgcagcactgattcccctgggaccctgggtctacccaagcagcagtgaagatggccgcttggcactgtgtcttcaccttaaggctcacctactcctgtttttacagaggaagctggtgaaagtcctctctggaaggtgaaagcataaaatgtgggaagctgctacctaaaatctccatgctggctctgccatgtacttgttatgtagttttgggtaaatcgtttaacttctttgagccttaacttttgtttccatacagagcactatcatcctcgtaatcttcccaagaactaatatcattaagtgcttatgtatgccaggcacagtgctaagtaacttatacacagcatatgaaatctttacaaaaactatgagtagtcctattgttcctattttacagataaggcaactgaggcacagagaagttaaataacttttccatggtcacagaggcggtaagtgtcagagatgggacttgaactgttctctgtaattataaacgctgcatgttctaaagatatgctagtctgcttacctacttgaaaaatgaggacagtatagctgatggtatagattgtgatgagaagcaaatgaaatgagtgtaaaagcatttttgtaaatggtgcagtatctgtggcaggcctggctggctttgcaccacagactcctgctcctcttctgcagtagagtgctattgctggaaagcagctgcccagccagaaactacatttcccaggcccccctgcatctcgaaggggacatgtgactgagttcaggccaaaggaatgtcacatggccatgacaatctccaaagggactcttcacactcggttttccttgtctgctttctggagtgttcctagctggggcagccctggaagtcacctttttggttctggttgtgttttgtcttgctttttgtttttgagataggctctcgctgtgtcacccaagatggagtgcagtggtgtgatctcagctcactgcagcctcagcctccggtgcccaagtgatccttctacctcagcctcccaagtagctgagactaaaggcacacatcaccacgcccagctattttttgtattttttgtagagatggggtttttccacattgcccaggctggtcctgaactcctaaactcaaggactccatctgccgtggcctcccaaaatgctgggattacaggcatgagcccttgcacccagccaaatcacttcttgaagatggcaatgactccttcagcctggatactttaataactctctggagccaagcatcttacccactcaccctcttagaccttatgggaatgagaaagacccttctataatgttaagactctgaaatttctgcatttttctgttgttacaggagctagcattattttgactaacatatgactttgtaaatgctgtggaaggcagcttctaaaatggttttcaaagatcaatcactcttgcctcctggtagtcacatctttgtagaatccgtcccccttgagtatgatctggacccacagccttacttctaatagataagaacatggcaaaagtgatggagtgtcacttctgagactaggttacaaaagcctgtggcttcagtcttgctccctttaactcttttttcactctgatgaagcaaactaccctgctatgagctgccctctggagagactcacctgggcaaggaactgagggcaaactctggccaacggctgatgaggaactgaggctctgggtctaatagccaaggaggaagtgcatctggccaagaaccatataagggatcttggaagcaaattcttccctagtcaagccttgagatcactacagctcggctgacactgtgattgcagccttgtgagagaccctgagtgagaggatccacctaagccacacccagattcctgaccacagaaactgtgagataataactgttctttttgttaagctgctacattttggggtaatttgttaagtgctgataggtaagtaacacagatgtaaaaatgtattatttcattaacacaacctgcgtgcactttgattcatttgactgtggcaggtgttagatagcaggctaaggaatttagaaactaatcaaagcatggctttcatggagtaatgacagagtgtgaaacaaaagccctgatggacacaggagcaaaccagtctttggaccagaaggtaaatgacagttacacgtgtaaattttgttttagacagagtcttgctctgtcacccaggctggagtgcagtggcgtgatctcagctcactgcaaccttcacctccctggttcaagcaattctcctgcctcagcctcctgagtagctgggatgagaggcagtggccacctctcccaaccaatttttgtatttttagtagagatagggtctcaccatgttggccaggctgatcttaacctcctgacctcaagtgatccacttgcctcggcctcccaaagtctgggattagaagcatgagccaccgtaccccatgtgtaaatttctatctcctcctgcagagacgtagactaggcccttcttcctcttcctttcttcttttgagcaccttccaatctcaatgcagctctaagacctccagataggtgcaggagtggcgctcctgatgtcttcctccatttcagatcctgctctttctggagactagttttttatcacggttcccacttattcagataacttcttattcagttttacctgagttcctttgcatgtgtatggatgaaatgagctcttgatcttcttaattttttgagataactttaatgagttgtgcttccttgcaaccaagtaatctaaataatttagttccttaattaatatcctcttttgcacccaacttagcaccagtattcccaagggaaaagaaatgatttagaaattcatgagcacaaagatgtgctgggccactgcccttgctgggctttccacccagagctctgttgggctgacacctctctccactgggctgacacccattcattcacaaggcatctgttaaatggtatttctttggggatatctttctaatcaccacctccccatgccccaactaaagcaggggctggtacaatgaacttctggagcaccttgtatttctaaaatcttaccatggatgaagtcttattgggatgacttactgatgcttccctcgtcccctctaaacatccactttcctttgtcagacttgcttactggatacctcccaatatccgttagctagcagtacgtgctgaccgacggggtaactccagatggattcccacatacaaagtgtgcttgacgagaagaggagtgggcgggtactttttgatagatctccttgctgtcctaacaaccctttcctatagggttgaaatagataccgcaaactgctcaaggtgcaatcaggagggattttttttttttttttggagtcctctcacagttacctaggggttttgggagtggctccttttgctgggaagggcccaggaagagctggctgtgctcactgccctgagtgaggactccaagctgttaccacttctcccaacctgtagcagcttcaagtgccccagtcaagtgaggccttgctccaggctaacactggtggacagggccagggaagaaaggggacggagcagtttcccagaaaaccacaacccttctctcctcccagctgctccttcagtgccatgtgaaaatgcctaattgcttcataattctaggatccacaaaagtgaattttaattatacttgcagttacactttaattaccaccttaattattaagcatatactaggcatgctcagaactaagcagtttttgaagggattctcatattcaaatatgaagctcatctgttatgagaaatgggtcatatgcagagccatcatgaccaggtagaaacttgttacagaaggggaaaggggggtagagagagagagagggagatagagagagagacaaatgaagagagagacaagagacagagtcatggggaatagctcaaaaaggaacagacataagaaaaaagacaggtagagaataagagaaagtaaaggaaaaaaatgagtttgccaagtgccttccacaccagcccctaccctgatgctggcaccatctctttgcagcattcaacctggtttctccttgaaggcatagctctactgcccactgaccctgcccttgtcgttaactaccacttgcttcctccttcctgttgagggaacaactggaaggggaggtggggacacgcagagaagagggattaaaaggaaaccagctgggcatggtggcctgtagtcccagctactcaggaggctgaggtcagaggaccgcttgagcacagaaggtcaaggctgcagtgagctgtgattgcaccactgcactccagcctgggcaacagagtgagacccacttctattttcaaaataaataaataaataaataaaataaaataaaataaaataaaagtaaaacagcagagagtggaaacaggttattgaaaaagaaaaggaagaaaagaattagaggaagccttggaaatgactgtgagtttctgcattccttttttgcaaaatgatattatttgagtatttaaggttattttcttcttaattcaccaagtgtctgacatctattccccaaccctctccctgcctttacttctaaatagaaattatcatagctgctttaaactctgacatggaattaagtgttctaaagagtgtttatgcctgtgcacagaattacaaaggaaattgatctccttcccacatttaaatggtgctactgacatgttctaatatttattaaatgctacattgctttttaatgagccttcaggacaacacttttaataaccacctgtacagataactgatcaactcatgctggtggaacctcaggcacttcttaatatctgcttgttgagagccactcagctaaatggttatctacccactgcaggccttaaaaatggaaaatcaaaggggaatgagtttaaaatgaaatcttgctctactactaggggatattataaataataacaattattaaaatgttaaaaattcgtgacctccttggcatgttaccagtgactttctgccactgggtggagtaagagagctgtaaacaaagatgcaaggttaatttatcaaaatttcttcttcgcttttattacacacaagagaaaataaaggtagtgggcacatggtacaggattttgttcgcaaggtgcagacgcctcctgccttttatcataaggctgtgaagaaaatcattttccagtctggaaatatgtagaaactgtaatttaaaagttattattttaataggaattcagttttttaaaaaagaatacagtagttagcacttattgagtacatattaggtgcaacaaatgtttgttggatacatgagttaagggatttacaagtatcatgaaacttaatcctcagagcaaccctgcagtcaacatcattttaatccccattttacaggagaggcaacaaaaacactgggaggcttcggaactggcccgacatccccagcaagtcagaggctgagccaggacttgaacccaggttcacctgagggtaaagccacataaccacgcagctggcctttaagtgctagaaggaattcactagaggaaaatgaggcccagagatgtcagacaatttgcttggatcaaacaaccagttaaccctgacaggtctgattcttggtctagtgctctgagtcagggctggcaagttctagtttttgggcaaaattgagccagctgcctctttttgtatcacctgcaagttaagaatagggtttacattttcaaatagctgggaggaaaaaatcacaggaacattttatgatacatgaaagttacatgaaattcaaattccagcatccataaataactttttcgtggaacatagccaaactgatttgcttcatcagtggctgtttgcgctttgcaatgggaggagtcagtcgctgtggcacagacagcatggcctcgaaagcctaaagtatttcagcccctctgctggaagtaactgagtttttttctccccactgggagaggggaattcagtggaaacaagccaaattctctaaagcagcaaattcctcctcaaatgtccactgctcctgtacccttgcacctccttccttagtctcctttcaagtggcaattagatagaggaggtccattttcttggtgacctgtaaatttagataacttttcatgtctcttttgccttgttactttatgtcagaaacagaataattcattgagaatcagaggcaaaacttctgctatgtcagcagctcttatttctttgagatgatatgtgcctaatacctagcaccgtgcttggcagccaacagcattggccatccatgtggcctcagtcgagatactgacaagggtttagataataataaggatagctaacatttactgagccaaggactattgcaaattatttaaaaactcatctgctccttacagcaaccttatagagttgccctatttttattccattttgcagaggaagaagctgagattttaaacccggttctgttcccaagtagctgaacaacctggggaagttactgcagctttgaggctttagatttctccttgaatgtgaatcatatctaaatgctttgtacccctaacattttatgaagattaaagatgacataagatattctgtgtggctgtattgtatccacacctaatctcctcgatgatttcttctcgcacagtaagaagaaatcaacactcgaggtgtgaatgtgatagttattcggaccatcacagcaggagcccccagctccagtggcaggaagccaatggctaagttcttctctacacggtttcaaagaatggtgtgtatgtgctatgatcatgcaagcaaggtttaggatcaagtctaacatattcactgagagctgatgctacgtgcttatgctttcaattacgttaacccttgaaaaaaagcaacatagatactaaaccaaagttaaaggagccttaatattaaacaagaatggaatgaaccctctggcaagcaagaacaccttacacttctgtgctcacctgccatcatctgctagggataagacaattcttttaaagaagggatgttttatacacccaaacatctgcatgtgaatttacctttcatgctttccttgaatcttcctcctagctttcaagccatgcatactctaatttacggatgatttaagaaattttcaaaggtaattttaacagtgtgagacttttgtcgaaaatgctgactttggtccaccattactgcctaggacagaatcacattcatcactgtgtcactcagtgtgattctgtccttacgtggggaaatgactgagtggacctcattgctaatattttccttgggaagaagtcagattctcagagcttaatattgcctgccaaattcttacttgactctcacgagacatttcagagcttaggggaagggagatttagatagagataacgtgaggattttccagaattctaggtcttgctgctggcctcttttctacactagggatctgcaagctatagctcacggaccaaatctgttccactatctgtttttgttaaaaaaagattactgtgacacagccatgtccattcctctacctattgtctactgctgcttcaacactacaatggcagagctgagtaatcacaacagggaatatacagacacaaagcctaaaatcctgccctttacagaaaaagtttgtagacctttgctctatacaatccaaatttctggccttgtggctaaagggtcaggtgaagacaagaatcatcttcatctggtgtttcccagcttgcagtccctacttctgacttgatatagtggtaagcagctatatatctaggagaaaaaaacccacctatggtctctttgaattgacaatggcaaatattggctcgaatttccactccctccaccccttcccacatgtgtggctggaaagatcatagaactctttttccactgagctgggatatagcctcagaatctttcttggcacagcactgctcaggcagccactgccaataaagagaaggtggcatgagatgaaagctgtcttccctcatctgaaacatttctcatgaagtctttccccataggtagttctgcctcaggacagcctcaaggtggcgctctctggaagagtctcagcgggacacacttagcgtctataagacactacagactgaatcacctgtaagtctcgtcctgatagcaatgtgctcgctcgctctttttgatggctcatcaaatatgactttcaagtggaaattgagtcaggaagaaatgaactgactagtcactcagaagatacccgagagcacgcagtggtgttctgacactataaggcagcacttaggatatgcgagtcctggtacctgcccagttttaaaacctctccttataaaaatggccacacccacagctgctgctcagggaagcaacttcaggctcttgttcctgaagggatgaccactgcctagagtggggcagctacccgaccaaaggcagcccactcctggggcagataagacctgtgatgtgcactgggggatgtttccttccatgcagagggacagtcattagtgtaacccctcctgttctctttgcctatcactggctccatccgggagtggtgatggtgtagggagctgactgaatatttgaatggagaaagttggcatgggtagtcccgccccttcctctggccttccttttagggatatgccactcagagtgagtccaggtcatcctctgctccttgggttccaccctgggatggaaggtacactgaagtctagtggagcctgtgactgggtttacaaagctgcctaattctggggcttagagtaaggaagctcactggtggtcacacaataaggtgcatcctccaactacttcttttttctttggtgatgaaggtaatacttttgtttcctcagtctattttatttcttactgggatcagaacccaggtggaaaaggatctgttgggcctcttcaaagaccctaaccccaaggcttggctggatgggctgtgaacaatgggagcagtggctattaggtaagctaattaggttggctacctatgggatctggacttttaaggaacaccgtgggatcaggatggccttcctgagaggctagaaggtctcagagggaccaagaaaaaacacaaaggagtgagaaagtcagttctgtggaccatactctgagaatcaccatagtaacagcagtaacagacactttatttatttatttatttgagacggagtctcgctctgtcacccagactggagtgcagtggcgcgatctcggctcactgcaagctccgcctcccaggttcacgccattctcctgcctcagcctcccaagtagttgggactacaggcgcccgccaccacgcccggctaatttttttttttttttgtatttttagtagagacggggtttcaccgtgttagccaggatggtctcgatctccgacctcattatccacctgaataacagacactttaatatgataactatccaaaagtcttgtacacttcatcaacaaactcagattactatactcaagcagccccactgagtcaacatctactgtattagtctgttctcacgccgctaataaagacatatccaacactgggtaattgataaaggaaaggggtttaattgactcaaagttccacatggctgaggaggcctcacaatcgtggtggaagagcaagggacgtcttacatggtggcaggcaagaaagggcatgtgtaggggaattcccctttgtaaaactaccagatcttgtgaggcttattcactatcaggagaacagcatgggaaaaacccaccaccatgattcaattatcttccacagggtgctgcccacaacacgtggggattattacaattcaagatgagatttgggtggggacacagaggcaagccatatcatttacagtatcattcttggaacagctcagttttcccaagctctgtgttgcagccataattccctggagaccttctcaagaaaaagtccaaggatattttgactctgctggtgtacccccatcctttgacatgaagactcccaaacagttgtagcctgtgttgttctctgtgcttgcctctctctttgtatctctttcttcttccactctctgccactctcctttctctttccttccctgagactgtctgcctcacatgtttagatctgcacaatatggacttaatagaaataataatcacaaaggaaaaatgaaaatggcagacacgccagtcagcaaagcctaatatgaacattaaaacatactgatgaattaaatcttcttagaagtgtaaatgcagcataattgatcccaataaaagtaataaaaggaaaataagtgacaaagctacaatgaaaaaaaattgatcaaggagtcaatgagtgcatcagtattggtgtatttctgattaaaatgttgatgtcagactgttttcagggtcaaagtgatcagagaccctcagattttaagagtcaactcttctcctgttcttaaagggggaaaggtctctatcagccaattatattattgtttgtcactggaaataactagaaatgaatgcacactacgattgacccattctttctggggatcctttctgtgcctgagttgtcacagaggcccacaatttattagttattcatacatttcgagaaaagctagttaccctgccttaaatttttcccaaaagatttaaaggagtgcatcttttattttcatactctgcttagtattccagaagaattaagtgatttttataatacgcagatgatattcatgctgaaatatgcaaaataccacattcaagattattttccttaatattctctgctgattgcatcagaggtctatctgagatactaagaagaagatttgacatttctaaatttgttagatgatcagatttgaatcttttaactaaatgtacttccaaggtttatgcctgtggttttttaattagttaattagtatattagtaaataccatgtgcatgcaggtcaatgaactttaggcattaaggaggatcaagagagatgtaaaaaaaaatgtcagctactagatggctgggaaaataaaatggaaaaaactaacaacataagacaatatctataaaatggtaacaagtgttatctgctaataggacctgcttctatcttagtaaaagtagccatcaggggatcccagacagccaccagactggtttgctgaatcttcagaaatattgataacttcacaatgtccactgtatcatgaaggaattgaatgtgatagctcaggatgagatcaaagagggcactgccttccaaatttatgcaaagaaaaatatacatagtgacccttcttagccactaccctctttccactattatagctcctctcttaccgtaagaatctgggatctttatcaagagagaaaaagcaagagagctttggacatttctggagtcctagctggtgtccttttcttcctcttgtgggaattggcatcttgtgtgataaacgtcctcggatagatacagggtctcacactcaacatgaaactaccagggatactcactaatattcatatgtgtgatttctgtgaatggagcagacccatagcaagacaagacctatcccaacattgtattgaccatgcctaataaagggaagatgaagcattctgttataactgtattcttggcactgatcataggtgaaacaatgcagaaatttgaagaaggtattatccataaagggaactaaatgcaaatcaagccaatgctttttagactaaggaaatgcagactcctaataatgtgtccctttaagggacaaaagtcagtgcctagtgtagctctgctcactttcattggcataacccacttttatgcttattcaacatggactattatagttatagtagatttagagatgtgagttagcaaagaagtagtataaaaggagaatttccaagttgagtctggaggataggtaagaattgaatcattgcaaaggaagaaggaaggagtgggtagaggatcagaagtcagtcatcaagtaagtcatcatccatacctgagagttggtattggggtcgtaacagaggtaaaaactgaagcccaggacctgggtagatcagaaggatgtcctggagagagtaatggctttgcagcaatatgttacggctaaaagaacagagtgggaaaactgagtaggtaccgagtcaatgacattaggcagaaccaaaaacccaagcagaattgccacagatataaagtggtatggaggcaagagcagagagaaaaggagatgagacaacaaggggaatctaaggaatttaaatctgtgaaccagaagaatgatggcatagttgatggacttgggaaagtcagaaagggaactcaatagagagcgtgggagaggatcagagatgaagctgcaacactggagagagtgcatgtggagaaagatgtatgaatacagggggccatccaaggagagatgtgacagacaaatggagaagttatggtcattttaaaggcccttcataaaccacatgcagaactgtggttttcaaagatagctcagtgaaaatgaaaaaccaaccaaaaccaaaaatatcttgtcacaaatagtggttctcagtacttccagtggagaaaaagttgccaactacagggacctttgcgaaatgtcttttatcttccatctaaatttttcatttgctttcctctatgtcaaaacataaattcttattctctcacaattttctctacatttagttgtagtttatccaaccttagagtatgatttggttccttctgttttttttttctaaacagagcaagtcttcatttgtctacaagaacaaagaaagataaagtggtacaaagagatggaaacattttggacgcttttagtggtagtttctatttgacctgacattacactatactctgttttgatggatgaatttctcaaggttctttattcatatcaatattaaaattggctcagactcccacaacacacaccattgtctagctagggagagtgaggtgaaaacgggtctccatcatcccagtagctattacaaagccaagtgacactaaaaatgagatgtgatggaaaaatgttaccagagactggattacaatggtacataatttttattgctaatatttattaagtactttctaagtttcaggcacgctgccacatgtttatcacagtctgaagaactgtgagattttcagtgatccagataacagacatttcaaaacccagtggcacattttgtaactactacctatttcctgtgaataaagtaagtggccttcttgtttgtttggtgaccattcagaagatccagggtccttgccatcagtctctctaatatgcagcccacattttaaagattctgttgcccacccacaatgtattaaaaatatcctgatgagaaaagttttaatcaatcaaatcaggcttgatgtagtgggattttgtggacaaatctttgttctcagctgtataataattacaagctgtttcaccagtggataaggaaaggattattctcctctttgaaaatggtaactttataattacatgtatttacttgccttatcagaacagaactcaccaactgagacagaggattatttttgttcaaaagactcttgcgtgaaatgaacagctacatatttgggggaaattcagcctttgtaaccaattgtttctggtgtgaataaagaacaaattatctgaaatgagggttttttttttttcctttttgaaacgtataaaaaccttggcacaaaaattgcctagacggttaacttggcccaacccatgaaactgttgagaaatgtacatttattgacagctctatacagtcagtgtacaaagcgttttggccaaacgcagtaaacaaaatgttttgagtggttttacagttctttatcagaatccaccaacatcttataataattttttaagaattccttttattactgtcctatttaaatctgcagcaaacttctatgtctcagatatgtctgaagaggaatatgcttgtttctcaggtgttcattatgactccaagttgagctcttaatatattaataataaacctcgagataatttgtagactggataccgtttctcttagccaaatcttctcaattttattttccacccaataccaaaaggtttgtttcagcaacataaacattttgtttttcttttgccaaatgtctttaaaaacaattatcccacccccttcattcttacaaatctctctaacattccctaaactttctctaaagttgttgtgaacataaacatattctgtgtctttcgctttcttgactaggcactgtacctcctctgggtggacactttcttatccttgattctgaaatactgataaactggagccacaaatagaagagtacaaatcgtgtccttcttagcatggactcggtatgctaagaaggacacaatttgcactcctattcgctacatgatggtatgtgatcctttggtctgctggaggagagaaagaaacctttgggtattaaagagtttagaggcagccatagagttttcagctgtgtcccatatgcttcgtggctattcattcttcaagtcttcagttatgctaggttctaagaccaagagatgagagcagtaataatgcctttacctcctatcaaaaaggcagcctcggtagattgactgtgggccgagtagctttgaaaacattttcattcagaatattagagcccaagatttgctgctaacacccagaatacattgagaacgggcccttagctgagtggtggaattgttctgggcagagtgaatgcagatccccagcagagccaaggtccagttctgtgtctgatgatgtcccctggcctctttgcacttttctggatttaggcattctctccgctgctcgtttccaacgtgtgttctgtacggagttaattttccatcttctattctttactcaagccctgtccccttgcaaggtaagatggacctgtttcccacctccacccacagcctgtctgaggtcgttctgttgctgctgtcattggagacgtggctcttggaggagggtctgatgtttttgtcagtgcatgcccctgtccttctgtatgtttgagtctcattgtcctttctcttcttactctccaggtctccattttctacatgtcctgttcatcactttgctctctgcctcaccagtgcccactcacctcttcatctccttcctccttcactgacccctgtggacatgtccttactaggaccagtttcacttcacagtgacatctttcacctctcctgccttatcactcgcatcctctccaccttttccctgcagaacccccttgctccttcctcctggtgttcaattcttcatcatcagcttaaacccagtaagacattgagggaatcccatgctgccgtcaagcctcaaatctgctccattgtctaaaaaacacttcttaatgcttaaactttaccacacgtaaacattagacaaaggctcacaggacctgatcaaagtattagttaggctagctttcttagatcgaatatatcaatttccaggtaaataatctactatatttggccctttgggttttcattttacccctaggataatgtgagtaattgaaatttatcccatgttagacatccactgccttaccttagagaaaacgtcctaatacactttaggcaggggcagaggggtgctccttaaggtaaaaaccactttcatagttaatagtggcagtaataataacaataagagaagactatgttggcatttgtactcataggttgaaagtaatggtaggcaaaaccgctggcatgttatcatggaatcaaggcagtggcaccatactgtgctagtagtcactgtacttttttttttgagatggggtcttgctaagttgcccagactggagaatattgtcatgatcatagcttgctgcagccttgaactcctgggctcaaacaatcctcctgcctcagtctcctgctcagctgggactagaggcatgcatcactacacctgagagatcactgtactttttactaccacatactcacagtaagaaaaaaaaaattggggaaggcagccaagatggccgaaatggaacagctccggtctacagctcccagcgtgagcgacgcagaagacgggtgatttctgcatttccatctgaggtaccgggttcatctcactagggagtgccagacagtgggcgcaggacagtgcgtgcagcgcaccatgcacgagccaaagcagggcgaggcattgcctcactcgggaagtgcaaggggtcagggagttccctttcctagtcaaagaaaggggtgacagatggcacctggaaaatcgggtcactcccacccgaatactgcgcttttccgacgggcttaaaaaacggcgcaccaggagattatatcccgcacatggctcagagggtcctacgcccacggagtctcactgattgctagcacagcagtctgagatcaaactgcaaggcggcagcgaggctgggggaggggtgcctgccatggcccaggcttgcttacgtaaacaaagcagccaggaagctcgaactgggtggaacccaccacagctcaaggaggcctgcctgcctctgtaggctccacctttgggggcagggcacagacaaacaaaaagacagcagtaacctctgcagactttaatgtccctgtctgacagctttgaagagagcagtggttctcctggcacgcagctggagatctgagaacgggcagactgcctcctcaagtgggtccctgacccctgacccctgagcagcctaactgcgaggcaccccagcaggggcagactgacacctcacatggccgggtactcctctgagacaaaacttccagaggaacgatcagacagcagcattcgcggttcatgaaaacccactgttctgcagccaccgccactgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagacaaaaagtagataaaaccacaaagatggggaaaaaacagagcagaaaaactggaaactctaaaaagcagagcacctctcctcctccaaaggaatgcagttcctcaccagcaacagaacaaagctggacggagaatgactttgacgagttgagagaagaaggattcagatgatcaaactactccgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacttgaagaatgcagaagcctcaggagccgatgcgatcaactggaagaaagggtatcagtgatggaagatgaaatgaatgaaatgaagcgagaagggaagtttagagaaaaaagaataaaaagaaatgaacaaagcctccaagaaatatgggactatgtgaaaagatcaaatctacgtctcattggtgtacctgaaagtgacggggagaatggaactaagttggaaaacactctgcaggatattatccaagagaacttccccaatctagcaaggcaggacaacattcagattcaggaaatacagagaatgcctcaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccacccaaactaaactgcataagtgaaggagaaatgaaatactttacagacaagcaaatgctgagagattttgtcaccaccaggcctgccctaaaagatctcctgaaggaagcactaaacatggaaaggaacaaccggtaccagccgcggcaaaatcatgccaaaatgtaaagaccatcgagactaggaagaaactgcatcaactaacgagcaaaataaccagctaacatcataatgacaggatcaaattcacacataacaatattaacttgaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacagaaaaaggcaggggttgcaatcctagtctctgataaaacagactttaaaccaacaaagaccaaaacagacaaagaaggccattacataatggtaaagggatcaattcaacaagaagaactaactatcctaaatatatatgcacccaatacaggagcacccagattcataaagcaagtcctgagggacctacaaagagacttactcccacacaataataatgggagactttaacacctcactgtcaacattagacagatcaatgagacagaaagttaacaacgatacccaggaattgaactcagctctgcaccaagtggacctaatagacatctacagaactctccaccccaaatcaacagaatatacatttttttcagcaccacaccacacctattccaaaattgaacacatagttggaagtaaagctctcctcagctaaagtaaaagaacagaaattataacaaactgtctctcagaccacagtgcaatcaaactagaactcaggattaagaaactcactcaaaaccgctcaactacatggaaactgaacaacctgcccctgaatgactactgggtacataagtaaatgaaggcagaaataaagatgttttttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaaacaagagcaaacacattcaaaagctagcagaaggcaggaaataactaaaatcagagcagaactgaaggaaatagagacacaaaaaacccttcaaaaaatgaatgaaaccaggagctggttttttgaaaggatcaacaaaattgatagactgctagcaagactaataaagaagaaaagagagaggaatcaaatagacgcaataaaaaatgataagggggatatcaccaccgatcccacagaaatacaaactaccatcagagaatactacaaacacctctacgcaaataaactagaaaatctagaagaaatggataaattccttgacacatacaccctcccaagactaaaccaggaagaagttgaatctctgaatagaccaataacaggctctgaaattgtggcaataatcaatagcttaccaaccataaagagtccaggaccagatggattcacagccgaattctaccagaggtacaaggaggaactggtaccattccttctgaaactactctaatcaatagaaaaagagggaatcctccctaactcattttatgaggccagcatcatcctgataccaaagcctggcagagacacaaccaaaaaagagaattttagaccaacgttcttgatgaacatcgatgcaaaaatcctcaataaaatactggcaaaccgaatctagcagcatatcaaaaagcttatccaccatgatcaagtggtcttcatcactgggatgcaaggctggttcaatatacgaaaataaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatgaagggtattcaattaggaaaagaggaagcccaactgtccttgtttgcagatgacatgactgtatatctagaaaaccccatcgtctcagcccaaaatctccttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacctaggaatccaacttacaaagggcgtgaaggacctcttcaaggagaactacaaaccactgctcaatgaaataaaagatgatataaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagccagcattgccaagttaaccctaagtaaaaagaacaaagctggaggcatcacgctacctcagttgaaactatactacaaggctacagtaaccaaaacagcatggtactggtaccaaaacagagatatagatcaatgcaacagaacagagccctcagaaataacaccgcatatctacaactatctgatctttgactaacctgacaaaaagaagcaatggggaaaggattccctatttaataaatggtgctgggaaaactggctagccatatgtagaaagctaaaactggatcccttccttacaccttatacaaaaattaattcaagatggattaaagacttaaatgttagaactaaaaccataaaaaccctagaagaaaacctcggcattaccattcaggacataggcatggacaaggacttcatgtgtaaaacaccaaaagcaatggcaacaaaagccaaaattgacaaatgggatctaattaaactaaagagcttctgcgcagcaaaagaaactaccatcagagtgaacaggcaatctacaaaatgggagaaaattttcgcaacctactcatctgacaaagggctaatatccagaatctacaatgaactcaaacaaatttacaagaaaaaaacaaacaaccccatcaaaaagtgggtaaaggacatgaacagacacttctcaaaagaagacatttatgaagccaaaagacacatgaaaaaatgctcatcatcactggccatcagagaaatgcaaatcaaaaccacaatgagataccatctcacaccagtgagaatggcaatcattaaaaagtcaggaaacaacaggtgctggagaggatgtggagaaataggaacacttttacactgttggtgggactgtaaactagttcaaccattgtggaagtcagtatggcgattcctcagggatctagaactagaaataccatttgacccagcaatcccattactgggtatatacccaaaggactataaatcatgctgctataaggacacatgcacacatatgtttattgcagcactattcatgatagcaaagccttggaaccaacccaaatgtccaacgatgatagactggattaagaaaatgtggctcatatacaccatggaatactatgcagtcataaaaaatgatgagttcatgtcctttgtagggacatggatgaaactggaaatcgtcattctcagtaaactatcgcaaggacaaaaaaccaaacaccacatgttgtcactcataggtgggaattgaacaatcagaacacatggacacaggaaggggaacatcacactctggggactgttgtggggtggggggaggggggaaggatagcattaggagatatacctaatgctaaatgacgagttaatcggtgcagcacaccagcatggcacatgtatacataggtaactaacctgcacattgtgcacatgtaccctaaaacttaaagtataataataataaaataaaaaaaaagaaaaaaaattatttcattaaacctcaacccttgattacacatctgtttgatactctttgtgaccaaattataaacacacataaagcacttctgcagcatcttgaactgttctgaggaaaagtgttcgtgcaactgtctgggtatcaagctaaactgctcacttttccatgaaatgctgtttctttcttggaataaagactgacacactatagttgctcagacttggttagctggcagacattttcttaaatatgagtgaagtgagtctgtcccatcaaggaaaacaacttaaccattttgtggctgataaaatttgcactataaagtcaaattcaaattctagacaatgtgcacctgccctgtgaacttgacagcttcctactaaaaagcttttctaatatgatggtggtaatattaacaaatgtgattttttttatattgtacattgaaatgagacaacctttggaagatctgcataatcacaaattttctggatcatcagtgaatgattttgaaccatgcatggataaaactcccttaatgtgtaacacagaccaatgggttttaatggaatatgaaaagttcatcgagatagttccagattccacatggaaactaattttcaataaactattaccaatagacttttagtgtagtaccaaagaatattcagaactatatgaaaagagcattaaaaactccccctggctaggtgtggtagcttaagcctataatcccaacattttgggaggctgaggcaggaggatcacttgaagccaggagttcaagaccagcctgggcaacaaacaaaccctgtctcaaaacaaacaaactaacaaacaaacaaacggacaaaactactcccattttgaaaaacacatatgtctgtgaggccagattttcttcatatacttcaactaaaacatgttataacattttatgcagaaacagacatgctaaatgtgaaaagttatttacaaacctgtaaaacaatgtcattattcttactaaaaattttttaaaatatttattgctataaaatatataatacatatgatatataaaatataccataaaatatacaaattattttttaagagttattttttaaattccaagtaatttcagttatcaaattaatttatcaattaaatcaattaataaacattgacaaatataagccaaaaaaccaaagctttttgggatcctcagttatgatgcatgattctcagagaaacatttctcagagtgtttttccccaaacactaatctcataaaatgattcataaataaaagggcttttgctctggggtaatttttcaaaatctggagaatcataacacctgccatacttggagagctaaaagccacattagtttgctagaggcccagggaagtcctgccgtactgtgtttgtttcatcttacacaatctagtgtttcgttctgttatctcaggaagtttgtgaatccagaacatgctggtcacctgaccttggagaaggggtgctggcacagcggaaatctaccatgactcaccttcaagccggaccaccaggggcaccttgagttctagctcccggcaggctttggtgatcccattggcaatgatggcacagttgacgataccaccaaatatattgacaaggatggcttcaacctgaaatcaaaaataaaaagttaccaatcaaaatgctgatcgccaacagtctcaaaaataactggttaaataatagagacaattaaaataagactgctcgtttttttgtttttgttttatacagagcataaaatacaaaaatggcccagaacatgttaagaaagctcatattagtaataaattaataaatatcacaatataacattaccaaattttcccatcaatcactcttttcaactcaaaatgaatttaatcatcattcattcgtctattatataatgtcttctttttctgaaaatattattgtctattctttttatgagtagtatcatttaaaatttcttgcatttaggtttttttcctccacgatttacaattgcctttttatatgtcatggtgcctcacacaatatttcaaaatcagaaaccatttattgttttgtattaaaaggtaaaaaagattcaaatgttttcatgcttccttaatacctctttgatatgctagaggtatgttctcaaaaatcagagatagtttaattatcttagacagcaaccttttgattaaaaaaagactctcgaaataaagagatccaagcttatagcataagtaagaatgtaaggaaagtcaagctactgactggagcttcttagaaatgtaaatttaaacccatcacccatcatgttaacttgtttgtacatattccatattcaaaggcatgtgggccaaaaaaaaaaaaaaaacaaactctacttgtcctgacttgataactaggcataagaaaatcctgtataattaacatgaagaacgagataatgaagagaattcattacctagattaattgataacacccacagaaaaatggctgttcatgaagctggaggcatcaaaattccaacagtagagtcacaattaaattatgccacactaattgtaaagcatatatatatgtgctgcatagaatcctattatttctgtctgttaaattacctacaccaaacatatgagaagagaatatcttacatttgtatagcatttaaatgtttagaaagtgccatcacacaaatccttattttttattgtgagccttcccagaaccctatttattaggtagggtgaaggttggctctctagctgagaaagccatcgggcgcattggggcatgttgtcccaaggtcacacagctgtcatgtggctgtggccaggcccaaagccagctccctagattgtctactgatttgttcattgatgttgttgctagggctgggaccttggtcgagttacagaacctctcttgaacatttcctcatctgtattatgggaataaaaagaggacctagcccacaggatgttgaaaggcctaaatgaggtaatacatgtgaaatgtttaccacatggctttaaatgtacttaatgggtatttacacttgcatttattcagcaagcattgatgaaagtgggcaagtaagaaaacctttttcagtagactgcagctcatgttgaattcaaatataatggaaatacaaacttattgaaattcaacaaaaaggtaatgccttaagaatcaaagaaatgaacaatatttttcaaaccaattagagattggggctactcccagaaaagaaatctcccattactattcacagtaggacaactggtaagcagaagcttgctttctaatgacagctattaaatgctgttagcattgaggcttggtacagcagtagtttccaaataactgtaggatggagaggaacttgccagaacaatagaagaaaaacattcaagagcaagaatgactccatggggtccatgatagaaactcaggacctgctgaggctcagtaaggtttgtgcagaggaacttggcattctagtaaaacacacattggcacctgcatgcctctgccatgttccagtctgcatattccttaaggacaagttcggatgtcaacttctcagggaattctcattaaattagaatcactgactctgtttaacccatctaaagctttacgatcattttacagagtatagtttacatcataatcttatgtgaattcacctaaacaggcaggagtgagggataggagcaaaaaggagagaaggggcttgagaccctgtgattcaattctacttagtgggtgagtgcctggagtaagtgtcaaacaggaatcagtgttgcctcaggtggcatcagttcccatgagtctctcatgtgttagtatctcgtgtttaattagagtccgatgttaaaaatagatactcttcatataaccacttgcggttaaaatttaactactttagttggtgctgaaccccaggaaaagccttcttttctaactgcagagggataactggttttgttagacttactgagaaatgaatagctgttgttctccaatgtactttattctcctcttaccttcctctccccatcccaagatgcaactcccgtgtttggatcatctttgtgcttctctaaaacaaagattatgtattttcccatttttttaataatcagtagccagcacaatccatgatatggcataatcacgtaaaaataatggtttaacaatgaatgaattaatttcaacagacacttgatcaacatctcccttgtaccaggtacagaattaagttttgggatatggagaaggatgaagtatcatcactgtcctcagggaagaattcaaagactagtttgagagccagaccaataaactgacaattacaaatacagggtctacagatgtctcacacagccaagaccaggggagaggcggtgatgcaggctgctgacatgacagaggatttttggaataggtgaggttctagtagacaggaagaaaaaaagagcaggatctgagataaagggagcagccaggataaaggcagatatgtcacccaacttagttcgctgaggaactaatggttgaatggtgaagtaagttaagatgatacaggtgaggccaagattgtcaggtgccagatgccagggatgggaatttggatcctcttatttcttcctttttagtttatttatttattttttgagacacgttttgactgtttcacccaggctggagtgcagtggcacaatcttgactcactgcaacctccgcctcctgggttcaagtggttctcatacctcagcctcctgagtagctgggactacaggcagctgccaccacacctgactagtttttgcagtattagtagagaggcgattttgccatgttggccagctgtctcgaactcctgacctctactgatcctcctgccttggcctcccaaagtgttgggattacaggtgtgagccaccgtgcctggcctcttccttcttcagaactgggtagacgcaagtcttgaaagcaggctccctgaaacgccgaagagaagttataggaggggaacagaaggacagagaggagagtgagtgcatgagagacaatgagaaatacagaacaaccatgagagagcatgggagagagagagagagagagaatgagtgaacaagaagcagtaaagagaaggcatgagagaacacaaaagaataagagagagagaaagtgcaaaaaggagagtgagaagtcatgaggaagacaggaacagaaagagtatgacaaatactaacaaagcaattgagatttctacaagaagagcaacaggacatagaagtacgcaggctgcttagctcagggaaatgggattgtttaggacacacgatacaccacagcaccctaagaggaaagtcaccaccctgggtggtgagaagatcccactcaaccagagattatgccattctcgccttctctcccactgtaaagtaatttgctgcagtcatgcactttaatggaaatctgatttaaggtttaactctgggccaacttctataattaactactgtaatctgcaatctcaaactgggaatgcaattaagacagtttaaaaatgaaagcctcgtgacatcattattattatttagcatttataaagcatgtcaaattttcaatatgtgcctcacgtgttcattcattttacaaccactaactgctgttccatgatgataccaacagcaacttttaattatcttcccccagccccctggcaaagagaatttttttttttttttttttttaagaattcagtgttaggtctatttaagtaaccagagactctcccggaagatcccaagtgcttttgggaacagaggctttttctaattctcgggtgagaattatgagggttgctatttactgttttacaaaagtaaagatcatctaatgaggcagttgaagtgccagatacagggcccgggtccccagaccccagacagctgatcccaaggcaagtttgctctggcagctgtgcaggtggtcaggcagtccatacacaagtttttcaaatgtctgggtgttttgctttgcaaaacacactctagctgcagattttagtacacaattaaaagtaaaaactaaactttgaaaaaagaacagctacagcccttgctatttatcaagcttcttttgacatcatccccactgctcaaataaacaaaccaacaaaaatcaatactaaacctcttctttggaacatggatccttttgaatatctgatgaatattagggattcctcagtcaggtgaattcacaaacacaacatttttgggggataatagtagttaagtcccatggctaccctgctcctacaggatatggcctccaagacctccaatggcaagtggtaacctacagcatatgcattcaggatagggctatgagtttcagataatggcaagtgttagtgcacaccatatgtattcaggagagggctatgagtttcagaggaatagtgaattcttcgcagctgtccacagaatttttgtctgaatgtgtatttttctgggcaaagtgtacataatcctctagagttgatatatgaatagctatcacaaatacaaccataattaacgttactaaagcatttagcaggttgtactcagtattctaattattgtatatgtactaacgcatttaacacatgagtatcacaggaggtgggtataatcatccccaaattgaggtgaagatctgggagaatcaggggttacagctttatctactgtcaaatatccttccaagccagcaaacctagagaagccctacaatgagtgatggcttagtctctttgtgttcattaccacaaccaactctgccatatacttgtgagacagatattacctacccccctttcgcagatgagaaaaccaagactcagaggtagaaacaaattgtgccaaattaggcagcctgtttgctgtcagtctaaaaaattcagctctttttattcaacatgatcctgagtccccttaatgaaataaaaatattgcaagactgctcaataaaaagttattaatttaatatatattcttcacggcctactatgtgccctgtgcttgtaggcagtagctaagccagcaagaaagattttaaaattagacaaaaaggttctatatatctaaaactgcaaaccacgataatagttatgaaggggaggaaaatgctaggtcctatgtgagtagcaggacaggacctatattacaccaggtggtgagggagggcctctcataggcagagacatttaagctagagtctgaagggcagttgggaagagggcaggtagatcaagattaagagagggagaaaagtatcttaagacaacagaataccatgtatacaggtggaggaacagaaaagagtgtggtgcatttgagaaactgaacagaatctggagtatcaggtccctggggcctgagaagtagagtgatggaaacaagatgggccccctcgcaaatcatgcagagtctcacagagcaaacgccatgacaaagagtttgagaagcctttggttttgagacacctacacagactacagtaaggtcaggaaggaaattaacatttattgagcatctacaatgaatttacaataagcttataaatgtatttttaaccttcattttatagataaactgagtctcagaaaatttagggtttcctagctattaagcagttacagttcaaaccaacactgtttcaccacagcacatgcagggcagttaggaatagctggataatgataaaggagccactgacattcaccagggatcgacaacatcttgcttttaagagctctatcagtatatattttaggttttttgagcccgtctctgtcacaactacttacccttgttgcagcatgaaagcaatcatagacaaacaatatataagtaaataagcatggtgtattccaataaaactttatttacaacaacaagcggtgagccagatttggcccacaggtcatagtttgctaacctgacacagatgtgatttggttcatttcccctcaaattcatggcaagtataccatcacccctccttcttcatgtcacttgatatatctttgataacacttttcagacattacgttgtctttctttgttgtgttattttcttgccatcactgataacacaaaggtacccaggcagtagtggtggccaattacataaaggagtccaactttaataacattcctttaaaacaaaacctgttacctttaacaagttcatagaaggaaagtctctgttttgttcttttttcctccctgacattggttggaagtgaaaaaatagaaaactttcagagtaagccagctactttgcaaaggttattgcaaatagttaagtactgcattgtatttaaaaacactgtagcatatacgtgaagcacagtaagtgcaactattaggttttgtctgtgcctattccaatcacgaatgctaatttagtcccactgtagcaggcatgaggttgataaaaatcaagcaagcatgtttatattagccaagataaggacttttttaaaaaaatcacaggttattttaattctgaatgttgttgctcttgtttaagcatctgtttttgtgaaactgtttttcttttttgttgtttttattttcctgatgaattctaatcatgtcttctaatccactggcagccaacgaaggaaaataaatggtgaaggaaatgagatgcagcttggataattgatgtttgtatgcctggatttaataaaaaatactctgctaaattagaggggagtctaaatagattcagtcaataaggaagtgattcaggtgaggaattcaatcttgggctttgttgtaataatacaaataaaccaacagattggttcgattgggaccagatttgccttctgctgaaattatggcaagctgctcaggctcacttttctacctttggtatattcttggagtttgaaattattttcttttgtgtgacttcaaatgccaggatccttggaataaagcaactcatgtacctccaaaatagctaaaactgacatgtgaaaaacagcattcctcgaaagataccctcccactctgcccttttaatttcttccaaggaaaaaagaaataattttagtgagtccacgatcctgcctgaaaatctcagaatcaaaaggaaatgtcttatacaacacccttaatacaaaacaagatttgggcattttaaattcatcaattgagatgaaccaaccattttattccaacttctctgaactgatagcatggaaacgacatcttatggagagatcctctggggacagtaacttgatggagagtcaagtttccattcaggttgacctctgaaagcagtcaggggaacctagggaaatgggtctaattagactccaatctgtccttattctgtctattctcttcttcctaaattcttcactttacttatattctataatttactccttggtagaataagcaaaactgtatggaggattaaggtttattgagtgttaattttcctaggtgctaaaattatgtattataactttccctggtaaataaactcaatgagcttaaacatcacacagcagtaggcaatggtgtcaagatttaaattaaggcggtcttactgtaaagtccatgttcgttccactccctctggcagtctctctataatcagagactcccaagatgagtcaggagttccagctccatattggtcctatttccaagcttcaagaacgtgcttctgagtcctgtattctggtgcccaagtatttcttgctttcaaattttgctgctgaattaaaatcaatcagaggtaagatatcttgtataggtttgtggaccaatgggttttagttctttacaatacagatatttcctgtttactgataaaagagttgtccagagctcatggttttggcatttcctagttagatggggctggggaggggtcatgaaggtacaagagtggggcctggccttcaaacactaaactctgtcctgagctgaaacagatgttcctaacaagaactctctctgcagactgatagctcctcctctccatgtctgaaacactgaaatgtataccattgccactattattctttgaaattatggccataaaaattctaatggtgagacatcatcatcaatacagattttagatatcaggcagtggaatggccactggtaggcatggtaactctgtaagtggctgcttgaagaatgatgatgggggcacattctagttagttccatggcagagatctttgaactgttaacaatgtctgccatggaagtggaggaaagagtcaatgcaagtgtataatacatttgtttccctaactttggagttacatgacacatatttacacataattacacataattacaactaaaggtttagtctgtcaacattgcccctcctttaataacttttacaaagaaaatatcaggcagtaaagaaatccagttcacatcctgcataaccaccaagaatatattaattatgtatgattaggtatatgtaaagcaaaaaatttaaatatagacttccagctctaaatagaatgaagacatcttccattaggaatactggtatagcttaacaggttaaaaactaatgtgaatactgcaccatataaattataaagccatacttcctcccaaaacaaggatctgtttccttaaatcaaagttctccaaagtatattgtacgaagtattagacctaagtaatgctccttgaaaaaatcttctggtcaaataatttggattctaccttaatgtgaactttagcagaccatctgtgttctaaattataacaccttaatttagttattttctgcaaaagagtcaatgggttggaaatttgatctgcagagagctgtcagaaaaggtgttcaggagctggtatgtttgtggttaggtggcacagagatctatggtccttctttacaaagatgctaatcatttcattatttaggtcaaagttatagtatctacaaaagtagaaggctttcacaagcaagaacagcaactacaaaggccctggccaggccaagggtggcatataaatgcttctgtagttgtcagcagacagggtagtagtggttaagtcaggtattaacaggattttcaggagaagaaaaatctgaagatggaaatattgaatggcattataaataggaaaaggagacaaggagttaaaaggactgaagggcacagagatttgggggaatagcacaagcacagtttctatttttttacagccatagttcccgtatccttttgaactgagaatcagaaccactgccatgattacaaaaaccatttggacatttagaatggcaaatgcaacgttcttttttgagtgctgtgtgtttaaaataaatcatgcaaaaactaccataatgtataatttggccacagagatattcaaagctaaaaaaaaatagagcaaagagattttggtcatactatttcataaaggggcatcaaaaggcttaaaaaaagagtcatataattctctcttaacaaatcagctattagaattgactcttcagaaatatttggttacaaaactgtctttccagcttaacagataattgctttcaaagcaggatactcattgcttataatgcagtatctatattttatttgtaatgggagctacattggtgcagattgagaatatttattggcacattctttctgagccatattttgttcaatcatctcagacttatgtcatcttgatgcatgtaaatacgtatactccatcatcatttgttggagagttaatatagagaacacccataaaattggcaacttggtgaaggatccatttattaatctataaacaggatgtctacccatctattgttgcaacatatcagtctccacagggttactgtccctacaagcaagaggaaaaaatatatttctatgagtggtttcttctcctttatttgtgattaacatcaattagaaaaaaaaatagctaagcagagagagccaaaacttaagaccacacagattcacacttcacaccacagagaaatgaagacaaatttagttaatggcaaaacccactgtttctgtaaataacaaatctaatgtaaaacgatggtggaatataatgatcctgtgaggttttaggcatctgttcaaataaacctatttgatcatttagttttctggaaaaataaggggttgacaaagattcatatcaaaaccctagtggataaatatctggctggaaagagtaaaaacataagattccagctatgatttcagtgatctataagctatttcttatagactaaaatttatattaaaattattttaagtaaaagcatttttaaaacacatacatgttttattcattacaaatctcactagtatatttgtgaaaggcaatttactgccaaatttctttacaaaaacaagtttccatttcatttccccaaatccccaccttttgttcattccagtaaaatgactctaatgccaaacctgacactcagaatcttaaattctgaaatttcagaattttcagtcactgctgaaaaaattcattagcatctcaaacttaaattcaggtaaattaagaggaaaaccaaataaacaataatgcaagaaagttacacattcaaacatgtgttataaaaatcaacaccccatttgaattagggctcctctgaaatccctgggcagggctggtgcctggtaatatttaatatcaggaggaatggaatcttgtagaattcattctacactgaccagcagtattaagtgtcactgtcaccaaaaaaacattctcagctgtagacaatattctaaaattactaatatcactgtctgaccttgctgttatctgttgtgtggaacagagatctatttatttagctgttcagcaaatgtcagtataccatgactggagaaaattagaaactacattggcagagcactccctacagcctgctaagtaaggaattgaacaaaatgctttctacctcaaagtgtctaaatcattgattggccacaccttctctcatccatggttaacctttcatggacctagtagagttctccagctattagactccttttgcaaaaggattccagaatatcatattctctgaggcacatgttaaacagactatgaaaacatcgtgatttgggacctagctgtgctgcagaattgtcaggggcctctccagatcctctccactcttttgcaacctcctcttggccctgggaggctgactagagagaacggattaatgggttccttttggatctgatgtctggggagccctggcaggaggagagggaattgggggcatttattcccccgtccctcccagcacgattgtcttgggtggctgtttcctccacagaaggtatcagagcatctcaaaaaagtcttcattacaggatattctcttctggtcaagtagtcacctccttctctctctctcagcattgggacagaagcgatcccacgctgccagccccaggttcctttaaccccacatatattgtcattatcaatatttttaaaaataaactttcctccatatactgtgagatgagtgtgccattgtttccttttaagactaactgataatgtgccattttgaccaacccagcttgctcttgggaaaatccattcaaccttctagaactggaaggttaacattttgttcagttaccccctctccacaagataaccacggtcatgggttacacaataaaataaaagtcaaataaagctgcacattctcagcacaagccattaaatgagtattatcacaaacatttctttccttggctctttttgggacatggctaatacctaagaatctgaaattgttgctcattagctgtctggatctacaccccagttaaaggcagaaaaaggaaaacaagctaaaggctttattatcttgggtcctgtccattacaaatgacagatgatggcttgtcaggtgaaaacgagcttctcagcactaaaacggcttcattcagtttattagccacaaacaaaactaaggaaggcccactaagaaagtgacttgaaatccttattttcagcatgatgaaagatgggctcaataagactgaatccccatgtggtcttccagtctgtctaaagaaggaacatgggtaacatggagacaaactcgagaagatggttagtatttaaaaatgtaggtctgcaaccttgaacaaaaagtgttaacttccataaaatgccaatgacccagctgcaagtagtcaccatacatttatctcaaaagccacattattctgttctactaagcaaataaactgtgtcattgagctgttaacagtcaaccaaaaaatatacccaaagggaatacgtataggatggcttaacaaccaagaaaaaccatgcggaaggaaactaaagctctcaaattccacatggcttttctaggaactgagcagcatccagtaaagacagatacacacacagtacctaagtccacaacgtagacaagcatttgctttccagatatgctagagcttccttttgtcttccctgctctgtaactctcctttattctctgaaatgtctggacaaatgtccctgtttgcagacgcctacctcatccatcttatcacacatgtttctcagtgtgggtttatctcatgaacatgtattttccaatatgttaaatccaaaaaatagtttttaacttatttaatgtctattttgtgtcctatcaaaaaaaagcttcttgggttgaaaaaaatatttttgtaaatgtcttgacctgccacctttttattttcatgattgctttgaatatcatgtcaaagttcttactccggaaacctggatggtcttctgtgttgctcaaggctagctgagggcatctcccatttttttgtttgtcttgagtaggtgatgcttcctgtaatgcccatttctgctacacgagttccctttcatactatgccatctaactcgactccgaagttcttgccacctagttgagaagactgtaatctctgccttggcagatttgagaacaggaattccatcccagtttcatgttacagttccaaatgactgtttttatagatgtatcgagtacattgatgttgggggtacttcttatgggagattatattgactaactgacttgcagagtgttaattttaattggaaggggtggtttcaaactcagtgccagacaggtaagtaaatgagtagagaggtattagattaagacaacagaaaatactctgacataccagcaaggacatgccttttcaaatggggcagttgctacacaatctatccaattgttgccatgcgaatgtaggccttttatgcccagatctttcctgttttcaaaagccaaaattctggatttttaaaaacactaggcttactagacaaaatgtatctgagagcagcatctgtccttactgcttaatctgtgtatctcccacaactaggtagatgtatcaacatcccagaagatgctttccaaaccagtgcatctttcctgatactatcactaccctctctaacttttggattttcccactccctcaaataatctgaaaatttctatttcttttttctttatgagatgcaatcttggctctgttgcccaggctggagtgcaatgtcgcaatcacagctcattgcagacttgacctctcaggctcaagtgatcccacctcagccgcctgagaagctgtgactacaggcatctgccacatgcccagctaatttttaaaaaagtttttggtagagatggagcctcgctatgttgcctaggctggtcccgaaatcctgggctcaagtgatcctcctgtttaggtctcccaaagtactgggattacaagcgtgagccaccatgcttggccagaatttgaaaatatttctgcatataatgaaatattcgaatggaaaactgttacatgtgtgaatgttggaatgcagaataaagctacacagagagagaaaagaaaccaagcaagtttggagaaggacacaaggatttctccggctacaaaacgaggattgaagagttatacaacatgaatttacacatgacagcaatcatgctaaggctgaagtagctaacacttcttaatcacttactagatgctaggcactgcctaagtattttatctatcttaacttactgatatctcaccacgaccctataaggaaggtaactgctttccatattttacagatggcatacagtatagaggcattaggtaactcctctaagccacacatttgataatcctaaaccctcatgtgactccagatctactgtgtcatatggtttgccttatactcttctactctaacaccttcagtcaccttactggccaacttggctgaaatccttggcatagcctaaaatgtcctttatatacaccagatgcaacacattccttaaacatgagacaaatcctcccttgaagatctccttccatggtagttttaaaatatgcccacaaatcccttaatgttcctctcttcaagatgtagagcttaatcttcctcctctggagcatgggctgtacttagtgattcattctaatgagcagaatatggtacacatgacagtgtgcgacttttgagaccaggttatgaagggtattggggctccttcctatttgttctctctcttggatcactcactctgggcaagccaactgccaagccataaggacggacactcaagagacttctatccagcaaggaaccaaggcctcaggcctcctaccaactgccatgtgagtcattttggaagcagattgatcctctagccccagtcaatcaagtcttgagatgacagtgaacctggcatacttcttgactgcagcctcatgagagaccctgaggcagaaccaacctacaaccaaaaccagatgtcacttatcaataaactcaaggttgaattgttggctcactgataggcagagttttgaataagaatttaggtagctctttcaataaaatatttttcacatttaaattaatggcagattgctgaataaaatgtatatgcttttaccatttaatgaccacatatgaaaattgaaactaatcctttgccatactgaaatatactaaactgcaagttctaagaagtgacatagatttatactttttaacagatgattttcctaaattttatacttaaaaaatcccactataataatactgctttggaaaatgctagcttttttttcttaatcaggactatgtacagggaatatgagacaatttggtatcctattagaatcttatttctctgacatgagtaagttgggctgatttctataatgatctgttacatatgccttaagtcttcaagtgcaatgtgagttaaatgaaaagtactgtggagttaacatcacaattacatcttaagaaattgcaggagataatctaaatttgttaaatatattgctaagtatatgactatccacataaagcttaatcaatttcataataaaatctactttaaaccctccaaagttctgattgtgttccttaatatagactattgaaaattattaaaatatctggtttagtgctacaataagtgaattaaggcaagatcagtatgaactacaactgagacaggtatccactagaggccagtgtacttcggcatggagaaggaatttataaccaattcctgtggaaaaaccaaccttattcctaccattcaaaagtggaggtcttgtgaagtgaagaaaaaaaagatgaagaaagctattttgattctctgaaaagaaagcttcagaggataagaaagatgagttaaggaaggatgagtcatgaaaaaaaagagcaaagagaattcttgtctagagaaaaaaaaatagtactaccatacactgtactgtttgatgtttcaccaacgtaagtgtaaattttcaagatacttggtgtaactgtaagctttttcataaatgtttcatttggcaatatattggaaataattaaagatctggagtacctagaaagtaccacagtaatttcattttcaaggcagtcatcattgctagctgcctagacaaggccaagggttttgaaatgggatggaacaaaactgcatgtctgcaattttcttcccttaaacaactgtattcagaacaagtaccaaatggttccttctcaaacatggaataattcatataaattcacctagcactacattcatattgtaaaatacatttcttaataatggtgcgacacgatgcctacaatactttttaacaaggaactgaactagtttctcaaaactaaaaatcggagtggaaatgaaaatctgattctttagtaaaacgtagacaataatagttggtaggatcctgagtaggagattttactttgtaagagtgaaggctgaatgatttaacacataacccacagatgtgtactctttccccttttcctccagcagagaaaggcaccttatgtaatgtgggcatgccggggagatgaatgaaccagaaaatcttagagctaggcaggacctgagggttcagccaccgcagcttgaaccttttcaaagacaaaagtttcctcctttgcaaggtggcccattgcatccctccattgcattgttgaggctatagctgtttgaaagttattctttaatctttatactgggggacctcatctgacacaacaaaatactgttctggttcctgaggccaaaaagaggacataagatacaaagataaataatacatgatcctgacttcgaggagctgtaaaattctacccatgcagtaggttctgattctgatctctgcaacaaaagcactggctctatcacttattagctgtgtgaattagctaacttctttgggcctcagtttcttcatctttaaaatggggataataatattagtacctacctttgcagggttggtgccaggattaaatgagataattaaaataaggcactaagcccagtacgtggcaagtggtaagtacttattagcagtcagcaattattgctactcactatttacctggcatataagtaattcaaccctttccaaactcctatgagctatgattttattaccattatttttagagacaggaaaactgaggctcagaaagctgaagtagtttgccaagatcagcagctaattaatggctagacaaggatttgaacacaggtttatctaatgacaagagctttaaccattacactaagctgttctggtgaacagtaaggcaacttcctaatcctaaagtgacagggccagtattcactgacaaaatctatgacaaatccaaaatttttcctttctctgatataaatatagttagtgccaaaagctaaccacaagattcctcccttcctagccatgggagaacaggagccctggagatggaagaatctttgaagtccctgagccctgcttccagtgagccatcctgcctgctgttccaacctctgttcctggagcccataccatcctggttaatctctgcctctgtagaggtggggcttccactacctttaactgttcttcatgggataatcacaaacggcctggacctctcctggaactcagggataacaaaaaagtattgagagagaattatctagtcgggaataaagacacacaggtgaatgttataagaaatgcattcagtgaaacctttgaaatagctgtgtgctctctatgccaagtcatggatttaaaaaaaaaaaaggtctgcacaatgttaggatcagaatacaatggtatgacacttaagagtacttccaggttgcttgcttcctgatattacaaaagcacgctcagtcatctctgtcctctatcaccaagcactcagtcctgtgatgaaaggatgctggcattctatttacatcagctaaatttacaaagaaactgactttctgttgatggcctgttgagaggaacaaattaaaataactctaaatcatgtctgtaattttctgaagagatacgcttatcacaccccacttagaacaccaggtcagatgttatctcggtctctcctgatatagattttctactcctttgaacttacaagatacagttctgcctattcattaggaaggtacataagaaattggcttacaaactacagtgaatcagaatgtctaattgtctgactctggctctgagaaatgtaactaaaatcatgaaccataatattaacaaaaaattatggtcctttatctgggaaggtcttttatgaatgtgctttcattagctagtaaggccagaggaaacaatttaaactcaaatcttagtgactgttttcttaaagtcttatattaggagcattctgtctgaaatgttaatgagaagagaaatctatgttgatttgacccccaatttatgacagtatgatatgaaatttcctcctccttgtcaaaaataaggcttctccaaataagtgtcaaactattatgatttacaatgatttaaaaactgttattgacatgattcacagagtggacaataaacaagcaggaaaagaaaataggataattgtgaggtgaaaaatatttagaatgacaggttgcatgattaaatgagaagctgaaaatcaaaagctgctgaaccattcaatcatttcacagaggcatgtttctctttaagatgtttaagaaaaggtgagggaaacagaaaagacactgcaaggaaggcagggatggtttgattgcttcatgaagataattaattggaatgtactaggaagctgtaggctttgatatgggcagcagcacccagttggcttgatttattattatggttacacagaaaccaacttatctgcaaagcataaagtacatacttgccatcctaaattcaggagaaaaatggggaaaatggacttgggtgaaaaaaggaaaatgaaattgaattgagtctgaagtgacttactatcaaatataagtccaaccatttgtcacaagtcaggtatctcatctacaaaataggcaacgtaataaactgactttactaaaatgtactgacctgaaaattgtttgtgattttgttttataacaatgcagtataccacactggtggtaagtgagaaagataataatctagaatgtgttccaaaaacaaatttggctgtatattggcaaattatattttcatctctgacttcaagagaagtaagggaaagaatgaaaaacaaagtagtaggatgagtattattaagtatgagtgtgggatggtgtgggaaataatagactattttcttgttactgatttgcaaaagtccatacaccacaaagtaaaactatgttctttctctgttaatttgatattgaagagcaaggagaatctcaaggggactatccaatccacaactatcctacaacatgacttacagacacatgtaggagtccttttcatatttcaaaaaacaatcctccattaggcagcatgataaagtaaaaaacaaaggaatagatacacacacacaaagacatacaccatatgcatactgtgtatgtgtgtgagtgtgtgtgggtatttatcttaattctaaagaaggtgcttgttgtgtgttccaatgagagttagtaagaaacatgactgtcatcttttcctttccccttgcagtaatcctagttttactgtcaggcacatatgggtttttcaataaccataactcagataaacatgtaatatctaagaatagttaactttttattaagggtgttagtctgtgtgaggtgtaatgctaagcacatcataagtatcaggtcatttcatcctcacaagaagttcaggtgttgacactggagatcacagaggttagtaacttgcccatagtcctacagctgcttaatgtctgagcaggaatttcaatctgggcccatctgaccatgcagcttacccaaactcttatccaacctgataccccatctaccacatttaaagacccactgtcattaaagacccattttaaagacccatttaaagacccactgtcctaccactgccagagtaccccacatatgctattacagtataacatgaccctagacacacgctaacagagtcctttttatatttcccaaaacaatcctctctcagcaaaaaaacaatcaaagaagcagggatgcataacatttcactagcagtcagttgggagacctgggttctagtcttcgctctgccctgctttaggtacaggaccttggacacatctcttcatctctcaggacctcaataacatcacctgttagaaaatccttgagaaacatttctgcacaaacatactaaatgtataggcaagtaatagaagtcaatcacagtgaagatcactagcaccagactgttgcttttattccactatggtatgtttatataaatgttttactgctataaaaatgaaagataaatagtattcattgggagaaaggggcttagcaactccacattttgtcatctactattacatatctaggtcaaatttggcttttattaataaatgaagaatgaagacaaaaattgcaaattggaagagtttaattagaatataaagactgtcaagagaactgaattgcatccttgacataaactggactagaaaaataattaaaattggctttttaaagtctatttcggttatgttgaggagcaggatattttgatgagaaatgttttcaattctttgaataaaagcaaagaagatttgcacagtcatcagtccacatgtatatagtacagtccttcaaggcaggaagaagtttactcaaatgaggcaagtaaatgcagaacagaactgaatggctgtcagccctacctgagtctcagagactaagcttcaaaacttgaggtttttctttcaccctaaatagctctgatgagcaataaagtatgacagggaagtttaaaaaaagaacattcaggctgggcacagtggctcatgcctgtaatcccagcacttaaggaggctgaggcaggcggatcacaaggtcaagagattgagaccatcctggccaacatggtgaaaccctgtctctactaaaaatacaaaaaaaattagctgggcatggtggtgtgcgcctgtagccccagctactctggaggctgaggcaggagaatcgcttgaacccgggaagtggaggttgcagtgagccaagatcgcgccactgcactccggcctggtgacagagcgagactccatctcaaaaaaaaaaaaaaaaaaaaaaaaaaaaaagaacattcaacacaattttactaagatcttacaatatgtgtacaactgtgttgagatgtggagacaaaggaaatctgtgaccagaaagtcatagtctttgcctttgctaattttataatctagtggtgaacttgatgttgagaatgagaaagagatttcaaaggcatagctcaactaagaacatcttataaaccataaagtcccagtttaatagctacttcaccatttactaagataatgcctatagggaggtaactgtggactttttattgtctgtgcatcttactaaagggtgggcaactgacggatagggcatctgtatcatttacacttaataagcatcttcagctacaccaagagagatggtcaatactcagaaggttgtgaggacacccatcacattaggtggaagcttctggacctgagaatggaaggtagaattatgtggtcagggtctttggagacaaatttattaggctgaagaaggtaggtttttttggaccaggctgccagggttgatttagtcttgtttgtggatggttaataggtgcagtgatgtggtttggctctgtgtccccacccaaatctcaccttgcactgtaataatgcccacgtatcaaggttgggaccaggtggatgtaattggatcatgggggcggttcccccatgctgttcgtgtgacactgagtgagtctcacgagatctgatggctttgtaagtgtctggcatttcccgtgcttgcattctctctcccaccaccctgtgaagaggtgccttctgccatgattgtaagtttcctaaggactccctggccatgcggaactgtgagtcaatttaaactcttatctttataaattacccagtctcaggtgttccttcctagcaacatgagaatggactaatacacctaggaataattttatgcatttccataaaatgcatgtttgtaatgtttccattacagggctaacctgatatgagtactcaaagtctagacactacaattccctcctcccaacatccaccaacttcatttaggctctttctgtgcctggcatttgagtctatcttcctcatgcctccctcacctcttggagcccaaatactcacacatcatgctgcctttgttaatatttgcccagttttctcttaccccctgctctacaagattctgtaaagatcagagcagaacttacttcttatttccgctattttaaaataaaaagcttttagacattttaacatttttgacatcagaatcccccttagaatgaatatctccctttactgaagtgagttttgctcctaaaacaccattattaaaacagtgaggtatcttactatagctaggattctagagcagaagaaatactgcatttctgttgtttaggtcctgaccaataacaggactgacactgatactaactatacaccacttcccttcctcttgttccacttcatgaagtctctaaaggatctcatatgtttggtggaaaatcaaaactgcagaaactgataaatactctgattttgttttctctgtacttgatcttcaaggattgctttagtagaatataaaagcaaatgatggctcattcaaaaaaggtcagtgaatgacaactcttaggaactcttttgtcactgataaaaatagttccatctacctggaataatcttgtaatccatttaaacatttgtacataattcttcaatctctgatatacaatggtgaggggactcagcccactgtgcctggggaagaggagaaaaaggggggaatctaaagcccaatttaccactttctctcacaaaccggattatctttttgacatctctatttccattcacagagattcaaggactctttattttcccagttatccttctctggacggactctagtcaccaacatccctcctaaaatgtaggatgatgcattggaactgttgctctctgtagctacttactgtccagtggtaatacagggatgtgtttagaaatacggaatatagtgtaaaattgcccgggctcaacatactagctatacccatactagctctgtgtcctctggttagttatgaatctcttctatgcctccttttcttggctgtaaaatagataatcatgtcttaaaatacaataatccacatgaagtacaagatcctggcaagtcataagagctcagtaattgctggccgttactaaaaccaccagcatcacttctgccaccaccattctcactactgctgcttgatggaggaccccaaatgaactgctgcaggacaacgatgattatagaagtggcagcagcattccttgccctccaagatttggccccattttatctggctgaatatgttgcttagcattccacttttagccaatctgaacaatctctttactgtattctcctgctcaatcatccagcctaaaagcccttaccttctcttacacccttccaactcttctgctatcaaggctgctcattgagcctactcaacatcttccacccacaatcgcctccccttcccccacacctttagccagagaatcattttgcatttgaattaagcgctcttctagttttaaattcaatgtcatataagattactatgatttatggcttcctaactgacttatgaatttactttgtttttctaattacagggcaaagagtttcctatttttacttggtattgccttcttgtacttagcatcattttaggcatacagaataagatctgggtattatcagtggactgacccacacctctgtcctaagtgtattatttatccctagaattaatattgggatgcttggaaagtacgataattaattttatatgtcaacttgactggaaaatgggatatccggatatctggtaaaacattatttctgagggtgtctgagagtgtttccacaagagattagcatttgaattcatagactgaatagagaatacccaccctcaccaaagtgggtgggcaccatccaatctgttgggggcctaagcataaaaaaaaaggtggaagaagggaggatttgctctctctgtgtgattatttagctggggcatcttccttctgccattgccatccctggttcccaggcctttagacttagactggatgctaagccattggctctctggctctcaggccttcaaactataccaccagccttcctgggtctctgccttacagacagcagattgtgggattccttggccttcatgactgtatgagccaataccttataataaatctctttatatctcttatttgtcctgtttggtgaactctaaaacaggtgtagtaaattttcactggacaccatgatactgcataaacattcgagctgtcgaggtttccaatgacccaaaaataaaatttagcctcaaatagagacttgtaaaatattactataagctcaaaaggattttaatgtacagttagagaggaattccagctcaggaagatcctgcttttctgtaataaagaatataactcaattaccaactgtctcacttaatatatgacacaattcctatgagaaagattctgtactctgagagtattagagaatgctaagtctctattccaggaggttagacaagacaagattgccaagctttagtattttaaaatgtttgctttttcttgagctaaaagaataaaaaaaacaagcaaacaataacaaaatcccataatcatgattatttcactacttataaaactcagtgtcatattagcacctgaggtcattaaggttggtttgtacaataaccaaaacatacttgaaagcaagtaaaacagacatataagaaagaatatattaggtgaaaaagaaagctctgattacccaaaatgctaataatggctctgcacaaacaattaaaactcttcatttcaaactccatttgttcagaatgtgaatatggaggactcttccacaatttacctttgcaatatttaaggaaaagtatttgctgagtaaaaaaatatatattacagtaagactgtaaagaacatacttaccatattcaagaaaataaacttttctccagtattgaaatgtctcatttataaatacttgattccttaatagcatgacactcttttctgctaattaaaataggtggcatgctgggcgcagtggctcacacctgtaatcccagcactttgggagcccaaggcaggcagatcacgaggtcaggagatcaagaccatcctggccaacatggtgaaaccccatctctacaaaaatacaaaaaattagccaggtgtggtggttcgcgcctgtagtcccaactacctgggaggctgaggaggggaatcacttgaaccctggaagcggaggttgcagtgagctgagatcttgccactgcactccaacctggcgacagagcaagactccatctcaaaaaaaaaagtggcaaaatccatccatttgaccaagcatcctttgcctactttaaacacataaaataataagtaacactaagaatgtaatttacaataggatttcttcctaccgattggccttatactaaggatgaacaaaaggttttatatattacctgaaagaacggtttttttgctgaatgaaactgattattagtaatggttccagtcacctaaaatagccaaaggtatgtattttatgttatcactcttctttttttagaaaaacattttcctttaaaagtagcctaccaattcacaggtgaaactgaatttattgttgtaagatcaggctttaaaataactttgaggaggagaagcccttgacaagaaagtaaacaatagaaaccaggtcagcaactgaagacctgattttattgttcatagacacaaatgcttggtttcagaaatgccttaatatcaaggaagctactggtcaaaagtatttctatgggcacattatatcccagaactaatgttgtcaattgactatctagttggtaggaaaagtcagttcaaccttaaaacctaagttaaataggaagaggttccaagatggccgaataggaacagctccagtctacagctcaagagaagggtgatttctccatttccaactgaggtacgaggttcatatcactggggcttgtcggatactgggtgcagcccatggagcacgagccgaagcagggcagggcatcacctcacctgagaagcacaaagggtcagggaattccctttcctagccaagagaagccctgacaaacagtatctggaaaatcaggacacttccacccaaataatgcgcttttccaacagtcttagcaaatggcacaccaggagattatgtcccatgcctggctcagagggtcccacaaccatggagcctcactcactgctaccacagcagtctgagatcgaactgcaaggtggcagcaaggctgggggaggggcgtccaccattgctgaggcttgagtaggtaaacgaagcagccagaaagcttgaactgggtggagcccactgcagctcaaggaggcctgcctgcctctatagactccacctctgggggccgggcatagctgaacaaaaggcagcaggaacttctggagacttaaacatccctagtggttctcccagcacagagtttgagaactggagaatggacagactgcctcctcaagtgggtccctgacccctgagtagcctaactgggaggcacctcccagtaggggccgactgacacctcatacagcagggtgcccctctgagacgaaacttccagaggaagaatcaggcagcaacatttgccgttctgcaatatttgctgtcctgcagcctctgctggtgatatccaggcaaacagggtctggagtggacctccagcaaactacaacagacctgcagctaagggtcctgactgttagaaggaaaactaacaaacagaaaggacatccacaccgaaaccccatctgtgcgtcaccatcatcaaagaccaaaggtagataaaaccacaaagatggtgagaaaccagagcagaaaagctgaaaattctaaaaatcagagcatctctttccctcaaaaggaatgcagctcctcgccagcaatggaacaaagctgaacagagaatgactttgacgacttaagagaagaaagcttcagacgatcggtaataacaaacttctccaagctaaaggaggacgttcgaacccatcgcaaagaagctaaaaaccttgaaaaaatattagacaaatggctaactagaataaacagcatagagaagaccttaaatgacctgatggagctgaaaaccatggcatgagaactacatgatgcatgcacaagcttcagtagccgatttgatcaagtggaagaaaggatattagtgattgaagatcaaatgaatgaaatgaagcgagaagagaagtttagagaaaaaagagtaaaaagaaatgaacaaaacctccaagaaatatgggactatgtgaaaagaccaaatctatgtctgattggtgtacctgaaagtgacagggagaatggaaccaagttggaaaacactcttcaggacattacccagaagaacttccccaacctagcaaggcaggccaacattcagattcaggaaatacagagaatgccacaaagatactcctcgagaagagcaactccaagacacataattatcagattcaccaaagttgaaatgaaggaaaaaatattaagggcacccagagagaaaagtcgggttatccacaaagggaagtccattagactaacagctgatctctcagcagaaactctacaagccagaagatagtgggggccaatattcaacattcttaaagaaaagaattttcaacccagaatttcatatccagccaaactaagcttcataagtgaaagagaaataaaatcctttacgggcaagcaaatgctgagattttgtcaccaccaggcctgtcttacaagagctcctgaaggaagcactaaacatggaaaggaataaccggtaccagccactgcaaaaacgtgccaagttgtaaagaccatcgatgctaggaagaaactgcatcaactaacaagaaaaataatcagctaacatcaaaatgacaggaacaaattcacacataacaatattaaccttaaatgtaaatgagctaaatgctccaaataaaagacacaaactggcaaattggacaaagagtcaagacccatcagtgtcctatattcaggagatccatctcacgtgcagggacacacataggctcaaaataaagggatggaggaagatctaccaagcaaatggaaaacaaaaaaaagaaggggttgcaatcctagtttctgataaaacagactttaaaccaacaaagatcaaaagagacaaagaaggccattatataatggtaaagggatcaattcaacaagaagagctaagtatcctaaaaatagatgcacccaatacaggagcacccagattcataaagcaagtccttagagacctacaaagagacttagactcccacacaataataatgggagactttaacaccccactatcaacattagacagatcaacgagagggaaagttaacaaggatacccaggaattgaactcagctctgcaccaagtggacctaatagacatctacagaattctgcaccccaaatcaacagaatatacattttttctcagcaccacattgcacttattccaaaattgaccacagagttggaagtaaaaaactcatcagcaaatgaaaagaaaagaaattataacaaactgtctctcagaccacagtgcaatcaaactagaactcaggattaagaaactcactcaaaaccgctcaactacatggaaactgaacaacctgctcctgagtggctactgggtacataacaaaatgaaggcagaaataaagatgttctttgaaaccaatgagaacaaagacacaacataccagaatctctgagacacacttaaagcagtgcatagaggaaaatttatagcactaaatgcccacaagagaaagcaggaaagatccaaaattgacaccctaacatcacaattaaaaagaactagagaagcaagagcaaacacattcaaaagctagcagaaggcaagaaataactaagatcagagcagaactgaaggacatagagacacaaaaaacccttcaaaaaatcaatgaatccaggagttggttttttgaaaagatcaacaaaattgatagaccactagcaagattaatcaagaagaaaagagagaaaaatcaaatagatgcaataaaaaatgataaaggggatatgaccaccgatcccacagaaataaaaactaccatcagagaatactataaacacctctacacaaataaactagaaaatctagaagaaattgataaattcctggacacatacaccctcccaagactaaatcaggaagaagttgaatctctgaatagaccaataacaggctctgaaattgaggtaataattaatagcctaccaaccaaaaaaagtccaggaccagacggattcacagccgaattctaccagaggtacaaaaaggagctggtaccattccttctgaaactattccaatcaatagaaaaggagggaatcctccctaactcattttaaaggccagcatcatcttgataccaaagcctggcagagacacaacaaaaaaaaagagaattttagaccaatatccctgatgaacatcgaggcaaaaatcctcaataaaatactggcaaactgaatccagcagcacatcaaaaagtttatccaccaagatcaagtcagcttcatccctgggatgcaaggctggttcaacatatgcaaatcaataaatgtaatccatcacataaacaaaactgatgacaaaaaccacatgattatctcaatagatgcagaaaaggcctttgataaaattcaacaccccttcatgctaaaaactctcagtgaactaggtattgatgtttactgtgacactattcacaatagcaaagacttggaaccaacccaaatgtccatcaatgatagactggattaagaaaatgtggcacatatacaccatggaatactatgcagccataaaaaaggttgagttcatgtcctttgtagggacatggatgaagctggaaaccatcattctcagcaaactatcacaaggacagaaaaccaaacaccgcatgttctcactcataggtgggaactgaacaatcagaacacttggacacacggtggggaacatcacacaccggggcatgtcgtggggtggcgggaggggggagggataccattaggagatatacctaatgtaaatgatgagttaatgggtgcagcaagccaacatggcacatgtatacatgtaacaaacctgcacgttgtgcacatgtaccctagaacttaaagtataataaaataataaaagaaaacctaagttaaatacaaacaaataataattacttaggggtcagcagctggtggctcaattgggcactggagaccatgtttgttctctttgggtggtacattgagggtgtctaaccttaagaaatgcaggaaggggatgatggatggtctgttcagattccctttgtcccaactgcatttttcagctgtcaagagatactgttagcaggcactagatttaacaatgggaggctagatgggaggctaactaccttttgaagtacacgcctggcagatgacaaccagcatctttacttttaaacccagcaacagtgggttgctaggcattgttttgctggtttattaaacttgtttcagtaaagaagcagcaagtaactggctgcatattatactagactaagaagctttttacagacagcaattggtcttagtaaatgctgtatcctgcaggtctaggacagtactagaggtgataatattaatttatgatcaacaaggtctgatttgaaatacaaagtcacatgcactggtgaaaccttgggcaaacagctgcgaaggaaactttctgtggtcaactataaacgttccagctatacaatattatattccaaatttgttgtttattttttatctaatttctatccttatgcctagagcttcctttttctttacacctggtaaaatcctgcctatccttagaagcttcatttaagattcttcttgtgacctctcccggcataattacccttcacattcatccaacatggtgaccccgatctgctaggttctaagcctccagttgttaccatatgccatcccattttacctttctgtcttttatatccctctggttcttctatcagaatatagagagaattatcaaataatcacattgtatgactcgctctcaagcttttgaatttgctgaaggacgaaatggaacctttgttatttcggttaccctttcacctagaaggtccttccgtaacaccacagtcagaattttaaaacgaagaggaactccatactcttttattggattgaattaaattgaaggaataactaatttctctcgagcttcctgatcttaaaatcctctgaataggtaagaaataaagctgagatggtatcttgttatgctgtactgttctcccctatgttaggggaaagggtgtctattatttgtcttttgggtttttcctcactgtacttctgggggttgggggaggttgctgctagccatttcctctagtaaaagttcaaaatagcccttctataaaagctaccccatagaacaccactttataaccatttgaaaaaccctaaagttgacctccaggagaaaccacttcatatggcttccccaaaccctgtttaacaagttttaaaatatttagctggaatgttacttcaagctaaatatgctactggtttattttttcattccatttaccagttgtgacctcatctgtgcttgcaattggctgaaaggaaccaattttattcagggaaactttcggatgtgagccgtgatgcccactgaggataaagataggaaggtgcgcacggtgggtgtggaaggagggagaatcctttctagaagatgggggagtgggcccagattcaagtgactgagtgacctttctttttgctagctgctgtgtgaggaaaaaaggctatttcttcctgcagagaactgcgaaatgaggtataaactgagtagcgaggtagatgagcctaccacattagctgattaataagcaaactgctcaaatgcccagagggatagagagttcctagcagaattaataataaatccagacattgggtgaattaaatttaaggtgtaaagactaaaccagggtcatattagctaggaagtatgaggtgcgggatttagtaaaaaaaaaaaaaaacttatttgcacagagatgcttagttagcctagctctacaaaaacatctataaaacacagctttttaactgttttcttgctggtttaataattagcttaatttctgttcacaaaaaattgtagttaaaaaaaagctttcaatacctacgagaactctgtctaattgagccatgagggcaaatccaagaggccaccacacatacactagaggttgacaaagtgcatgagaagaagcaggtctcgtaagtactgatcttgcaaccccaaatcactaaagtacgagtaactgctacaggagcaaatgaaatgatctgtcagaaatctctttgaaaagcagaaaagtgagcacacaaatatatatgatcatttctgttgtttaacataatcaagaaattgatgctgctaaaataagttcaatttaaaattgtggccaggcatagtggctcacgtccgttatcccagcacttcgtgaggccaaggcgagaggatctcttgagctcaggagcttgagaccaggctgggaaacacagcaagaacctatctctacaaaaaatgaaaaacattagtcaggcatagtagtgcatatctgtagtcccagctactggggaggctgaggtgggaggatttcttgggcctgggaggttgagactgcagtgtgtggtgatcatgccacttgtattccagtctggttcctgtctctaacaataacaacaacaacaataacaacaatgtgggactgtgaatctgcttttaaatattgtacatagggtacctaacaaaaaaaggtgttaaaattatttctcaacacttaggatgagagaaggggaaggccagcagtaatattttatactggttgggagaagggtagatggcagtcaaatctgaatacaaagcaaaggctttattttaaaaatgtatttccttctttatcagatttcatatatatgtgactatgtataccacatagcaacatgagatgcaatgagttcatttcttttctcttttcattccaaataaatgggcaagagaactgcacccaaaagggctgggtcaagtccaatctgatacattgtaccagttcttaaatgtgcattctttctacgtctcaactgttgttaggtaagttcttcaccagtaactaatgataattaaatatataaatctgtgaataatgtacttgtgcttctaaatgaagtacaaaagactcaaggtcaatcgtataatagctttttctgcactcacttgctttctcctgtttatctgcttgagtgggtaaactacagtaggacctctcctccatgggctggtgtagctacagctgacaaaggtttgaggaccacagttctcattctcagcaaatcacaagtacacttgtatgactgcagtttgcaaccttgtaatattgatttaggcccaaacaatatgctttcaggatcctttaacaattattttccttttgaacaaaacataggaagaataataaacttaaaaggctataatacctcaaacttttgcttcaaatgcaaggtggctctggctgaagcagaaaatatgtattattaacactagcagttgttaatagtggtaatgataatatgttatctccaccacatggcgataatgggttttttattattaaagtaagatgccacctttatttatagacatcgttaagtcagagaaaatgaaaatgcaaaattactacacagttcaaattgcagcagcccttaagactcagtggggagaatgtacatgcatcatcttatggattaaaaagaatacacattatctaagcccaatgttatgtccacacatatgtgcctctaaggttgcaagaataggaaagctagtgaaagtaaagaaaatattttttagatgtgattttctattaagaaagatgggccctaaatgtaatctgttttgctttaatcaagtacagacaagacaacattatatgctcactcaattatgactgttttccccttaaataacttcacttaggaacaaacacgaacatagctaaatggaatttccactaaccattaaatgtagttagatgttcttttcttcatatattttagactgaagttctattaatactgtttgtaatataagtatgtgaggaatagtgtctcccaaaagcggtcctgaaattgtatttgctatccgaagagatgcatacgttatagcagtaaatttggtacttgggaaactattttatttggtttgagcaattctaaaaaaattaagggcaaacattagttttgagcatcacagaaagatatgaaatgaagtcaagtctcaaagtgcttcaggtaattttaagaaccaaaggctcaaaagtgagaaaaataacctgcttttttctaaagacaaggctactgctaataatgaatgagcaggaaaacaaaatcttgctctgcttcagttcctgcaggagaaaaagtaagtggtctgaaactgaagtaatttaatgttcctgctttccagccctttgccagacacccatatcacagtgacccatagtggaccccaaagagagcccacaaggagatgggctcagtcattatggaaggcatcaccatgctaaataatagactggaggagggagggtaaaccaacatcaagaaggccagagggcaaatcttcattgaatggcatttataaaaatcctgtagccaaacaagaccaacgattcaaaaatcttcactggttgaaggattcggattgggaggaaccaactagcagcgatgtgctagtcaagtctgttgcctggattactataggacttttactaagttgtcactatatcatcatcaatattattactagaaatttacatgatacttttcatcagcaagtgttaggtaaaaatttaccagtatttttgtataaacatctcatttagtgcttaaaaaaattataagtgatgtatgaccaccacacaaattttcaatattatataatcttgaatacaaattatacatttttgtaggtatttaaatacaaatgcacacatttcaacttttttctcactaaacaatcaaatgtttttcaaatgttacctgtgtttaaacacctacatgtactttgtcctttttctttgctttttcttttcttttatttattgttttccttttaaatattgccattttgtaaaataatatatgatcaagataggaaatagaaaaacacaaaaaagtagatcaaatgacagagtcctaacacttaaacacattgagtattattaattttgtatatttccttctagtatgtttctgggagtggggagaagttttatgccaggtgtggttaaaaaaaatactgtgtgtaaacagagagagcaagcagcagcccccaagactgaagcttcagtcttttttataaccgaattatttcatttctattcattagatgtgagtcagcaggtaaagcccacatgcaaggggaggtgattacacaagagcctgaacaacaagagataaggatcaatcactaggggccattttaaaggctgcctgaaaatacaatcctgtgttaaacatcttctggcatcaaaaatgctggtattattttcttaagacaaaataccagacatggactacaaggctaaatgatacgatagctttttaacgtaccagatagaaacagtctttgtgtgtcaggatacatcccacttggtaatacggcttattcatttaatagttgctgactcctattcaataaataaattattacagatgttctcatccataatcatattaatatcagtctttaacttttttggctgtagagaggctggctttattataagggtaaatttcttctatttttttttaaaagaagaggcttttatgatatgtggcagtttataaaatatggatttaggtggggagaatttcatgcatcagaaaatttggttgaacgtaaagttcttaagagatgataatgattatgataaaaaattataatcatcagaataatttaattactaccattactgagccactatgaaatatcactttcccactttatggaacagaaaactgaggctaatgtagtgtgatggttttaaggatatgtccatctttaatactcccttcaagagatggaactcatttgttccttggagtatgggtaggcttagtgactcacttctagtgaaaagaatacatatacgtgatgcactgtcgcttctgcgattagtgataaaaagactgtggctcagtgcaatcaaatcagaactcaggattaagaaactcactcaaaaccacgcaactacgtggaaactgaacaacctgttcataaatgactactgggtaactaatgaaattaaggcagaaataaataagttctttgaaaccaatgagaacaaagacacaatgtaccagaatctttgggacacagctaaggaagtgtttagagagaaatttatagtactaaatgcctacaggagaaagcaagaaagacctaaaatcgacaccctcacatcacaattaaaagaactagagaagcaagagcaaacaaattcaaaaggtagcagaaaacaagaaattactaagatcagagcagaactgaaggagataaagacatgaaaaactcatcctcccacccaaaaaaaatcaatgaatccaagagctgtttttttttaaagattaacaaaatagacagaccgctggccagactaataaagaagagagaagaatcaaatagacacaatgaaaaatgataaaagggagatcatcactgatcccacagaaatacaaactaccatcagagaatactacaaacacctctacacagataaactagaaaatctagaagaaatggataaattcctggacacatacaccctcccaagactaaagcaggaagaagtcgaatccctgaatagaccaataacaagctctgaaattgaggcagtaattaatagcctatcaaccaaaaaacatcaaggatcagacggattcacggccatattctaccagaggtacaaagaggagctggtaccattccttctgaaactattgcaaacaatagaaaaagagggactcctccctaactcgttttataaggactgcatcatcctgataccaaaacctggaagagacacaataaaaaaaggaaatttcagaccaatatccatgatgaacatcaatccaaatatcctcaataaaattctggcaaaccaaatccagtagcacatcaaaaagcttttctaccacgatcaagtaggattcaaccctgggatgcaaggctggttcaacatacacaaatcaattaacgtaatccatcacataaacagaaccaatgacaaaaaccacatgattatctcaatagatgcagaaaagacctttgataaaattcaacacctcttcatgctaaaaactctgaataaacttggtagtgatggaacatatcgcaaaataataagagctatttatgacaatcccacagacaatatcacactgaatgggcaaaagctggaagtatttcctttgaaaattggcacaagacaaggatgccctctctcaccactcctattcaacatagtattggaagttccggccagggcaatcaggcaagagaaataaagggtattcaaataggaaaagaggaagtcaaattgtctctgtttgcatatgacatgattgtatatttagaaaaccccattgtctcagccccaaattttcttaagctaataggcaacttcagcaaagtctgaggatacaaaatcagtgtgtaaaaatcataagcattcctatacaccaataacaaacagagagccaaatcatgagtgaactcccattcacaattgctactaagggaataaaatacctaggaatacaacttaaaagggatgtgaaggacctcttcaaggagagttacaaaccactcttcaaggaaataagaggggacacaaacaaatggaaaaacattccatgctcatgaataggaagaatcaatatcgtcaaaatggccatactgccaaaaggaatttacagattcaatgctatccccatcaagctaccactgactttcttcacagaattagaaaaatctactttaaatttcatgtggaacccaggaacagcccatacagccaagacaatcctaagcaaaaagaacaaagctggaggcatcatactacctgaattcaagctatgctacaaggctacagtaacgaaaacagcatggtattagtaccaaaacagatatatagaccgatggaatagaacaaagccctcagaaataacgccacacatcaacagccatctgatctttgacaaacctgacaaaaacaagcaatggggaaaagattccctatttaataaatggtgtttggaaaactggctagccatatgcagaaaactgaagctggactccttccttacactttatgcaaaaactaactcaagatgaattaaagtcttaaatgtaagacctaaaaccataaaaaccttagaagaaaacctaggcaataccattcatgacataggcacgggcaaagacttcctgactaaaacaccaaaagcaatggcaacaaaagccaaaattgacaaatgggatctaatcaaactaaagagctttctgcacagaaaaagaaattatcacaagagtgaacaggcaacctacagaatgggagaaaatttttgcaatctacccatatgacaaagggctaatatccagaatctacaaagaacttaaatttacaggaaaaaaacaaacaaccccatcaaaaagtgggtgaaggatatgaacagacacttctcaaaagaagacatttatgcagcaacaaacatatgaaaaaaagctcatcaccaccagtcattagagaaatgcaaatcaaaaccacagtgaaataccatctaatgccattcagaatggcgatcattaaaaagtcaggaaacaacagatactggagaggatgtggagaaacaggaatgcttttacactgttggtaggagtgtaaattagttcaaccattgtggaagacagtgtggtaattcctcaaggatctagaactagaaataccatttgaccaagcaatcccattactgggtatatagacaaaggattacaaatcattttactataaagacacatgcacacttatgtttactgcagcactgtttacaatagcaaagacttggaaccaatccaaatgcccatcaatgatagactggataaagaaaatgtggcacacatacaccatggaatactatgcagccataaaaaggatgagttcatgtcctctgcaggacatggatgaagctggaaaccatcattctcagcaaactaacacaggaacagaaaactaaacactgcatgttctcactcataagtaggagttgaacaatgagaacacatggacacagggaggggaacatcacacactggggcctgtcaggggctggggggctaggggagggatagcattaggacaaatacctaatgtagatgacaggttgatgggtgcagcaaaccaccatggcatgtgtataactatgtaacaaacgtgcacattctgcacatgtatctcagaacttaaaaaaaaaaaaaagactgtggcttcagtgttgtgttgagtctcctgtcttgtcatgtgtagccctatggagactcatgggaaggaattgaagcctcctgcaaatatgtctgcgtgtgagcttgaaaacatactccaaatacttctgagactgcatccctaaccaacagtttgtaacctcatgggagacccctggccagaacaacccagctaagctgctcctgtatttccaaccctcaaaaactgggagtgataatagatgttgttctaagttgctcaactttaggatcttttgttacaaagtaatacagataactaacatatacagtaatctacccaagatgacattgctagaagtggcagagttcaagccacttccaacatacttgctgttaggaaagaaggagagggcatgaaaggaaccaagaaaaataactcagaatatttccccactgctgttaatgaaaagagaaataaaagggcaaacatactggcttcccatctgctcctcctcccaaatcttacagaaaacactttgccatctttctttcccatcagtatcttgttctgaaatatataaaatacctgtcaagcaaaagcctttttaaaaagggttgatttcatcaatctggctgtctactttctttcttttttttttttttttgagacgaagtctcgctctgtcgcccaggctggagtgcagtggcgggatctcagctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaggctgtctactttcaaatcacaactgaaatccccagaacagtggttctcaaactatggtacctggaacagcggcatcagtattggcctgaagctagtgacaactgcacattttgcgtccccaccccgggctactaaattggaatctctaaaggtggggctgaagaatctgtgttctaaagggctttccaggggattcttatgcacactgctctagatttaagactcctgtgaaaatgacagtggctgtcctagagctttgttcctactgatggctgaaagtgtttttcagatatgaccaaagactttgggtggccttcagcctaatcaaaatatttagagatttaattactaaatgccaacccatacaaatgtaaagatttttcctacagagactttgtggtgaactgaatgcattttttaatcaactgcttggcaagcagtatgagttttcttgtttgtaaacatctatactaatgctaaacatatttattcacaacttgacaagaaatattgccctgtaattaatcatttcccagactgaattcagacaaaataaaaatgcactcctgaaatgtgcatccccttcacaattgtaagagtcacacacataaataatacaatcagctctccctatccatgggttctacatccatggattcaactaatcacggtataaaaatattcagaaacgaaaaaaaggacggttttgcctgtgcttaacatgtacagactttctttggtcatactccataaacaatacagtataacaactacttacatagcaagtacattgtatgaggtattacaagtaatctggagatgacttaaactataaaggaggatgtgtctaggttatatgcatatattgtatcatgttatatcagggacttgagcatgtgctgattttggtatctgcaagggagtctggaaccaattccccaaggatattgaggaactaatgaaattagatctcggaccgccgggaggatggagttcagcgggcagcggagctgtctcagtctttgccgccgcgccggcgagcgcccctcgggaggcagcggctggaggagcggacgggccccgcggggcccgagggcaaggagcagccgcctgccttggcctcccaaagtgccgagattgcagcctctgcccggccgccaccccgtctgggaagtgaggagtgtctgtgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcctggccgcccatcgtctgagatgtggggagcgcctctgccccgccgccccatctgggatgtgaggagcgcctctgcccggccgagaccccgtctgggaggtgaggagcatctctgcccggccgccccgtctgagaagtgaggagaccctctgcctggcaaccactccgtctgagaagtgaggagcccctccgcccggcagctgccccgtctgagaagtgaggagcctctccacccggcagccaccccatctgggaagtgaggagcgtctccgcccggcagccaccccgtccgggagggaggtgggggggggtcagccccccgcccggccagccgccccatccgggagggaggtgggggggtcagccccccgcctggccagccgccccgtccgggagggaggtggaggggtcagccccccgcctggccagccgcgccgtccgggagggaggtgggggggtcagccccccgcctggccagccgtgccgtccgggagggaggtgggggagtcagccccccgcccggccagccgccccgtccgggaggtgaggggcgcctctgcccggccgcccctactgggaagtgaggagcccctcagcccggccagccaccccgtccaggagggagatgggggggtcagccctcccacccggccagccgccccgtctgggagggaggtgggggggttagccccccgcctggccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcaacccccccgcccggccagccgccccgtccgggaggtgaggggcgcctctgcccggccacccctactgggaagtgaggagcccctctgcccggccagccgccctgtccgggagggaggtgggggtgtcagtcccccgcccggccagccgccccgtctgggagggaggtggggggggtcagcccccctgcccggccagccgccccgtctgggaggtgaggggcgcctctgcccagccgcccctactgggaagtgaggagcccctctgcccggccagccgccccgtccgggagggaggtgggggtgtcagtcccccgcccggccagccgccccgtccgggagggaggtggggggggtcagcccccctgcccggccagccgccccgtctgggaggtgaggggcacctctgcccagccgcccctactgggaagtgaggagcccctctgcccggccagccgccccgtctgggagggaggttggggggtcagccccccgcccggccagccgccccgtccgggaggtgaggggcgcctctgcccggccccccctactgggaagtgaggagcccctctgcccggccaccaccccgtctgggaggtgagcccaaccgctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaagaaaatgaaagctgcaatagaaactcataaatgaaaaaattatctcctgaccatttttgagagaatgagagacatattctgctcagtgtaaaagtggttattaaagttattttgaaaaatttcatttaaaaaaaaaaaaaatgtcatagaaggaggaactggttattctcaactgcagcgacaagttctgtgctaatgagtaactttcttcaaaatggggtgatttcttagtatagcagactacacagacataatcagatgtgacctatcccttcagccatagttcatccttgttaagaatatgtttattcaaccttgaggaggttgggatgatgcctaagagaagaaccaacttaggcttctagacggacctatcgggagacctgttccaagtaccaataatgtctcttcttcaaagatgtgggcattggtgacccactattagagattttatacaagttttggggctatcagggaccttagagatcgtctagtctggattcaaacattaatccaggtatcccatcctcaaagattgccagggagctgcataagcttcccaggtgatgtcaatgcgcagctggatttggaagtgaatgcctaagtaaaaaggataatttaggcaatcacttcaaggttcatccttggaaagtggattgtttctactttttggctgttatgaataatgctgctataaacatttgtatataaaaaaaaaaaaaaaaaaaaagaaattagatctctccggtatctaaatatgtacatatgtacatttttttttttttttttttttttttttttttgagatagagtctcgctctgtcactcaggctggaatgcagttgtatgatctccgctaactgcaacctccacctcccgggttcagggattctcctgcctcaccctcccgagtagctgggactacaggcgcctgccaccacgcctggctaatttctttttttttttttagtagagatgggatttcaccatattggccaggctggtcttgaactcctgacgttgtgatgtgcccgcctcggcctcccaaagtgcctggattacaggcgtaagctattgcacccagccatgtgcaggtctttttaggcaaaacaatgccaggcactcaaagaatgttggtcattaaaagggtatttcacttttagaaaaatatataactacacactttattcactataatcactattcactttattttaaattgtgacatattaaaaaaagattatctattaattgcatacttccattaatgtaatccttaataagatgcaaatttttaaataatcctttatgtttgaggaagaaaatggttaaaaatcaaaaaaggttaacattagttttttgaaacaggttaaaatcatcactagtaattagctgatgaaaattcattgttctctggttcactagttttatttaagtgtgttgtcaaaatgcagatgttaacaggaatcacctactgaaaaacatgctaaaattcaaggtcaataaaactgagttaattttaaaaaatcattttacctactaacatctaggatttctacctcatttctcaactgtaataatactagaagtaccataaaatactataattaaatacaaaattgactataaagttgaaccccaacaatgagagggaatgtcttaacaagtcattaccaaaaagtgactgtttaaatatagaaaatatgattttataagtgtaggaatgagtttttttcctaccatcttttcaatattcattgagcagttattacatggcaggcattgggatagatgcaggtagctacaaaaatcagtacaactctgatttgattatgcccacaatctgggggtacagaaatggaaaaatgtgtgtcatggagggcaggagaaatgcagaatacaatacactgaatggatacagaaaacaggaacaagatacttcaggaggaagctttgactcccacaacagaagtattgggtaattaatgaactatattccaaatcaacatatttgccaatggaaaagaaagttcataaaaacttgaaaaaatttgtcccattttatttatttattgagacaattattaatgcatttatttattgagacggagtcttgctctgtagcccaggatggagtgcagtggtgcaatctcagctcactgcaacctctgctcccgggttcaagtgattctcatgtctcagcctcctgagtagctgggattatagacatgtgccaccatggccggctaatttttgtatttttagtagagacagggttttgccatgttggccaggctggtctcaaactcctgacctcaggtgatccgcctgcctaggcctcccaaagtgctgggattacaagcatgacccaccgcacccggctgagaaaatctgtttcaaaaagtagataacaattaaaatattaatatgttgctttagccgttttacttctaacaatttatcagaaatacaaaagttcataaggatatatagatgatattcactggatgaaaaaaatccccaaaaaactatgaataacttaatagccatcaagatgggacttggtaatacattatcattcattttatggaatgcagtcataaaaatgaatgaaatagtttcatttgtattaacataaaaatctaagacctattaggtaaaaatgtaagtcacagaatacatatatgatgggtccatttatttaaagaacaaattaggagacatgtaaacatatcagaaggggaacagagaagagtcacacttaaattctgactctgtagcccaggctggagtgcaatggtgcaatctcagctcactgcaacctctgctcccgggttcaagtgattctcatgcctcagcctcctgagtagctgggattacagacatgtgccaccatacccagctaatttttgtatttttagtagagacagggttttgccatgttggccaggctggtctcaaattcccgacctcaggagtacctgagataccagctactttttgtttcaaaaagtagataacaattaaaatattaatatgttgctttagcagttttacttctaacaatttatcagaaatatgaaagttcataaggacatatagctggtactaggaaacaatacacttttacaatgtttaaactgcatgaaaaaacactatttctgaatcaagtgtaaaaaaggtttttttttcttttcttttagtgggtaaagtctagttattctgactgcttatcattattactgttgattctggtagtgaaaaaaaacttttgaattccattgagatagtaatgaacacagaattgtaacaatagacagatggaagtaatataaaaacactgttgaatttgaatatttcttgcttttttgctttcacagaaacacattattttacatttactttatataagtgaggtattttatggtgttttctaaattctattaagaacattctaaaaagaaaaggtgactgtgacagacagattaaaatccaatccacaggcagtcccctttggcaaaccactctgattaagtggctctattttatttcaagaatatatatctcttgcccctttaggaaatatgtgaatgttttccaaaagcaagtaaagagtgccacatcttaagcactagaaagcctatgagctttatctgggatctttgctttcataggcttgtgaagaaaatctgaacatgcagacaggcagtcactgtcacatattgaagtttaacagtgactagaggaactataaaagcccaaaactctatattcattctgcagtcatacaaagagcagagggtgaataatttaacttccaaaacaattagtccagtcctttacttcaaattcttcaataatcctccttttcctatagcagtcatcagacatgtacataatacctctgccttttttttttttaccacaacagtgcacactatctgtttgctatttgctgaatattttatttttattttattttatttttgagtcatagtctcactctgttgcccaggctggggtgcagtggcgtgacctcgctcactggagcttctacctcccaggttcaagcaatcctcacgctcagccccctgagtagctgggactacaggtgtgtgccaccatgcccagctaatttgtgtatttttagtagagatgtggttttgccatgttggccaggctgatcttgaactcctggcctcaagtgatccacctgcatggcctccaaaagtgatgggattacaggcatgagacactgcactcggccatgctgaatattttaaagcttaaatacattatttgaaaagagaacagtatcactatcaatacgaaaaataacatattaattcctataaattgaagataataaaatacaaaaaaacagtattttttttaaaattaactaattaatttagagacagggtcttgctctgttgcccaggctgaagtgcagtggcataatcatagcttactgcagccttgaactcctgggctcaagcaatcctctcgccttatcttccccagtagctaggacaacagacacgtgccaccacacctggctaacttttaaatatttttttgagatgaggttttgctatgattcccaggctgatctcgaacacctgggctgaagcgatcctgtcacctcagcctcctgagtggctgaaattacaggctcaagctaccaaacctgggaaaatgtacaatagttttattaaattgtaactagatacaggctgccagtggctctgagccaaagcaaagtgtttaagccatattggcaccaagagactttcttgagattttctggaattgaaaaagaactaaagagggaatacactttctcaattttccccaatactgtattgtgaaaattttcaagtatacagagaagttgaaaaaaattgaacagtgaacacctatatgcccatcatctagatactatcatctggcatttgctgtatttcctttttcagacatcatctttctatccattcctctatggagaaatcaaggctatttaatttaatattgttatttaactacctagagggagttctctcaagaatcaccaggtcccaatccacaattttggaaagactattgtaaaagataacaacatcatttcccaggccttggcccatcccagaaggcttgctactgtatctggcccatggctatctttcttccttatctctagtccctaacacataagtgcaaaactaaactaactctgcttgccataaaatgccattcacaacctggccctaattcacttctttggcctcatggtatgtccatcaggtagcgtttattgagcgcttactctgtgctaggccttgtcctaggaatttcacttgcttatctcataaaacccttaaaacagttctatgaggaaggtcttccttcctattattcccaatttataggtgaccaagtgatagcagtgtcttataactgaacaactcaacacactgtccaatttttgcagtggcctccactcagcccatgtacatttcttctaacacctttcacaattctaaatctgtagttttggctgcttgaatacatttcctacacttccttcatccaaactttactcatctgtttagacctaactcaaatgccacctcctccatgagacatgctcaagtattttaagaattaaataaatgaatcgatatttgcaaggtcaaaatgtacatttgataaactaactgaaatattaggtcttcgttttcgtaagtaagtcttaagacaaccaaaatgagactatttctcacgtacagttgtcagaaaagagtgacaaaacaaaaatcaaccagatgttaaataatcctcaagggaggtacaccaccatgtttaggctaggtacaggcaaattcacattttgttgtcctagcagttatctcttttctggtgtcttgagttcttcagctcaatcatcaatggaaggatattctaccacaatgactattttcatagatacaaattttcatcccctttcttatactttttacttctggtgggggtggggcggcaattatagttggagttaattttaaaagatggtaaatatctcagaatgtctgtaatataattacttttgaaataagggatcactgatttatacagccttaaagtttgaatggactttaaagataatataatctatgatgtagtggtacaagggaagaggggggctggggaagaacctgatgtgtagtgtttgccaatttccatagcccaaccccgtcaatgaaagcatgagtattctgaggaccaggataactgaaagagttgttgaaggtaacagaaaaatgtgtgagcatctgcattagaagccaggttaactgactccatgtaatctattcattgtcaactccctagaatcatctaggaattgtggaaagatactttgccaagcctcacaccagagtaataaaaaaataacttctggtgattaactcctctccagaaatacaaatacaaataaaaaacaaaaactctctatgtgcttctaaaatatctaagttccagaactcccataattcttttccccaattttatgttgcctagtaagaaaatctcatccctttatattaacttggggaatgaataaaacatacattaataaaaagcataagttatcataatatttttaaaggttgtaagtttcaagtattttccatgtgtggccatgaattatgcctattgaaatattttctaaaaatttgggcctgcttttacaaagacgagactggtttgtaattagtgcattgattttatgtgaatgagtgcttttgaggtgcttaatgagccagtaatgattaatacttttaacagactaagaatacttttacttctattagtttctttattaaaccctttctaatatgtagaaaacaggtaagtttcagttagtagctcaagttaccacaaattccttgtcaaatttactaaacaatccacatccagtttagctcttcctcccttcccactcttcctcctttccgcccttccctctcaaatatttattgagcatctagcaagtagattactaaatccaacccaagacactcccctgcatcagagataacatctaataaattcctctaattgtcattctgtgactgaaattgtattcaggaccgcatttctaaattatagttcaattagtagctttgtttacaagtcatgaataccattttaattttgcagatcttggtaacacatataagaatcttctagccattgcactgccttttgaaactgcataatctcgcacgttttaaaggagcctctggtattattttcttttcaatgtaatcatagatgaaggtctaaagtagaccttcccattctctttctgaactcctttaagttctttaattataaccctgaaatgcatctcttttgcgtgcccaacatcttcagcatatttctcttctttaccctgcagctgattagcaaggactacaacactgaatatcaaatattatgatttttgagttatatgagcattttccttttcacaggaataatatgaagaaaattacctcagtacattcagacttcttttttttttatgagtattttcttttaattcttattgatagtctaaaacaaaacaccattaactggatagtttataaacaacagaaatttatttctcacagttctggagtctgaaagatcacaatccaggcaccaacagatttgatgtctggtgagggcctgtttcctggattacaggtggtgccaccttcttgctgtgtcctcacatggcagaaggaatgaaggagctcccttgggcctatttcataaggacactaatcacattcatgagagcccaccctcatgagctaatcaactgctaaaggccccacttcctaatatcatcaccttgagggttaggatttcaacttacgaatggtggggagaggggcacaaacattcagaacacaacaaaattatttagcatgaatatatatatgtattgccttactggttaccaggctacaaatcaggaagtaagaaaacaatcttccaatgcagttattttcaagtagtgggaaactcttgatattccttaatagaggggccacatcaagcctttggctcccaagaaggcaatgcctcttgaaaactactgtgttcactggtcacatgtgtatcagttacaaatgtgaccatccagttgaaacataattctagctgtgtatgccagaaatatatctagatataaccagaatgccacgatgtacttgggcaaacccccaaggttgtcgttgtcgtgcattttgtgtgtgtgtatgtgtgtgcaaatggcttaaatattccattactgcctattgttcttacataaaacttttcaagaaaattagaagttaataggctgactgatgacagccttatatcaatataaattgcttaaaatattcttaggcctaagtggatgtaaatttttatgttcattcccaatgttggataagaagttgacagagctgcacaaaaattgcaaaagaaacattctaaatcatgagctctttaagtacagggacgagggacgacatcttacccatttatatatctccaggatttggaacagtagctggtatatagagtaattgttgaataaataatatgaaaaattggtttgagatccaggaacagagtaaaggatagggttgtggtcgcactggtggttacaaggcaatacttttttacctttcaaactaagaaaaacatcaaatatataaaaaaaaaatagaaggtgaaataattatacagcctacccatgtatcctctacctacctttagtagtatttaacgatttgccatatttgctttctccctctcttcctctctatatctatctctatagagatatatgtagctatacatatatagatagatggatagttgttgaagcatttcatactgagtggcctacatcatgacacttcactcccaaatgcatctcctaaaaataggaacattgtcctaatcacactacaacatgtaagaaaatgggccgggcgtggtggctcatgcctgtaatcccaacactttgggaggccaaggcgggtggatcacaaggtcaggagatcgagaccatcctggctaacaaagtgaaaccccatctctactaaaaatacaaaaaattagccgggcatggtagtgggcacctatagtcgcagctacttgagagactgaggcaggagaatggcgtgaacctgggaggtggagcttgtagtgagcagagatggcgccactgcactccagcctgggcgacagagtgagactccgtctcaaaaaaaaaaaaaaaaaaaagaaaatgaacaattcccctattgtcatctaatatgcagcctgcagtgaaatattcccagttatcccaagaatgttttatagacacacatacccaaagcagtatccattcaaagttcacacattgcatgtagttcttagggtctatttcacatattcagtgttttagatttacttatttcaagttttctatttctatatatattttagtccatttgtccctgaattgtagcaagtattttcaaatccataacttgaaactgagctttgtggattaaggcaaaaaggacattgtagatgcctctggcccatcctcctcacactttgagtaagtgagggtcttctggtccatcctcctgcacatcaggcgttatttcactcttgacatacacttgtgatgtggggcataaatcaccataagcatctttcatgtttgcctaaccaactcagtttaaatcccatgactaaaaagggagcctactttccagaatcagactggaggaaaagaggagattttaaatttcttcctgctcctaaaaatggaatgcttgaaagtgatatatactggcaatgtaaaatagttttgatggggagagaatgcagaaattaactttctaacttaaacaatttcaattttgtaattctcaatgttagcacaaacactataatcaaaattcactgtactgtgctctaggtactgggtggaggaaaaaaaaaacactgatgggacaaagatcttcttagggaatatggcagagaaagtgaaaaagcatgaggaataaagattttcaaatatgggtatctgaaagggtaggcctttccattttgttctactacccagtgtttcaatcccggcaagaacaccacaatattccaggtctttacctccatcaccctgccctaaggatatgtggggtaaggggcactgttgtgcccaaggctcttcaaatttaacgtattattaccactgttattatatttaattctaccactggaagtagtaagacctcaatcaggggtgattcactcccatgatattgatcagtataaggcagagactattgggataccaagtgttaattcttctttcattagtggcagtatctcaacagaatgtcaattttataatatttttcagcatccctttcaacctggaatcatgtgattgctgtctgggtagtgaggtgggacttccgggattcagcctggccttcctcctcccttgatacatgaatatcttaaattatactgcataggactctcttcctttattaccaatcaaataaaaaattaattgggtcaaaaatatatggcccattatatgcaagggctataacataggcaggtcttagggaatatcagcaaagcgaaaggaaaaaataggtccctctatggagaaaatcaatgctcctcaaatgtaactgaaaaacatgtttgtctattcaatcccggtataagccctcattggaagatttactggaacacactgaattgaatatagatagtaaaggaagatgtagctgataataggaacagagttgccctgtgatccatggtatgtgagggcatagggaaaaacacattcaactcaaacaagggtatggtaatttcaggcttcattagaaacacagcgaggtgaaatcaattgtaagccagacaggaaagaatcaaaatcagttagaaaagaaattttaatttcaagcttctaaggagaaactataaataatgcaaggtttaaaacatattagcaaaaatacatcacggtatctctctcaagcaaaacagctaaacttgaaactttcttgaggatattcagctctgaatatttaaaagcaaatgcacatatttgccagagagaaaaacatgtttagggggaaaatattaaaatgaagtctgggatgatacacaccaaaatatgaatgtggacataaacaactccaggttattttccttttcttctttatacctttatgtagtttttgaaaattttaaattatgaatgcataatttttgtaattagacagataaagagctttagcaaaaagaaaaacattcaagtcatcatataataacattgtatgaacattagacatggaaggctcatcacaagcaaaccccaaatatcctccataagacaatctaatgacttgctcttaatgaaagaatggtccttcctctctccaatctccatttttgggtgctgctaatggttaagacctgtgcctctgagtttgtagactctagtatggttctccagatcttcagcattaaatgtatccggaaacaggtaagcaatcagttcaaaagaaaagaacagattttcaatttccttctcctaaaaatgtcatgctctaaagtgatacatggaaatgtaaaacaattttggtgggaaacatgtgcagaaattaactttataacttgaataatatcaattttatgattctcaatgttacaattattagaagtacagaatctctgtccctaactcagacctgcttgaattggggaattggggaacttattggggaattactgattaaaggaatttattctaccctcctacttacagaagatgcccgaggaaaactgtggatagtggtgttatttaaactaagagatacagaaataaaattatttcattttttaaaactatataaattgttttccatctatatctacttataacaacaaaagaacaaaagcagcttttttttttttttttttttttttttagctgtttttactcctaaaacagctaccactactattactactatactgcaagagagcaataacatttatgggacctttaccatgcatgagacacagtggtacatgcttgggatagtccattacaatggtgttctataatgaaccttgtcaacgtttataaatgcccttgcatagtcccttccctttggatcctggctgagtctgtgacttgctttagtcctgaaaatgtggcagcagagatgctgaaccagtttcaggccaatgccttgagaaggcttgggagtctctgcctttgccctctcagatgcttaagggccacatagggaggctggttactttgctgaaggggccctttggagatatcacatggagacagaggggccttcaacaactggggatgagggaagaggcccgccttcccagaacctgccagctgaatgcagtcacacgaatgaacactgacaagaacagtggaagaatggcctacctaaccccaggccagattgctaaatcataagaaaatggttctatcaagttttggggtggtttgctatgcagaaataataaccaaaacagtgctttatagacatttgactcattttaatctcacaacaaccctaagaaataggcactaataatatcatccttctacagaagcatttatccaatttgaataacgcctcctataataagtcgagggggtagggctttactgcatgagaacaattctgtatattatcaaacacacagcagttccatttctcatctgagggtggggcatttcctattactgactgtgtctcatcatctctaaagtaaagagagtcaataactcactgaacgtctaagattcttttcagctctgaaattccatgactctaaatgagtagccggtgcttattgtttatacagtggttttcaacacatcacatcacacacactagcaaaggtcggaggggaaaaaagcaccttgagaacatcccatcccaactgcccaggccatctgagtaacaggaaccaccccaccagtcaggaagagacggctgaatgcatattaaaacactccaagtatgctgcccttctggaatatcgttaaacaactcagtctgtcatatggtcctttgagtttttcaattaaaaaagaaatggcaaatgtaaatattaccatctctttttcagtctgctaatttgtgttcaggaaagtcttccaacaagaaaaacacatggttaatcacctttgagacccaatataacaaagtagcctggaaagagaaaaggggcttttttatgatttaaattgttatgtggtcaatcaaatctaatctattctaattcattcacatggaaggtcaattatccaaatgctcttaattcaacctgcctctgatcttggtgaccagtgaaccattcaaagggcagctgttttgtgtgtgtgtgttttaatatgaattcgttatcacagttttacgttttcctcattctcaactatttaagctaacgtggcctgcttgacgaagcacatttaagtagagggaaacacacttagttctctttgtattctgaaataacaacattctctatgacctttctggagtcaatgtacacagaaaacccacaagattcatgctatcaccaactgttggaaggaaaacaccaggcaggcagcaaatctacttcccaggccaattaccccattccctaaaactattccatcttcaaaacaagcctaaaatgcatgtcaagaaaaacatccatgtgtctttctttactctttttatgaaggcttttgcttggtgatttgctcaagggtcaagtttaaatttgggtcagtttgtttatttgtgatataatgaaaaagaaatttaccagggaagaacagaactattggaagtactccatggtaaatgagagaaagtatgccaaagctcttcgcaccaagactaaataaattagttgagaattgtatttggatgctaggaacaaagaaataaatataaggacttaaacatacaaggatttattctcttacataaaggaacactggtggtagataggcctgggatggtaggatgctaccaggagtccatcaggaactcagatgcctttggtttgtctcctctaccatgcaatggtaccgttctaaggttatttctcagtctaagagggctgctggagcccctgccattgtaaagtcattccaagcaacagtgaggagcagggaaaagggctcccttcccagctgcttcagcttcttaaacacagccttgccagaggtcccacattacacttttgtttacatatcactggccagaaagcagtgacgtgattccacccagctgaaagggaggtggaacaatatcatagaattgacattttgttgagattctactattaaggaagaaaaaaaaattgatattggatatctcagtaggccctgccttataccaattaatttcttggtagtaaatcactactgattgaagtcttattatttccagtagtagaagtgtagctaagaataataacagtggtaataacaccttaaatctgaaaaacttctatgtaaaagttacaatctggttcacacaataatcacatgatagtacaataaaagtgacaataataatgatagcagaaattaacagcagtatctgtcatttattaaacaccaaattctgtgctgagtgctataataccttattctcatcaatcttcacatcaactttgtgaggttttcattaactccattttatgaagacatggacttcagagatgggaagtgacttttctaaggtcatacacttcaggagggaaacagaactgcaattccatcaaagccctcttgatcacactggtgttaatcattcccctgatgaggtcattaatatcacattttacagctgaggaaactgaggtccaaattatcggagtgctttaattcactgtaatattgaatcaatggtaggacttttattataaaaatcctaacagggccagaaaaggacttaggaaatctagcttctcatcctcgctctatactttaatactgattttgatctgatagtaaaaacaatacaggcccactgggaaggaaaaattaaaactatacagtaaagaagagagtaaaaaatcattcccaacactaccagttggagaaaatataggcaatgcaaacattctagtgagcattctctggggtttatctgataagatataaagaaggggaggggaagtggagagacagaggttccataatttgtctaacgtctctgcactacagagccagcactcaggttcactgcccaagtgcccagtgtactctctgacccaagacattcatgagtcgtacctttcctgctgaaagacattccaattacatgcaggatttaaaactctatgacaagggactgctctttctttttatgagtttttaagaaaatgccttttaaaatttctcttccaagctctgagataaagaaaactgaaatacgaccattaacaatttacccacagcatgcatgagtttaacgctccaaacgatactcagggttctcaacattaacagtgcattgaagccaactcatttctcattttctgttgccaactccataaatctgcttgaagtcttgaaagtatagattatatatttaagtgattcttgtattctggcaagtaaaaacataaaatgtaattcgaattccatataacggtattggaagaagcacaaagatggcattctgagggggaaggggtttgtgcatttaatattttcggaatcatatattatgtatcaggtactgggaaaacagagatcaatcagaaaaggaggaccttccatctagtactagtactagtactagaattttcatctagtatctaggggtccccaacctggaaactagtgtcattttaggctggaaaatgccttgttatggtgagctgtttgtgtgctgttgaacagcatccctgacctcttcctgccagatgctagtagcatacccactccaaaatgacaataataaatgtctctagacattgccaaatgtcccctgggaggtagcatggcccccagctgagaacagctgatctggtccatcccgccccagttcacagaacctgggaagatttccaaggagaaagggataacaggcaggcaaagtgaggagggagaggaagaacattctgggagaagggtctctggaacagatggtagagatcatgccagcaaggggaggtaaggtcatgcggggccggatgatacaagcttctgaatctctgactcagaaattcagaatttagtttgcaggaaatggggattgtggtattattttacatatatatatgtatgtttttgtccacagttcctagctcataactcccacagctcctgttacagccttttgttataatgttggggcactttaggtctcagaagcaaacctcaaaaaacaatctctctctctctctctctgaaattctcctgccttcctttcacctgctcctttttcttcccacagcaggctttagaaactaaaaatatactctaatctccccccacttttctgattatgggtcattagaccctcatttccgaaggggtcctgtgtcatacctcagaagaaggaatgctgcacagagaggccaagaagcatctgtatagacaggcctttctgggtgttcccactcagtctactagcattagatcataccctttttgtctagtcacatttcaaaatggctgtcaatcatgcccatccaatggactctccataaaaggtccaagaggatggcgttcaggagcttctggacggctgaatgcatggaggtttctgtagggcggcatgcccaggaacgggctagaggctctgagccccttcccataccacaccctattcatttctttatctgtatcttctgtaacatcctttataataaaccagtaagcataagttagtatttacctgagttttgtgtgccaccccagcaaatgaattgaacccaaggaagaggtcatgggaaacccaatttatagccggttggtgagaaacacaggtaaaacaacctggagcttgcaatcagcatcggaagtgaggcgtggttttgtgggactgagccctcaacctgtgggatctgagattatctccaggtggagtgtcagaactgaatttagatagaggatgcccagctagtgtctgctgcagaattgattgcttgcttactggtggggaaaaccccccacacatttgatcacagaagtcttctgtgttgactattgtggtgtgaaaatagagaaaatacagtttgtgttcttccattcagggatcaagtttgtgggcagaaactgcagtaaaatgcacaaaaagcaagtcctatgagttgagtgtgaccgtgtgctgctgccatttgattgctttaattaaagaaaaataggggatgaagtaattacaggccctctctgagactgtcttcttaacaaggtggctgaatgtcattgaaaattttctggattttaaaacagaaatacactgacacagagaaaatattctgcacattgcctgacacacagagtaccctcaccaatgttaattccttattattaccattcttgttgctggctgtcttaaagcagggtggggcactgatggctgatgtcagcatttctcagtatggcccaaggaaccctggtgccttggaagtgttaataatatctgtacatacatacagatgtgcagacacagagaatcattttctttcagaaatttatcttttaaaaaggaaactatgacaaaggatgtagaataacagaaacatttatctttatatattttgttataaatgcttacctaatttatactttcttaataaataaggagaagagtatctaaataaaatgttttcttgaattaatttgtttatggggccatgcttttcctgttctctctcaagagttcctgttggtaccccacttatatttaatttagatactgttagcctggaaaatattgccctaatccagttgactggggttgtatggaaaaggccctggctttggtaaccagagattatgccagggccgggggccgtcttgaaataaagagaaagaaagtgtcatcctgtgaaaaggtcaaggaggaagccatctcaacagctgtttgcaaacctcacttcaaggcaaccaactgacagagggagaaataatctcaaggaggtatgaaaacagcagcagggctagggaaacacatctgtgaatgcccagataattgagcatcattgtttaggagttggagggccatctctttctgtgcatttgaagcaattttctcttgtgacatactatgttttgtgttcccgaacatttaacctctggatttggacagcagagacctggcccaagcccattccttttaggagtcctcaaatggttactgaaagtgacggttttctaattattctgtcaagcatcaatctcagaagttcccagttcctccatgctctgactgacagggcaatcagcactttacttaaagtataagcaccaacctcttctggacagcaagagcacctcacatgcccaaaaacagaaaaattcacagctctaagaaagtaagaagccctcatgggtgtgcaattttacaagcgtgtgtatgcatccttcctgggaatagcgctttttgatctggcatttctttcaaatgggacatccccaattccaaatttcaaccatcatggctatgattttacatactcactgtgctgctgaaaactcaatcaaaatgcacagcaaaaagccagtctcaaagatctccctcaatcaaggcagaccagagtggtcagaaaagaagcagatgtctacactccttcaactccaagtcaaaacttataattccactttcttacatgctactcttctgagagaaaaatgtgggcaaaaggaagcataggaactgtcacaacgagaaaatattcttattaatcacatttaggcaaattccatttatttgtttttctctaaaagtgacctccatatattaacagatgccctactttactttgtcttttagaaatcagttgcttgtaatctctgagacaatatatagaagtagaaatgagattggtggatcagtcttcaactggtttgaaggtgatggtaaaagtctatgaaagctgccagcatggtgctaaaactcaaagagggcatggcatagtgacatgggttatatgatgagtgagagctgccaggacgaatcggaagaggggcttgacaatcgattgcctgaaatacattacagggcaaaagaaagcagggcacctgtggttatgtccctgatataagaagatagccactgtatcttcaagatcccagaggcatggagaaaaagtaggtaattcaaatggaggcaatttggagacacctagactaataccattagtctccaactagtctctgttttctcttccttttccacaatgcgtactcctatctttgtctaagatttcattgttctggtgcttaaagcctttcagaggcttacaattttatccagaatgaattcaaacttcctgatttggcctgcaagtcctttcagagctgggcccagcttcactctcagcgcctcctcagtccttctcgctcactctgctctgaaacactcagagctctctcctgcctttgcttttccgctgctcttttcactttgccccaaatcaacaaggttcactcatttacatcattcgggtctccactcaaatgtcacctcctcagagaatccctctctggccaccccatctacagcaattgctgtctcactgctaaggtcctgagaatgcacctcacactctgaactgcaggcagcatgactggctgcactgggggcaaggctatgcttcccctgggctgctcccagccgagtaggggcatccaatcttccttccctctctccttcactcagagtcagacctgcatcatagtctgatggccaggccagcctctcctggctgctttctcattttctttcaaagggatttctgctgataaaatccttgcacatttaatcttgtcttgatggcatctgggaccctagcatatttattatcatcctgttttactatcttcttagtaccacagaaaattatctagtgtggcacccagcaatcagcattttccatgcccttcaggcagttctgggacatgctcaagtttgagaaacaatgacctattattatatggttaattatagtcagagcaagaatcaggacccagctgtaagaattcccattcatttctcaccaagcagtactcttttaatgacacacacagcccttacgttgtatctgcttaaataccctgctttaaaaaattggccaggcatggtggctcactcctgtaatctcagcactttgggaggctgaggcaggtggatcacctgaggtcaggagttcgagaccagcctggccaacatggtgaaactccgtctctatcgaaaatacaaaagttagccaggcatggtggcatatgcctgtaatccctgctactcaggaggctgaggcaagataattgcttgaacctgggaggtagaggttgcagtgagctgagatagtgccattgcactccagcctaggtgagagtgagactttgtctcaaaaaaaagaatttatgctggtcatatttttacatccatttaaaaagatggatttaataaaatgggcattaacatactaggtaaactgaaggaatttgtagaacactggtttgatcaaggctgactgcctccatctatctaactggctttgtagctttttaggcagtaaaaataaacttagtgtatcccctgtcttgtgagggaagcttaatctgatgttgtgctattactaacatggaaaagcagtcatgctatcaagatggcatccggcaagatgagatgacactgaagtttgtcgctatcgatttttatatggcaaaacctgggtcttgttctcccttttctccctttcgatcaagtactctcatctccaggaggaaatgctactgttttggtagacagtggctgcccagccacagtgcaagcaagtgtgataacgacaaaatggattgattactatcaggaaacgtatggacagtaaggtatgaaatattaccagctgaacaaccaagatacaaagatataacatgctttactgcttacaaagggaggcagccattaggaagtttgctttctcacataaatccttgactatctttccctggaggggaaaagtatattacatctagtccaatagaacatttagatacaagtcaggattctgacaagtaggaatatttaatttgttttgaattaagaattgagaatcggaacttccactatgatatgaatacagaaaccaagaccttccttactaattaatgacctctggcctataaagtcttcaggagaatttctaaatgttctctacaactttgtgttttctcttacctcttgagattgataatataaacacacctagatacacaataactatcctccgaaatcttttactatactagctacaatctctcatacatcaaaacagcagctctagtatatttttctcacctgaaatattgaggaataggaagttattcagtttctcacaattttcttaagctcaaagggtttggtcaaagcacacgtcatacctgcttaatctctagagagaacaactttgacaggtgaagcgagaaaaaagctgctccactgccttcacgtggaaaaaagatgaaatgtaaaggcctgcaatgacagacttttcaaatagggttttagtaaaagaatgatgtctttggaaacttaaactgcaattttaccttgaacaagtataggataggatatcctttaaagagattatttgaaaactataaaatatttattcattcaacaaatatctaataaatgactaccagatcagtataacaccataaccaagagttaatggaaatgaataataattaaatatgtaatatggtaggagacgtatatgttttatcctgtcatttaatactcatagcaaccctgctgagttgtttctattaatatacccatttcacaggcaggaaaaaaaaaatgagacttagaggagttaactcacttgggaaagtcacagatgtaagaggaaacagagcgggaattccaatcaaggcttactcatgtttttaactacatggtctaacaccaaactaagcaccctgaataatataatgcatgctgtcgagaaatgctattgtgaaaatgaataggagagaaaagagccataatacagatgcccaaatgagtgctacaagaggggcaaaagtgtgaaataaaagcaggccgggtggtgtcaaattctgtatgatgtgtgggttgaggaggtagagcagggagtctggcctctgaggaggcaaaaaaatcgaactcactcaaacttgttttctgagcgaatcttcaatttgtctaagacttttccctggagttaggaatttgccaaaaaattatcagcacctattaggtgccaatatagtatagacatggaccctgtcttcatgaagggcacagtctagcagaaaaagtagggcagctttcaaagatggtcctgtaatattttctgcttcacactcttctgcagtgcaactttgccattctcacattaagagatggggtctgtttctctaatccatccagctccttgaacctgggcaggacctgtaactgctctaacagaagatggcagaaatggcacactgtcagtcctggcctggaagtttccatttcctgcctcttgggagccattcactatatatgatcactctgagaccaccatgctatgaaaaggccaaactacacagagagatcagatggaatgtgaagagaaagaaaaagagatgggccaaggagcaatgagatgccaggcatatgaggaagccatcttgtgtgtccagcccaattgagtcatcacacggctcgggctccatccaccaatgactgcagctgcatagcagactccaagcaggggccactcagattagtcatgtgaacccactgaagcatgagaggtagtgataaactgctgtttttaagccactaagcttcggggtggtttattaaggaagcaatggataacggaaacagagctgaatacaaaattacctgtatgactacataatcaaacaagaaagagtataatttgagaaatcctaacgaggaacatgcccctgccttcaatcaggtgtaaggagtgcgtacaaggctctctgcataattacattcagctaagacctgaagagtaagctgaagaaagaaaaacatgagaagggaaagtctggagcagaaagaacagctcagtcgaagtcttgaagatggagatgccctcatacattctaggaagggagaaaagattagtaaccaaattaaagcagatgtataaaatgggcatgaggtaggctggcgagttgggcatgggctagctcatacagagttataagctgtggtaagcattttgagctgtatcccaaaagcagcgggagctaaacaaagggatggaagaaagatttgtggccactgtgactgtcatgagagattcaggagaaatcagtggggaacctaactggacataagttcttaaagatcaaggagaggataccctgaagggaaactcaacctttaccctaggcctcacatgactaggaagttcttagctatactttattttaaaataattttttttggctgggtgcggtggctcacgcctgtaattatagcactttgggaggctgaggcaggtggatcacgaggtcaggagttcgagaccagcctggccaacatggtgaaaccccgtctctactaaaaaatacaaaaattagctgggtgtggtggcatgtgcctgtagtcccaggtactcgggaggctgaggtgggaaaatcacttgaacccaggaggcggaggttgcagtgagacgagactgtaccactgcactccagcctgggtgacagaatgagactccgtctcaaactaataataataattttttaaaaaagattatggcccgggcacggtggctcacgcctataatcccagcactttgggaggctgaggcagccctatcacctgaggtcaggagttcgagaccagcctgaccaacatggtgaaaccccatctctactaaagatacataattagctgggtgtggtggtgcatgcctgtaatcccagctactcaggaggctgaggcaggggaatcacttgaacccaggaggtggaggttgcaaagtgccaagatcacgccattgcactccagcatgggcaacaagagtgaaactccatatcaaaaaaaaaaaaaaaaaaatgttgtccaaggaattaactttctcaattcaaactttacatctcatacaatgagtttaattgtatggtctatacataaatctgatctaattcagggaatagaatgtaactaactttaataaactaaaaaaaatgtaaaaaagaatgacacagttcaaatgagaaacttaaatcaacttttcacatttcatgtggtattctcaggcccaagttagccaaaaatgtgcacataatgagcttcttatacttcagcctctgctttattcctctgcttatttctctcgtatacttcagactgctgagtctgtaactgcattttcttatttacatgcttttctctacaatgatgcaatggtttgaatgtctcctcccaaactcatgtttaaatttaattgccattgtaacagtgttaagaggcagaacctttaaaaagtgattaggtcatgagggcatagccatcctcaaatggatgaatgtctttattgcaaaagttggttagctggagtgggctcctgataaaaagataagttcagcccccattttctctctgtctcatacactctcttgccttttcactttctgccatgggataatgtaacaagtaggccctaaccagatggttgagcaggtgctagcatcatgctcctggacctcccagcctctagaactgtaagccacataagtctcttttctttataaactacacagtctgtgctattttgttatagccgcagaaaatgagttaagataaatgcctcagagttctcagttgccaccacttagatagaaagatacccactgccatcctttctatccttgccctacaaaccaaacaggtgaaatgggggagctgctgctttttaagcacagctgttacagacctgaaataccccgttcttctgttatgcctgttaactgggagggtgatgggttacgcaaaaagggacactagagcaagaacccacaggagcactgcaaagagaaaaacttggagaagatagaaaatattgctaacactgttgggatcagagtggtgttcatttcaattttgtttccttttgtgtatcctctagataagaaagagttattggagaaatgattatttaaatcacattactggtgaattgagatggtattcaaatggcatttggccagagaaccctgggaagtctgaaggcttcagccgtgattatgaggctgccacacaagggtgatgagggaaataaatgtacaagcaaagtgaggctaggcaatatgacctctattatcagctgaggtgagagcatccaaatctttgtaagacagaataactgggttgagggcttctttacccagttaagttaatgacattaggacatcacacttgccttttcaacttccatgacccaactgcagcccctctaaattcaagctccttaacttaccactctattgaaaccagaaaacttcattcttctacagttacagggaaagtagccagagagaaagacagagaactctccagaaacggctaaaactggtctggtctaggctgacctagccttctctgggggagaatacaaaaaggtgtgggagagaaatgatgatgatgaagaagaagaaggcggcaaattaatttggccagttttaggggagaaccttggtctgtgttacccctcagccaggtcctgagggtagcagagaacggacaacatggctgggctctggatctcttaaccaaacccagcagctccactcaccaaggccaactaaatatgctttcatggagcaaaccacatccataactctcctcatccttgtagtagtttcgtgagaggtgagaaaacaagtagacacaaagaactgtttcctccagaggccacaatgtgattaaagaaaacatattagatatatgcatacaccttcctatgtttagagtccttaatgaccttgttttaagacaattattttcataaaattactaaaaataatttgatgttacattataaatggataaaatcactgaaaaaaaaatcaaatctagtttcatcttgatttcctactttgtccatccatgaagacatataaaatgagtccaataggaacaagcaaacaacttctttcttggactctaatttgaggcattgttaacacagtgatgttcatttattctatacatggaaaaggtgatgtctaaaaaattcacatgtccatattttactactgacttgtacattaaaaaatatttttttaaaaaacaagaccatgtttcctttcatgctggatgtgaatgaagtctgtagcaaccacaaagtgtcatgtgttagatctagattaggaatctggtaatcatagacatattacatgatatactggattttactctataatttttacattttatcacaatggctgttttctgggttatcttataatgaaatattcttgatgaaaataatttatttttacccaactgtcactattacacttagatttatttactttaattatatgcagaccctctgaagccatctgttaatgtctaaatatctattatacttgttaataggtttttatttaatatttgggatcatttagcaaaatgcattgttcagcagatgacagaagccaatcaatcttaattaactaaatggtcaccagaggactattttagggaaggatagcaaaaaataaaattcttccaacttgtaggtgtagggttaaaaaaacaaacattcaatgtagtcccatgtctccaaggcgggctggagtggggataatgatatacttcaaattccatttataaatgtatactactaaacgtatctaagatgatggtgacagcaaaaagacaggaaggcagctaagtatcttaaacatggggaaatgactaaaagtataagggtgtaatcatataatggaaaataaaatggccactaaaaatcttgtttcagaaaaatatttaatgatgtcataaaatgacttcagtatgttattaagtggaaaaaacagtatgatctagactttaatttttaaaaatatgcatttatacagaaatgaaaagaaaatactggaagtagataagtcaaattttaatagttgttatttctgagctaaggaattatggatgactttatttttatttattttttttgagacagggtcttactccagttgcccaggctggagtacactggtgtgatctcagcccactacagccttgacctcccggactaaggtgtttctcccacctagcttgatgactttatttgtgtacttttctgtattccaaatcctttgtaatgactattgtaaaggattacattatggagctcaattatttaggaaataaatccctcagacacttaattctgaaatttgtgattttttttttaaaagcaccagtgatgaagaatagaaattaacttagaattccaaaaagaatgagtattaaaaggtgtgttttagagactgttaaaaataaaaatcccttctgtaccaacctcccaggcaatcattaagagtcttttgactacacgatacaacacacattaagagtggatattgcacacttcattttagagggagttttatttgaattttgacccaacttcattttaaaatgatattttgtttggaaaagacttaaggctgttttctacagataacttccgagtagcagtaccaccagtctttaacttcccaaaacttgccaagtgcagcgataaaggtataaactgtgtttaattaaaaccacttgctttaagtaaatggagtaagagtttatcattcacatcacctcccaacttctcttatcatgccagctcagctcttctctgaaggaggctactgctgttatccttagtgatggaaaacgggtacaaggtcaacatcatcttcttgtggtcactgagtttaaagaatacactaacaggtcaggcatggtggctcacgactgtaatcccagcactttgggaggccaaggcaggatgatcacgaggtcaggagatcaagaccatccttgctaacacggtgaaacccgtctttactaaaaatacaaaaacaaaattatccgggcatggtggcaggcgcctgtagtcccagatactcaggaggctgaggcaggagaatggcgtgaacctgggaggtggagcttgcagtgagccgagattgcgccactgcactccagactgggtgacagagggagactccatctcaaaaaaaaaagaaagaaagaaagaaaaagaatacactaacagactaacattttctagagcttaatttctatatattgaagagatgaatattactgtgataaaatgccgcaaaataatgcccccaaatgaagcttatttgctactttttcgccggtctcattctatagatttctgtggctataccaagtagctgacagagatgagacaagacgtgatttgattggtgactataaatgacttggccccctttcagaagaatatgccaagtcttcctatatttgctcaaatttaacttgcattatgatattgctttctttcacatttagaagggctcatgtaattctaaaatactgttacatataaagttttaaaatagttttttaagaagcttcactttaaatttaaacacacactttactggctgaatgcaaccttcctttaatttatctttactgaattttgtcctggttatttgcagttttaaaaaatgcccatacacatgtccagggcattcacaattcttacaagtcttttaaactccagagatttctcttagggaagccctattcccagctttccacaggcgtatgggttgtgccttcatctctttctagctctggagatagtggtccctacaacaccaacataagtaggctctactttcccaaccctcagaattgctcactcatgatgccaacaaggtgtgagtgtccagctccaacccttatttcctttcctggtctaaaaaaaaaaaaagagaggaaaaatcatgcttcccagaaatgaataaaaatgcaagcattgtagtcttaatgtcatatcttttgtattagtgtcacataagtgaatggcataagtgatcaacaaaatattaccctacatacaactcagagttcccaaatcatgagttggcaactcctgacactgtaggagaatgtagttaagtcaactgcctattagcaaaacagaaagaatgaaaacgatattaaaccctacctaactgaaacaagacattaagggctcaccaaagaaaatgtttttcatttgtaagaaaactgagtgatttctcttcattgcaaaaatggcaaggaaactttgagtttctactccacctaagaaaagctgtgctggttggaagttctgattaaaggcgaatctgtcacaattctgagagcacatccccaaagaggcaggcactcaaggggacagcctctaagggacatgcagaaattaaacatttccaaagagatcctgtaacttgccagcccaatgaaatgtcctattataagttttcaatcaaaagacatgtcttgtggtccaaacctttaaatcaaatgatttgctgagcatgaagcattcaggtgctatcacccactatgacataccgactttacataggcattttcttttatgtgttcacctcgcttccgctgccccataattgattttccttcccctccttttttttttttgagagcgagatggagttttgctacactgcccaggcttgtctcaaactcctggtctcaaatgatcctcccacctcggcctcccaaagtgctgggattacagtcatcagccaccatgcccaacaaaaatgtttcccttttgcaagtgtgtacagttataaacctgaaatactgcctggaaggataacatcattgaagtatgatatagaaaggccaatttaaaaccacagaatttgagtattccttccctttccttctccctctctctctctctctctctctctcacaagctaattttgcctatcaatttaataaaatttcaatgggattcaatttatgtgtaactaatttataaacacaatgttaacctttaatgttttatatgttgattctgagaaaccaagagtcaggtgcacattcatgttatacagctgtccctaatccccaagccatggaccagtactggtccatggcctgttaggaactgggccgcacagcaggaggtgagcagtgggcaagcaaacgaagcttcatctgtatgtacagctgctccccatggctcgcattaccacctgaattctgcctcctgtccgatcagtggcgggattagattcccatgagcatgatccctattgtgaactgtgcatgtgagggatcaaggttgtgcgctccttatgagaatctaatgcctgatgatctgtcattctctcccatcactaccagatgggacgatctagtaggaaaacaagctcaaagtgcccactgattctacattatggtgagctgtataattatttcattacatattacaattaataataacagaaacaaagtgcacaataaatgtaatgcacttgaatcatccccaaatcaccacctcttcccccgcaaccctgcacccttggaccctcactcagtagaaaaactgtcttccatgaaaccagtccctggtaccaaaatggttgggaactaataatgtaagataagaactggatttgtctcataatattctcctaacaatgtagctaccaggctaggcaattcattaattccaaaaacttcaggtggcatgagttaataattccagagactgcagcagtggaagataacaggaaaaaatggaaactggtggatattttaaatcaatggcgtctacatgattccatacttagcaaaaccagggatagctgattccaactctgattctggtcttgtggagacgccatgaaaattttcttgtgataaccttgaggaggtctctggagccagaataaccgttatctattaccccctgaacaactgtcatgattcttgaatctacaaatatatgtaaattctgcttgtatctatctgtacctgcctcccatatgctcagggttatcaccctctgtatcactccttctcaaagtggccgcactgtggcatcacctgaacagcttcaaaagtcccgatgcctcactacctcccccatcccaagaagttgatttaattgctctggagtaaggtctgggtatgtggagtgctgaaaactcccctcagatgcttctaatgtgtacaagctccaccatttggctgacttttttttcccctaaaggcaaactctagatcttagtcatctcctgattctcagtgtcctcttcacagtacttctcacaatcagtctgtaattagaaaactggtgagaggctgggtgtggttgctcatgcctgtaatcccagcactttgggaggccgaggcaggcagataactggaggtcaggagttcaaggccagggtggccaacatggcaaaaccccgtctctattaaaaatacaaaaattagctggccatggtggcaggtgcctgtaatcccagctacttgggaggctgaggcaggagaatcacttgaacccgagaggcagaggttgcagtgatctgagatcaagccactgcactccagcctgggtgacagagcaagactctgtctcaaaaaagaaagaaaactagtggaggttttactaagtctgtctgacccacgacactgtatgctccatacaattaggaattatctctcttttgttcaccacatccccattcctcaaagagcagcagaaatatggtacagaatgaatacttattttgtggaataaaagaaattaactgatctacagtgaaaaaataaaaataaaaataacagcagctagcacttacacagacactgtttgccagaaactgttttaacagctttacaaatattaacacatctattaatcacaacaaacctacgataggtactattatcatgtctactttatagatgaagaaactaaggcacacatagattaagttgcccaaggccaagcagttagtggcagagccaccaggattcaaacttaggcaacctggctctagaatcccttctcttatcagctagctcaacaatgcctggccggtgggagaggccacttaaccgccccttccatataaatgaccacaatacccatagccctgaagacggccaccacggccacaattttatggaatgacaacaaagtaccagacactgctgagcacttcacgtgttatttcctctaataatggattaactgcatcgtacagaccaaacaagcgaggtgaagagattctgatcaacttgcccaaggtcaaaaagccagaaactggctgagaaggaactgaacagacctctgtctgtcattgaagtgcaagctctcaatcaacatatataatgaccctttcggttggataattgaatattaaacaaacaaatgaaaaatcctaaaaatggaaaactaatatgcatgacaagaatacccttcaacaattccttgatccctggttgttttcactgttctctccgtactttcattaacatgttatgtagtatcatacgtcaaagttgcatcacatacacatttaatttatgtaaatccaactattcaggcacagagacagaacaagtaagtgagtgggaaagaaccaaaattaacgaataaaatctagtgggaggttgcaactgctattccattcaaagtacacgagttcctgagacagaaggaagagaatgagctctacataccctcatcgggtcagcgtctcaccatactactgggactcttgtgcttaaaggcactaaaatgtatgggtcacttaaagaattttcaaagttaatgatgatagtaaatatgttgtgccttaagaactgtctttagaccttcaccctcatatagggtgtaacaccactgtgcagtggctacacagagctagagatgcccaggatctacaaatgggaattaaaagtagctcaagtcatgtcttctctggcccactctctaagacagacatgaacatccaataacatgatataacctcagaggtggaagaaacagcaatgaagtctcatcttgatagtgaacgtatgaaataaaagaaaagcattcaaatctcaattcccaaatggtagttgacataaagactatttatccaatatctagaaaaagtcacatgctgattctctgaccacagagtaatctgtaaaaggagcttgtacaaagagccatcaaagtaaaaaaaaaaaacaacaaaagaaaacattaaattctatttttaaaaaaagcagtggttttttcattcctcatacataccgaggaaaaactcagcaaagaccttatgtcacatatcattatgaatcaattttcttgaccaaacatcaaagttgattcaacatctccatcttgaaacactctattatcacgatgtttgtcaaatactgaaagatctgaccactgtccttttccccagacagcacaaggaacacagataacaaatgaaggttgtactctgtagcaagaatagacaggagactgaatcacagcaaaacacttataaatcaagaggcggaaagaaagcgctaagagtgattaaatgcacgaagagcagtaataggaaagaaatctcttgtgaaaagaagcagttgatggtaacttaacggggacaaaaatgaattagatctacctcgatgactgagctcaagatgaggtaatttcataaagtttatagaaagtcacttaaaaattacacaacttgatgtagtctacttttggagagaaggaaaataaaagtcctccatgagggagttgatctttagaaaaatgcatttacaaaccacattgatgaactctacctattatctggaagattatccttaattctcatctgggtaacaaagtcactttagaatggatacagtcctctgcatttcagggacagattttgaaacagaaatagaagagaataaaaatcttcaaatataaggggttataaagcgtatggggaaggaaataaaaataagtgttaacagaggtgagctctgggccaccataggacgcaagagtgtgctgaggcatattctcggtttggttaagaatagtactcatggtatgtgaaacaggactttctgtgttgtcagtgaccgaaaatcaactctaatttaaggggttaaagggaaccagttggcttacacctgggaaggatgctaaagtaactcacagaaataaggaggagctatagagctgtagtagacattctcaaatgcaagcaaacacgagaatcatctagaaggcttgttaaaactcagattccggggcctcatcccagagtttctgactctgaaggtctggggtggagcccaagaatctgcatttctcacagattaccagatgatgctgatgctgctagtccaaccacacttttgaaaaccatggagtcatggaaacctaggctagaggaactaagccctatgatggcaggagcctccatcatagcatggcaggagctttgctcctggagcttacacaggctttcaccagctactagggaatgtagcctcctgggccacattattttctttcatgatcccagaggtaggtggcctctttcatgagcttccacagaaaacccctggggaaggttctaactagcttgagggacttgtggccagagaccatccctgaaagtaacctacaatggcagggatgcagtaaagcaattggcctggcctgggcgaaagcttactctgtgagcagtagctagggaagacaggatccaagtgaagacatacagagagaaagaaggcatcacattttacagcatcaccaaggtcaaggaagtatccccaaagagacaagaggaagattcatggaaaagcagggtgagcaaagaataggacaatgtgattaccgcagcccataaggaagttcactttggcatcaagatgtacaatcacattcacttatgacactgttttttttacaaacatatcatctacactcatagagtgctgcttcttacataatctgtgatgatgaatgaatttttaaaaataattccctaactcattgacttgtattattataaaatgtaataatgcaaattactaaaaaattgatattcctcttgcatgtcatggcaagggtaattagcaatacaagtttctaaatgcttattctcagtatctgtacttatcacaaacctaaaacagctcacaaacaggcactggtacataaactggcatgggtccaaccacacactttcgagcattactgctctagaccacgtggaccaggacttcttggtcacaacttcttaactccttaagaaagtgaatgagcacagctgtattccggtacaactttatttacaaaaacaggcattggccaggacttggccatggactgtagtttgtctgtccctactttagaccagggcttttcaaactctaacgtgcacagcaatcacctggagatcccatgaaaacacagactgtgcatttctaacagcttaaaaattgttgtcaacactgacagtccatggctgacattctgattagtaagccttcacagacaaatctcagtaaacctagagactggtatgtgaccttaagtataatattgctctatactgggtttttattgagccttaaaaagactgcagaaaagactacatctgtcattcaggtacctacctttctctgctttaaagagattattacaatcagaaaaaaattgataaggaaagccccattggaaccaatagcatcaaatatcggatggtttcctactttctcgattagctcctaacttgacacatagtaggtgctcaagaaataattgttggcagggcgtggtggctcacgcctgtaatcccagcactttgtgaggccgaggcgggcggaccacctgaggtcaggagtttgagaccagcctggccaacaaggcgaagccctgtgtctactaaaaaatacaaaaattagctgggcatggtggcactctcctgtagtcccagctactcagaaggctgaggcaggagaatccctcgaacctgggaggtggaggttgcagtgagccaagatcatgccactgcactccagcctgagtgacagagtgagactatctcaataagaaggaaggaaggaaggaaggaaggaagagagggagggagggaaggaagaaagaattgttgattgcaggctggatgcagaaataccaagctgtaaccactagaagagaaatatagtatgctgatggggcttcactttccgtcctataccttatttaaggtatttcacactgtaggataaattggtgcaactttcaattggcagtgcctttaaggaagtacctgtatagaaaaactgaatcaaagaatttgttctttcagtataagttctcttcatgtttctatacttttgtatttttttactttagcttcattcacccttcttatttgaataccaaatatctattctttggaatttggtcagcactgtcagcatttggattaactatttggtcgttcagcttaatggagaagaaggctccactcatgaaatgcaactactgatcacaggttataaaacacagaaaatatcagaaatcatctaaatatgaggtgattttggtgttttctctcacacctgctacccaaatgccaagactcttggatcataatgacacacggaagattctaagtcacttttgtctccctctcagagaaatgtgctacttgggattaacgagcaagtgaaacctagaaggtcaagggttaaagctccaaatggattttctgcttgctgtttacgatcttcaggcctttcagtattagagcagacacctaaacgtttgctcaaaaactttctattgagttctaattgagaaaaaaggatgtgtccagaatacttagagataacaattaatgaaaaaacccacagataagctggaagaaaaataattaactcggatttgtaccagatggcccttgggaatgctaatatgtgtgtttgcagtgctccatttcagaagacctcaaaggtggaaatgaagcattctcaggagaggttcctgggtatgcagatgaaatatccattgatattcagaaaggacctctaattgcgagagagttgccacccaaattagggtaaagttgctgcgtaaactatttaagtggacaaaacttaaaaaaaaaaaatctgtaataaagcaagcaacattgctcagaacactttggtaggtcaagacaagagaaaggaggacaactccgaggggcagattctttcattgatagcattcatgtcattacccacaaactccaactccaaatcatggaacggcgatgacatttctttctctaaggtcaactatcagagaggtctgcttggacaaatctatcagaaataacaaacacctggcattttcaagccccctttcatttttatatttcaaactagcagacagcaccagcagatatattgcataattttcttttactagttactcaccagtgtaaacgattttctatcctctttaaaatggcacctccagtgaacaagacgagatgtatttcactcactgctttatcctcagtgcctataagaatgcctggcagggatgacacttaatatattcttgtttggctgatgtttctaaatggcttttaatccagtttagtcattctgtggtctgaggaactagtaactgatttcacaaaggggtctttgcagagctgccccctgacatgctggagaacacccccctacctactcaagtcattcttgctgtggaatgaatcttgagctcatggttgacaccctgacttgtacctatggctgagttcctggcttagttatctgcctggtacttgagtctccctagaaccaagctttggcttacaggaggcttgccatgaatggagtttggcccttgcactagtgtgggattggtggtactggctatttgttaaaagaattacctatatgttgtttgggaattgcctccctctgtgtgtgctctggctatcttctaacatgctgctttcaggtaaggcccctccctactgccacaatccttcctgtacaaccaaccatttcctgtacgcattgcctctggctgctggatggaacctcatcccactctctgcaaagagtccttccttccaatgcttgcctgactctggtgaacaagtctagtcctagagtatggcccccaccagactgccccattgtattacagtcttgccagacacatggcattggcatctagcctggaaactgaatcgtttcagaagggcaactcattgacttattacgcttttcttcctggctgagaatattcagctagatgacttatatggaaataaaaaaataggctgacaatatgagtttgttctaaaaagatatttttggggcatctaccatgttctatgtaccattacaggggctacagataatgaagtatacaatagttgcataaaacaaaaaccttgaatggggagaaaattcaggaaagctctataccttgggtatttttaaagaatatggagcaaaaagcaacaagaaatgtggggatggggaagggggcaaacaaactataatatttctgagcaattttacagaatttttaaaaagaagtgaataaataaagagattattcagcggtgaggactgtaaattgtaaatatcacatgaaaaagaaaaaggagataggcacaaattatccccaaggatacatctgatgatggttataaagattaaaaagacgcttaatttagaagttcacctggagtatgttgctcctttacaaagacagaaagtttggtgggaatgcacagagaaatcagtggaatcttaagaggtttttggtaaaataaatcatttgaggattctagcaagaaagagaatggaaaaataaaggtgagttcattttctgaccagtaccaagtctcattcttgacgcctcctaacctcactgacctgaatataccaggaagacattgaacaggaagatattaaactgaaaaactcggaaggtgcattcagccacctctggaattcttaggtagtttagcatcccagcaacttagagggactgtgtcaaatattaataaatgacttgccgttaattctgagataattaaaactaactcaaattagaagtccacagaggtagtaattgtataaaatacataaaaaatatgtagcttggtcctgaattatgttaattttccttttttattgttataaaactgttatgtacccccaaagcttttctttttctttcctaagtcttatggcttactgtgaaacaaagctcttcatacttgttactattatatttgatttctgactgtataattccctgctttaagcaaatctggtttacaaagttccacatgctttttgaaagatattttatatgttaggcttctttaaataaatatctaaaattaaaaggtccattatactgctaggaaaatgatgatcaagaagactaacaacatgagaagatgttcatcaggcaatgacacataatgctggaagaaaattttttaaaatgataatagtggttgtattacaggaatacaattaggaaattttttaaaatatcacacttttagtaggaaatgtaaattcgtaaaggtgaaacagcgatcattatttaatatttaaaaacttccaaaaacataaagtgaaaataacctaaatttgtaaggaaagcattcttaactgaaacgttgaaaaactaaaatttcctcaaactttaatcattccatagctataaaggcagtatgtctaaaaagccattactggcatattctaaaggttctcataatcaaatccttcctttaggggaacaagtaaactatgataagaaaagttttttactttacatttagactgggggtttctgattgtcctttctttaaaagtgtctcagcttggcgttgtggctcatgtctgtaatcccagcactttgggaggctaagaggcagatcgcttgagcccaggagtttgagaccaggcagggcaacaaaccctgtctctacaaaacaaaattcaattagccaggtgcagtgtcatgcacctgtagtcctagcaactcaggaggctgaggtgggaggatctcttgagcccaggaggccgaggctgcagtgagctgtgatcacaccactacactccagcctgggtgacagaatgagaccctgtgagaaaagacagtcaagaaagaagaaagaaaaagaaagaagaaggaaagaaagagaaagaaaaggtgtctctatcatataatctatgaaaagctgctcataattatccaaaacactacccaggcaattctcattatccacagtagttatggtctatacagtcactaaaaccactgaattagcaaatactcaaccattgttcttagcggaaaaacacagttacatttttatgagcctctagtcacaatattttcatcagcagatcaattcctaactttgttttaagtatgcttctgtttaaagacaccttatttaatatatattgttgcttctcatggccaacagcattattaactcatgccgaatgaagcttatctagcacctgtatgctctctgtagggtacatcccaggcttctgacacttaggaatgctagaaagcattcaatactatgcttgggggccaacagtgaaatcatacacacaaaaaaggacaaaaatgcaaaaaacatggccataaatagactgcaaaaggacacgttttacagtatgaaagctgaaacaagaaggcagaggattgcctttttgatctcatttgggaacatgtgcattgggtgactaaaatttttcaccactctgcacattgccttgaatgaccttgaaagtgctgtggaattacaaatgacttttggagtacaaattaattttagcacacaggcgaatttccaaatacagaacaagcaaataatgatcaactataccaagaatactaagagaaaacaatgtagattagattacagtgaaattcctccaacactctaaaagcattccttggaaataaaaagaatcttattaataactagaggaacatgccacttctgatcctaatattcatcttgctttaaacagaccaggagaactgtttcctttgtgggaggggtggggggaataccatttttgacttgaaattgtaccatggtatgttgattcatgaaatcacaaattttaaaactctaaaaacaagtttcatgggaaactaagtaaatcatagtaaaagacactaacatgcatgaggtgatctcaatatactctacacaatagtatttcaagtgtacatactttattatagtgagacatcaaaatttatataaacaaatttaaagacaagagtcaagatgtgggaaaacatgactgatgacataaataaaactgcccattcccttgatctcaaacacacatatacacacacacacacacacaaacacacacacagagtcctgtgttctaaatcactgtgagaattatgtaataatggaaaactagacaaaaaaaaagaaaaggcaagtcataaagaggcattacaaatgctgaatagaagaaaaagaatttaaaaatgctacctctcctgttggtaaagaattacagcaatgatagccaagacatgggaaaataaatgggcagtcaactcactgatgttagccctctacaagtccttcaactattactgaggtaattcagcaatgcatgtgaaaaccttaaaatgtgcatacattttgacccttacacttctaggaatttatcttatatgaataatcccagctttatgtaaagttatgagaacaaggaggttcatggcattattttaaatttgtaacaccctgaatatcaaataacagagcactaggttaagtaaacttgtatatccatacaagtaaataccattccgccactgaaaatgttatagagaactgtactaggacaggcaaaacacataaaaaaaagaaagaaagcagactatataatattgtcaattatatgatataagtctagttttgtcaaaactagtgtgtgtatatatatatattttttaaaaaggtatatataaatatatctgtgtaatctattttataattttctcttttgtttgtccttattttaataattaggaaaagggactactatttataaaataacctaaaataaggacaaaagactatttagcaaactactaagtcgagccaatttcttaggcaagcccatatggacatgttgctcgtttaggaatgagaccatctttcctaattcctaattctctgacagtgggtggggcagcatggaaagaggaaaaaaaggattcacagtatctgcaatctcctgaatccatggggcacatcccaccagactacatctcacctctgctatacaggaaaggaatcagtccaaaggatttcagccttgttcttctgaatgattttcctaagttcactacccacatctaatgatgcctttaccaggctttatctgaattttaaagtaacatctcaaaaatactaatagtacaactttcagatgccctgccacataagattattcttaagatgcagagattcttgacattattcccgaccattattgattgtcttgctgagaaatgcactgttttctaattgttgcattcaatgcttcattttctctatgcaataacattaaggaaaacaacaaccctaactcttctaataattatatatttttccaaactatatggcattatactttgattcatggtccatttctctttaacactctacaaaggcatctacacagaggactcgtaatcaattccggagcttgctgggactaacgacaaaatttactaagccccaaatctgttaaattattcaagtcacttaccataaaacaaagtaggttgcattaaaacctggattttgaagacagagtaaagagtaaaaatcttatttttggcttgtttctgagggtatgtcagtgaggagcatgtaaatagattttgagtgttctattagggatggtttgaaaatgtggtagctagcagatacaccgatcatgtggaagacacaaaaccaaatgcagtcaccaggacccacttattactgagaagtattggcaggtaaaatggaacaaatgtgaggtgggcaaggagggccagatattcttggaaattttaattaactagacatcaggaaaagatatgcaaaaatcaacatttatgaattcctcacactgggaaaactactgccgggggaaaaaagaaaagggcccagagtggtagatggttttccatcctctagcttatgcagagtgacttccctaaataaagagctattctaagtggaagtggagactaaatgaccagctgatcaacacaaaattaatcattctccacagactagactatcaggtcgactaccactagaaagaatggctgcctggaattttaatcttttccactctatatgaaaaaaatacatattttcaagcaaacctgcaagaatagaaatgcagggtagtcatttcaaaaataatgcttgtgttgtataaagtattgagcactatattcgaaaataaattcctacaagagttctacttccctacaaagaaaacagtcgcttgcagataaggtatttcagcaaacacatgtggtgtgtaatgaaatgggttttgctttgttacaataaattaaaatggacaccagacctgaagaatctctgagcagacaaagccagttaggcctcataagtgatcttaactctgcttgatttgcagacataaacaaaacttgagctatttcttgtaaatgcctatgttacagaaaaatgaaacttaaggctaaccaattggaagcagaaagttctagttatctaacttatggttacataactagaactttccaggaggatagaccaaataaggcaacagtataactgtaaccaatccagtattttctttgctttactttcgtgtttgccctataaaagtcttcccttcacattcttttgatggagccctggaagcacttttggtttggagctgctcaatccgtgaatcactggttattcaaatcaactcctgacaattttacggcacctcagtttaagtttaaacagctctgtgcctcagttatacgcatgtatctgaaagaaaacaggatattcttctttgtacttaaataaactctaaatgtgcaataatttaaaaatatgagacagcacaagtgaatcctaaaatatattaaaacgtaaggcatttgcatatacctgattctgaaaatatggcatgcagttttacttctctggcttcacattctaaagtttctgaaacatataccatagagcacaaaaagagctggcctcttctcaaatttataacaaattatattttgttcttctttcaaacatgaatttaatcctccctttattaactgtttccttggttgtctgagtagagaatcattgtaagctgagtcacttacaccttccatcaatttcaaaacaacacatgaagtaacactgattatcactgaacctgtatcagacacctcccatttctgagatgtgcatttattctaaatctaagttttggaagtgataatggaatgaaacactcagaaaatataaaaagccaaagttttcactatgctttagaaaggtttgcaagttggtacttaaaacaatgctttaaggtattattttcatgtctatagatgaggtaatacaagtttacagagtatattcaaatggctaataaatacatgaaaaggtgctcaacctcattagtcatgacagaaaggccataatgagataatgcctcatacttacctgaatgactaaaattgaaaagactaaccagtagcaaaagtaaagtaaaagataacaaatgcaaaagagtatacagtacatgattccagtgatattaagtttaaaaataggtaaaacaaatctgtgatattagaaattacctttgagggccgaacacagtggctactgcctgtaacccaagcactttgggaggcccaggcgggaggaccccttgagatcaggagtttgagaccagcctgcgcaacaaggtaaacccatctctactaaaaatacaaaaattagccgggcatggtggcagacgcctttagtcccagctactcaggaggctaagtcagaagaaaaaaaaaaaaaaaagagagaaaagaaaagaaattacctgtggagagaaagcagggtaggaaaatgatggggactgcatgaggaggaggcttccaggatccctgttatgttttatttctttttcttttactttttttttttttttttttccagacgaagtctcgctcttgtctcccaggctggagtgcaatggcacaatctcggctcactgcaacctccgcctcctgcgttcaagcaattctcctgcctcagcctcccaagtagctggaattataggtgcctgcaaccacgcctggctaatttttgcattttaagtagagacggggttttaccattttggccaggctgctcttgaaatcccgaccttctgcccacttcggcctcccaaagtgctgagattacaggcatgagccaccgcatccagccatgttctatttcttgatctggctggaggttagatgatatgttcactttgtaataattcatcaagctgtatacttaaaatttgtatactgttctgtatggagattatactttaataagtttattaaattttttaaatgatactgtcatatgaaattattttccctctaaatgaaaagtgtgcgtgtgtgtctcaatatgtgtaataaaacaaccctctgaggtaagtactgctattattaccactttataaacgaggataccaaggcacacagaagttaaatagcatgcccaaggtcccacaaccagtaactggtaaagacaagactggaacccaggcagtctggcataagaatcccactaagagtcccttccattcttcaacttgtctttggtgcttaggtagcacatttcttcctagatatttcaagggcttagaaaatatgattcaaagttggatctaaaccaggaagtacaatcaaatccaatgaggtgcctttactaatgccaatcgtgtacttttgcttttcaaaactaggcctccagagagcaaaagatttgcttatctttggccaacagagttggggtcatggagagattcgtgccaagtgtcctttccttgtattcacttcacaagatgtttcgtgtaagtgaacactaggtgttttgtgtaagtgaacacaacatattccagatgttacatttgctacacctttggaattctaagttcagaattaaaatacaaaccagagtataatttggaaaacaaaaacccaaggttaacattctatatagtgcttttcttttaaatgtctttaaattcttaacagaaaaccacaaaaccctacttctatttcctattttatacatttttgctctttatgatttaaagaatactaatgcttagaattctttaaatcaaaatgatgaagaccaccagcagaacaaactctattacttttctctcatctcaagctcagctggaaaataagagaattataaaatatttaatgatatactttatatgaattcagttcagtaagtgagtttatcttgaaaaagactcttgttttattcagcttggtagaggaacttcatttcatatatatgataaaataataagaaacgtattagttgtagagatacttgtgttaggtccaagtgaaaatcagcatttgggttaacagtcaagcaaaataactaaaattttcagctctatgactgacatcatgagtggaaatatatgtcaacctgtaataattttattgaatgacgtgtttactaaacagaattatcttagacacactgcaaataagcagttgtaaatatcagttgataaaagtttaacaaaaactggtgttctgtaattttgactttctgtgtattcaactaactaatccttacatctaacaagacaattgacacctttgaaataattagctttgggctctcaggaacctctacttttgggcaggtggacacgaaataattactgccaaaactacagccagtttgcttgcaaaatcacatcaactcatctatactattttttaggttctgttctctaaattttgtgaaacgaagccaggattgaaaatactcattacatttctatgttttttaactggttttgaaatttcaagatttggaaaaagtactgtgagatgagctgtgcattcattttcctgatatagcatgagaaaaataaaataactcccacatacctttatctacccaagatgacagttaatctcaaaaaaagttgaaataatccaagcatttgaaaatgttccataaagtcaaaattttggaagagagtggtttttttaaaagaaaaatggctctgacagtaatttttccactatccctccccatcctacaggttttacaaaattaaaatttgaggtgagccactaagaaaagctatttcaacgaaatccaatgattgtcctggtagatttcatctctcagtggctctctattatcctttgcacagagtttcagtagacgctaaaagttcagtattttattacaatcgtctgtcctctgggtactgtgtggttcaagcagcttaaggagctgtgtgtctcggtatttacagatttcaattggtttgggaatctctgggaggaaaatgattcttcccttagaaagcagtaggaagaaagaataagtgaattaatacatgattagagagccactgataggtgtttctacctaaccaatgaaaacaaagtgcttatgtaagtggaaacattgttctttttgcgaataccttccttatggctggctgcctttgaacttcaataacttggctattcctgaacggcactggagaactgaagataagtgctaataataccttgccgtctgttttgtgagtcagaagaaaagacaagcaaaaacataaggccaccaactatgtaagtcatgaggaaaacagacaagtgtactaccaatataagacaaaattttatgcatgcaaaacaaaacaggctattgccagtatatttattaatgggaagcttccatatttagttcagaccacatttcttttttaaaaaatctggtattattttcatttatcattctcttagtaacaattcagatttcccacatcttcagatattttagtaaccaactcaatatattagatactctaacaatattgagacaatgattctcaaataaaagtttaggccaattgtgatggctcacgcctgtaatctccaagatctgagggcctgaggtaggaggatcacttgaggtcacgagtttgagaccagcctgagcaacacagcaagacaaaaaataaaaaaaaattggccaggcatggtggcatgcacctgtagtcctagctactcaagaggctgtgcgaggaggataccttgggcccaggagattgaggctacagtgaactatgataacaccacagcactccggtctgggtgacagaacgagaccctgtctctaaaaaaaaataatcaaaaaattaaagaaaaagttttatatcaaattgttgtggcatatacgtacttcacaggcctgttaaaagaatgaatgaaaaccgtgtacattagactttcaaaatattttggtctttctacataacaagcatctacctaaaccatgttatagtcaactgagtatctacaggtgaaacaaagcatactgatatttaacttccttactaaactagctgattaaatattaattgaatgcccacactgcccctagcatgggtgtggtagctacattctagttagctaccctcaagttaaaaagatgcacatgaagcagcaatagtaactatgaaaccaggtacagttatttgctacttagtacatatgttacaaactaatggtcagagataaaaattagaaagcatacaaaagaaggtggggccattatttcccagtgatttttgatcccataaccctaaaattttccaatatatggtaataccttcagcatctttatggaaggaatcatagtactcttccctctaaatcatgtaagcataggaccagtcacttctgtgtaaattacccaaataaagttcatgccaaccaatgtttcgactggcacactgtatcttttttatttccttccacctctcaggactgtacacacaacctctgaaataagatcccaagccttttacccaaaacgagttaaatcatcacgtattccaatgtgatataagacagaagttgtgggctgggcgcggtggctcatgcctgtaatttcagcacttttggaggcctaggcgggcagaccacgaggtagggagtttgagaccagcctggccaacatgagaaaccctgtctctattaaaaatacaaaagttagctgggcgttgtggcgtgtgactgtaatcccagctactcaagaggctgaggaagaagaatcgcttgaacccaggagacggaggttgcagtgagccaagatcgcgccactgtactccagcctgggcaacggagtaagactccgtctcaaaaaaaaaaaaaaaagatagaagttgcatctggggctgcagagtacacatattgacttatcaactctcaccaggaagaacaagtgagctcttgacggtgagaaattaaaactggcatataatctccctacaaagagaaaggttaccttaggatcagctgtgagcaatttgaatgcttgatatacttgagcttcctttacaccacctccaagatccaagaagttggctggcttcccaccattaaggaaaatgatatcacaagtagccatggcgagcccagcaccattcactgtgaaatgcaaatgggacacaagacaggctacatttagcaacatgaaatggtccataaacattttccctcccccatattgccaagagagaactctgtcattgccaggccaatttatatcctgtttggaattccattaaaccagattagttcatagacttttaggataaagaatcaggacatgtatatgcaaacaatgaaacaaaaaagacttaggaatgaggaacaggatgtattgggaagttaaatcaatctgaaaaacagaaagaaggaaaggtttaagtaagtaaccgatttgggccagtagtaaaaaaggaagttttaggttctgcaaagtgtaagcttaagagaatcaggaggcagagaaacaagctattggaagttgctaggacctatgaattacattctttttaatatactttaagagacaggagtaaagaatggaattctcaatgttttgtttgctgagaatatggtcctttgaatgtggcatctgtgggattgaaccacaggcttcccaacttcagtgggattttatacttttttacacttagtacagtcatacatgtttacataatgttacctggataaacttagaaacaaatgaacaaatgactgcacaaaaacaatattcttatccccttgttcctctttcaaattaatataagcaatgctcaccagcaacccaaccgttaaaactggaaccaaaatgtgccaacatcttaggagcctttcttaagaaagtaggtagagagttttaatatcaaaagtcttgttttccagagctaagttttattgatcaattgcacttattttgcttcttaagcttaattatataaaattactttccttgagagagaaaaaaaaaactccagaacacagcagaaactcacaaggtaaagtacctttcatttttctgaccctccaattccctagaaaagcctatgactgtgactaattaaatttggagtaactaaaataaaaatggtttacacagaatcttaaaacaatttgaaatgtgtaaatcatagattttgaggctgctatgtggtcaaaccatgcacattcctacagaggctataaataatctgtatttaatttggtttaaacccatatacctttcccctttctaaatgcctacaaatattgagagtgcattagcttatcaggatcagaatgatgtgagtgatctggtacattatagttattgctccaatacaaagcaagagcttttggtatcacttgtaattggatgtcattttctattgtattgaacagccacctcttggatgaggtctcttcagttctgaatacaatgatattgctggtttaatgagctacaaatcatttttattttaattccattaagattaagacctcagtttccagtacaatgaattgattctaccagaaacacagtcttgtgcaattaagtcagaagcatataaatctgagcactataagctgtgaacaataatagaaactgtattgcttctacagacattcttatctcagctgaagaagccattttcacaaatttagatgagtgtgataaaatcaattgttttattaataaactagcataatggattaaacatttcatcctttggttatcacagaacctgaaactttagcaacgtgattaaagtgtatgtcctcttctatttcctctgataaaggaattttgttttaaacctaaatttcagaagagttctgcatattaatactgagttgagcagcaaaggttctaattttttactaagcaaagtttaactgagatgttttaagtcaatatttctcagttggggtgatttttgcataccacagccatttggaactgtctgaagacatttattttaatttattgatttacatgggtttatttgtcttcacaagtgggggttgttagtagtatctagaggttaggatgctaaacatcttatgatgtacaggacagtaaagaattatcccacccaaactcccaatagtgccagagttgagaaattctgctttacaccagtgaccattaatcaaaacaactttgagaagaaacttggatactttcctaagacttttcagctacaaaaaaacttatgtgcttacttcttcttggtaagtgacatttcagaaatcaaggtttcctaaattctataagaatccacaaagcattcttttgatataactgcttcttaccaaagcaggcaatgttcccatctagtcctatgtattttagatcatatttggcagcttcattttcaatgggctcattctctgatttgtcgtccatagcaaatatgtctttttgtcggaattctgcgttgtcatcaaagtttatcttggcatcaaaacagacaactaaataaagaagaaaacaatcatacttgaatatctcttgaggatctataaattaagttcttcaggctggtaggcacaagcgaagggaaagttaagtactgtcattttttttcacatgttacaggcaggagaggctgctttggctttcttgacctttaaattttagggtttggtccctgttgtcaagggacttacgttctagtaaagaacatagtaatttctacctgttgttctcatttcaatagaataaccccaaaagttgccatcaaccattaaaagttacagactggcacagcttcatagatacagctttgattcattatttttattatatatttttagtatttaaccactaattatcacctttctcttctatgtaaagagagactagacaatattattaattattttgtcccctattgtccttttcttgatatggtaaagtgaaatttttattgaatcagtatcctgtctagtatttccaaaagatttagtggaaagaatgccagactagaatcgctcgatttttatttgatccttaactaactctgtaacatttattaaaaataaaaattgtatacacttgagtcttgaacaacatgggtttgaactgtgagggtccacttatagctggatttttattctcaagatgtaaagccccagagggtcgacttttcacatacatgggttctgcaaggccaactgcaggaattgtgcaatatgaacgaagtttggtatatctgagattcctggaaccgattccctgcatatattgagggacaactgtgtatttaaagcatacaacatcatgttttgatatacatataacacagtgaaataattaaacacagtgaaatgattactacactgaagcaaattaacacatccatcttctcatatagtttttggtttttctttttggtgtgggagagcacttaaaatatatacttttagcaatttccagcatacattactaactctgtaaccttgataaaataacctagttcttctctgggccttggttttttaattggaaaaaatggcaataacaatccttaaaacaagggccatgcccttgattcgtgcaggaccatcttatggtgcttcagattcaagttataagacacgaaaagaccaagactggtcagtcacaaagccaggatgccaggcattattagcacaattgtctctagtttctggagctggtggaaatctcctggacccagcaaaactcattccataataggagacagactacagggcactttccttgatttacagatctcctatacatacaatcagggagagactgcagtggagagggtggcattattggtatctgggtatctgaccccttttattatctctcttagtgtagaaattagtgttctgtgatgccatgtcatcataatgtttgtttgtttgtttatttatttatttatttatttatttcggagacagagtctcactctgctgcccaggctggagtgcagtggcgcaatctcggctcactataacctccacctcccaggttcaagcgattctcctgcctcagtctcccaagcagctgggactacaggcatgtgccaccatgcccaggtaattttttgtatttttagtacagatggggtttcaccgtgttagccaggatggtctcgatctcctgaccttgtgatctgcccacctcagcctcccaaagtgctgggattacaggtgtgagccactgcacctggccaatgttcttttacttaacttgggatattgatagccaggaatctttgaacaataatttacagatactacctattctcctccagcattgctgacaggcacctgactcttgaaagggaaacagccacagaacatttctcactcactgaaaagcagtggctataatctcctaattatacttgcttcttatgaaaataaaacatggctgtatatggcatcttggcgttagagaccccaggtagagggttttctccaagggtttccctaccacaatattcaagcactttgatacaaatctgtgtagaccagcatattaacatctaagaatacttgttataagtatatatatagaccgcacatgacttaaagtagcactgagcgacaagagagaatcttatatggaagttaatgtctgcttaaatccttagtcttgccccaaaatgcccaaccactttgtccacacattgtgaatggttggagtgaatgagtaattactttccaaaatattgaaagcttattgacagaatcctacaattaccaaacgaattggccaatgttctctgcttgctacaggggaattttctcagcagttaatgactggtataataatcaataaaaaagcaacttcgtacatggctttccactaggtttataaatgcattctaattaatttattagtaattttagctcctccattactcattggcaagactacttataactgacaccttcaaaatgaatgggctaaggttatcaaattgacttcctaagggaagagtttcaaataaaggaattcttggttgagatcaataaacaagtaaatcaaaatagtttcaagctgacctttgctccttacaaagactacagttacaagctgcttcagagagagaataattaatgggtatgtattcaaagttcaaaaggcaatcccaactaaatgcctgcaaagctagattttcagaggatgtttttctgtggtatgacgttctctccagggaacaatcttgacagaactttgcagttaacccagagcttcaagatggtgactatgggataaaaggggtgtatatctacaacggtcctgtgccgactgttaatttgtagagaaaactaaacaacctaattggatcattgcatgtatgtctaagtgttttgggaagttaaaaacactacctaaatatgaagtaatttatttagaggacttaggacttaagaaaggggattcaaattgaactgccaccttcaagaccccagtctttacttagtgggtaagggaagaaaaactttaaggatgtaaagggattctttcagacacatatttgttacgcctgttttatattttaaaagtagtctgtgatactgtgatttataataaatatattattttggtcttcatccctaattcctagcatagagctctaaaacccttgtgatttcctaagcaataggggtgctaggagaatcttgtgttctaacatttggcctttgaccctgattcctgatgcagagctcctaatcccttgggattttctgggagataggagagtcttttgttctattaaggtaagtcttggtggaggcttctgtatggggctggtcgccagaaagaccaaactatgattagaagcttggaaatttcagccccacctccatgctccagaaagaataacagatcatccctatgtaataaagcctccataaaaatttctcaactccaggggactggagagcttacaggttgccaaacacagggaggtgctacagggtggctcacctgtggagtacagggaagcttgtcaccccttcatgcataccctgccccatatacctcttcatctggctattcctttgtatcatttaaaatatcctttataaaaaaataagataaaaaataaaataacctttataataaatcagcagtagtaagtaaagtgcttccctgggttctgagagccattctagtaaatgatggggcacaaggagggagtcctaagaacccccaatttacagctggttcatcagaagtaccagaggcttggtcttacaaatgacatccaaagtggagtcagtctgataagactgaccccttaacctatgggatctgactctaattccaggtagatggtaaaagaattgaattgaatcataggatacctagctagtgtcagagattagtcagtgttggaaaaactcacacatctggtccaagaagtgttcttctgtgttgagagtttggtaggagaaaaatgtttgtttttccctattatacatagtaccaaacaaacaaagtgctttcctatcttactatctacaatgttgtgccatctaaatgattttccttgaacctgaccacttaatatagactggcatcaaaaatatcagggtataaatgacaactcctggcacttcctagccagctatccttaagcacattaacctctcttaaacccgagccttgtctatacaatggggatcagagtatgttctactctaggtgttggtggcaggagagattgtatgcaaagcgcttagcttcctagacagtgggtactagcaggttgttagacgaccacaccaccctctaatatgcacatgcttttttatacttaagagcttcccattattgtagcccaggctacagaactctcctctcttcctaacaataaaaattatctgttcctttataatctgagatttctgtttagagcaaatctaagcaaatgtctcccatagtttacatatgtacaggttacccatggttttcaataaaaagccatcttctgaatgaataagaattttcccaaaggaagaatattaatagttggcattttaggcatcataaatagtagaaaacaagatttttggctaaaagataagggtaaaataggctgttggtgactctcaaatcacatcacacctgtgcataaggccaaggctaaagattggtacagaatagctccaaatgaagatctaagcaaagggtagcaactaagaccctcaagccagccctatttttatgaataacagattggaacatagcctcgttcatattgcctatggctgccttcccaagacaaaagcagaggtgagtagttgcaatacagactgtatggcccgcaaacccccaaatatttactaactggtccttgacagaaaaagtttgccaatccctgctaagtcacagttctcacacttgtatccacttgtgtgaaccaagtgatagatacacaggtgtcatattttatagtgaaggagaaacttagaaaaagtgcattccattaacatgaaaaccaaaaaaaaagtaaaataacaaagaaaataaataaaaacctgtggctacgcaaaaggagtagattaatcctggaatactaactgactcttacatgcttatttcctcctgtaagacgcttctaaatgcacttcttgaattgacgtgttaaaaatggattgatgtctatgtcaacagcagggcgataaaataaacttgcctgcttaaacccttagctttctcatttaataaaacaacaaacaatacaaaatgcattttcagaggtgctgagcttggtccggaccttaagattgtcaacgtcacattaatgaaactcaattctaaagaaaattcatcttgaacaaaggccattttttatacaaagtgggtgaaagaaacatacctattaatatttataaaacaattttcaccatcaaaagcacattgttacatgcttgatagattatacaaatgtattttccttctgaacgaatatcaaagaaagctgtggtacttatatgcatagggtgttttgttgttttgtttagtggcgtgagattctgtgagctgctaattcaacaatctcgatagaaaacatgactggcagttagaggcctctgaccctagaattttaacagaagaatgtgtcacagaattaaacaaaagaagaatacatttcagaggggaaacttacacataaaaggaacataaaacagcaggaaataagactatcataattagtttgaaaaataatctgtcttcaagcaacgtactgcgtttgatttgtgataaataaccataatgtactattgaaacacgccttgccaaaatggccttaaaatgctgatactttcaaattagtcccacttcccattaaatattgatgttctgagagttgtatactttttagaacttttttttagtggctgtgaaaagagaaaataggtatggggtgggtaggggggttgggggaggtagagaaccgaaaatgttcttgaaaatagagtcttgtgtataaagacagaaacagagaaacacccaccaacaacatgggcacttgctaacaagaagcaacggggtggttatttagggaaatcaatccgaagaaagaaaggaatttgatgtgccagttaactgtggatcacccagctttaattctcacggaatcttagccagatagtcactgcttcaaattggatctcattcctttggcccagtgaatggatttcagcttccaactgatgaagatgccccaaagcaagaattcttaatctctagactatggacagattgggtgaggtcgttctctgtgaacagggaccatcctgtgcgttgtagtttagcattatccacgccagtagcatagcctccaagttgtgatgactaaaaatgttccctgggggacaaaatgcccacccttcccatggagtacaacttgctttaaagacatcagaaaaaggagtctgtgtacagatagagctggctgaaggtgagaagaaatatgacatgaaatttcacagtggctagcaaaatgaatgaatgaatacatgaatgcgcaggtagataaataaataaataatgataaaacattgcttcttgcttggctgcagaattaatgaatgaattggcactgcatttggacaaacaaggaaaataacgattaatttctattgactaagtaacagtttatttttgtttcaataaggttgcatctttctggtaggcatgttttgactcagtgtcccttcttccattaagaaactgtatgtctcctataccatatgattcttgctcagtggctggcatgggcatagacatgtgacccaagcagggtcaatgagaatcatttgaagggatttatggggctgctgagggagagttatggagcactgggagccatctttgctgccagcttctgagagcctggctgagaaagaagccaatttggaggcaagcagggctggagaaccagcaaatccctgattctcttcaggccttaagccagtccacaccttagacttccctgttacaggaatataactttttaacaaaaacaaagctaatataactttctgtcattagcaaccattataatcctagctaagagtcactaaactacattgcagttagtagtgtcaaattatattttttgaatcagattattaatcacataggaaaaaagagctcttggactgcagttctttctccgtgtcaaaaattccctatgggtgacttagcagcatagatgttatcaaggcccttgttcttcactcaacacggcatcacttgttgtacaaatatatgaacaataacctgaattattaaaaatagcactcactgaccaatggaaggtcaaaaaaagtttcctacaaagaggtgggtacaggccaggcacaatggatcacacctgtaatcccagcactttgggaggccgaggtgggtggatcacctgaggtcaggagttcgagaccagcctggccaacgtggtgaaaccccgtctctactaaaaatacaaaaattagctgggcgcggtggtgggcgcctgtaatcccagatactcgggaggctgacgtaggagaatcacttgaactcgggaggtggaggctgcagtgagctgaggctgtaccactgcactccagccttggcgacagagtgagaccctgtctcaaaaataaaaaagaaaaagaaaaagaaaaagaaacaacaacaacaaaaaagagctggtacaatgtgatgctgagctccttaaacttttaaatttaaagaataattattaaatcaaagtttcaatgtggaaattttaccgtgaaatgttctgctactactgatctaaacagaactaacaaatactcagattataaatattaagattatcaatattgctaaaatataaatgactgcttttacagcttctaaataaaagatagcttgaggggactgtgataatgatgaagatcaatttgtacatttggtcattaatcaccatttcctaattgggtttaatttgactactgctcattagagttataaaccaacatactcatttaattgtgattataattcaattgctgaacttttatggtacaatgaacaaattaataactaaagataattttgctcttaaaaatatcacataagacttatgttttaatgaactgtatataatgttttatgatgattcccttaaaaaaaaatctcaagactcttccattctcttaataattaaaaatcaaacttcagactcatgacgttttataaacacagtctaagaaaaggttcccatacccctgttccctgaagcgagaacacagctcgtgactgcttcccaaagggttgaataaaaaatgtattgcagccatttttatcccactccatagctacagctacatttccatttttcttcatgcaaagcaaccaggctgcttgtgtatactagttgaaaaagcaatatatgacctttaagaacttttgttaaaccttctccttcatttcttggatttaattgtcaacatgaattctgactggtattccctgccaaactggagactacttctaggtcatgtacgtgaaagcaaataagtagtttaaatgggagaaagtagaaaaggcaggtagctgcagttgagtctggagtatcagaatcaatatgcacgctggactcagagggacatgggttcaaatcccagcttttgtaacttctgactagcccctgggacagtcacaatggtttctcaatcctctataaaatggggataacaactcctaatttttcagggttgtggtaaacaatatgaaagaatataggtataagcttatcacagtgtctggcatataagctcaagaaacagcttcttccccttcctttcttagctttataaaatacacacaatttgatagccatagcaactttaaaaaaaatatttatgaataaaggtagcttgtttataaatgagcaagcacagatttctatcggatggtcatctgtataaatcatgaaatatattatcttcaatggcttcctaaacataaaatctttgcttgttctcgtctgaaatctatactattcctgggctactctgagactacctgagaagaggaatttcattttatgaatgttagggactagcctattttgtatctgacactgcatgcatactcatatatgatttcatcttattttcacaacactctatgagctagacatcatttctaccacttatttgattgaaaagattgaaaaaaaaaaaaaagacctgaaacttaggcaggctaaataacttgcccagatccgtagccaaaacatggcagatacagaatttatacttaggcctctctgggttcgaaggaaatgatagtgtagtttctctgagtctagctacagaatctctgaaatgtgctaaggagaaaatattgtctcatccgtcttggtccaaaagttgatgtgtttacacataatgattcaccccagttaacaattcaatgcaaattactatttactgactgtaacaagctagacaacatgcaagacaccggaggtgaaatgtactaaaaaagaaaaggttcatggtgcttacagtctggtatccctatcctatccacctgccattccactgttttgacagcaaaagcttgtgaatttgtgtgtagaactccactttaccccttaccacacacacatttacaagcttttgctatcaaattaataagaacttatggaatatttgctgtatgcaagaaacagtgcagtggtggtaggtactgatatataaaagttatttatactctacaactacctgatggataggagaaaccttcaccacaaaaatgccacctcctcctgcctgaagcagaaactgctctccaagtaaggtgaaagagttcaactgggggggacttggggctttaccaaggtgatataaatccagcccagaacacaaggtgaaattatatacagatttaggcaaactaaagacgttcgaaaagttccagttccataaaggcatatgccttcattacacccaagtgtgtggctcccatttctacacaaatctttaccttagtagcagcagtgatgggcctaaaaaaataaggtggagagaaagaggtgaacgaatgtttctttccttttattatttattattattattattatttttgtagagacagggtctcaatatgttacccaggctagtctcaaagtcttggcctcaagtgatcctcccgccttgtcctcccaaagtgctgggattacaggcatgagccaccacaccaagcctgaatgtttttaagtaaaacaagcagtagcttccttagaggcttggcatttggctacaaacaaacctaagtgctgaaatgttcaactgcatcatgggagcatttcaaactatggcagaaattaaattactgaaagaaatttatgcaaagctgctgctacagtcttttgtgcaatttatagtttgcataaataattataatacattcatttgttttctcaattcttttttttttttaccttgtccttctggagtttcaccaaagggattcacttccacctgagtagcatcaattttcaggaagagattatacagcttcgtaatttgatctgcagcctaaatgtgatcaagtgaaatagaattacaccaaagcagtaaaagaaaatttattttgctggattaatgaaaccttaaaaatagcaagttatgtctttattttcagttaggttttctgaagggaaaaacagaaaagcataattattttaatttccactgctattcattaaaaggaattgctcagctctcctctagacaccagaagagaccattatcaagaaaagaaaatattttcagtacggcctaaaacgttgttaatctttttgtaaattatcatgtctctattagcagagttatgctgcaatataaattacaatcattaatacaaacaagctccatttaagtaaaaggtaaacatgattttgagagtttataatgactaggttttccttattgtgctgaaataaaacagttattatattcatcaatccaacccataatctgtgaaacaacaattactgagtgtctaatgaaaattgttgcaaaacaggaagatgaaagtgcttaatagtgtagttactgaacagcacaagttcaaactgaaaatagcttgtcccaaaggcattaaccacaaagggcaagaatatccaaggttgccctgttatgccctgacttcatttttctcacctctgcttgaaattcactcattcattcattcattcttttcaaccaacatttctccactgcctatgacacagcaagctggtatcttgtgagctggcgcttgaaataagagcatgaatgagccatgcccctaccctggaaagctcctggcaataacaaaaggagcatgtgatgcacagagcaagagggtggatcgtggagaagaattaggtatcagtctcattcccagctccattttccaagccaaagttttcccactgccacatttcactcattgtgccagcctcggattacttgcagcagatccgttttcagttctccaactctactctgtatatcagagaaggtgactcttacaggctgagttttctaggttcctgggtcagctggtttccagctggggtcagccaatggcaagcagtggtgagagatggaggtgggaagaagggaagagccagggtacttccactcctctctttctatctgggcagcacctcctcctctggctgttgctcccactggagaagcccaccagggctctagcttctgtatacaaggtccagtaacaccactgcctcatttttgttcctggagcatgtggttggatatgctttaggttgcctttctgtcaactcttaaagtactcagctcttgcagcgcctatgaaacacatccctaaagtaaatccccactggtgtaaatattgcaagtggttccagatttgactgaagaactccagatttaattcatgctatcttaatgtattttataaacacctacaaacatttttaaatccaaatttgagggctagtagatataaacgaacccacataatgagtatgattaaatatttttaatattaaatatttgcataggtagataatacatgtatatgatacaaaattcccgaagaacttaagggttttccctgattgtaccactcaaccacacaggcccccagtggcagccaactcataaatttagccttcatatgagagacagtctatgcctaacacagtacgcattcctccttcatctgtcttaaaaaagcaaacttgttccaatacctctttacttaacagaattttagagacacttcatcagcaacacaggtagatcaatcatatctttttaattgactaaataatatcttactgtattgatatgctataattcctttaacctttcacttaaataatgaccaactgcattgtttctaataggttgacattacagcactgccttatttatctctgtatatttaacatacatgtgattaaacatttgtaggataaattacccagagtgaagcaaaaaggaatgtagccattttaaacatcaaaaggttctgttaaattgttcttttttttttttttttttttgagaccgagacttgcagtgttgccagcctggagtgcaatggcgcgatctcagctcactgcaacctccacctgccgggttcaagcaattcccctgcctcagcctcccgagtagctaggactacaggtgtgccaccaagcctggctaattttttatattttagtagagacgggttttcaccacgttggccaggatggtctcaatctcctgacctcgtaatctgcccacctcagcctcccaaaggtgctgggattacaggcatgagccactgcgcccggcctaaattgttcttcatagaagctgtccctgatttccactcctaaaaagtgaaaattatcagagacactattttccaattcacaatcattagccatttgtatctttgtcagtgtgttaggtgaaaaagggtatctcactggtatggttgggctctgtgtccccatccaaatctcaccttgaattgtaataattcccacgtgttgcaggagggacccagtgggaggtaactgaatcatggggacgggattttcccatgctgttctcatgatagtgagtaagtctcacgagatctggtggttttataaagggggggttcctctgcacaagctctcttgcctgccaccatgtaagaagtcccttcactcttccttcgtcttccaccatgattgtgaggcttccccagccatgtggaattgtaagtaaattaaacctctttccttcataaattatccagtcacgggtatgtctttattatcagcgtgagaacagacgagtacactcacatatagttttaatttgaatttattttattatgaatgagtttaggcattattctatgagtttaagagacatcttattttttttgtgtgaattttgcctatttttctattgagattttggtcccttattaatttataggaagagtgtgagtgtgcgtgtgtgggggggtgtgtgtgtgtgtacaagagagtgttgctttgtcacctagactggagcgtactggcataatcatggctcactgcagccttgaactcctgggctcagatgatcctcccacctcagcctttcaaatagctggactacaggcacatgccactaggctgagctaattttttattttaattttttctagagatgggggtctcgctatgttacccaggctgctcttgaattcctggtctcaagcaatcctcttgtctcagcccctttaacatttaccttttgaacatgcttttgttacttttgccacatggaaatttcacaataatgtcactcttatatggcttctggctttgtgtcagacttttaaaaggctagtcccattctgagagtatttttaaaaattctcccattattttttctagtattctttataatttcttccatttttttaatccaaataaaatttgagttaaagtgcgaagccagcaaatacttcattgcggaatattttttgtattttagggggttttctaggtcatcaatgtgaccttgcaatgtgagttgcatggggcaggcatcttatgtatcctgggcaccttggcatccactgtagtgatacaacctctgcagagtcaacactcgataaatatcggttgaattaaagattaattcagttctaagtggggactacataatagaaataacttctgggtacacatatatatatatatgtataatctaatccagctacttcaaaacttcctttttaaaaaattgtgataaaatatacaaaacataaaattcaccatatctcaaccatttttgtctacacagttctgcagggtcaagttggtacattcacattgctgtgcaaccaattcctagaacttcttcatcttccctcacactctgtatcgctaaacaaactcccgttcttctcttcccactgcctctggcaacatcattctactttgtgtctataaatttgactattctagatagcatctctctctctgcctctctctccatctccatatatatatatattttcacacacacacacccccctctatatatacgcacatatatatctctccatatatatctccatatatatgtatatagataatacgtatagatatatatagataccagatatatagagatattagagatctctatatacatacatacataaaataaaagatatgcatatatatacatacactagatacctgtggaatcatccagtgtttgtctttttgtaactggcttatttcacttagcataatgtcctcaagccccatccatactgcagcatgtgtcagaatcttcttttacaaggttcagtaaagttccattatagtatataccacattttgtttatccattcatccacagatacacacttaaattgtttcagaacttcttaagcctacaccaattttgcttagtacaaggctgcattttctgcacattaatcccattgtaattatacattagcacagcattttggggatattttctgttttaatttttactgttgcacaaaggcagaccataatttttttgagcaagactaaaacataatctgatcttggagacatctccaaaccaagctggttctcccttgtagatctcacaatgacaaacccttgtaagatgtcttattccagaggctattcactaaatggttataagggctaagcagacagaatgtgtgtgaccaggtgtaacagggaatggcatggcatgtggcaagttgagattagtattcccactttctacaaaagttaaaaataagcacaggtcaaagaaaacattctcctggtcaacttgcagtcagtcgcttactactgccatctatttctcagctcataaccactgcgtacaaaaagtttttctgcacttttgccatcaattgttattttgtctgttaagtaatttttaaaaattaaaattcgtaaaatcaaatatacgtacatgaaaatctgacaagtttataaaaatctttaaaaatgtctcaaaaggagcataaggaggaatggcctcagaatcgtgcaggcacagttgtgcgctgcatcgccaagatgccattcccaaagtatactccatcgcgcctggccactccaccctcgaccctctacccagcggaatacgacatatccctggaaacccagcaggcgcaagccgagcggttggccataagagcacagctgaaacagcagtacttgcttcagtacaacgaccctaactgctgacggctcattgaagatcctgccttgatttgttggacctatgcaagatcagcaaatgtctatcctaatttcacccctaaaaactcactcttgggagctttgtgtggaattaggcacctgttcttctggtatgatgtattcaaaactgacaggaataggaaagaaaaacttatccaggaaggaaaattggatcaaacatttaacatctcatattaagtctggcaatgatgactatgtgtattcttgctgaaataaatcgtctattaatcaaacaaaaatctcaacaggttaagaattttaaatatttttcttgcattccagaaattatcatcaatattcacgtacgcctctcaaatctagccagaagtacaaaccacttcaagaggtgttagtgatcttgcactgacttggaccatccgatcttttcatcagcctaaaccttagaggcacatgttgacaattcgtggcactcatgttttcagaaatgaacagtatagatgataattaagacacacttgacaaacttgtaagtttcagtcatacaatagtcaccctttatcctcagtttccctttctgtggttttagttacccatggtctactgaggtccaagttattaaatggaaaggacaaaattatggaataagatccttggatggaacacagcactaaagtcactgacggattacaacctctacagccacacttagatgacctaaaaagaaagagacaaacttctaattatgatgttcttctaaaaggttgtggtgaaaaaccttcagctatccaggatccctgaccattgacatcatctgttcctgacatccagccattgacacccatggtttgatgatccaggatcatccaaagtagatgtccctcacgaagtattgccaggaggtcatgagaagcccaatgctacatcgcaatgctcacatcactcaccccacgtcttaccatgtagacattgcatcatctcacatcatcgcaagaagggtgagtacagtacaatgaggtattttgagaaagagaccatattcacatcacttttattacagtatattgctattgttctatttcatactgttgttaatatcttactgtacctaatttataagtcaaaatttatcctaagtataaatatctagaatatccagaaaaaaagagtatatatagggtttggtagtaggtaagcttcaggcatccactggaagtcttgggacgtatcctccacagataagggggaactactatattaagctttcctatgtcttaacgtttttcaacaaattctcacagaaagagactttggttgggaacaaacactggtaatttttatgtaaagcaaagtatcatctttatttttgttatgtctaatattcatcacattttagagacaacaggcatgagtcacaggaaagatattaataattttataagactatcattttatatgatattcaaccatgagtgaggtacctccaaatgcctaaaccacatcctagatgaaaattaagtaacttaactttcaaagtcacgttgaacctaaggtacctctaagatactatttccttaggaaaagatcattgatgattgtttaaatgttttcccttctacactgtcccatctgctcattgtacactggccctctagagcatttcactaatccccacagcttgagcaagccccataaagcagagattcccaagcctacaactctaatgcacagctttccctgggatcccaagccatatatcccttctactgtagaaatacactcaggtgtccctagatgaacaacttccaacatgtctacagctgagatcaacctctctctccctctgcccgctgccccctcccccactctctccttcacattcctttatccgtccctcttcctgtatcctctcagccagcaggcagatatctaccggtctgtgagcccctgaggaacaatggttatttttcattgtctcttttccccaaggcacagcagactgagcagcaccctatcagtgctcattccaagctgctgagaaaatgaagatttaaagcctttcatggagttagcagtgaaaaaagaaaaaaacaaattaaaacattttatttcctttcctcgataaattaattcaaaggtatactgacaatatggccacttacttatccctcagttctcacatattcgtcttccttccataggtaactcatttaaaacctagagtgtttcaggtaccaggaaaacaagaataagccatttaagagctgtaaataactcttaattttctcgtataatatgtagtgagggggcagtatcttgtgatgtacattatactgttattaacttctctagaactctctattatgttcacctcctgagcttttaaatatgtggtcagcagattttgcccactccagatttatttatctgccatgaaaagccacctattgctgagcctctaggaacttcttcaaagtggacacctagaagtgttgtttcacctagtcatgcacatgacaaatgtttcttgggcaataaaaatagatgccaagcactttgccagctgctggcaacacagcagtgagtaggatggacaaagtccctgccgtggtaaagattaggatctagcaaaggtgactgcaaataaataagagaaatatacagatgtccaaagtgatatggaggaggcagacagggtcactgtgcaactctggagctgactgccagacagtgcagctagaccacagtggctgtatggaaaacgggctcttggtgaccaccactgctacaggagaagccccttaataaacatcaaatgaatggctaatgtagctggtatcctcattctcaggaggtgaaaccaaccactgtagcacatattcaggaatcttccaggatcttcctttcaacagatcactttcctggcatctctttgctagtctcagaaatggcaattagttcctctaactgtccatcgaatcctggccctttctctctcatcctgaggtttagttccagatgaccctgttccattctaccatcttcaatcttttgctttcaaagtgagcctttattcattttcaagtaagtggtttcccttcatttaagcatatatattttttaaaaccttattctgttttatccctctttgacttgcctactgttgccattaaacttccagagagagtcaatcaaaagaaaaagacaagacagaaagaaaagagtgcatcatgtactgtcttatgggaatagtgctgcccaaccaaattaaaggacatactctgtaaccttttcataaagccccaggccagagaacatacacacatgcacacatacacacaatctagggccattaaggtggcctctctgagtaacagaggaaggaacaagtaagtttatctgatttagctgtgggactaggaagcttgccccactagacacataatcaggtgccatgggctggaacaaaggcagagcaggggacgatactaagacagattctgtccctcaacagctctgaggccaatgttttggtctttgaagccaagggatattattacaaaattggcatattttaagctgttctcaataaaatatcaagtttatgccatcaatattcatttcaaatgcccattagctatgaaagaatagcaattagctaaataacatgtattattaatattaataccattaagaacagacctttatggagcagtacaataaggacttttacacattattctactgaatccccacaataagcctctcgggagttgtcatcattcccattttatagatgatgaaactaaagttcgaatgagctgtatcacatgcctgccaggtggctaagtaccagcaatgctacagaaaaaatagagattaccatctatcatgaagtgtatgtgtccacatgcaatacacatgcacacacataccaaaacacattcaaagacacatcataaacatcctcttttaaaacatcagggaaatatttttcttcatcataaacagctggaggaaaaaattataaaacaataaataatcctgtttcctggtaatcacaaacactagaggcaatgaagcaagttcccaaatgttttctgaaacaagtcagacacaccatcccccaatggcttatatacctggcttttcaaaggcccaacgaagcctagattttcggccatccgctgagcttggctgtcctttattccttcaaaaatgtcaatttgctcctagtaaaaataaatcaaataaacaaaattcagacagtcaactgagaagatttacaacctcaaaagaaaatgcttagtatttatttgcaaatgagtaattaaagtgtggcatctatccagagatctctgagcagggctaccgcagatgcctgtagggtatgttttaattagcagaccatctataaaaaagcccttccaaaaactatataattcttcatggtggcatgctgacaagaaaatctgatgccagttttcacttttaattactatacagatggcattgatgaatatttagtcagttaattttttgacatcttttggaaggtttccaaagtaaggttttcctgcctactagtagttaagtttaaagcctgtcatagataggttaaatattaccttatgatttaaacactctattgatgataattattactgttaccttagctctacaaaatgatattgtctcaaagacaccgagcactgtcactatacattatttcatgcattctcttaacaaatggaatggcctgctttaaataatgtgaactttgaaaacagctaggtgttgttggtaagtctgcatataaagtctcaattcagtttccaaggtaattaacttattatataatattagtgaaaatattttaaaaccaatcactgcagtatgagtacagcaggtcttcaaataacgttacttcattcaaggtcgttttgttataaggttgagaaaaaaaaaaatcaattcccagccaaggccactgtctctgtgtagtctacacattcccctcttgtctgagtaggttttctctgggtcccccggttttctcccacatcccaaatctgtacatgttaggtcaactggcatgtatacacagtcccagtctgagtgggtgtggtgtgtaagtgtgctctgcaatgggatggtgtcccatccagggtgggctcttaccttgcaccctgtgctccagccatcagagaccctaagctggaaaaactggataaacaattatcttacttgtttttatgaaatctttctgaaacgtacatatagctcctatttattttaatgtgtaacattagaagtgtgctggtctttatttaggagttgagtgatgttctgtgagcagaaatatgctataggaacttaactcttgtttatatcaattagcctatgtatggtaacattggtttccttatacatcgtttccattcaagtcgcagtttccaagaacctgttgaggatgctaagtgggtgtttattgtacattatttagacaaagagatttaagaaataaaatctccccttctcaaagggaaacaaaaaaatcattttctaaaagaaataatgaatgtttctggtggaaaattgtaatgtaattttgaccccaagaacccagattaaaaacttcaattttagttctgaaaacttatgtttttctcctcatagctgacgtaggttaagaagcactttatacacatcacctcatttaatccttataatctcacatggtagaaatcaccccatgttcattttactgatttaaaaatgaggtttggagactttgagaaacttgtgctctgattaaatttgacctcagatctctgacttgaaactaatcttaatatcaataaatgagtcaagatttcaaggattgaaaaaaactgatagaatctagacttcataaagattctagtttacatcaagagtactgagagaactcaagacagtttctagttcacatctgctaaaagagaattcattcatctcctaggagagaatttccggatcatatataatattaaatgaaagagagttaaccataagaaatgaaaatatagcagtcctctcccattggttaattcttgaggaagattggatggaaaggaatcagggaggaagaaaaggcaggaagaagtaaagaaggaagggtgggaaaagcaaagataaaaagtccttgaacactgaataccttgattccacccaactttcaactggatacccagaaagaaaaagggctcagcatcttcttaccttaaattgtagagacagatttagtgctcctggccttagactccccattaaatatttaacagcttctacaataacaatcaattaatagcaggtagcccggaatttaaacataccttaaaaatgagctccgggtttgaagcagccacctcttcaatgtcgacgcccccctgggggctgcccaccagcacggggccattgcaggaccggtccatcagaattgccaggtaggtttctctggaaatatccaaggcttcagcaaccatcacctaccacattagtgggaaagtcaaattaattcagcattaagctgatttctacttggaaatctatacaaacttgctacacgaatcaaatggcttcattttcaggctcttacagcccagggagtgagtttgcagagctttgagagttctgctctcatggtgcacacaatgcccattttcacctccttaattttgatcccattaacttgttcgagtgacaggtatttcgtttgcctcaaggaaccttcccactttaatcttcttttttgtccttcctcaagaaactgtgtcacttaagaaataccctagagaagtggctgttattttaatttgagatattaacagtacacatatatattactacactgacttttctcagatttcactggtggaaaaccaagcatgattgccacagacggattcttttacagtatgtctgatgcttcatatgtttgtgtatttctgtctcttcgatcactatattttacttcattttatacttccttttaatttataaaaagaatatttgcttgttcaaaaataatgcaaacgataccaaaaatatataaatgagaaagtgaaagcagcttcctgctgcacagctctacctcaaataaaccctcgggccccaggagtcagggcagatacgagcctaccaggaacctccgtgataactagaaaaaggcaccccttcctctgggaatatgtggtcatttgccagggccatgactagacaggggacaagtgggatggaagaatgtcattcaattccacaagtgagtggggactcactgcctcagccaggtgtccttttgctctgtaggacttgaatttcatgtaacagccccaccaggaaaaaccactgctgacattctagtccttttctatgtatctgcaagcattgcagtaatggaataatcctacatgtggaagcacattatatacaacaggatgcctttcttttttttaatcttttttttttttaaaaaaagacagagtctcactctgtcactgaggctgtagtgcagtggcacgatctcagctccctacaacctctgcctccctgcaacctctgcctcccatgttcaagcaattctcatgcttcagcctcccgagtagctgggcttacaggtgcctgccaccatgcttggctaatttttgtatttttagtagagatggggattcaccatgttggccaggctggtcttgaactgctgacttcaagtatctacctgcctcagcctaccaaactgctgggattacagaggtaagccaccacgcctggcctcttttttaaaatcttaatactacaacttaaatatctttctaaggtcttctctcttcattgtgattacatggtatttatatgacaatatttatttaaccatgttcctgcatttatttatttatttatctatttatttatttgtttattcattttgagatggtcttgctgtgttgctctcaggctggagtgcaatggcacaatcgtggctcactgcagccttgacctcccaggttcaaacgaatctcctgagtagctgaaactacaggcacgtgcctccatagccacttaatttttgctttattttttgtagagatggggtcttgctatgttgcccaggctgatctcaaactcctggactcaagcaatacactcgcctaagattcccaaagtgttgggattacaggcatgagtcatggtgcctggcctgctgacagacatttacatgaacttcaattttcctaaaatgctactttagtgagtatttttgtacatgtatctttgttcatttcttttagtatccctgtagataagtatcctaaaagtgaaatgtctaggttttaaactgtgaatatttaaaatgttgataagtactgtcaaagtgcttgagagaggttgttccaacttacgcacctaacaagaacagtgaaagatatcttggatgtttaaagaatataaaaacaatcccataaataatcagtaatagatgtgaaaacaatgaaagcactaacattgcttttctttctttttttttttttttttgttgagacagagtctcgctctgtcgcccaggctggagtgcagtggcgcgatctcggctcactgcaagctctgcctaccagatttacgccattctcctgcctcagcctcccaagtagctgggactacaggtgcccgccaccacacccggctaatttttttgtattttttagtggagacggggtttcaccatgttagccagatggtctcaatctcctgacctcgtgatccgcccgcctcggcctcccaaagtgctgggattacaggcatgagccaccgtgcctggcctaattgttttgtatttttagtagagacggggtttcaccatggtctcaatctcctgacctcgtgattcgcccacctccgcctccaaagtgctcggattacaagtgtgagccaacgcacccggccacattgctttttttacaagtagtttagtgatgggttccacaaaaaaaagttacagattaagtagcattagattttaactactcagataccacaaaaacacttaagttttaggtcacatgaaatgggataaatatataatgatctaaaaagctataatggaatgaatatagaactcctctttttcaaacttttgttgaatttaccattagttaaaaataaaatatataggtcttcatattgatttatcagaaatggaagttcataagtatataaaaactgtttctcagcacatggtgttagaattagcacagaaccattctgatttcaagttggttgttctcaccaacaatgaaggtcaaaccatcagtcagtgcctaattctcccagtcttcaggttgcttgaaaccgtaaattctttcagaatttctgattgaggggtaggacaatatttgaagcaaaaatacttagccctattctttccttataaaatacagtaacaacttgtcgtttatagaaataacataaagtctgcctttctaagcatcaacattaatacaaacattttaagaaattaagataatcatttcttctaaaactttctctagaagagaaagctgttttaagaaatttgattggcacaaaatacaaaatgaggagtgtgtttggtatatgctttcaggtctactggcataatactgttcattttctaatgcagagttagtttagagaataatacttaatgactttcagtagttattcttagaggcaacacaaaattataactttttaggataagtgtcattcaagagtcctattcttaatcttcaaaaatgttgacagacgtgctctgtattccaccaaatttctatttgtgaagcccagctactgtctgaaacagctcttgcttcacaggaataatgcatgactctttaagaaaatgtcaccaggaaaatgataattatcaagagataattcaagaaattttatacaacaaagaccagtttgttgacatcgtcatgccttccaaatgaccgaggatgacagagtatattaggaagtgttacagagaaatctaaatggaatccacaaacactcatcccggagcaactccattagaaacatttcaaaagagcttcacctgtgagttacacaaagaatatgttgacacatcgtctttgtggagtccaccagtatagaaagctttttaactttctttgacctatctactgctgaatctgtttccttaaaaatatcatgctactggaattgtggtcaggagatgagtgctagcgtacaaactatttgtaacacacccatgaacagagaagattaaaagtacattctcgaattttaaattgattacagagcagtaaccactattggtactgaatcctggaccgcatgatgagtagcactgtctcacaggccctagtactagccccaggaatacataacacattggcacagacttagaaaacaaatatctgatgtgtataaatgtgtgtatgtgtttaaatagcttctgaaataaatttagaatcaaaaggttctataatctggggacttatacttttgagaagatggagtagacatgtttttccctattcttcccgctaagtacaaataaaagccttggacatatatatacataaaacttaaggtgactctgaaagttatagagaagaagggagactagctagggagcttgaggtccaaggaagcgtatggtagtgagtctcctatgttttctttggcctcataaatctcaggcagggtgctgggtgctagagaagccagcaacccaaaaacattaacaggcacagacaaataaatctccaggctcacatggtttcactagggaacttcaccaagcatttaaaaagaaatcaacaccaattaacaatgagcatgttggacactgaaattaagaatccaatgccacttgtaattgctttaaaagagaacaatgtatgtgtaagactgacaaaacatataccaaacgtatatgctgaaaacaatacaatgctgatgaaataaatcaaaggagacctaaaagaaggagagacatatcatactcatgggttgcaaggcttaacataacaaaaaaccaattccctccaaattcatatacaggtttaataagattcctatcaaaatcttagcaagattttttcgtaaagataaaattgttctagattgtacataaaaaggtataggaactagaacaggtaaaactgttttggaaaagaagaataaagtgacaagagttattctactcaatttcagaatttatataaatacagtaattaagactctgtgatattggtggcgggacagccacaaagatcaatggaacaaaacagagaaccccaaaacagacccaaagaaatatgcccagctgaattttgacaaagatgtaaaagcaattcaatggagaaaagataagccttttcaaaaaatggtgcaggagtaattgaatatcatagcccttttgccccttaaaaaataaccttgacctaagtctcacaacttattcaaaagtcaactcaaaatggatcacaaacctaaatataaaacataaaactataaaacatctagaaaaaaacatgagaaaatttttattatgtagggcaacgtaaagaggacttagacctgatactaaaaaggtataatccataaaggaaatattgacgtattggacttcatcaaaattaaacacttttgccctgcaaatgaccctgttgaaaaaatgaatatatacgttatatagtgtaacagataatacttacaaagcacatatccaacagtggactagtacctagaataactcaaaactcaatagtaaaaacataatctaattagaaaatggccaaaagaaatttgctttgtctcttcatgctgctgttacaaaatacctgagatttggtcatttataaaggacaaaaatatattgtttcacagttctggaggctgggaagtccaagatcagtgcaccgccatttagtgatatggcctttcttgcttcatcctcacatggcagaaagtggaaatgcaaaacaggtctaagctagttcccttcagcccttttataaagcactaccagggatgtccaatattttggcttccctgggccacaatggcataagaaggattgtcttgggccgcacataaaatacactaacactaacaatagctgagctaagaaactaaaattgcaaaaaaaatctcataatgtttagaaaggttacaaatttgtcttgggccactttcaaagccatcctgggatgcctgtggcctgtgggccgtgggttggacaagcctgcactaatccattcatgagggcagagccttcatgactaatcacttcccaaaaggctctgcctcttaatgcaaaccacaatggggattaaatttcaacatgcattttggagggagcattcagaccatagcatccatgaacagacaattcaccaaccacaatctacagatggcaaataagcacatgaaaagatgttcaacatctttagccattagggaaatgcaaattaaaatcacaatgaaatatcactacacacccataagaatggctaaaataataccaccaccaccaaatgcgggctagaatgtggagaaccctgaccacttacacattgctgatggcaatgtaaaatggaacagccatgctggaaaacattcatcagtttcttaaaaaaactaattatacaacttccacataacccaacaattatcccccaaaatgaagatttatatttataccaaaaacctgttcatgaatgtctagagtggctttatttgtaatagccaaaaacgaaccaacccagatgtctttcaacagatgatggttaaacaaactgtggtaggtacatccatatcatagattgctacatagcaagaaaaaggactgtaacgggattattacacattgtatgcctatatcaaaacatctcatgtaccttataaatatatacacctactatgtacccacaaaaattaacaaaagaaaatggaactaaatactgataaatacaacaacttaagagttttccacaaaactctccctgaaaagtaaaaacaggatgtcaccactgcagtgtcctgcagcatggtgcattggtagagaccactgatctgtgacgctatgtcaacagagcagacagctgccaccccaaaatgcaggaccctaattcgctgttaggacaggatcttctaaccatggatgcttttcagggctgacacatgtgatctgtgtagttgtaaagggatttaatgtttagctatagctgtcttgaaattttaacacgggtccctgcctttttatttggcactggattctgcaacccaggtagctagttctagtgtctggatacacaaaagggatggtgaaaggtagattggcaggagggagagttaggttctggtctcagctctaccactcacaatttcatgactgaggcaggccactttcctctgggctttattttctatgtgtggatgaggggtgtgtgtccacatgctatacatacttgggtacttcagctgaccttcctaatgcaatatacccccagcaataaaaatggctcaaaattacagtcatcctaaaataaggaatggggcatttagaaaaacaaccacaataggtaattctgacagacacgcctggggttgagggccactgtgtgggagcagcgaatgtccctcactgagtataaggctgtcacagcaagcgcttctcaactaaatagaatgcatctgtgttctcagagggaaagccattgctcggtcactcaccctcacccactttttgctaaatgctaatgataataaataatattactatcatagagccctttttatttctcctccaagacatactacttactaaacagattagatgagctttaaaaaataaaatggcacactgccaaagagcagtacttcattagattctgtcaaaaactgaaggatggttttcttttctattttttaacacatatatagaaaatgacccaaagtatccatattaccttgttaactttcacaccttcttttggagtttgttttgtcgctagattgtacccaatcatctgtttagccagctgtcccacaacattagggctaagagaaagagaaaacaagcagaaaatgaatgtttgttgaaaatcatttaaatgagagtccttacacagagcctcatgtctacactgcaaagggttcaccttcaccctcacaaaatccatgagtctttctgcttatgtgctgcgtgtttagcactgtactagaggctcactgagagcaaaataaaagtgagttcatgaatgaataaatgaaacaaaagatgctttgtgacctcttcacccaaaaaagttacagtcatagtaaagagagaatgctgaaatgcacaccagattcagataagggttgactgaagatccgacagtggaaaactggggagatattgaacaatgagagggaaaggaagagggtaaagatcaaagtaaatagtaaaaaggtgtgtgacaggaacagggaggagaggaaagtgttcagtgctaggagatgcaggagatgaagttgaaaagacaggctcaaataaaggaaggcttggactatcagaggggaggtaccccagatgccactggtaatggggagtcccttcaggtccttgaatagaggagtgacattatggaagtagcatttcagttggaagtggtatcatttccaacatttatgatgaatcattgattgtttaggacagaaggactgtcaagttttcaccaattagtaagaaaaatcattttgtgggggcagaaggaaaactagggcactgccagagccctctacctatgatttcagtttcttctagttgctttggcccgctcctaccccaccacaaccaacctcagtgtgcctttcaatcttgagcaagatcttccataactgcttggccaaaagacaaggaataacaacctccagacttactcttttgttaaatgaacacctcctttcaaaccactattgaagacaccttttcctcttcctccagctaagatctgggcttttaaaacaatttcttttgcatctgaaaaagaaaaatccagagttggtagctgattttaaattctttttttgttttttaagcaataaggaaagcaataatggcacataacttccaagtaactggtaaaagctctctcaaactaactttgaaaataaatgcaatgaagaacttcaaaaaaacatctatgagcctaaatacaaagcttgtttactgaggatattcaaatgcttcctaccagtttaatcatctaatacttgaccttcccaagggaaagcaagacatgtgttcccttgctcttttgagtgtgtcagaagaagctaaataaatcctggaaggaggtattaattttactgtgtaatggcactcccatgtggcagaggcaccagttggccagtaagaggagctaaccatcagagatgtcaaagggaagactggattatgcgggggaaggtttaaagacaagacacaaaggtcatagttaataactgcattattggaaaccaacagttttctgagcagttgttctatatactgatagggttgggaaagggaggaggaaatggattaaaactaaaagcaagcaatattttaaaatcattggcaaggtaacaaaatatcctgggggaaagtggttgtggaatctttgtttctcatcacactccacgaatgaaagaactctctaatcttgactttttagacgagagttattaacacaaatatcttcccttgcagggaagttgggtgcatgaagtagcccagtgacaaatggggcctttagcaaacagggtagctcccctccccaaccaccaaaacaaaacaaaacaacaacaaacaaaaaactgcctccaaatcaaatatgtttaataaaccaaatagcacacaactgcagaccacagctgatatcctctgtttgtgagtcatctttatttaaaatcacagaacccagctgatcccctataaggccatgagagtattctggttcagtataccagatttagaatctgcaaacccaggtttcaatctggccttcatccctcacccagctgtgtgacattaggcaagttacttaatgtctctgaaactcggtttattcaactgtgaaatgatgacaagggttgttttaaaaattaaatgaacacacatgaatgctttatcccagagcctgaaaacttgtgattaattaaaaactattgcctcgaccagttagttcatttattacctttgtatattgtaaagaatgaaaggaatcattacagagatggctaaaccaaaaaactaacaagcgctccattaagtttggttatttcagctattactgtcactgtcatcatcattgttacccacaggcaagcaggtaaaggttcaaacggaaagagctgtggaaggttttatcatcaaggcaatggggagctacagaagtattttacagaaggcattcagccagctgatgtcacaccattgaggctccttcactgccttcattggttagtcttcttgtctcctatatttgcttacactcagaaagctgaagcccaccttcttctcagaagcaaacacagttttttcttagaaggctgtcctgtgtaccctctggcaataatttctgccctggatacgaaccatcacaacattggtcaagccctgtcttataataaactggtttccatcaagctgagtagaagacaaattaattgtcagaaactcacaaggaaagcaaccaagtaaaatgaatacattgcatatttagcttactgcaagaacagtagtaagagcaaggatattggagttaaacagacctggttaaaatctccaactctacctatcactttctttgtagagaagaaacaactgagattcagaaaggtaaaagtagcatgcccttctgtaaagtagtcatattaaagaagtctacagtgtaaggatgatgtgaagaataaatgaaatacagtaaagtgcctggcacatttttttaaagtcaaaatatgatagctatcaacattataataattttcagcaattaagaaaaaatggcacacaggaagacatttcctgtttttctttggaagacatcaagtggaaaaaatactttttgctgtctactcaaatttttaattgtgatcacttcaaattctttacataactggcattccattgccattatcatttttcatatccttgtcatcctgaagagatgctttcctctctgagctttccagcagcaaaacttgaaagccagagagaatacctaattgggcattgttaattggcactacataggcttgattagatcagctttagtcactaaccatcaagacacagaaagagttgtatcctcaatgaagtgttgtcaattaaacgtgtcgccatttgacctccagtcaaagtattccatgcaaaacagtgttggtagaacaagcaaccagttcagagactatgaaaccagagatcaggacaaatagaaaaagacaacaacctacgcacatctgcaacatacaccccaggccaaaaatgagttcactaaaatcatctcttctgattacatctcaagtgctaaatcaatatagtaagtcagcaagtcagcagcccaaagtaaagcaagtttttctcatcttgagaaaaactctcatgaagtaatttaattcaaggcttatttactcaaggtgctgaaaattaagatgacaaatcccactcaacagtaactcgtctcttcattcagtatttaccaaattgattcacatgtactaaatgtcactgtttctatttatttaaagatctgatctctcccaaaactcaaatttctgtttttatttaacattgcctcttgccccaatcctgaacggtattagaaaagaaaaaaaaatcccatatatgaaatgcaatttttgtctgaataagacgacttaaccatcctttagaaaaacaagctaaaaggacagaggaaaaaattaactctaatatgagttggggttttatttttgttttttgttttagacagagtctcactttgtcacccaggctggagtgcagtggtgtgatcttggcccactgcaacctctgcctcccgggttcaagcggttctcctgcctcagccttctgagtagctggggttacaggcacatgccaccatgcccagctaattttttgtatttttagcagagatgaggtttcccatgttgctccagctggtctcaaactcctgagctcaggcaatctgcccacctcagcctcccaaagtgctaggattacaggcataaaatagattttatatagaagtagacaacaacctagacattgataattatattattggactctgagttggtataacttgggtctggataactccaaagtctttgctcttaattgctatttttatacgcagtagcctaagtatgcaacgtcttcactaaattttgttcctttcttagtgagtttctgaaaataaccagtactcatggttaggttttcactcagtttaataggaaccagtttattagaatttacatatattttagtagaaaacactgtaagacatatctgacaaacttataaatatgtaagactctcaaacacagtatcacttaagagaacaatatttagagcgatttaaaaagtctaagcaaaaccttactctgtggtctttttttagtctatcagctgaattataacaatgcttttacaaatattttcttttcattctttaccacaagtgttattctaattataatgcagttttatagcaatttttatagatccccaatagtcacatgctagataataaacattcttggaagcagtaggtctaaagggaaaaaaatcaaatcattaagaaaagcataatctaaatagaatacacatttttaattaagcaagctttgtaaaatgtggttcacttaattttcttagagatggctttctgaaaacatatttacacaaagtaatgctcacaagacatatttcagagccataataggaatcatagtaaatgtctgaaatgttaatcaaatatattgacaaaagtaagttattttcaactattttttaaaaacagttcagtgatgagtcaactatttgtgttactgagctggtttttattcagcattgctcttttctaaattataatactttcctaaatgctaaatgtatcactgatactgcaatgagatgactactacaatgatcatctatttggagtcaataatattggacttgcagaaactgatttctgtggttcactgactggagcaaaattggaatatccagttctcagcacaactgcatcgtgtaatatgtagcatggcaatcaccttccctgagagttgatagaattcctaattgagaaagttaaattgtatttcagaatttcagatttacctattaccagaaggcaaggagaaggcaaagtggaaggcaagagaagagtcaaaaggtattgtgtaaagatgaactttaataaagaatatacaattatatagagataagttagaggccttggtgccaatttctcaaaggaaatgagctcacttctatgtttgcgttacgacttcagaacccaaacataaaaatagagagttaccaatcttcaatcattactatgatatcacctatagaatgacacatatttcctcaagttgtaactgggtcaatgggaataagatgatactgtaataattctccatatgtcaaaaggcatctttgagactgaaataattatttcagctttcaacatgtctgacatggacttttcaaatttgggacagagagtttcaaacacacagcacattagaataaaccatttcaccattggtcacatcatttgactgaatgagactggagatacatggctctccagtagactgctgcccatcagagatttgaatcgtgtatgtctaaaacagccactttcaagtataagtacaagacagaaatagaaccatctccaggacaaggattttatgatacaaataggaagttatccagggagatattatttcaaatcaagaaattcttgactgataaggctttcatgtaagttttaaatctaaaacttccctttgaatatgattccctattatgaaaaaaaatcctttctttggatactgtgggggcatgataaagccattttgaagagtttgattatttaaaaatgataatatcttaacaaaaaatgtatttatgctttcgacggaataattttaattttagtccctataaaaattcctaaattaaagtttattaaatcacagttttttcatatttgccatatgcttaaaaatattgtatatttattactatattatgggccacattaaaatctgtaatataaattaggctactcctctgatcttgtcactaatcttacttactgctttcataaccgttaatacacattttgttggtgataaaatttttaaaggtaaataaaaattatctctagaaaaacccaattcagttgtaacatcttactattctcagtaaaagatacaatcttgctcttttcatgtagtttaatactagtaagccaatcttacattgtgtcaattatattaaaagatatatttctacaaaaaagccttaggacagaactccctaacactgatggcaaaaaaaaaaaaaaaaaaaaaaaaaaaaaaaatgcccatgtgacatcattcaacacctgtaactaattaaagaatttctaacattgtaagaatgaaaccacaggacattaaacaaatcttttgcaaatgaagccacttgaagaaatgacagtttttcagaaaaatacaagtttcttcaaaagaacaaacttccagaagaaatctctactgattaattacaggacaaagcaatcctattatgatatacattgacagtaaaaatacctgtgtaacacttgtaatttcaagaggtgctggaaacagtcatggaagatgaaaagcatttatgaaagccaaaagtatttctactgtattatgtgtatgtatttaaaggaagttaaggaaaactagctataaaaaaatcatgtctccccctgattttcaaacgaaagatgtgagtcagccagggttcaattaaggaggcagaactactatgacttatagacaagggatttattataggaatcgaagcttgcacacttacaagaggagctgagaaaaggcacgtctaaaagtgaggttggagggtcctaggagtccccagccagccaagcagaggaatcagcacctccagatggagaagtggatggcaaaggaggagctggggaaaaggacttgggacttgctgccaagtgctacagtttggatgcttgtccccacaaaatctctcgttgaaatctgacctccagtgttggaggacaggcctaatgggaggtgcttgggtcacgggagacgatcccttatgaatagattacctggaacttaaaagaaaattaaatttaaaaataaataaataaatgaattacccatcctcaggtactcttttacagcaacactaaatagactaagacaccaagcatctcaggatgggcctgggtccatatggctcagcaggatcagcacttgggacaaacagctggacacaatgcagagaagagcaagaaaaggctggagcctcttgctaacatctccacatctgtctgtcactacctaatcacaatgaactgcagggagtaatcacaaattctgtgcaaactcctcttttagtcaactcaaacccaaaactacacagggaaggggattctggaaaacgcagttccagctaaacaaggtgacacagtacaagtcatcacacctgatagctataacatctgacagcagagcccacaagtgttgcgggttgaaaatgaacagctctgaaacgtttctgagttgcttgagaatccacctctcctttagttgcatattattgaaggctacttgacattaaggggattctctcgtcgaccataaccagtgatgaggaagggaagaacaaaaggtggcaacagccagaacagctcttggtgtgcacacactcatatcctgctggtggaacataaactcatgaaggtttcattttcagagccaattggaatgaccatgaaatttaaaatgtatgcaatatatacactgtctggctgcacctatatttaaagatgttcgtttcacttttacagcaatattactaatttcagagatcatctaccttcttgaatagaaatcttgtattttccttattttctgttatttaaatctgttcctctctcagaccctcctccattggtgataggcgccctcacaggcaatcacaactactgtccagaatctttgccctgctgtctgttcactgccatcattcactgcctatggtctctggaccatactcctgccagttttcacactaaacctgagacctctgtgcctgcaaatcaccaagccctgctgcccagtcgtcttcttctcatttagacacatcatccatcaggaacccttcacctctccaacctgttctgctctttagaggaactcattctccagacagccaatgcagactgaaatcaaactccctctcacagactcctgagcccagtacaaatcaaggattcaggctgggcaacttatttcatacagctgaaaaatgcacaacagttaaaaagtacctggaatctttgaaggcaattaggagggccatctgcttagggctcacagaaaatcctttgatagcgcaatcctacttccatgaaaattgacaagagaactaaagattttcattgcaatgtagttataatagtgaaaaaactagaaataatccaaatgtccaccaacatttggacactattgggaaaataaattttatgtatccaaataatgaaacaataaaacaccatatgtacagtcattaacaataattaagtatactttttaaaattatactttaggttctgggatatatatgcagagcctgctggtttgttacataggtatacatgagcaatggtggtttgctgcacccatcaaccagtcatctaccttagatatttctcctaattttctgttatttaaatccgttcccctctcagaccctcccctacccccaacccaccgacaggccccagtgtgtgatgttcccctccctgtgtccatgtgttctcattgctcaactcccacttatgagtgagtacatgcactgtgtggtttactgttcctgtgttactttgctgagaatgattgtttccagcttcatccatgtccctgaaaaggacatgaactcatccttttttatggctgcatagtattccataatttatatgtgccacattttctttattcagcctatcactgatgggcatttgggttggttccaagtctttgctattgtgcacagtgccgaaataaacatacgtgtgcatgtgtctatatagtagaatgatttataatcctttgggtatacgcccagtaatgggattgcttggtcaaatggcaatttctagttctagatccttgaggaatcgccacactctcttctacaatggttgaactaatttacactcccatcaacagtgtagaagtgttcctatttctccacatcctctccagcatctattatttcctgactttttaatggttgccattctaactggcgtgagatgatatctcattgtggttttgatttgcatttctctaaagaccagtgatgataagctttttttcatgtttgttggccacataaacatcttcttttgagaagtgtctgttcatatccttcacccactttttgatgggtttgttttcttctttcttgtaaatttgtttaagttccttgcagattctggatattagccctttgtcagatggatagactgcaaaaaatgttctcccactctgtaggctgcctgttcactcggatggtagtttcttttgctgtacagaagctctttagtttaattagagcccatttttcaattttggcttttgttgctattgctttggcgttttagtcatgaagtctctgcccatgcctatgtcctgaatggtattgcctaggctttcttgtagggttttgatcgttttaggtcttatgtttaagtctttactccatcttgagttaatttttgtgtaaggcgtaaggaaggggtccagtttcagttttctgcatatggcttaccaattttcccaacaccctttaggaagagggaattctttccccattgtttgtatttgtcaggtttgtcaaaaatcagatggttgtagatgtgtggtgttatttcggaggcctctgttggtctatatctctgttttcgtaccagtaccatgctgttttggttcctgtagccttgtagtgcagtttgaagtcaggtagagtgatgccttcagctttgttctttttgcttaggattgtctttgttttaggggccctttcctggttccatatgaaagttaaagtagtttttactaattctctgaagaaagtcaatggtagcttcatggggatagcattcaatctataaattactttgggcagtatggccattttcacaatattgattcttcctatccataagcatggaatgtttttccatttgtttgtatcctctcttatttccttgagcagtggtttgtagtcctccttgaagaggtccttcacaaaccttgtagttgtatatctaggtattttattccctttgtagcaattgtgaatgtgagttcactcatgatttggctctttgtttgtctattaatggtgtataggaatgcttgtgatttttgcacattgactttgtatcctgagacttcgctgaagttccttatcagcttaagggaattttgggcagagacgatggggttttctaaatatacaatcatgtcatctgcaaacagagacaatctgacttcctctcttcctatttgaataccttttatttccttcccttgcctgattgtcctggccacatcttctaatactatgttgaataggagtggtgagagagggcatccttgtcttgtgccaattttcaaaggaaatgcttcctgcttttgcccattcaatatgatattggctgtgggtttttcataaacagatcttattattttgagatatgttccatcaatacctagtttattgagagtttttagcacgaaccggtgttgatttttatcaaaggccttttctgcatctattgagataatcatgtggtttttgtctttggttctgtttatgtgatggattatgttaattgatttgtgtatgttgaaccagcttggcatcccagggatgaagcctacttcatcgtggtggataagctttttgttgtgctgctgaattcggtttgccagtattttattgaggattttagcatcgatgttcatcagggatgttggcctgaaattttctttttttgttgtgtctctgccaggttttggtatcaggatgatgctggcatcataaaatgagttagggacgagtccctccttttctattgtttggaatagtttcagaaggaatggtaccagctcctctttgtacctacggcagaagtcagctgtgaatccatcttgtcctaggctttttttggttggtaggctattaattactgcctcaatttcagaacttgttattggtatattcagggattcaagttcttcctggtttagtcatgggaaggtgtatgtgaccaggaattcatccatttcttccagactttctagtttatttgcacagaggtgtttatagtattctctgactttagtttgtatttctgtgggatcagtggtgatatcccctttatcattttttattgtgtctatttgattcttctctctttttttattagtctggctagcagactatctattttgttagccttttcaaaaaaaacagctcccggattcattgatttttttaagggcttttcgtgtctccatctccttcagttctgctctgatcttagttatttcttgtcttctgcttgcttttgaatttgtttgctgttgcttctctagttcttttaattgtgatgttagggtgtcgattttagctctttcttgctttctcctgtgggcatttagtgctataaatttctctctaaacactcactgccttagctgtgtcccagaaattctggtacgttgtgtctttgttctcattggtttcaaagaacttatttatccactggcttgaaattcacaccgccagcacatcagtctgaagtccacctggggtgcttggtgggaggaggggcatctgccattactgaggcttgagtaggtggttttcccctagtagtataaacaaagctgcttggaagttctgactgggcagagcccaccgcagcgtggcaaagtcactgtagccagactgcctgtctagattcctcctctctgggcagggcatctctgaaagcaaggcagcagccccagtcagggacttatagatcaaactcccatctccctgggatagagcacctgccagaaggggcggctgtgggcacagcttcagcaaacttaaaagttcctgcctcccggctctgaatagagcagtggatctcccagcacactgctggagctgtgctaagggacagactgcctcctctagtgggtccctgatccctgtgcccccttactgggagacacctccagcaggggtcgacagacacctcatacaggagagctccggctggcatctggggggtgcccctctgggacaaagcttccagaggaaggaacacacagcagtctttgctgttctgcatcctccactagtgatactcaggcaaacaggttctgtagtggaccgccagcaaattccagcagaaatgtagactgtagcagaggggactgactgttagaagaaaaactaacaaacagaaaggaatagtataaacatcaacaacagggacatccactcagaaatcccatccaaaggtgaccaacatcaaagaccaaagttagataaatccacgaagataaggaagaaccagtacaaaaaggctgaaaattccaaaaaccagaacacctcttttccttcaaaggatcacaactccttgccaccaagggaaaaaaactggatgaagaatgagtttgatgaattgacagaagtaggtttcagaaggtgggtattaacaaactcctctgaactaaagaagcacgttataacccagtgcaaagaagctaagaaccttgagaaaaggttagatgaattgctaactagaataaccagttttgagaagaacataaatgacctaatggagctgaaggatacacaagtatcaatagctagatcgatcaagtggaagaaaggatatcagagattgaagatcaactcaatgaagattacagaaaaaagagtgaaaagcaacaaacaaagcctccaaaaaatatgggactacgtaaaaagaccaaacctacgtttgattggtgtacctgaaactgacagggagaatggaaccaagttggaaaacactcttcaggatgttatccaggaatacttccccaacctagcaaggcaggccaaaattcaaattcaagaaatacagagaacaccacaaagatactccttgagaagagcaaccccaagacacataattgtcagattcaccaaggttgaaatgaaggaaaaaatgttaagggcagccagagagaaaagtcgggttacccacaaagagaagcccatcagactaacagtggatctctctgcagaaaccctgtaagctagaacagagaggccaatattcaacattctttttctttttttttttttgagacggagttttgctcttgttgcccaggctggagtgcaatggtacaatcttggctcgctgcaacctcctcctcctgggttcaagcagttctcctgcctcagcctcccaagtagctgagctgggattacaggcatgcaccaccacacctggctaattttgtattttttagtagagacggggtttctccatgtaggtcaggttggtctcaaactcccaacctcaggtgatccacccacctcagcctcccaaagtgctgggattacaggcgtgagccaccatgcccggccctcaacattcttaaagaaaagaattttcaacccagaatttcatatccagccaaactaagtttcataaacgaaggagaaataaaatcctttacagagaagtaaatgctgagagattttgttaccaccaggcctgccttacaagagctcctgaaggaagcactaaatatggaaagcaaaaacccggaacagccactgcaaaaacataccaaattgtaaagaccatcaacactatgaagaaactgcatcaactaacgggcaaaataaccagctagcatcataacaacaggatcaaattcacacaaaacaatattaaccttaaatgtaaatgaggtaaatgccccaattaaaagacacaggctggcacactggataaagagtcaagacccatcagtgtgctgtattcaggagacccgtctcacgtgcaaataggctcaaaataaagggatggaggaatatttaccaagcaaatggaaagcaaacaaaagcaggggttgtaatcctagtctggggtaaaacagactttaaactaacaaagatcaaaagagacaaagaagggcattacataatgataaagggaccaatgcaacaagaagagctaaccatcctcaatatatatgcacccaaaacaagagcacccagatgcataaagcaaatgcttagagacctacaaagacacttggactcccacacaataatagtgggagactttaacatcccactgtcaatattaggtcaatgagacagaaaattaacaaggatattcaggacttgaactcagctttggaccaagcagacctaatagacatctacagaactctccacccccaatcaacagaatatacattcttctcaccaccacattgtacttattccaaaactgaccacataattggaagtaaaacattcctcagcaaatgcaaaagaatggaaatcataacagtgtctcagaccacagtgcaatcaaattagaactcaggagtaagaaactcactcaaaatcacacaactacatggaaattcaacaacctgctccggaatgactactggataaattaagtatatttttaagtgtaaatgtcagaaaatgcccatgcacaaactaagctttaagctgaccttaatgactagcattttttaaaaaatacacctgtaaacagttacatagtcgtaataaaatctaaataaccaaggttgggtgtggtggctcatgcctgtaagccactttgtgaggccgaggcaggtgggttgatttgggaggctgagacaggtgggttgcttgagcccaggagttcgagacaagcctgggcaacatggtgaaaccctgtctctacaaaaagtacaaaaattagcctggcatagtggcatacctgtagtccaagctactcaggaggctgaggtgggaggatcccttgagcccaggaggttgcggctgcagtgagccatgattatgtcactgcactctagtgtgggcaaaagagtgagaccctgtctcaaaaacaaataaataaatgagcaacaaccaaactattaactgaggttaccttaagtggctagggagtagtattatgggtacaacattatatcttttctatgttgacttaattattttgcaattatgtgtcagaaaaataaaaagagtttaaaagctgtgaattaaatgtgggcagttaattcatagtagtttgtcttgaatatttaaatactcatttctgtatcagcctttaccattttaccacatggggtcggggtgtttatatttgaggaagcctctagaagatatcttaaggacacatggctgaataccttataacatgacctcctaaagagtcacgcaagaaaactgggagtggcaggaaaatgttttgcccttttaaaatattagtgagcacttacttattctatgggaattcaaaaaatttttttaaatgtcatggtcattgccttttgtaaacttaaaattgactggaagaaatagacacaaacaaattactgaaaatttttaatttataataagcattaagaagcaaattaggaaggggaaatggtgtcaagtaaagctgagaaggaaaaaggacggaagaactattgatatggtttggctctgtgtccccacccaaatgtcatctcaaattgtaatcccctgttgtgaagggagggacctagtgggaggtgattggatcatggggatgatttcctccatgctgttctcatgatagtgggtaagttcttacaagatatgatggtttaaaagtggcactccccacttcactctctttctctcctcccagcttgtgaagaaagtgcttgcttccccttcgccttccaccatgattgtaagtttcctgaggcctccccagccacgcggaactgtgagtcaattaaacctctttcctttataaattactagtctcagggaagcagtgtgagaatggaccaatacagctataaagagaagagtacttggccaacgtcatgaggaagagctgtgagacttctaggaagatgggactggagagcaaggacatggagtgaaaaacaactaaaaaaaggctactttgcttttctatttatttctgtttggctttcatggtttgctgtttaaactagaaatcactatagcaccacttcaaataaagcagcaaatcatgccaggatcctgcactataaatcattcaaatttgctatttcagatattcagaaaacttctacagattaaagtttatttccctatgttcaagaacagcatataaatagaaaatacattgatcatctttgttaaatttagatattttaccccaaatacttttaagagctctaataattttatcatgccagtctcaaaacagctcccaaccaggtaagctaactctcagataaaacagcccccagccaggtaagctaactctcctataaaagttcctcaaggggtcagtgagattcatactaagcattatttagtagcaacaataataaagtatacgctcccctcctcccatcctgcaaagaaacacatattccatactttaaatctgctataattccaaatgctagagatacagaattccagacaacagcttgatgttgttgccataaaaaggaatccaggaggcatttgtcttcaattttaaagtttgtaaagtggtcaatgacatgctggagttaagcagaagccaggaatgacctaccccaagagagatgaaagatctcagaaccactttcccatgatacacacatctactgaggtccagcataactgttatgctgctttcaaattgcactgagttttaaattgcaatgtcttgctcttttattgcctgtcttgatgcattcattgtttttgaaatctaagtctattgctcgaatgttaaacacagaggggactttagattacatcctggaggatgaaactgagcagtatcaatgaacttggaagagtttatatttggctttcaagggttgtgaaggcctgagaaatagctatttccttttctctttatgccactttctttggtttcctccttctctccttccctgcctcatgctttcttcctttctccctcctccctcctttcctctctccttttcattcttccttttcccacctgcttccctgcaatacttccaagttatttaatttgcatgtttgactatatctcagataactaatttcagttccagcagccagagagatccacatttacttcaaattctaccctccattacactctcccacagaaccactcccaaataagaatgtatccacttaaatccctgtgaattggaacactcattatcaatgtgctacacctaaccacagaagccataaaacctgaacctactttcttggactgttttcaaaacgacatttctgattatatgtgagcattcaaatctcttctggcactttctgcatcttatttttcaatgcctggcttgagctagaattcatactgggggaagtcaggccaagtgttataaatgggaaatgagggaattaacaagctggtataaattttacttcttggagtaaaagaatacaaaattttttgacttgagtttggaattataccacccaagacagcacaggaaaatacttaagagctagcatccatatctggtaaaactgaaataaaatttggcagcttttaagtagttctccaatggtattagtgtggcacagaaatcaagtcctgtttcatatgaaccaagcagtcctacaggaggataccctttgaaattccaatcattacaagaaatttgcactaatgattcatatttcaggccgggcagggtggctcacacctgtaatcccagcactttgggaggccaaggcaggtggatcacttgaggccaggagttcgagaccagcctggccaacatggtgaaaccccgtctctactaaaaatacaaaaattagccgggcgtggtagcacacgcctataatcccagctactcgggagactgaggcagaagaatagctggaaccggggaggtggaggttgcagcgagccgagattgtgccactgcactccagcctgggccacagagtaagactctgtctcaaaacaaacaaacaaaattagctgagcatggtggcaggtgcctgtaatcccagctacttgggaggctgaggcaggagaattgctggaaccggggaggcagaggttgcagcgagctgagattgtaccactgcactccagcctgggttacagagtgagactccatcccaaaaaataaacaaacaaaaaagattcatattgcatcatcacagctggaaagctagcatataagtctattcctcctatccacacacagcttgctaatatggctaatgttttttctatacccccacattctctgctatggtctgaatgtttgggtctcttgtaccccaaaattcataagttgatatcctaacccccaggtgatagtactgggaggtgggggcagagacctcctgcatgggattagtgcccttctaaatgggaccccagagagttccctcatcccttctaccacgtgaggacacagctagaaggcaatatgtgttaaggagaaagcaggctcgcctcagacactgcatcagccttggtcttagacttcccagcccctaaagctatgagaaacaaatttctgttgtttataggccacccagtctctggtatttccttacggcagccagaatgaactaagatactccctgaacacatagtgttttactctattttctactttagttttcagcaacatggacatccagaagtaaacaatacatctatagaattacctgaaatactctccttcgtcctcaagcactggtgcccttaaatccagctgcagcctcttccaggttcctgaccctttctcattgcctcccagcaggaggtggaacagtctgtcataatgcataaacatgatttgactgtggggagggggcagatcttgctaccctagaagaatttcccaggatacctgtccaaaaagctaaaaacagaataactccagaaaagaagatgtcctagccttatgcaaagggaacaattttcacgaatcaactaaattaacactgacttgggaatgctaccaagtctaacaaagcagatgccacctctcctctgaaggcccttggagttcaaaggagatgctacagcaagggggatccatgaagccagggagagattctgtcaaacctaatgaagccactctccagttttgctaatcacaccccttacaccgcctccagtatgaaagtttctaccgaaggacgacacagcatgatgcaaaacaaaatcgcctcattctcctgaaaatgaccagtaccaggcacatagcaggccctcagcatacggtcattcattcacaatcatcacttcctttactctatgaaatcataatcacagtgtttgctaggagcttactgaaaaataagatttgtgctgagcgtattcactatttctatttagcaaatgacccaattgaagttaagggagtttcctggagtcatacagctaggaagaaacagagttgagatttttaagccagaaagattatttgagagactgtgctttaacttcctcacatagagccttattactgatttttccccaatgttctattattaaaatttccaatcacatagaaatgtcaaatgactagtaaatatccacatataacctagatctacaactgttcacattttgtacatgtgctttgtcacatctctcaatccagcacaacccatcttattttttcatgcaattcagagtaagttccgtgcatcagtacagttaaactcttcagtatccatatcagttattagagtttaaaaatattagagtttaaaaatattaatttataataaacattaagaaccaaataaggtacagttcctttggggaagaggtaaaatttaatttcagtgaaatacccaaatctcatgtgtaccaatcaataagttttaacaaatgcatatacttgtatgactcaattcccaaatcaataaatctattattgtttctgagaacatattacaagagtatccttaggacaaatgagcgaaaatattgacaatagggatcacaagtctcttcctaaatacttactgagactaagcataacaaaatatttaatttatacaccttagcacaaagcgcaatgtccaatgcctggcctacaagaggcacccaacaggtatgagactatccaaaggcgtataaaaaaggaatcagcttcccccattaccacttccaaatcagaatactgcttgaaacactcctaaatcagtcacagtcaattatatgcaaaatactgagttcaaatgggaattttttttaagccatgaacatagtaactctttagaaatagaaacaattcattatttatatataagttttttatagtaatgatgttgtgtaagctcagtggaaattatcaaaaatagctgcatccacaagtttccttgcaccacgcttgcccaagtatttctgtgtggctcttccattttcaacaagggattgaattttcctggaaatacttgcaacctccagaaaagccaggatgatacctggagcttaagactgatacttaagcaatgaagtgacgaaaacgactatctttaaccaaaagcttttctacgctatcaatgtcactgtcacctgcctgaagcttaacatcatgggactccagacttttgataagcctgcaggatttttgaaaggaaaccaccagaaagtacttagaagataaaagccaaaacatatctgtggtacaaactagagtacattactttttgcaaactttagaaaatatagacacaaatgtctaaacaaagtctgaaatgatattaatataaagcccacatcaacagtggttatctatagggaataggggttgatctttacctccttctttatagttttgttataatctgcgttctttacaatgactatttataatgagagaaaaactattttcaaatttaaataaaagatgtttctttgacctggtaagaggagtaacagtacattgttatgagggggaaaagcttagcatagtgcaaaatatataccactaaatatatgtacatatacaaatctataactgaggataaatctggaatgaaatatgccaagatattaactctgattactggtagagaaaggttgtaatggataaattttttcttttttttttaaactgcaaatttgctacaaggaacgtatattgtatctgcaaatggggaaaatgacagttatttttaaataagcttattacgtattagattaaatcagctgcctgagatgtgtacacagacaccattcagctctactgggcttaaaccacttcttcatttcatgggaggagtgactcaaaataaagtaacgggcaaaattgacacttctgaattcagctgctaatcctctgattgaacaccagccgtattcttccctgggcctggggcacatacatctgcacttgccagaattagctgacctgctccatgcgggtaacatgattggtctctgtgagactcaggccacattactgcatctcaagtcattgactcctttcgtgaagcagaaaggggtgatgcactctcttgaggtgtcccccaacaccaacatctaagatctataaacaggattgttaacacatcttccttttttttgttttttcttttttccttgagacagggtctcactctatcacccaggctggggtacagtgaaatgatcatggctcactgcagcctcgaactcccgggttcaagtgatcctccctcagcctcccaagtaactgggagtagctgagaacacaagtgcacaccaccatgcctggaaattttttttgttttttatagagatggggttttgccatgtggtccaggctggcctcaaactcctggacttaagcctcccaagtgctggggttataggtgtcagccatcacacccagccaaaccgtctcctttctgtgtacatctgtcttaccaagtttaccatctgtcttaaatttctcctaaagaagataccttaccagagataattaggtgcagtggataagttcatgagctgcaggccagatggccttggattagaactcacgctttgtccccttctaggggtctgagcggctttggccaagtgaatagagccttgattttcttatctacaaaatgaagctgataataaaagtgcttacgtttaagagttactatgagtattaaacggggggtgggggcaggggcggcggcagaaatgcatggaaaatacttaacacaatacttggtgtatactggcttatacttatacatatcaagtaaatggtagatgataatgataaatatgttgcctattgggcaaaataatttttgtaataagtaatctattactgacttttgccaagtgttaagaatatataaaacactcacgtcttgtattttttgcaagtattcagaaataagtaaaatgtgctcatggttgatgagatggttgatgagacagtacaaagttaaaaagggttagatgccttcaaaagctgcccaaattctaaagacatttagtactgccctgccaccttctgatggactaatgcttttatgtgtaaaatgagtacctctggatccttgataggattcgcctgctacaaatgcacaccatgtttttatttatgttttgatagtttgttttgacccaaggcctgtgtcttgtcttgcttttcgatagtctcccttttgatatccatggctgccgctagtgctggtggccttggaaatccaccacattttctggcagagaacacaacacttgattccgtctggagctgctcaactttgggcctcattagcaggctgaggcttatatcagcacagcacatccctcccccaacatcgatgcagggactgatccagccctgtggcagcctgggagggagggaaaatgagctgggaagcaaccagacactgaagcttggctggcgttttgtggagcagagtgagcatacacagctatctgtccttcagtgccattactgatgttgccattattgttactataatggttgggactgttgttctgtgtcttaaggagaccacatactcaccactggctatgcaccaggagctattcaaaggacattacaaacctcacctcgtttatcttcacagcagtcctctacatgaggaaacttaagaaataaagtcacttgcccaatatcacacagctgtcaactccagagcacaagatccagccagagctgaaaccttatccacaccaccttagtatggtgctaagaggccacccacaactctcacctattcaagctcaggtgaatataagaagttggtgggaacatgatgtgacagtggtcagcaagaagccacgccacccagtatcaaatatgaccagaactcctgatgatggcttctggggaaactgactgtcaattaaaatggagaaaacacttgcactccagcctgggcaacagagcaaaactccatctcaaaaaaaaaaaaaaaaaaaagaaaaaagaaaaaatggggaaaacacaatgacccaataatagcaaaacaaaaacctttcctttcaagctatatgaaaggctgtgcccatcacgtatctcacatgtattaatggcttcaaggacaattccttttactgtctatttaaccaaacatttttgtgacttaatataccaaattataataaaacaaggcccactctattggtgtattcatgtagtacttttattatgcatgtaaaaaaagacagtagtctgaattgatgaggtacaaaagtcagagagcaattctgcaaagtaaaggcaatactggctggtcttaacttctctgcaacactgttactgcagacatggatgtctataacataggaatacgagaacgtggatttgagttcagtagtctagcattagattttgtggattgccattccagttcaactctttctacttagctgtgtaaaactggataagtcacttaacctccataaacctcagtttcttcatctgcaaaacagagtataacaataaatatctcatggtttattgggagaattcaaggatgcaatctatgtaaagactttgcacaatgtctggcaacatttcaagtgactgataaatgtaaactactgtgtgttttataccttaaattatctgatttggccccaaatcatttgtaagctatttcagcagtctcatcatctttctttaaaaaatgcaactgttgtctgaacacctgttaggtgataagaaatatactgaatgctttgtatgtgtattacttctaatccacccactaatcacataatttagaaattattgtcatcaattaattgttaaaaacaccagaattcaacagacagtaagacagcccatgctttttctatgacatctcccatcccaaccaagaagtggatatgaatgttatcttgctgcccagggcatcgagatcaggtactgaaggctgacaatccctaatcttgccatcttagcccagacaatgacactagaaattagctttggcatccaatgtggcatccagcccctgtgaagacagcactcttgtccaccacagatcttccatcatggccactgcagcagggaattgttccctttgtccatggtggctttgccacaaagggtccacttgtggtcttcagttaaatatttgctttaataaagtgacaaatgtttaaaacttcatcttttttgtagcctttgagttcaacttgcaaatcttatcattctacttataagctgaaaattataagtttaaaatgtaattcactttcaagggggcttttggacttaaataattcaagttagatacactaaactcccttaagtaatcagtatcatttacaaatttaatttaatttttaatttttcttaaacattttaaactgcatttacaaactcattatacccattttcttttcttaaagtacttcaatttctgacctggaaagcaaaatctactaagtattaaattgcaccagtaactccctaacaaattaaaataaaagattccatatactttaaaagcattgcaatattgtttataatctttgtcaaaaactttatctttcaacataaaaattacaagagtaatggtaactactcaactaaacatagaaagtagaatcaatatctactttgtcagttactttaatattccgagttatcttaaacagtagaaacacatcaactaaaaaatgtacgcagattactaataattgataagcattaattatcatgggtttcagaaattttatcatgtttactaaattctaaaccttccttgggttaaaagtaacataaccagtaactaaatacttttgaatcccatgtcatagacaaggtcacaactctaaggagctggggtagccctctcggtcggggtaggtgtgattttttgcatgctcttgatagccaggttggagctatctttaccagttgccaagacaaatgggaagccccatacagagtgatctcaaagatggcatcccggggttccctcaggatgtgctactacatgtttttaccaaattctgtctgattttggcagagagaagtcagctaccctctgtaaggctaaagctattacatttacttaaccatgtgaatgttgttttgttggagtgttgttgttgttgttaggaatttcagttgctttctaattgcctgagaaccttgatgtcatgcaatagaattctttacactcagctgtaattcttacaaacttctataaattgtgtcacttgatttagggagatttaaattcaaacccctcactgtaacctcaataaatttggtgctacactcctttatgaatttctttactgcctgactgaattcagaattattttcatttccttcttgtctagaaggggcaatattagttataattcggtttggctgttaagggaccaaaaaattaaaataatacgttgaaaactttacataagagagagaagtttctgtttctctcacatgaagtcccaaggtgagttatagggctggagttgcaatttcataatgatcacagttcgtcaacatatggcttccacttcatggtcatactggctaccagtagccataataaaatcacacgcccacaactagttacaagggaggttgggaaataatttattccaggtagccatatattcagtgaaaaagtgacaggtcccctagtacgtgaggacaagtgctgaggggtagaagaagtgttgtgaagatactggcagcatgcatactggagatcaagtacccaggcactgagggatgttggggagcttcctcacaaagacacggtagtagcatatctgacagcaccccaaaactgaagatgttggagagcacgggggttgtgggcagaagagacagaacagctgggaaactgatcacactgattaataacagtaaattaaggaaataatatatagaggatgagagcaagtttcttgctgttggaggaacttccaaatatggaaaggtaggaggctagaaagaaccctgagatttaggaatgaaattggaagtatcaatataaacccaatatttttggtaacacaggtagacaaataaatggttgcagatgcatgtttatgtatgtaaatgtacatagggagggtaaaatgaatgtgtatattttatactcatatatatttgtgtgtatacttacatatacatatatgtgtgtttgtgtatgtctatacacacatactacctcctgagatggcctaaaagcagtaatgcctcaacagtaatgatcacaaacaagtgcccagatcttagtttctaaatacaatctttcccaaaaacaaccagggtttcttagagaaatggctgataccagggctgggacaaaaaagggataagttgacattgagatatcttgtgccataaagtaaggaagtggttaaagaaatgatgaagccatgtcaaaaaggcttagaaatgaaagacaatccactgaataaaacaagaattcgtaagtctttgatgatataaataaggtagaagaacaggctcttccttatactaaaataccaaccagcaaatgatggaaatgagaataccaattgacaaccccatgaaagccaagactggtgggtggaaggtagacaaggaccatgatattggcataatctcagaacatctccccacaaaattcaaatcacttacaaaggaaaaatgtcaaatctaaggtggagaaacctggcatgtaccaatgtgaacagagtgggacaggccatgtgccttctgatgggacatatataaacacttgactatcatttctatggcattttccccgagtgggggacctgattctggccatgtggagacactggatggatccaggttgagagacgttctaaacagaaaaagacctgacttttttttaaaactatcaaagactagaaagacagggaaagatcaaagaaatgttccagagtagaagagatccaatagacatgataactaaatgtgacatgtgttcctgactgaaatcctgggtcagaaaagaaggacaatcgccactgggatagctggtgacctttcagtgggctttgtgtcctggggggcagcagtgcatcaacactgtttcctgacttggagggctgaatgctgatggtgtaggagagtgttttcactatttaggaaatacatacccacaatgtttagcagaaatgcagtatcacgtttgtagcttcctctcaaatgctaacggttgaggaatcaggatgaaaatgatatgggagatgtctatattgtacttggaatttttccctaagcttgaatttatttcaaaatagagaattaaatttttaaaatatcaaggctctattattcaggaagagcgggagccctgagagacagctagtggtgtctgctggtcaagccacaaaacatcctactgtatctgcatatatttcttggctttgttcagctctaaagtcacagaccttcttcccattgtctctgctgcagttttttgctataacaccattatctccttcccactagcccatcaatgagatcccaacctgctttatgtacaaaccagtaagagttaccaaggacaacatgttttggggccggataacaagatgtttttaacatcacagtttctgcgctgcatttaagagctgttggacacaattctgccctgaggcagaaattgagcaggaatagaagaatggaaataacacaagtaaaaaaactggagaacaggcaacatggggagtatgagataacataaatcgtaaagtagaaaacagaaatgagagcaggtttcagagacataggcttggactgcctttctaccatgcacaagaccacctgtcgctagcatgatgactagtgtttattccaaaagtctggtcaatgaatctcccaactagaattctagacatgtttcttttaagtataacttaatgtttgcagacttctccctcactggaagaggaataaaggataggaagaatctccttcctagtatcaaatgcatgcaactctacctctacaatactcaggtgacattttaagaaatactaatatcacatattacatagacgtaacatggctcttagcatcaatttgagatgaacagagatcgttctgatgtttctaatgaagagaataacctttttgctccttttcatattcaaatttatattccataaacatttattgaattcctaccacgtcctgaccaccaaggtgaataaaacagccagtgccctcactgagcccaaggagacagacccataaactaacaaatttcataaaaagcacagatgacatcaaattatttgttcactatttctgggcttaccaaatgaagttgcagacctcatgtttttatttgaacttactttattctgttataaggttaggaaccacattagggaaactgaacacaaactagctgtagtctttatcatttaaatatatagagctgtatgatatatcactgaaatcagtggtttccatggtccatggctgagcggcatcagaatcacttgtagtgcatcttaataattgagaaatccaaagcaaatgaatcaaaatcccaggaattagattcagagttcagtgtttctaagagttccacagagggttttgatgcacaggcaagtttgggcacccctgaaaaatcactgtcactgattctaccaagagtgaccttaggcttgcagaacactagtttgcaaaataacaatcagtcccttggctgtgaaattcacaagactgctgattaattcatttgaatatgattaaactgcttccctctaccctgggtttgtgaatggtgaggaactgaaacgtttgctgcaccatccattattaatgctcttcccttccaaagcctgtccctttgacctctgtttattccggcttgtctcctatatgagtttatagttacttattattatgtgcaattacatcatgctgagtgtgaggacaccccacaagctgttagctatattaacttaataatagatttcagggtgtgatttccaattaatttcattttccatatgcacatgcagctccatggaaagccaaaattatagagtagccatatggtgcctcataagaaacaattaaaactaattttctattctttgacaccaaaaaaaaaaaaaaaaatacggtttacatgccacagagaaaattgaaatttgaacagcctcggtagctctctagaaagaagatgccccactttccacatttgtggcatggatattccagtttcttgcttggccgtggtggactatggtcccacctggcttgtagtacatttgattcctcactgttcttaccctgctggactgtcttagagcagctgtgagaaagtgctgggctttctgtttcacaagagtgagttgagttgaaaagaatagtttgtctccttcagaaacagatgatttccggtaatagaaatttcctactgatccgtttccaaaaggcagtatctgaaacactggggcaatctgcccaagccaaggagaaaaataagcagttccactaaaagcagatgatgattgttaagcaataatgtaactgtccaaggctgaggagggctggagaaagggtcgctcccctggaaactcaggctggtttgttaaccagatcaatgatccttttacccttaccatatggtataattttgttaattcccaagggccctattttattaaaatcatcagctgggaggttaaaaaataaaaaatgaaacatatcaagaccctattcaagataagcagtgtgacaaaaaataaaaatccttgattttattagtctttcatataggtttcaactcttaaaactatcaagtttttatgtgggagcaaataatatcacaatgtattaatagatttactctaaagaataccttaactacgttgctgaaaacatgactaaatctcattattttttattttatgacaaatcccttctacagctaacatacgtgcacaagggtggcagaaggaaccatgagaaggtagagtaagaggtcagaggtctttttcgattgtagtatgaacgagtaagaaaactacctgtattagtctgttttcacaatgctataaatatactacctgagactgggtaatttataaaggaaagaggtttaactgactcactgttccgcatggctggggaggtctcaggaaacttacaatcatggcagaaggtgaaggagaagcaaataccttcttcacaaggtagcaggagagagagatagcacaaggaagtgccacactttaaaaccatcagatcttgtgagaactcactcaccatcatgagaacagcataggggaaaccaccgccatgatccaatcacctcccaccaaattcctccctccatacagggaggggactccaattcggatttcaatgcaagatgaaatattggtgaggacagagccagactaccatctatatgtttactgtaaagaaaaaaataaaattatcagaggtgaaactttgtgaaactgacatcaaaatttttaccaataaaaattataatggcagagaatttttcacagagaattttcagggcaataaaactactctgtataatgctataaggacaaatatatataattagacatttgtccaaacccatagaatgtacaacaccaagagtaaaccctaatgtaaattatgaacttggcctgatgatgtgtcaatgtaggttcatcaatcgtaatgaatgtaccatgctggtgggggatgttggtattgggggaggctgtgcagttgtcgggggaggggtatatgggaactctgtaccttcctctcaattttgttatgaacctaaaacttctctaaaaaattaaatctttaaaatatatctatataatggctacaaggaagaaaaactctaagtccatgttaggagttgaactgtgtctcaggacctctgaaaattcagttgttgaagtcctaatccccagaaactgagaatgtgatcttatttggagattgagttgttgaagatgcagttagctaaaatggcatcattagggtaggccataatccaatacaatagtatcttttaaaaaatgagaaatttgggagactctgcttcacagcctcagaagggccaaccctgccaccaccttgagcagggacttctaacctccagaaccatgaaacaatcaatttctgttgttcaggtcacccagtttgtgctactttgctatggcagccctaggaaataaatatagccatgttaggtaaagaacgtgagatctgggttcaagccctgagtctgccaaccactagctatgcaagagatgtctctaagctagatgtcctctctcaaccaggaaggtaagtaaagcctcctcacagcattgtggtgggggttcaattattaatacacaaagccggtgaggtacaatgtacaagtcttggtgtctaggtaagtgtaggatacctaaatggttctcttcactatgcccccaaccccaggagtaaactcagcctttgggagtgtgggagaacctcatctgcttttctagtgcctcctccaagtaactccttcacacacagaacatcacaccaggtcttccttttcatatccctggaaccacaaactctccccctccttcaggttaggaaacagcaagacgtggaagtttctgcctagccttgagatgccttaggtgtcagtgatcaattaaaacagataagctcccctcccaactccatttttttccttccctcctcacccacactcacaaaatgaatataaaaccagcataacaaacacaaactcagcaagttaatactaacgcaattgtgtactttgctcatctagaatgctaggcttctgactccacaagatgctaaaagaacacaaaaaaatcctctttgatggctaacattttcttccttaaggtaagaacaacacaatcctctcagtcatttagtattatattagctttatcttattcccaggggctgcttgcaccttgttttagtgactcctacaaactgcactggtcagaactactgtagcaagcactgtgcctattatctttttgtagtaaagggttaatgaacattaaataccacatttatttactctcatgctggtggacacagatgagcaccaagaaaatgaagtgggtctttaacatcttttgctttcttgcattaaaaacactgccaacattaagacatccttacatgtggcatttcctgctcagcaagtcttaaagttcccaacaactatttaaaaaatatcctcttgtgtggcaaaataataacaaaaagcttagcaacagcagccccctacttgctttgctaaataaccgttccaacaaaaaatgagctggaagattaagtgtatcttcatattccagcaaaaataaatatttagaaaaatatgttaggccaaacaagtcccccttcaacattcaatcaaccattccctcttggtttgtctttctttttgcccccctactctattcccatcccttccataaaaatgactaaagaaattcttgcagtttcacttttcagtggtgcataatcaaaattcaaaggaaattaaatagctgtcattatcatgagtatcctaggattctttattcctgtacataccagttcaaaaggcagacaaatgcacacatgacacacacttacatgcagagttcttacaaataaatcttgtgtattgctagtttgctattacactgtagggttttaaaagctcaatacatcatttgaaaaggttcctcctctacttatcagtcacttatccatgaagcctttggtttccagcaaggttttggcccctcttcctacacccctgcccctactcccttctgcatttttgatgggggaaatgggaacaggtcagtgagaggatgaacgactactgtaaatacttaaagacatcaattgaccattcatccccccttcccttagggtagagtccagtagagcacaaacattctcactgtaaactcttccttgtgtaatcttcagtcatagtggcattccttcatgtttgcactttaaatataccctaaaagcccaagttctccaattcagtttttttgtttgtttttttttttgagacagagtcttgctctgtcaccaaggctggagtgcagcagtgccatctcggctcattgcaacctccacttcccaggttcaagtgattctcctgcctcagcttcccaagtagctgggattacaggcacaggccaccatgcccagctaaattttgtatttttagtagagacagggtttcgccatgttggccaggctggtctcgaactcctggcctcaaatgatccacctgccgcagcctcccaaagtgctgggatcacaggcgtgagccactgcgcccggcctccaatttagattttatttggcaaaacattcccccaattttatgtaataaagatgcagcacgatggttaatggtcaagtgtatggcaagttgcatacactttttcaacactaatttccttgtctgtaagaagacaaccactctggtcacctcataatgacactgaagaatttaaatgacttgatttttataaattgcctcaatacaacatctggcacatagttaaatgctcagtaggtggtagtccctactattactgctattagtattatccttattaaggctaaaaagtcttgcaaaccttagtgaactgtgtatgtatgtacacatataaaaaattatctatatcttttaataccgtaatttctaaaatggaaaactatataatttacacatttttcattttaatgattaaattaataaagtaattatatgtttgatatagcttaggaattataatgtgtacgatttacattctatttattattttaattatttctattatagtttatttataattttaatatataatacatatatacataatatataatacatacattttttaatgtattctctgaaaatgtcccaataccacagaatctgactggaaaataccttgggtactcccaaaaccagagccagaaatcgctatattagaaaattagttttgggattctaactgctgtgaacagtgaaaaacagtatggtctcttaaggagttccaagcctcttgttctgactttgaacaaggcccgtcatgtgtaaaatgctctattgttcctcattccctaagtttcaagtcctcaactagctcagaataacacatttagcctttaacaggaatagtgagaaaaatgagacagtgaggatgtgtaagtaaatatgatacgtccataaactagaacaccatgaagcgtttgaaaagaatgaagctgttccctatacactgacctctaaaatattgttcagtgaaaaaatggcaaagtacagaacacaatgtacaatatgctcccttttaggctgaatggggctcacttaacttcttaaggagcctgcaactgaactttagcatatgctagaaaagaagtactactagttggccgggcgcggtggctcatgtctgtaatcccagcactttgggaggccaaggcgggcagatcacaaggtcaggagatcgagaccatcctggttaacacggtgaaaccccgtctttactaaaaatacaaaaaaaattagctgggagtgatggcaggtgcccgtagtcccagctactcaggaggctgaggcaggagaatggcgtgaacccgagaggcgagcttgcagtgagcggagatctcgctgctgcactccagcctggacaacagagtgagactctgtctcaaaaaaaaaaaaaaaaaaagaaaaaagaaaaagaaaagaagtactagttgtccctgaagctctcttttgccaattaagtgatatctgtgaaagaatagagggagagggataaaaagagaaaaacattaagaatattataatttttcctactagaaaaatcaagtgtatctgcaacagcaatgtaatttgaccaatcgaacatactctttccttctgtaaacagagcggctgccagcacaggaagtaatagtgtccattttttggactgcattccacttggaagattatctccaaagtactggattccagcatatacactttgttgagctgatctacagggctcactagctttcccccctcccctcgctattaatagtactcactctgatctttacctcacactttaccttgacttagactttcagcaacctgcaaagtaatctaccaaaacagagaaggaaatatgtcagcatggcaaactgtattagtgaaactagttagaaacaaaacgccacaggtataaactctacattcaccaaaatggacatgagttactaaataaaatcctctcctgcaggtactatgcatccctgtcttaatcatctgtgtttcagattctatacaaaacagttagcaagcttgtccaatctgtggcccacaggccacatgcagctcaggacagctttaaatgtggcccaatacaaatttgaaaactttcttaaaacattatgagatttttttgcacttttttctttttagttcatgagctatctattgttagtgtgttttatatgtggcccaagacaattcttcttccactatggcccaaggaagccaaaagactggacacccctgagtcagagcttgaaatccaggtactgcagtggaaaggtatcatatttttaaaataattaaaataagcctttcgtgctatttataatcttagaacaatatttttcctttctggtgaaaataaaatgtaccttgtattctaacacaacttctattcttcccactgcttttttttttttaacaaccaagcatacattaagttttcaaactgtagcatttgaaattaaagtaatgagtgagtgactctggtacctaacagactcaatcaagtcttaacttaaatagtattttgacagggaaacacattaaatatgtgctacgtgctggtcactgcactaggtgctgagtataaggaagcaaataaaacaggttccttgatttcactaggattatgtctaggggagaaaggtcattccacacaaataatttcataaactatttgatttagtcacatatactctatatagttcctgatttatatagagttagtaataaaaactctactaaatacaatatagtcttcttttaaatcaatgtactgtagcactacagggtgccttggaaatatctatgtgaaaagtagttattttattatttcagtcttaccccaactgtataacccaatattagctattaaaatacaaatatgccatacttttaaaaaattaaaaactaacctatttcattggccactggcttaagtacaaactgtgtaacattggcatataaacaaatacccttcattgccaacagcatgagatatgccactgcccctgagaagcatttctgactctctagctaaagtttgtaaactctctggttgccacaataatttatccaaatttccactgtgatgtttatcatattgtacaagagtaatttgtcatcctccataacctgtgagctcctcaggtgcaggaacaatgtctcattcacaacgtatccctagcactctcactagcgcctagcaccttggagcctctccacaatggtctactaaatgcattggtgaaaaagggtgaattgaacactacacggcagctgtcacttaaagtacattttgagcttccacaaggcagattcactgctcaaattggaaatgttctaaaagtcttgttcatcttagctgtctatcctatctgaaaatcattccttccttttgttatatttgatttactgaggcacactctgttccagggaccacagtaacaaccttgactcaatcaggcaaggagagtatagcggtggaaggattcacacacctgtccacttaagacaagattttgcattcaacgacaagcacttgagtgagctactcaagcatcaggcagctgatgagcctttctgtgatcttactgattttccgaatacggtgaacattctagtctgtctttgacctcacaaagttatatttttacttctcaggttgcaaatttgcagtggtaaaatcatcctaaaaactttacaggaagaaaatggttaagtacgttttaattcatcaaatgagagactttagtataatcattagaattacatttgggggggatattttaaaatatggaaaaaatctcatataccatgttaatgttaaaaaaagctgaatacaactgtataaagtataatcaaaattttgtgaaataaatctatatgaaaatagtcacatatacatatgtatctccacacagaaaaataacttaaaggagtttcaactttttcaactatgatcatgtattatttataaaaattctgaaaataatgcatgcttttcttctaaagtaaaaaacataatttcttaaccggctttatggtggattttgcaaagtaacaattcctctactatcttccaatgattcacttttcttacaattttaaattatatcttattcatgaaaaacgcatataccagaagtaaagatgaaccactatgtttctctctgtggtgaataaattacacttttaagaaatttaaaagatacaattacctaggacattaaagattaatagtttcctttataattatagattccttccatcctatgtttttatgcctcataattgcagtatgtctaacctcctttaaaaggcaagaaagactgggcatggtggcacacgcctgtaatcccagcactttgggaggccaaggcaggtgcatcacttgagctcaggaattcaagactagcctggcaacatggcaaaacccatccctaccaaaacacaaaaaaattagctgcccatggtggtgtgtgcctgtggtcccagctactcggaaggctaagctgggaggattgcttgagcctgggaggcagaagttgtagtgcgccaagatcgcgccactgcactcaacctgggtgacagagtaagagcctgtctcaaaagaaaaaaaaaaggtgggaggaggaaaaatatcaatggaaacttaaaaatacttttaaatataaagtaatgctgcattttaatatggcagaactatacttcctatatcaggattttttttttttttaagtgacagggtatggctctgtcacccaggatagagtacagtgatgtaatcatggctcactgcagcctcaaactcctggactcaatcagtcctcctgtctcagcctccctagtagctggggctacaggtgcacaccaccacacctggctagtttttttcgttttaacgttttgtccaggctggtctcaaactcctggcctcaagcgatcctgccacctcagtttcccaaagtgctgggattataggcataagctaccttgcccagcctcctatgtcaggaatttaaagactaaaggaaaatggtaatctgaaaacttttttggcaaccactatattcaagtccttctttattcccacttatacagaaaaacttcatttccttttgttcttttttcacattcgaagaccctaaaattgatttttccccagttgagccaaagtggaagagggacaatgttttattaaaagattcatttcccagcataaactgtcttctttatttatatacaaagaaaatctgtctttttattcttgtgaaaatgttttctgaagctatcattttacaaagttaattcaattgtacttgactctaaaaacagacagagagggagaaaagatgatgatgacaacgctgttagccgcctcagcaaaagaaaaagatacgcactgatcagctctcttaagaatggctgcacaaattaaattccaccaaaatgtaagaacaagggcatcgtggtgaccagtcttcagtgacttctgttgtgtgtgtgagagagaccaggacagcaaaagaactgtggtattagagtcactgaactggttacaatttaagaaacattcatcgttgggcttaaatgtactgaagaaaagggtattcatgtgacacaaaagacaagagaataaggagaatccaaaatgatccatcaaatgaaacagactgaggggcatggttttgggccaagtggagacacccagctggctacaacactgaagggaaagcatcgaatagattttaaagtagcaaagtaaggaagggataaaaataaataaaagactaaaaagtaatatgattctttgatcctatgtaagtctgagattccacagcaacacagaaagagataaatgagagagaaaacgtgagaaaatgaatgttttccatcctggtcttaaagaaaacttaagtggcatctttttaaaagaaagcataagtattttctgaacacaaacttcaaatcattaaaattaccttccctcattcttcctagagcagcaagcttttaaaaaataaagagtgagccgggcgcggtggctcacgcctgtaatcccagcactttgggaggccgaggcgggcggatcacgaggtcaggagatcgagaccatcctggctaacacggtgaagccccatctctactaaaaatacaaaaaattagccgggcgtggtagcgggcgcctgtagtcccagctactggggaggctgaggcaggagaatggcgtgaacccgggaggcggagcttgcagtgagccgagatcgcgccactgcactccagcctgggcgacagagcgagactccgtctcaaaaaaaataaaataaaataaaataaagagtgaaagctctaagaacaaatttagagctatatggagtttccactttttcagttttcaattcctaagtcagagttaagattgttatagttgaaactgtattagaaacatatttaggaacgatgattgtaccgttgagcttttcagttatgatccccacccctatcctaactggaatcctgaaattatcaagcttaccaaagctaatgcattaattctctcatttcatgattcattaactcagtaatttcctgcaagatacatggccaacaaaaatctcaaaatatccctgaggatattccagattaaaaatgctaaattcttaggacataatctttctagcactcatagagtttactatttcttagtttgttacaactatttgcccagatgcctgtctccccaagtagactgtaacctccaagcaaatgaagattgatcaagtaggattcaatatttctttttcttatacacagatctgatcatatttactctcacctggactcttaggggcggggctatcactcagagccaccggggcatggctgctgcccaagtggacccagaaggctggactttggcctcagtgggcccagaggcagagcatcatggaaacaaagagaattattctcaagccttaaaatacaatggactttgtcctgctaggttttggacttgcttgggccccaggattcctttcttccttctaatttgtccctttaggactagaatgtttattgtatgcctgttcgcctatttgggaagcagataacttgtctggtttcacaaattcacagcttgagaagaattctgcttcaagatgtatcacacctagagtctcatccatggctgatttagatgagattttcaacttagagctgatgctagatgggttaagattttgggggctgttgggatagggtgaatgtattttacatgcaagaggaaacaaatcagggatgggagggggcatgcagaaggcagaatgctatgggctgtttgtaaacctccctaaattcacgtattgaattctcaacccccagtacctcagagtgtaaccatatttagagacagggtctttaaagaggagattaatttaaaataaagccattaggaagggacctaatccaatacgatgatgatgtccttataagaagtgggagagacatcagggacaggagtgcccagaagaaaggccgtaagaggacacagcaaggaggtaatcatctgcaagtcaagaagaaaggcctcagaatggaatcaataccttgatcttggacttctagctttcagaactatgaaaaataaacttctgttatttaaaccacccagtgggtagcattttgttatggcagccctagctgactaatatgcctgccatttacattctccctgaattgccagtcctgtggcaacgtaccacactacttcatctacaaatgcacatttgttccttttgtcagggactgtgtagtagaaaatctggccttgcccaaagggtggtctggcttttgtcctcaacttctaggaggcaacccatgtcatccctatgggaatatgttagtcttgggaaagaacaattaaggtggggccagctacagccaatagtcttaggttaggggctgggcatgacagaaagatcaatcatgtgttttacagtggggaacacagaggctgaaatcaaccacatgggcaatcaggcaattgatcatgcctatatagtgaagctctcaataaaaactctggacactgaggctcgggtgagcttccctggctggcaatactctgtacatacagttacacattaacgacaggagggtaatgcatcctgactccatatggagaggacacagaaacctggtgtacagaatcctcctaaactccaacttagttgtctcctctttctttgactgatctgatttcatatcttttccctgtaatgtaatagtaatcatgagcactcagtgagttttgtgggtccttttagcaaactgttgaaactgagggtgttttggggaaacctcacacttgcagtcagtgtgaaaagtaaagacagtcttggagactgggccctctaattttgcagtttggataattccatgtagggatgaaacctcagatgtcactatctcagcaacatttcttgtatctaccctaaacagagttaatcataatttccttccttctcagtataccacaggatgtaatcctaatttacctggtaattacagtgattctaaacctgaggaaattttgccccccacagaagagaacatttggcaatgtctggacacagttctggtggttacaactgggggatgctactggcacctagtactccacctccaccctaggggatggaggccagggatgctgctaaccatcctacaatgcacaggacagccctcacagcaaagaattatctgacctaaaatgtctacatcatcaggtttaagaaaccctgcattagactgttgacatttaccggatgaaccccaggtctgagacaacaactcttggagtagtgagacaatagcaccctgaattctaagggccagtgtccaaatgccaattccacataaaacacttctgtttaatgtcaggcaaatatccaaacccttggccctcaactatctcatttgtaaatgaaactaaaatagcatgtattccacagaattatttacagaagaaataagaccatatattagaacaagttagcaaactatttagaccacagtaaacactggctaaatgttcaccctatatcatttaattttccttgtacaatgtaaaacattttataaaaaatatttgcactgactagattactggtaaaaggtcacaaatcactttttctttggtttagaacagatgtaggactcctggatctcataaatgtgggctactaacaaattaaatgtttctttctatgcaaaatttgtcttctcttaccaagaccacatgttgctctttccttccattatcaccacttatgggtggcttccttgtgtgtccattttcttcagagaaacaaagtttatatcacatatgagagttaccataagaggcaatgacaaaggaaacaatcaagcaatccagaaaggagattgtagtccacctaatacaaccacctgtgaaatgcaactgccaggtaggcagctccttcctttatgatcatcttccaggaaattacaaattgccccacatcagacattattcaggtcaaatgcctatctatgcatattatatctgagaactaaaaaggtttaatttattccctttgtgtctgtgtctcctacaatcctacatctaaagtgaattccccaagaaacaggagtaacttttccctcagatccccaacctatcacaacacctagcacactgtatatgttaattcatcattcttggataaatgtaagaaaagagatacagatggccaaatggatgaaaaaatacaagaccaagtggaggaacaaatacaagaaggaataaatgaataattaaatagttctttagcctataaatagcagtactactaatttctgcttgagcttcaacaacattaaaatatcagtgttcttacaaacatatatgcaggacacaattgttcaacaaaagaacttggcttgcagctataccctgcacagtaaaaaaatgtactctctcagtgttaatgaatgatttaacccagagcagtaagaacaggttagattcttactagcaggaagctactctgcattttgcaacaccacaccacagactacaggttaaaacagccaggaatatgacaaatatcatacttactgggagagaattaatgctactcccctaagatagaaggcaaggtaaggaagtcgcctcttaccgattctactcaacatggtagtagaggttgagccactgcaagcaggcaaggaaggaaaaaaaaaggcattcacactggaaaaaaacaaaaagacataacatggcctattcacagaagacatagttctgtatagagaaaatgttaaggaatcaattttaaacacaatttgcatgaataaacaagaaaaggaaggtcacaggatacaaaataaaagatacaaagatcaattgtatttcaacatacaagcaatgaataatctaaaaatgaaattattaaagtaatgccattcacagtagcatcaaaaataaaatacttagaaataaatttaacaaaagaaatgaaagacatacgcttgaaaaccacaaaatattgctgaaataaagatctaaataaatggagagctattccatgttcacagactggaagattcaatattgtgaagatggccatactcccacaattgatgtacaggatcaacatgaactctaatcaaaacaccagcaggtttactttcagaaattgacaagcagatcctaaaatgtatacagaaatgcaaaacacctagaattgccaaaacgaatttgaaaaggaaaagaatattgaaaaattttcactttcaaatttcaaactttctaataaagttaacagtaatcacgtcaccatgtttctgacatatattacatttgattgcttccattagaaattaccacaaatttagtagcttaacacaatgtattatcttacaattctgtaggtcagaaactcaacactggtctcaccaggctaaaatcaaggtattagtgagacagccacatgggagggggtccctggagaaactccacccagtctgcccactggggtacagcctcgagaagttcaggatctttccagcagaaagcagcctggcccctccttttcctgtgtgaaacctgggattcaaacggcctggtgggaagcgctctatcagggacttggcctggtgagaatccttgtttccccctttttttttctttttcacccaataaaaccctgtcttactcaccattcaaattgtctgcgagcctgaatttttgtggctgtgggacaaagagccccatctttagctgaactaaggaaaagtcctgcaacaacagcagggctacattttttcctggaggcactatgtagcatctgtgtcattgctcattcaggtgattaacagaattcagttcctgggcttgtagtactaagatccctgtttccttgctgacagttctcagctactggaggacacatacattccttggctagtggcccccttccaccattttcaaagccagtaaccacaggtcaagcccctgtcatgctcaaatacctcctcctcctttcatctctcatctctgacctaaaatggaaaggttttctgcctttaaggacttgtgattagattgggtccccctagtaatccaggataatctctcatctaaacgtttatacttgttaagacatctacaaagtcccttctgccacataaataacatattcacaggttccagggcttacgacatggacgtctttggggaactacttttctaatgaccacatggtataaagatagatacataaatcaatggaacagaatcgagaggccagaaataaattcttacatttatagtcaattgatttttggcaaaggtgccaaggcaattattggggaatgtatcctctgttcaaaaaatggtagagacaatagcacaattttaacttagactctcaccgcataccatgcacaaaaatgactccaaatagattcacagacttaaatgtaaaagctaaaataataaacttttacaagaacatacagtagaaaaatcttcgagatgtgactcaggtaaaaaaaaatttagatacaacatcaaaagcattctccaaaacagaaaaaaattagtaagttggactttgttaaaattcaacttatagacttcaaatggcactactagaaacatgaaatgacaagcaacacactgggaaaaagtatttgcaaaatacatatctaataaaggacttttctccagaatttatgaataactcctacaattcaataagacaaacctcaatcaaaaaatgggcaaactatatggccagataatttaccaaagaatttagatgaatggtcagtaagttcatgaaaagatattcaactgcattagtcagttagaaaagataaattaaaaccacagtgaaatatcactctctacctactacagtagttaaaattaaagagacagaaaacaacaaaagttagtgaggatataaagaaatagaaactttcatgcattgataaggggactgtaaaatggtgtagctactttggaaaaagtttggcagtttctcaaaaagttaaccatagagctaatatcatccaataattccaatcctaggtatctattcaagagaaatgaaaacatttgttcacaaagacttacatgaatattcacagcagtattattaataatagcctcaaagtgcaaacaatctaaatgtccaccaactggtgaacagattatccacataataaaatactattcagcattacaaaagaaataactcttgatatatgccaagtcatagaagaacctcaaaaacagtatgctatgaagccagatacaaagagccacatatcatatgattccatttatatgcaatgtccagaaaaggcaaacttagagactgaaagtgaatgaggggttgcctggggctgggggtgagaatggcaattaacatcaaacaggcattagggatcttatgggagggtgaaaatgttccaaaagtaatttatggtgatggttgtggaactcaatgaagttactaaaaatcactgaattatacacttgaaatgggtaaattaatgatacataaactgcatttctataaagttgttttaagaataacttattaaaaaagaaagctagccaacaaggacacctatgagaattatcctggtaggaagcatgtgttcttgggaaattattacaattatgctattgctactgaacctaagaataaaaaaagtccatctcatttagacagatttgaagaaaatgggtgatataacatgaatctagtggaattctagtggattctaggggcagctgttctctggattcctaaaggactgaaacagagaaactaggcacttatcatcaggccattcttgtcacgtgaaatataggtacctccatgcaggggccttgactgggaatcctctttcactgacagctgagtcctttttatcttgaatttccatgtaactgcagctgaatgaatatattggaaaagatgggtctccttgctatttccacagcagagtttctgtggacatgactattgccatgagaataataactaagaaatactccaatcaacagagtagcaaacagataacacaggtcaacacagttctcaagaaatcccagatcaagacttgtctgaaagacaggctcattgagtttgcagggatattgttcctttataacctagcgactctctgaagagagagacacagtatgccatggtaggatttgtataaagcaaatcacagaagtatttcatgtgggccagtaaacaattggtccaagttttaacaggaaaaaaaaaaggtagacttaggaaattttcttgattcagaattgaacagagttttcagaagtatttcccattcacaagtgtgttgaaacattctcctctttaaatagaaaatagatgaattgagataaatatatttaaatttccagagcaatcttgaagagctgcaacagtttagggaaatgtcaagaacaccctccgcttgagacaactgctctgctatgtaagatggagatcatcttaaggaaatagaaaccttctcgaagaaacttactgagtgccacatttttcccaactgttgatttttgtgaatttcagttgagagttactctcactctgccaactaaataaaaatatctcaaactgggttggaggcgaaaagcatgtaagttgagaagacagaaaatactacaggttcacctgattcagagcttgaacacttctaatcctcactaagaattgataaccaaatgcttcaaataaacttcacttgtcaatatcagtcatttaatttttattttatttttttttacaaaaagcccaaaatggattaaccacctgagtttaaagaactctactgattgatcgacccaggtagatggtctaaggaaagaattaagtccaactaggacactcaaaagtgaagtgctggccaggtgcagtggctcacacctgtaatcccagcattttgggaggctgaggtgagcagatcactggccaacatggcaaaatctcatctctactaaaaagtacaaaaaaattagacaagcatggtggcacatgccagtactcccagtcgggaggctgaggcaggagaaaagcttgaacccaggagttggaggttgcagtgagctgagatcctgccactgcacttcagccttggtgacagagacagactgtctcaaaaaacaaaaaaaaaagttaagtgcttatactgaagttacaaataagataaaaggacttttaaggaatattctctactacaaaataattaggactcagagcagagcttggttcataagtttaagtagaatcatgagctagagagaaaaaaaacgaattgcactaagtaaaagaagacatacatggaaatgacacaggaggagagctgatgtaaacattaaattttcacagctactaaatgctaaataaaagacttttcatattatagagttcttaaaatctggtggcatttcaacctgtggagacctaacacattttgctcagggcaaaaatctggcagccaaaagaatctctaccagagcctctgtcttccctggatccttttcctcaaataagggcaggaatggcaagaaagaaggcaaggaactcttcagagcctcagaaagtggtatgcagccaggtacacccctactgtaaaggggcatccacactaccagccatcatgctacatattttatatgcactttctcattcaattttactgaacaatggaattatagttccatttgcccaaagacctaaaggccaagatcaggaaggataccctctcaagatcttaagagcaataggaagaagagaaggtgtcaaatctgaatttcaaaaagcatcatcagttgcagagtgcttggtgagagcaggtgaagtaaggggggaagaccaggggtttattttgtatcttcctttctttctgggcttttatctctgatttggtcaacatttttaactcctaacacttcaaaatcacatctacttttggttaagatgattgatttataagttacacaatgaataaatagcataaactcaataatataaggaacacagagtaatatgtattatatattttatatatatttcatatataaaaaattttacatatatcatatataaaaaaattttatatatataaaattttatatatataaaatcatatatatacatatatatgattttaaagcctattctatatccaagaggtaaagaaatagtggcaactaatcaagagtaagctggtgcctgctggaactaattttccaataagtacttagacaaaataattatgagaatttatgttttcaaaatgtcttagattgacttacctagaaagcaaaagcatgtgaaaaatgtgtatgccaaatcttatgtgagagtagaatctcagggaagccagaaagagaggggacagggcaatgaggccagggaggaaggaaaggaatgcaaaatgggatgttgcctaggtgaccacggctgaaccggagatcacagctttccggaagcttggttatgggagatgggtgtctctagagaggccatacgaaccactgtgtctgggaatcatccctgaaggaagaagggtggagatgaggaagaaagacaaggcaaggaatttatctgcaggctttttctgactcccttctctcactggtcaaagtcagtcaaacattagcgggaacagcctgagacccagagggtctgatgggactgaacctgggcctcagaggagaaaaagggttcccaggcaggagagcaacacggagaggccaagggaggttggggtgacctggcaccagtgttgccgctctctaagaagatccaggaacacctggcctggcatcaattggaacacatacagaatattttctaggattttttactgttttccaaaggctaaaatttctatcttgcaaccctaaaatttcctcagaaagaaaggaattaggaatttcagtatgttatgtgcaatatcagaatttataattaaaataaagctgaaaataaaattatttcacccttaaataaaaattttccttcctcattaatagatcattttacaattgagtttccagtaagttaaagggctcatattcacaatttataaatcatggcaagataaggcaattacaagattaagagtagaagaatttagaatgtcaagtggcattaatttaagtagaaataagttctctacacataatttaattaatgccaagtgctcatagagctttgtttttctgagatgaaactcgaagttggatgagactaacacagtaatcataggctaacaccctgcccttcagaactacaagttttattgcccatcattttttaaaaatcttattactcagactacgtgcaatataaaatcaggggtaaaattcgaacagatgttaataagcttactgccactaaattacaaaccaagaaacttgcagaggggtctctctgtcctggcttctctttctacctgattggaaagtctgttctaggagcacagtgatattccaagctgggcactaacgtccttcagtgtagcacctaaaagctttcaaacaaatcagggtggtgttagaaaaaatcaaattttttaaacttgaacagggtaatggaaaataaagtccacgtcagatatcaaagatactacgatgttatcctttgaaataaagttagtatgtttaaaaaaattaacttaccttgtttataggaaaacacatgacattgagttacaaggtaaaatggtacctattattctgagatacataaacagaaagacacattattaaatatttaagtcacagatgtcagtcagtacaactccacaagacttaaaaatcaaggaggtgagtcaacaaaaagaaaaaaataaaaataaatgagaaaccatcaaattagaatatactgtagcaaatctcaatatatttatgttttatggttttatccatctttatttcttaattatgttactactatacaactatatcctaatacatttttaaaaatcaaacttcatggaataaagaatacaacgtaaaaatccctcctcttttttttctagcatattcagataagcaacataggagaagcccacaccagtacctgttgccatgatatatatatttcattcataacacagacagatacagccatgtttcgtggctgtgtgtatgcacttacacattcatatgtaagtctggaaggtcacaccacaaactgacaaaagtgattacatctgggtgggaaaattttacctgttcttcttcatattttattttttgaaaaatttttcaataagctttttttgattaaattgaggaaaagagtgctaaaaagataaatataatgaaagatacatcttcaaagtggctacctttattctttcacccaacatttgctaagtgcctcctcggggcactgggagagatgtatggaagctggccaaagctgagtccagaaatgaagcctgagacaacaggcaaacggcagagattgtcccttgattaactattatctctacttccagggtgcgaacgttacctatgggtcataaaatttgaagctgtttcatcttccaaaatcattggtcagttttgaacacagttgagttgaatattatagaccgtcaatcataatttcacaagtgagttgtcagggagaaaaaaaaattcctattgcacttggaaatgtcaagtgtaacccaataaatgtcaaattaaattgagctgtttgtgggaaattgtttagagctgtttataatagggggaaaacatgcaatcatcctaaatgggtatatgaacaggaagcctgggaaataccttccgaaaatatgaccacctgtatctattaagaattgtgtttgtgttcctgaaatcaaggatcctccctctctggtaccttgtaaggtaaatggtgctaacttcttctgaagaatacttaatcttttaacacttggatatccagtcacttttctaataaagatatttctcacacatgtatctctgtgtgctgatgcaaagggagttactgcgcatgtcaccaacgctggttagcactttctttagtcattcccatggtggtctttttctcaagagtaaagtccaaaaatgcagataaattaagaaggcacaagatcaaaagtacgtagtacccagctatttgttaatactgaaaataagacttggtaagcagatgtgtcacacacatgtctatggtcaacataatggggctgtcttctgccatatttgtttgtcaaaaggactggaaggtctgtcaatgagaagtgactttctctggacacttaatctttctctaagagattaaacattcagtattttttagaagaggagggcatgcaatgaagtgatggctgcaattctttgctttaattcaatcagtatttactgagcactttcctgttgcaagttctttgcaccaaagctgtgatggtgaaaagtgagccttgaacttttcaagctcaaaatcaagttagggagacagatgaaaagaaaacaaagacaaaagaatgcatgatgtataaagtgcagtggcagcatctcaaaatgacgcctaactcgagtatggaaagtcagagacacttcttggagtattaggctaaggagatgtgagcactaaagtacctacgggaggaaagaataattatagaaagacccggtggtatttaaggcaacttataggattcagtcaggtaaggatgacttctaacaatacagttaatcaccagacatgcatttaatgtgcagaaatggtaaatcagtaagagttgtaaattagctcccaaaaagtcagagcactaaatattaacttacaatacccaaattaagaagccaaattaggaactctgtttagttctcaggttaaaccaagctagatcctttgaaagttttgtacttaacacttaataagtaccagagaaattttgccatgtgcatggcatattaatataccatatttctttaaaaaaaacttatttaacattcaggggtacatgtacagttttgttatacaggtaaatttcatgtctcaggggtttgttatatagattttttgtcacctaggtaataagcatagtacctgataggtagttttccaatcttcaccctcctcctaccctccattttcaagtaggcctcagtgtctgttgttctcttctttgtgtccatatgtactcaatgtttagctcccacttataagtgagaacatgcagtatttggttttctgttccttaggatagtttgcttaggataacggcttccagctccatgcatgttgctacaagagacatgttcttgctcttttttatggtggcatagtattccatgctatatatgtaccacattttctttatccggtctaccagtgatgggcacctaagttgattccatgtctttgctatagtgaatagcgctacaatgaacatatatgtgcatgtgtcttcatggcagaatgatttacattcctttgggtatatacccaatcatgggattgctggttgaaaggtagttctgttttaagttctttgagaaatcgccaaactgttttccacaaaggctgaactaatctacattcccaccagcagtgtataagtgttcccctctctccaaaatcttgccagcatctgctatttttgactttttactagtagccattctgactgactacaccacacatctaaaccattcattttggtggaatgacattcccctcccccaccaaaaaaaacaccttttattacatcacacgataattctcccataaggcaactctcagtctattcattttgatgtttgttttcttccatcaaacttccatcacctccctccagtaactcaactgtctcagggtagtgaatggcagttacttgtatgcagtgacaaaagggaaaataccttacactgtctttcttttaccactgagtccatgacatacctccctctcctctgatgcctcagcctcccactgagactcaccagtggccttggtatgttcaatcaccaaggctctgggataccacctcctgccacaccatctctggccatgccacttccagcagagggccaaacctgctgcagatgcctctgtcatccattgccctgtccaaattccaacttggaagagccaccctagggagagccaccatcctccccgcttgcctgcctcctcactggtctcctgcttctgctcttggctccctacaggccaatttcggctcagcgaaaggatccttttaaaatatcatgtcaccttgagctcaaaaccactgcagtttctcaaagtcttaatttaccataagatctagcaatttcactgctggggatctacctgttttagtttacttttgctgtcgtggcagattattacaaatgtaaaggcttaaaacaatgctcatttattgtctcacagtgtttgcaggtcagaagtctggcaggatgtaactggattttctgtttagagtctcaccaagctaaaatcaagctactggctggaactatgattcttatttgcagcttagagacttcttcccaccttactagttagtggcagaattcagttccttgcagctacaagactgaggtatccagttccttgacacaaggccctcatcttgaagccaacaatggtacatcaaatccttctcaggcttcaaatgtctttgatttctgctatacctctctaaacttctcttctgacttcctctacttcctcttgtgcttttaagggcttatgtgatcatactgggtccatctagttaatccaggataatctcctgatcttaaggtcaactgcatagtaacctcaactacatctgcaaagtcctttttgccatgtaataccacatattcaagggcacaaaactaggggtaaaagtcttggggccagaattctgtctatcacagcacccaagagaaataaaaatacattccacataaagacttggacataagtgttcatagcagcattaatcgtgatagccaaaaattcaaatcaacataaatatctaccaattggtaaatggacaaaatgtgctgtatctatacaatggaatactcttcggtaacacaaagaacaaactattaatacattcaacaatatgaagtaacctcaaaaatatgatactaagtgaaggaagctcgacacaagagaccacatgctgtagcattccatttaaagaaaagacaaatctatagggacacaatgcagattaatggttgctggggctggcaggagtaatgggattaacagtaaagggcataaggaatcttattggaggatgaaatgttttaaaactggactacagtgatggttatataacttggtaaatttactaaacatcatggaactaaacttctttcacttaatatcatgataccatgtttttgaggttcattcatgttgttgaatgtattaatagtttgttctttgtgttgccaaagagtattccattgtgtggtgtattagtccatataattgaatactctctggtaactgctgctataaagaactgcctgagactgagtaatttacaaaggaaagaggtttaattaactcacagttccacatggctggggaggcctcaggaaacttacaatcatggtagaagaagaagcaaacacatctttctttacacagtggcaggaaggggaagtgccgggcaaagcaggaagagccccttataaaaccatcagatctcatgcgaactcactcactatcacaagaacagcatgagggtaactgcccccatgattaaattacctcccaccgggtccctccccaagacacatgaggattatgggaactaaaattcaagatgagatttaggtagggacacagccaaaccatatcctatggatacagtacattttgtccattgaaggatatacttgaaatgggtaaattttatgatatacaatacataacttaattagcttgtcagaaaattaaaaataaatcaataaataaaaccattgcaaaagccagcacccctctagttgcatacagagccctacaggttattctccatgctccaatttcacctcatgtcccacagcttgcttgctctctttctctaatcacctgatacctccaggaacattcctgcctcaggaactttccaattgatcccaccaatccagtccttcgaattaggttaaagttgctttggctccaactctctcttaaattagttgtgaaaacacatggtcttgaccatggaaagaacatgaagcggacactcagtgctcctctctgctccctttgtgctccaatgggataagggaacatataatgaaaaatgatggcactgtaaatactggtacaagttaagtattatgatgcttagagagcaggcaaaggacattcttcagaacacggatattccatcatctgtctccagctgccactggatgccaataagccactagaatgtaagagctgactacaccaggaatgtacatatcaccatcatgctgatgcttctcccagctaccactcatgttcccttgtccaccaagagtactgctttaggctgggcgcagtggctcatatctgtaatcccagaactttgggaggctgaggcgggcagatcacttgaggtcagaagttcaagaccagcctggctgacatggcaaaaccccatctctactaaaagtacaaaaaattagccgggcatccatgtggtgggtgcctgtaattccagctacttgggaggctgaggcaggagaatcgctcgaacccaggaggtggaggtagcagtgagccgagatcatgccactgcactccagcctgggcaaaagagcaagactccatttcaaaaaaaaaaaaaaaaaaaaaaaaaccaaacccacaaagactcctgctttatttcaattattttccctgatagattttcctccacatttgtaaaataatgctgacatcaaccagccaaaaaaatcacacccactttatcagaactacttgtgcagttaaataaatagcatgctacttccaaaagaaacaattacttctattttttaaacaaggatgaagcatcctacttgtaattctcaatgatttccgcagagatcaagtgaggctccttctttactacagccaaatttcccaccaccagattcacaaggcagaaacttgagagttcagtgaatagtaccagttaacctcagagggctgttgtagtttctcagtaagctcctggaacaacctagactgcatgggacaaaattttctttttgcaaatgatgtgtttcattttttttaaaggaagagctatgaataataatgagattcattgatttcgagagatcagaaacaggtaagttttgtagcagagtctaatgtgccaatttcagtccttaggcagtcaattaatctacccttcccaattggtctgatgttcatgatcctatggggtattttttaaaagtaagtaaagtaagtattctaaataaagaagattaaggatgttgctggcttcttctatttttatatgttctgttggatgaccttttgaaatgctctagaccaaagttcgttgcttttggcttaaagcagcacagtatggtggttaggaacacagactgggacaggtggaggttccaattccaaatgtgacatttactatgttcagagatttaagtaacttgttcaaggtcacacaagtagtaattgacatgaaagggatctcaaccaagatagtctgactcctatgggcttagtcagtaccctaagctgcctcccatttactgttactgttcacccatcaccaccacgactatcctcctcctgctcctcctcatcatcatcatcactatcagacagccatgttatagataacaattaaaactgttattaatgtatccagtcttgaacaccaaaaagccacattcagcaaatgtcatccaataaacagtcaccacatccattcatttttctaatgctattccagtgaactagggaagaaaatgtcataaaactcattttacagaatggggaactgagctaaaaatgattacgtctcctagcttccctcggtgactgagaggctgagacagaactggtgacactcggctctgtttgcctggcattatcactcatcttaaaaatatttaagcttcccaaatgaaaataggtaggactgtttctagccgtctgatctacctggagacaaacaaggccaagctggcttgctaagcacattggaataaataaagtattaagacatgagtgagggcctatcatacagaattcccatattgcgtctgcagtcagcataataaccgtggcatttcttttcgttctgcattcagcctggctaattcagtgaaaccttaaaagtgacaaatgaatgttgaaaaagagctggcatttcttccaagatttgagaagatgccagaaggaccctaggaaagtgcagtgacagctggaatggaggaggacagagtttaaaaagcaacttaccacttattttttgtgtttaatttttatattaagaccacaaaaataacatgagattgtactgaaagaaaaaaaataagttttttaattgtacagttaatatttctaaattagccaaaaccagaacgactgtcaaatgtgtcaccaaagcctataatccagtccctatggcatcattcattgacaaatatttttatccatttcaaaacacataaggaaaaaggaaaaaagactcttaaagcttctaccagacctttaaacaggccctaaaaaaatccagagctttataatattttcctactactttgttacatgcacatttgccaaaatttccctaaaacaaaccacttaaaattaataaattacctgtcaaatcccataaaaacagatggtcacttagagacaggagaagatgctagcattctgttttacacagatgttcagactgggaaaagatcatttcattttccataacagacaatgaaccttgtctaagatttccaatattatgcataaaaatgaaaatatcatgcagctgcttctatgttacacatctggttactgttgaagaaacatctttaatagtaaaatgaaaatcattataataaataagaactaaaattggtctttgttttctcttaacaagtatcatgctacttgtaagtcctttgctatcaaaaaattttaagttgctaaatgctcctaaattgaggtactctaatatgctatttaatgcaatcaagaattaatcagtaaactcctatccataagaaagtacacacagctgaatatctgacaccccaactgtttcttcctgttactcctttcaagaaggtgttttagtaattttatcagaaatctaacacatgaaacaataagtcaacacaacattagtgtcacacatccgaaatgagattttgacttgttagtctccaacacattacttacattactataaattgcatgaagatgaagacatttggcacctaagaatagttatgaaatacccaacaccaagagcatgcctgtatttatgctcagagctctcttggttctacatttttagcaaaagacatgaaacttgatagctaaatatatgaccactttttcacattacttgccaggagcaccaatgtttaagtcttcaaaatgtctacaaaatatattggtgacattcaactactctaagagatggggtatgtacagcagggggattcatttaatattggcaaaatgattacaatttggacaggctactttgggttaactgttaagtactgaatttgatcagaagttttcctaacaatcccttgtttaaaatatccagtggatttcactggaacaaaatccaagccccttacagggtctacaaggctctggtgacctctaagaccctgcccatccctctaaccccatctccttccactccctgatgccatgcctccatgatcatctttctgtcccttgaagtcaccaagtacctggccatcacctatgtgatccacccacttggaatgcccttcccttagatcttcttgcagctgttgagcattcacatcttgcatcacaatgtcatttccacagggaagacttctccgacccttggtcccacccttatttttccatcactatctcactaccctcttttatattattcatagcattgctaacttgagaacattatattgtaagtctttacatggttttctgtcttctctcactagaattcgaagccgctcccaagagatgccttactccagttatatctccagcaccaagtacctgtacataatacctgctaaatgaaggaacaaactgcttttcattaaactgactaataatgtgattgaagtggccaaacaatccaatggaatccaacttgtatcttggataccccactactggcctcataattagacttaaccatggaatgaggtgataagtcctcaaggcctaagggattgtccagagcctatatatcccctgccatgcacattccccagaagtctaccgaaatggcccattgtgggcctcttttcaagatggggccttccaagggaagcatctgctgtcctctaattatactcctatgctcaaggggtggctgtgtgcaggagaggtggatggacctgaacacacatactcatgaggcacctcacaacgcacagtgaagctgggggcggaaagaggaaccacaggctagggggaggtaatccctaatccctgtgctacatgttcctgcactaaactccacaaagtccgggaatgcaaaatggaagccaggccttacaggtcactctgaaggtatgtttgtcagggcaagacattttattcaatttgggatatactttagtctacttgatacagcattaccttgatttatatatgcatttatgaaattttatattttgaacatatggtgtatgggcctctatttgtccttctgcctctggtcctataaatgttagggatggggcctaactgctactctgagaacttgatcaagtacctcagttcactgagtctgtttcctcatttcagaaagagaaataattcctgtcctgtcaacaccttatattatgtgaagaacaatacatacaaataaaaaacataattttaaaatatttctattatgttctttcccacatacctccctgtgtattccagcaagtgagaatgatgataatttccatcaccaattccaaggcaactgtggcttttgagaaacttttgaactagacaggtgatatggttttggtgtctgtcccctccaaatctcatgttgaactgtaattcccaatgttggaggtgggagctggtgggaggtgtttgggtcatgggggaagatccctcatgaatggcttgatgccctccttgcagacgtgagtgagttctcactctgagttcatgtgagatctggtgtttaaaagactatggcacctcccacctcccactcgtgctccctctctcaccatgtgacatgcctactcctgctttgccttctgccatgatattaagttcctcgaggccttcccagaagccgagcagatgctgataccatgcctcttgtacagcctgcagaaccatgagccaattaaacctcttttctgtataaattacccagcctcagctatttctttaaaacaacataagaacagactaacacaacagggtttggcttttcaccgccttttcttttagtgttaagtactctttacatttcttctccattctacaaagtttcacatctttccagaaggaaaagatgtccaactgtctaagactttggacattaagagagagagagttctttaacaaaaatttctaaagtaaaaattaaaaaaaaaccttttctaattatttacagttgtagagaggtgccaactaaaaaatatctcatctcctatttagtctattgaatactgacatgttttccaggaaaagtacataatatacactaatgctgtgcatttattgatctctaatcggttgctggaatgaactgaacaagaaatatacccctggggctgttttagatctctctggctgtctgtctagaagcctttcctaccattccagagaaaggatggtctcagagatttaataaatcaagagcacaaacagcgcatacaaggaagctaggacaaacaaagagaaatgcaaaatgagctggcaggtgggttagggtatagcagtagatgaaacagactctgcagggcaagggaaaacagaatgagttttcaatggactgagattgaaaaagtcaaaaccccttttcacaactgatatggttttgctgtgcccccatccaaatctcaccttgaattgtatttcccagaattttcacgtgttgtgggagggacccaggagaggtaattgaatcatgggggccagtctttcccctgctattctcattatagtgaataagtctcacaagatctgatgggtttatcagggggttctgcttttgcttcttcctcatttttctcttgctgccaccatgtaagaagtgcctttcacctccagccatgtttctgagacctccccagccatgtggaactgtaagtccaattaaatctttttttcttcccagtctcgggtatgtcttcatcagcagcataaaaacggactaatacaacaatacgttagatctatcacatggagtacactagtcactgtggaaaaatcataaactgcctaaaactaaataatagaaatctatatcacattcccctttagagttcatcatatcagaactttccaattttctatgtaattaaatagttctaccttgtctctcaagtctacaaatcaaataaatgcagcaggaaacctacctgtaaataataacagcaataataataaaggagttaacatttattgtcttttgtattgattgatttccatacactgatctgagttatcgctattaatttaatgaggactcagcaacaatctgattcaagaaatatgattagttcctttcatagatggggaaacttaagacacaggaaagttaagaagcttgcccaagatctcatgtgggaaaattagaagaaaagtatttagaacccagaaggtctggctttatagaggcagccaaatggttcagagtgtaaggcacagagtgaagaactgccaggaacttgacacttgatcagccagcccttcaacaaatctgtgttcatcattatcacattcaagggtgcaaggaaaaacaaacaacacaaataaagctaatgtgaatccaggcctggaaactcactatcctagcagagaaggaagaagatcttattgataagaccttatggagcaacttcaaatacaatctctcatatgatatctcttcacaatgtccctgaattgctattcccagttcatagagaaagaaacagagaccaaatatgccgagcaagttattcaagattacaaaagtattcagtggcattccccacatatgaacaggtgttaattcaatattaattcaaccagcatccccaaatagtctggggaataggtcctccttgttattcaagacatcaactcaacaagtgggaaaagacattggtaatatctaatcgtaagcatatgtaactctcacatcctccaaaaaaaaaaaaaaaaaacaacaaaaaaaaactgaatatcaaagccacagctcaaatccagaccttctaaatcctattcaaatattgtttctaccacaccaggtacactgtcacctcacgatactgtatagaaaaacccacaatgtaattataaactgtaaatcctgatgggttaggccttgacaaatcaaaatgaagaaaatacactcatttcccaatgtccatggcttccttgcttactatagaagcaaaccactatggtgagcctaggtagccaatgaaggctattaggaaaatgacctttgttagtgacaaccattcttctgatacaatttgtgtacattactataggtccaggtggatatacgtcaacctccacatttattccatcgatttctttaacatggttttaaagatagataccacattacatgtctataatatataatgtatttgcaaatagtggcttgttattatattctcgcaataataactaaaagttgttattctaccctataggatatttgcatattcaattggtctaacacatatagcacattcaattgtgtatccagcaaatagcatatttaattggtctaacacatccccaatgcctaacaactaaaagttgttatcctaccctatagaatatttgcatattcaattggtctaacacatataacacattcaattgtatatccagcaaatagcatattcaatcggtctaacacatccccaatgcctttcttcaactaccccatcccaaacatcaacaagtcccgagctgtccatccaaaacacatctcaaagacatcagctccaccacatctcccgtgtaaacctctcattcacaccaccatcttctctcacttggaagaccataatgacagctgatctctttctcacttctcctgcagccccattaatctatttaccacaggacagtccacagggtgaccgactcatcctggtttgccttaggctttctcagctttagcactgaaagtcccatgttcagggaactcctcatttttgagcaatcaagagcagttggtcacccccgactatggtgaactttttataagatagataagatcaggtcattgcagaaatcactagccccaattcctcatctctccctggatccatgccattttccaagtgactatgcagttcttcccactagaggccctgaccccttgtctttggattccaacaatgggatattagcagatgtgatgcaacaaggagcttgaaacatacttgcagttgggcttgctctcttgcattccagccacttccttgtgaaaactatacccacacctagcccacaagtccgaggaggatgagaggcacgtggtacaggcctggacccaacctgcagtttgcagccaagcccagagagggccacctcaacccactaatatgcagacacttgagcaagaacaaatgactccctgagtttggggatggtttgttacctagcgttgttgaggcaatacctaactgacatggatttcatccaaatcttttggtagcttcccatttcacttagaataaaatcaaatatacttagctgagcacaaagccttatatgatctgggctccaacccatttgccagacctcaccatactatccttttctaaacttcattctcaccgatcccctttctgtttatcaaattgataaagctgtttctagttcaggatctcggcctctcctgtcacctgtgcttgaaacactttcatcccagttctcatgactggctcgtgttcatcctcacaggtcagcttaaaaatcacctcctcagagaagccttccttgactatcctataacatgaaatctgtgtatttctgtcacagtatttctcacaatctgtcaattatttgctaatttgtttgcttatactctgcatcctcaccaagctcaaatattcaaactattttctgcatatgttagtggataccaattgaatggtacccaaaagctcagaaaatcccttagcctggtaccttctggtgtgatgggtaaaagatttttattattgaaaacagaaagtgaaaatcagtaagatagtaaagctatagatgacttttagcaatcattgatattgttttaaattaaaagttcaaaaggggtttgattttttaagagttagctggacataacttttttaaaaccagaaagaattacaccagatttttagttgtatcagtctttccaaatgaaataatacctcaagatcagactccaataacgataccccctccccaccaaaaaaactactttgcttaagtcaaaggaagctgaacaaataaaaatttgtttggtgtggtatgaaattacaagcctttagtgacaggagtaaaaacggaagcaatgaaagtatcattctctatcattagttatacttccatactactggtcatgtggaaaattttagctattcacttcttggcagggacttcgatgttcacaaaagacccctttaaactccaaacactgtgaagttaaaaggcagtgaatcgtgaaagtaggtgtgtttctatattgagaatacctgtgtaatgtgaaacacaacagaccagttccttgttcagctaaagggggctgcttgcagtattaaagacagaggtgaggaggcaccagggcttctgagagttttgactaataaaatcaccccaagaagggaagacacagaacgtcagccaggcctcaagcaggaaaggagtgccagggtgggagtctgcccagtatagggagttttgaattgacctttgggagaaagagggtgtgaagagatggctctgcgtcctaagcgaaggtaagcaacctcatgaacatggctctggacgctggaggccctggtccctggactttgggcttggaagcaaaggccactgactgtttctctatcactctgagaagctccattgtgcctgggcctcttagatgattattttataaactatggattaggacaatggcatatctcaggaagggcacatgaggattcagtgagataaagcaggataaacacttaacagtgtttattacagatacactgagttttcaaaacatttcagccattgtattttctaccacctagcacacacaccagatcaatatttgatgagagcataagtaaatgaaagtctaaggttttgttgaaatgtgctctttgtcttgaaaaggaaaagaattgcataaaggtaaaacaagatgaatgtgtctcctaagacatcaggatggcagatctgaacattctagtcatgagaaaatcattccattttgtaaatgtgccattggcattctggtgtatacatcattctcacaggcttggttgatgaacatccaacctccttagtttgatgaactctgggtgggtacccacaagtttcctgacctaaaaggcaaggagtggtttggtttatttaaagtagtatcccttgacgggttgtctataggatctatctcagaaagcagccttctacacttccatcggaaaacacctctctcttcccctcaacacaagtaactagctttacatacaaacagtaagatgatcacagttattacttctctgtttaaagctagaattgccaacttcctgccaatcattttgaaagataattttcatgagagccaggagaaagaaagaaagttaaggacaaggtttctattctgggtcagaaaaaaactctgtttgttaaatgtattatatttaataatgagtcagaaagggaaagtagtttttgcctcttccaagaaggcttccctgaccacccagcatttacagtggaataggcatcccttttccctgcgtgccatgacatctgggcacaccttcactactcctgtatccctatgagtttacacatctgtctctctaccaagcagtgaacgtcttggaagcaccaactatttgtagtcatccttgtgcccaaccaacctcagtacctgattatttcaggtactcaataactgttaaatgaattaacgtcccattgaaaagaggttacttaaatcacagggggttttgagccctctcatggtttccttatagtcccctcacttataacacacacaacactggcaaggatggagagctactgtctaatactgagcaatactgatgttttttccagaagtaggggaggcagtgacaaaaatggcactgagataagcatatttgggacacctttaaactgaaatgagcacatatccaaagatcctataactgaaagtagagctcatcaatgtaaacagaacaaaaagccactatggaccagggacttttgttaacatgacctgccagggatcagagagaacccacagaaggtgaagctgtctttgtctaaggagattcattcctggtaataccagacctaaccatccccacatttcaactaaggctgttctgtggcatcagacaggaggatcagcctgaagagaaccctggacataaggctggcaacaggcaaagacaccgagttgatgtgtcccttcttaatttcccaacttcccaccattgcccacagggctgctgcttccttagttttaccttctcccttaaacaaagcttacaatcatgacccaatgacattagagaaagtcactgggtatgtatacaccagaagtcctgcttggcaacttttagcctagatggagggttcctggatgtctttgttctcttattaactcttccattcagtaatcacttatggaattcacactacagtccaggtaccaggaatgcaaagatgaatgggaaagttttagccctggaacaaatccagcctcgtcctccctatctatttctgtaccccactcccagtagtcatcccaaactgtctggaaggccctttcttctcttgttcatccttcatttaaaagctgcaagaattgatggaataatatttaaagctctcatctttggccgggtgcagtggctcacgtctgtggtcccagcactttgggaggccaaggcgggtggatcacaaggtcaggagttcgagaccagcctggccaatatggtaaaactccatctctacgaaaaatacaaaaattagccaggcacggtggcgggtgcctgtagtcccagctaccccggaggctgagggaggagaatcgcttgaacctgggaggcagaggttgcagtcagccaagatcgtgcccctgcattccagcctgggcaacagagtgagactccatctcaaaaaacaaacaaacaaacaacaacaacaaaaaactctcatttccttttcctttttttttggagacggagtcttgttctgttgcccagggtggagtgcagtggcacaatctcagctcactgcaacctctgcctcctgggttccagcaattttcctgcctcagcctcctgagtagctgggactacaggcgcatgccgccatgcccagctaatttttttgtattttagtagagacggggtttcactgtgttgcccaggctgttctcgaactcctgaactcaggcaacacgcccacctcggcctcccaaagtgctaggattacaggtgtgagccaccacgcccggccaaaactctcactgtctttcctacaaaacaggcttcctgttaaagacagctgctatcaaagagtcatccttaatcttattcaggtaaccaaaaactttattctttaaatggagacaactttgagagtaaaagggatttgcagttaataatagttctggaataacagatgtatccaagtctgtcccaggcaaaccaatagggatgatcacctacaccgaagagacagaaattctaagcttaaatgccagatgaatcttgaaacctgtccagatttacagaaacacctatactttattttgtatatgaaaagtatcgtgtgaaaggtcacctcacaactatgttgtaaggaatatgtttcctctttctgggtacagaggcaacaggttaaattacaacccctgcatcacccagtgtatgctgtgatgtggaacacactatttaccgtaacagcaaaaagcacatcatctactgatgtttcctatgagccagagactgttaaggcctagatcattcctcccaccaaacccatgagtagacactactgacatcccacattttacagatgaggaaatggagccttcgagaagttacagcacagctaaaaaggatgggactatgcttcaaactaaggcagtctcttccagagcccaccttcttaaatactaccacagtgccttctcaaagacatcactgaagaggtgataagatgagccacaaaaactgggagatcgtgacaatgataatgatcctaactacccattattggaaactttagggtatacaactctgctaaaccttatacacagcatgatctcatttcactctcctggctctcctaggaatcattattactaagcccattttacagatgaggaaactgaggattctagaggctaagtaacttgcctagggttgtgaagctatcgtggagcaaatgcaagatttgaattcaaggcgaactccagagtcatcctcaccatattagaaggtgcactatgaaagaaagaatttggacgaaggcaggaaggaaactgatgtggccacacactgggtaacaggcataaagagaggacaatgagcgaaaggtaaattgtgactgcgtcatgcacagctgactgtgtatgccacagtgagttaaaactgaatccactaaacaaggaacagtagtaagaaattctgagcaagagtgtctcaacgggatccaggttttctcatgtttatgatgctaatggacagatcatttataaagaaaatatatatttatgtaaagttgtttttcagtgctgcatctagcacctgaagattctgggaacaatttgatttttgcacatcaaatacctttagcactgttattttccccctgttatccacgtcccatctgtttcctctgccccatgctgaagtgactggtatatttgctcaaataaaagcctgaagacaaaaaaaaaaaaaaactctaatacttggctcacatttaatttgagagaaatagactcccaaatctcttagcttgttcgatgttgaatgaaagaaaaaaaattacacagctgagatagcttgtttacttacccaattttcatcctaaggtagatcaagtaacacaactcttttaaaccttctcaattcatttcctgacttttttgtccgtaacctagaaaactcaagtacagccttagtactatttatgaacatctgttaaacattgccaatgcctgttacaaccaccttggggaatagtgtagcatcttaaaagcataattccatatgtaatatttattctgttgcaatgtaaagaaagtatgacgctcattttctttaaaaattatgcaacttttgacttacatcttcatctacttagaaaatatcaaccaacagtacacaagtcattatatattcattatcaagttatctgacaagttgtataaaaaaacatagcttcacacttgggtgttattgcaaaagtattgaaaatttttatttttatctgctgttgatgttttaatagttgttttgtatttctttcatgacggctcaaaacactggctcagttcaatccaaaaaaagaagaaaaaaagaaagagaacttggtgagtgcctcatttgtgtgaaatgtgtttcgtttatctttgttgccatctcaatcattccttgaagtatgtattattatcccctattttatagtcaagtaaattgtggtttagggtaatcagtcaaagtagggctgggatgggagctctgttctgactgtatagcctgtgtttcttctaagccttgaagcaaagagacaaagattttcaagattctaaacactactttcagaagagaccactacatgatcaccaaacccatttcttctttttcctaagcatggattgaaactgtatttcccagccacccttgaagttggttgagatcttgcaattacttttagctgaaatgacacagtccatgcaaatttctacatgcaatcctccatggtttttttgccttttgagtggctggaatgggcatactttccaggtcatctttgggagccatgtgtggaagacagcagagtgaaaaacaaaaggagcctgggttcctgtggcagaccaagaacatcatgctagatttgtatgtgaataggaaataacttcttcttgcaccaggctactgagaatggggcagctcatgtgcttcagaagctagcactacctaatatgccaatacagagaaaaacaatccaaaaataaccacaagaggaaataacacagtcaatctagagattatcataaaaccttaaaataatattttggaaaaaaatttaatatttagacaatgttcattttataatatagaattttaaaacaaaaattataaacaaaactgtacttagtacctcaccaaatttataaacaagctcattctctctcaatgatgtcatatacatatgtacacagaaattaatattgctgaatgcatgtgtgcaaaacaaaaatgaaagaaaatatgttaatattagcacaggcttcctctaagtaatgagattagaagatattttttacttattttttacttttttgtaattttctgtattttccaatatcaaaataatgagcatgttcctttgataatcagaaaagatttgtctaattatgtttaagatttctttaaaaggggcaatccacccagacagagcgatcacagcagtgaggtcctatgtcatttaccctaggtaaagtttttctgtttttctgcatttatagcccataaagtaccctctgaactttcaaaactgccaaactttacaatggggtgagtcaaaggcccccagggtaaaatatttcacgggaaagtcctggaaaatgagaccacatgccaacataacttctttgcccattctcaatgaggtagctttaaaaaaacaagtcggccaggcctataatcttcccaacttggcctcccaaaggccagcaatttgggaggtcaaagtgggaagatcactcgaggccaggagttcgagaccatcctggccaacatggcgaaaccccgtgtctattaaaaatataaaaattagctgggcatggtggtgcacgcctgtaatcccagatactcaggaggctaagtcatgagaaccgcctgaacctgggaggcagagattgcagtgagctaagatcgcaccccccaactccagccggggcgacagagcaaaagtgtctcaaaaaattaaaaaattaaaaattaaaaaaataaaaacaagataatacataactgcattaatgacacaccaaaaagacagaaagtaaaattatgttagttaccatggatacacaatcatgggcatgaagagatctggtgacactcagtaccagtccttaaaggaaagtctttccctttggtttagatgaagattccaggagataatatttatgaaatgctcagcacaataccaggcacatggtaaaggcccaaagcttaaacaccaccactattatttttattggtaaaagtgtaagaagaattaatccttgctttagtaggctgttaaaattgaagttaaggcattgagtttcaaagtactgttctcatttgtttctgagaaaactgaaaggaagctacatgtacactcccataaagcctgcctgcccacaacccgccttgatctcgcccttcactctgcaggtctcctgcagagtggtattcagtgaataccacaagacacttagggaaaagatattctagcacagagaaattctaaggagatgaccagagaagaccatttatatttgcagacttaggaagaagaaaaaagaacattttataaaagggggatctctttgcaaaaatacatacaatagaaaatgtcattaaaagctacaacttgttgaatgggatatcctctttataaatacagttagggaaaaccattaatttaaattcaggtgctcctttaaggagcatttgcaagcgagcatgagcaagtgaacattttctgaataacaatatttattcgtgagcacctactgcctctgaggacctatgagaagcactctatctgcatgagaccaggttcttagcagcaagcaacagaaattaactctagctcaaataagcatgaactaaattacgaaaaagaaattgggaggctcacataatcaccaagaaggcaggacaatcagacttaaaaaatgggaaggaaccaaagaggccaacagcaggcaggcacacaatcaaatcacaccacaggaaccatctgtctggtgaggacaccactgttattcctagaaagcagataccgcttcaacctctcatggaccacatatgccattaccctaggagcagctttatattattgactccaaagtcaaaataatgggcagctgatatgttggtaaaaggaaaacttacttcacaaaaatcaatgttatccttgtctgtcattataagacaaaaatgaccgtcatctcaataaaaaggatattaagatctttttgcaagatcctaaccacatgtcataggacaaagccacaacaatcaaggaggcttgcaatgtatttaattgactatgggattaatagtacatatcaatcagtagtcaatgcacaacagttctttttttacatcaaatacaattccttaatggtgttaagtaattcaccaggctttaggatgtgattacataataccaaaagaacaagttatcatattgacgaatggaaacatgttatagctgaaagcaatcaaaagctagccaagttcaataaaagctccttatctccattttaggatgcatgtcattaggccagagaagattaatttctccattcatagttcaattttctttcccaacaaaaaataaaactgagcttttgaaacgcaattttcttgcttaatcaaatggtaagagtctcatgtcaacatgtgtggaataattaataaattgtagagattctaaaaactgaaagatagtgatcctagatatgtttcatctaagtttatatacaaatacttttttaagacaggtatttccagttatatgagagacacaatccttcactcactttcaaagagaactgaaaaggtaacatgaagatcagtcattcacacagtaggtattctgtaatgatctgttgactgtattcattaatttaatccataagagaaaaaaagtatgtacttataagcctcctaagaaaattgtatgcaacgtaaacaactcctcctttaaagcgtgattataaaaggtggctccgataaatggcagcagcaatgaatattatccacacattaaaaacttaattcaaacaaatttgctctctcagacataaatccattttctatgcaagaaaatgaggatctcactcaatatcttaccattatgaacagtgtttcagaaacaaaatgtatgcattacccattttaaacaaatgttcaaattaacaagctttccataactacacagcaaaaggttctatttgctcagagataaaagcaaatgaatcattaagaaaatatctgcagattgcagtttctatatattgcaccttaaaacctgccacatctagttttaatccaatcttctaattttattaatatgcattttccatgtttaaaatgctgacccacacataaaaatctcccaaaaatatcatcatcaagttagcaaaaggaaaatgctaggggagatttaatctaatctgactggattaaaatcccatcatctttgtcatttagctctacaatctcggcatgttttttaactttatcttgcctgtttccttgcttgtaaaatgacataaacaatgactgaatttggcgaccaactgaatatagtagacatgagagacattaatgatgcagagctatttcagctgggtaagtagggtggcgagaagaagagaaggtttgaagcaaccaagagatgacaagttccatttaggtcaggtgtgccaaagacactcatgaacaagtggtcaacagacaactaggaatgcagcttcaggcacaaagaaagagatctgcgagacaatccgcagagaagtcaccctggaaatcacagatatgattaatgtcacatttattttcaaaatattttataaaatgtcatttcaaaacacatcaaaatatgaataaagtaggaaggtaagcaaatatctttcaattatttacaaatctttctaattaaaatatgaactctcctaacacatgattaacaggatagttattacgatgtctctggtctctctgtgagttagaatcacaacagtagtgaacctcctggaatttgctgccactgacaacaatgatgatgctgatagcaataaaatcttatatagaactttctcagtgttagacacataatcattctaggcaattttctcccatgatggtatcataattacaaggtgaagatcccattttttcaggacaatcaggaagatgtgtgcataatccagttttaatcttaacctcaaatctatttgctaaaacttcaatcgtgctcttggttctgtcaatcttgtggtgacaagaatgtaaatactctgaagttttgccagattcttcttgctttgctctctccaggtaatctcagtgatgtgcacacaatttttatatttatgatcaactaatttcacttttaaccaactagaattggttccatatcctcttctaatgctataaatttccccttagatcaaaactattcaacaacagaaatcagaggagaccttccttctaccaaaactactcactgagttcgggaaggattactcattcattcaccaaataaggagcttgaattttccaaattcctgtttagctctagacagaatcacagggaggccctctgttggccataccaccttaaggagcatcatagatatgcactggtgaaacctgcatgcacacacactcacacactcctataagcacacacacacaaccatgcatcattctccattcctttatccagcttgattttgtcaatccttttatcattctcaaccctttatccagtttgtatttcttgagagcatacctgaagaactaattttcttttacttcaaattgctttattgtctctttttttccctcccttgtcccagcccaacacgtcaatgcaacattgctcattcctccagagcagaaattctattaaaagcatgatacagccaggtgcaatggctctcggttgtaatctcagcactttgagaggctgaggcaggaagatcacttgaggccaaactgggcaacacagagagaccccatctctacaaaaaataaagacacaaaaattagccaggtgtggtggtgtgtgcctgtagtcctacctactctgaaggctgaggtgggaggatcactcgagcccaggagttcgagattgcactgaactatgattacaccactgcactccagactgggtgacagagtgagaccctgtctctaaaagaagtaaaaaataaatacaagtaaaaagcatggtacacaatccccaaccacaatacaatggctaaataaatgttcataaaaccataactaagaagtcaattagctcactaagtgcatatctccaggaatatctcaaagagattaggtgttatgcctaagaggggtgaggggagtaatcagctggcctccagaattctctttaaaaaacttagttatacctgcaatgctagtgcttcactgtatttaagaaaataatggggaaatgaagatcaaagaccaacttgaactttacatttctttgctctcacttcccaatccccaaaccacaagagtataaaacaaaaatgatcctttcttatgaaaaggctggaatacagtactaacctttactgagtctattatcaaagttcactgaggagctctcatccaggtttagatcttattttactgggattttttcacagtaaaaaccaatcttgatagcttttaaaaatgaaaccaattttcatttattaaaatataagtcacttcaatttctacatttaacatctgaaagtcacaaattaatttctttctagaacataaattctatgaagaaaaagggcttgcctgtcttgcacagctgtgtccacagtgcctagtacatggttgaccctcgataaatatttgttccagaagagaatgcatatacatttcaactgacataacatagaaagggtctggtgtattagcatctggtagaactttaaaaagttcaaagaacaacaattactagctaaagtacctgcgacttactcttaaaagagcatagaaaattagaatattgaaatatggagagtgcttctatcctaaactctcaacctgtgctactgatacctggacaagactgagtagcagacgcacaactctttatttttagtgggaaataactgcattcccaaggctgaaggatgcacatgcaaatccttctagtgtccaaatgtgcactgtcctagatggtagccactagccacatcagtctcttgagcacctgaaatgtgactagtctgaaatgagatgtgctggaagtgtagcattccaaccaggtttctgaagattgggacaaaaaaatgaacacaaaatatcctgttgataactttttatattaattacatgttgaaatgatgttgttttagatatattggagtaaacagaatatattattaacattaatttcaccctttttttcatttttttaatgtgactgttagaaaactttaaaatactgacgtggctcacattatactcctactagacagtggcaatccagaccgacacctacaaagtctgtatgccacaggtggggatgctcactgaaaggcagacagcaggacctgatccctaatatctggatctgtaaggaggaaaatgagctagatgttctaccacacaacaatcgccctttgatatggtttggctgtccccacccaaatctcaccttgaattgtaataatctccacatgtcaagggtggggccagggggagataactgaatcattggggcagttttccccatactgttctaatggtagtgagtaagcctcacgagatctaatggttttataaatgggagttcccctgcacaagttctcgtctgccaccatgtaagacatccctttgctcttcctttgtcttccactatgattgtgaggtctccccagccatgcggaactgtgagtccactaaatctctttcctttataaatcacccagtctcaggtatgtctttattagtagcatgagaatagactaatacactcctaaagactcgcaatagcattgggaaataagtactattagctttgacctaaagaaactgaggcaaggacggagaaggtacttctgcagaattacaaagctggtaaagggaaggcaaaacactgaagcaaagttagcttgactttaaagtcatgcccttgtctttggtctcctccagtcactcagagggtgctctccccatgttctaagggacttaaagaaggatgtcgacaactgactcaccctgcaaaggcttctcaagcccttcagccatgtttctcccagccactaacccacagctgacagaagtgggtgaaatagtgactaaaatctctgaaaaattaccatgaagcaacatcccatgtgctgctatctcaggtaaaagaataaagttttcctaaattgatgttttttgcttttttaaattgcagttatcatttcctttattagttaacatggatcacaatttcctttttgtgttatcaaatattgttgaaggcttccatccactccctgcacacattattgaacgatgctccactgttgtactattcttcatttcaaaaagagctgggatgaaaacaccctaatgctcatactgtaagaatttctgaggatacaccctccctaagggatactgaaaagaaagggaagttgtttgttgttctaattttttttttttttttaagagagagaaggtctcactctggcgcccaggctagagtatgttagagtgatcatagcccactgcaatctcaaactcgtgggctcaagtgatcctcctgccaaagcctccagagtagctaggactacaggcatacaccaccatactaggctaatttttttagtttttgtagaaacgggttctgctatgttgcccaggctggtctcaaactcctggactcaagtgatcctccctcctcagcctctcaaagtactgagattataggcatgagccaccccactgagcctgttctaaggtttttgacacttaggccaagtgcctccagtgagtgatcctggcggaactgaggacacagaggtgcctgtgaatctcatgcagcatgggtcaggcagggcccagtctagaggaaacctctaggtgtgccagggaagaaaggctctattctcctacacccaggccatcacactgaaggctgtcctgtgattccacatctcctcccaggtcagcaggactgaagactcacagggacaaagctctgaaagcagacccctcccttcacgctgcagtcaccatgtgattcctgcacacttacacacatgtacatgaggcaatctggacttttttgcttttgcagttctaagctctcccctgtatctgtccctgtcagtttaatccacaacaaaaaaaattaactagtgggaagccactacctgtgaattcactgatttgggcaagtgtatttcacccattatgaatcagcttacttagtctcttagcagcctcgagagcttcatttgcagtgtctgctacaaagaatctttgaactctcactccgttgtcagacatcagtttcttgctctggtattcctgcaggttcagccatcttctggaggttaattgaactgcctacagaaattgaaggagagaggtaagaacattcattaatagcaagaaaaataaaagtcaacctacatggccagtcttagaggtactgttgactggcaatctgcaacccagagttgagagaagcaaaagaaaaaaaaaacccacttaaattcatgcctaattattttttaacaaaaactgttaaggacaactacacacacacaaatgaatgcaggttttttaaaaatgctgaaagctgagtgagctctgtgatctagttaacagtaatacacaaatatcaatgtcttgcttttgatattgtaccacaactacatgaggtgtcagcattaggggaagctggatgaagagtacatggggctgctatactatttttgcaacttcctttgagtctacaagtatttcaacataagttattttaaaaactgttaaggactctattacatggatatggctccccccttctcaccccaaataaataaagagcatagcattattttaataactgtatatagactgttaatcattgtaaggtttttcaggaaatttgtttaaacactctgaagtcactgggccacagactaattcatttctttaccacagtttttaacagagtctgggtagggccattgtgtgtttaacgagattatctctttcatccaccaaggttgagtgcaataacctgaaagactgactattaattaaactagttcctaaactgcaacttgtgtattaaaggaaatttgcttaagtttcaagtagaagtggttttccaatatgcactacgtgtttatctgtgttaaaaggacacagtcaaaggacacaataacatgaacaaataaattccttacattttatccaataatatcaacagtattccctaccaaatctgtaagccccatttttaaaagaaggaaaaaaaaaaaaaaccaggaaaaatgaatacacttaatgtaaactcctttccatccatgagtcatatgcaaaggaaacattactcacaagaggaaggatgacaatacagttaatgcacaaaccaaaaaaatcaatcacacaactggatcacaagactggtagtacatggacatcatctgatacaatccctactggcttctgtccacggctttggtggatgtccaaggcagtgtcacacagatcataaaagtgaggcccacagggcttcatcacatggagccattaccttttgggacatctactgtgtccttaaaatgtcattttcttctggtatccccaagctatgatgtattcatggagctcttttgaaatagggtgattcaaagctctatacccccactactagactgtgttccactaaagggtagaaagtgtgccttaaacttctctgtatctctgtgaagaaggtgacagtgcttgacatatgaaagacacccaaaaaatgccacttggatggccaaatgaatcaactctgccttttgtctcctgatatggacaatttttcattcccagaaactggccacctctaaaaataaaaaagtacaagttagtccttaagatgtgaaataaacataatataatgtatacatgctggtaaaaaattcaaatttcaacatgatcaagcctaaagatagctctctgttccgtccttgtagctgctggtaatgatggtttggttttgcttttaatattgaagttgcctatacttcttctttagaaataaataatactgggataaaaataaattgtcagacaagcaatgctcacatcatttaccgtatattattttttaactacacattatttcttaatcttactttttaagtcttgatgaaacattagtaatttgaaaaacacaaaattctgtaaatgaacatactcaaaggctttatagtcttaatagcgtgttatataacatacaaagaaaaatacgagtttaaggcatttagcgaaaaagccccttagtgaaagaaaacattaaacattagctgtgtgctattatctaggaccactcttaaaaggcaaataggaacaatcaatagattatgtctacgttgacataacaatttaaagccattaaccaaagaaagaaaaaatatagtttgaaaagagcatttgagggagactaaaaacagccacaatgtggttgtggtcaattccttttcatcagaacactcgccatattaattttagatatgttaatgcaatctgctggaaactaattgcaattgatccagaggccagcttcacagacatgtaacatatattgactgtttccacactgactcaaatgaaagccagcttgaagtctgttgctcttaaattgaaaaccaggacaatgagcacagttccaaatccactgatgacacccggctatcactccacaaaggaattcttttacagaataatcacctatttttgtcaatccaaaacttggaaaactagggccctgactggctctaaaacttcaagacaactccacttattaagaatttgtagctgggtgtgggcaggcgcagtggttcacacctgtaatcccaacatcttgagaggcggaggcaggaggattgcttgagcccagtagttcaagactagcctgggcaacatagtgagaccctgcctctacagaaagtgaaaacattagctggatgtggtagtgcatgcccacagtaccagctaattgggtggctgaggctggaggacaacttgagcctggaaggctgaggctgcagtgagctatgattgtgccactgcactccagcttgggtgccagagtgagactcagtctcaaaaaacaaaaaaaaatgtgatacatctacagaagtataatttatgtttacttctgcattctcagttgtaaaaaaagggtgagaagaaatctgctatgcaaatggatggtagaaagtacgctggaaatgtaatataaactgctgaataataataacaataatagttccatctactattaattgagcacttatgagctaggcattatattaaatattcatgtttcatggttaaaacaatcaggaaatgtcaagaattattatctctctctgtagctgtcattagtgcaaatcaagaaatatcctcggtcttcttccttctaggcacttccttacttcagctgaagttaggcgatgccgtatctactacctagagttagcaccagatcccccaggttagaggctcagtcccacaggactatacccacttgagatgccaggcacaagccccaggttattttacctgtgcttctgaccaaccagttatcaattgggagttcccaagacctcctcctcgggtttaactaattttataagatggctaacagagctcacaaaaaccactgctgacatttaccagttatttataaaggatatgacaaaagacactggtgaacagccagatggaagaggtgtacataacaaggtatgcccatggagcttccatgccctctctgggggtaccaccttgcagataccgccacatatttggcaatctggacactctccaaaccttgtcctcttaagattttattattttattacataggcatgattgttacctcattagccattggcgattaactcaacttttagtcccgctctcttccccagagactgggaggatggaaccgaaagtcccaaccctctaattatgctatgggctttctagtaaccagtcacaatcctgaagctacctagtggactccaaccactagtcatctcattagggtagaaaagacactcatcacttcagatatcccaagggtcttaggaactgtgtgccaggaaccaggggtaaagaccaaatatgtattttttttattatatcacagtatcatatcaattaactagttccagccagtaagttgtgagtacatatgttgtgtgacacattcaggccaacgtttaattgccatccctcctaccccatcgaagtttgccctctctagatatggggaatggcaacattcaagatggtagctgatctatcagccagggaccagaataaggatggacatataccaagtgactttacgtaaatgtgtagtaaaaaatacacctttgtggattcttagccactgaaattctgggggttatttgttactattgcacaacctttttgcccaattggctttactgaccaataaagccatgttacaaattaggaaacgggctgaacttgcccaagatcacaagttactctgaaacagtaaaacttctggatcaactgggtaacactattggttccctgtgtttgtattctggtcccagaggctctgtggtgatagagactgagataagagacaagtaaaatagtgtccctttcgtcaaaagtctaccaggaataggactttcacgaaatgctgacagagctcgtgtaaggtaaaatgtaactactccaggctttgggagggagggaggtggagatgtgaataggtgttgtcctaagatgctagaatggtagaagtttatttcaactcctaggaagagctacctgttatgaccctaaaaataacatctttgctgcaggagacatgaagaatctctcagataatccatgaattctagaatgcaaggaatggaatggagtataaagatcatctgccccagtgccttttgattgtttctgccagtcatttgccagcctgccctcaggaccattccacaggctcttctgcctaaatttgagactctgttcagagactgaacagtagggggaagacaccaggctttgttgtcctctttgtgggtgtaacagcatctcctctgaagctccaggtctctccagacagccctctcttccacattccagctcctgctatctcccctgctgtgacttctgcttgtaacagctagccctagactcggccaacaccatttccttcctctcctatggctcacggaagattcctgctgttgtccatccatctctgtgttgcctcccaagcctgtgtgccttacaatctttccggccctttgttaaattctattaaatgacctcacaaaatccctgtcttcctgactggcccttactgacacagtgcttcacaggctgaaggtgaaggggaatggcagtgatccacttttaaaaaggtctttgggaccctatactggagaagtttcccagttagtcacatgtttcaaatactggggtttcaagatataaagggaccactggggtccaatcacctcagtttacagtcaggaacctggaggcctgatgagggaaagtgtcttgcctagggatcatatagtaagccagaggcctgatgaaagctggactaattcccagcttttttccttccttcacatggattttggcaaagtgaccgtgataggaacagcatcacattcttaaactagctggggtaggtgggcacctaggttttgttccctttggacttgtacaatatccttgccatcattcccttccttcctgcgtttctttgatagagcaaacatttctaagcttggaggggaaggggaaaaatacaacttaaaagaaaagcaacacataaagatttaagggcctatgggaacaagggagcagaagcagaagaaaaagaatgaaaaatgaggcaggggacaaagagaaccagaagataacaagacaatggctaagtgggcaaaaactgacataaaaactccaagcacaaaaccagacagctacacagaaaaaaaaaaatgacatgcccaagaaatcatccttcgccccatggttttaaaattagaggtgtagaaacaactgaaatagcacctggggtggggaggtgggggaatcaacagagaatatcaaaagaaatgtccctgagctcgacacccctgaaagggaaaatcgtctacccactggctctgcacttgctccagccttcttcagctcgactttgcacactagtactgctcacttgggaaggcagcataaagcagtattagaaagagcccaggacttactagtaatcaagaaaatagaaactcaaacaaaacggaagaagccattttgccaaaaggaatgaagatgccactgaacacaaacacaaacacaaacacacacacacacacacacacacacacacgagatctgatgctattgttgttgaaggtcaggtgaaatgcactttctcagatactatccttacaacagaacactagtgcaaccaccttccaaaacaatttgacagtgtttatgaaaactaaagcacccccattctctgacctggaaagtctacttcctgggtatctatcctagcaaaacatgtaccagagatacatgcaaggatcttctctggagaattgtacataacaaaaggatacgattggaaatgatccaaatgcccatcaaatagaagactggcaaaacaaactataatatattctgactgtgtgaactatttaacattatctatggcaacacagtatcaccaagtaaccatgtgtacccctacatttctcagttctcttgtagctagtatgccaaaacttttaagagaccatgtgcaaccctccagagccctatttgttggctacaaggacctggaagccacatgtggagatggtggaatcacaggtgagattaggctggattataagagttacaacatgggggatgtcacctgacccacatgtgcatgactgagaaataaacgtttgacgtgttaaccactgagatcttaggaataactcatgataacagcattgactaatctagcctattaagtctgaacatggtagcactaattattctacaaggcacaagactaaaagaaaccagcaagctgcagaacaatacatacagcagaagaacatatattagacacacatgttcacacatgaagcaataatgtgtatcttctaaggacagatacatgcataagtaaatgtataggaaaaggtccagatgatgttcaccaagctattgccagtaaacttgggaagggcagaccaagaaatttcaacctaatctataatttaaaaaaatttttttaataatgaatttttaaataaattcatttattatttgtgccataaatatcaatctacttaaaagcaacattgagaaaaagaaataaaagccaggctttaacacaatggtgtagccttaagtctctattaacttttgtgcaaaacaaagggcttgccccttacttaaatgtagcagggttcttcaaatgtggtatgaaatcgaggtgggtgagcaaaagccgcattttctgttatacagaactaccacctctaatataaactcctgctgttagatatgaagaggctcttaaacctcacttcgagctctcaacagcagtgacgacagtggaatacaaacaaggaattagatttaaactcagaggaaaatatatttccctctcattacaggcatggcaatgaaggcagatgcttggtgggctgtggcaagtcaaaagttagtatgtgtttgttatattttagttttgccaatgttgttctgtatgcaaattagcaccgataaatctaccttagtcacgttacctaggaaatatgaggcctcaaataaatgtgttggtgcaaatgaaaagacagatataactcaatgtgtctcaatataagtgtcataaaataaaaggcctgcttgtttaaaacaggctctgatgaagaaggcactttaactgtgccatccggtaaaagagattaagtggaatcctgtttgtgagaggaaaaataataataccaataatgctgttctgcttaggccttaatacgatgacaacagcacgtcaacttctctttcagcatgaaaacatgctacagaaataggtaagaaaagtaatcatcgggattagaagcctaagcctatggaaaggaaaaaaataataatgtcagatgtagaaggaagaataggactgtgggtactgacactgttctttttccctccatgttcaggctaaagagtagtcttcattggaagtcacctttgaaaacagaacgtcacttttgtttagcactgcaatactcttcaccactctccacttgggttctccctgttttgcacactgtaagaaaatgaattaaccaattaattagccccctgtggctgagttcttaaactctagaaggggtacagagagatcctacctaccctatggatggcagaaatggcagctgacatgagtttcacttcctcatttataaaatagaggatactaacaggcccatcttcaaaggctgttgtaaagattaaatgagttaatatatgcaaataaactggaacagtgcccatgacaagtactcaaaaaaagttagctattattatttaatccagaaatataaaagaggaggaaaggtgtaacaagtagatacctggcaatcattaagataaaaatagtaggtgatcatataaataattttgttttaatagtgcccactgagccctgctcattgttttaaatacatttgtagagatatttttaaactctaatcatggaatttctatacttgaatcactcaacaatcacagaaaaagaacagtaatttgcaaaaggaagaactagaaaaatctcacattcagaaagcatcttaaaatgtgctacttagggccaggcgcagtggctcacacctgtaatacaagcattttgggaggccaaggtgggtagatcacaaggtcaagagattgagaccatcctggccaacatggtgaaagcccgtctctactaagaatacaaaaattagctgggtgtggtggtgcgtgcctgtagtcccagctacagggaggcggggacaggaaaattgcttgaaccccagaggcggaggttgcagtgagccgagatctcgccattgcactccagcctggcaacagaacaaaactctgtctcaaaaagaaaaaatgtgctacttactataagtaaatttacttttcatctcatttgaactaggttatccccatctcacagaagaagtctgaaggtgagacaggttggttaagtagcttgtctaaggccactcagctgattaagagagagtcacgatttgaatccaggtccccctgcctaaaaaaaacccatgagctttctattatcacatctgactttttctctttttagtcagtctgtaaatcctgtgtcaattaaaaactacttggaaccaccacagacaaaaactatactgccattcctgacctaaaattactgttttccattttaaagtatgaacaaataaagcagctgacaaattggtaataataataatgacgatatggtacctgaaaagccagcgttgaagggatgtaaaacttaattagagtggatagctagagaagaaaagtactttaaagttcccgcatcaagagaaacaacacttgagttattcttcacaggacatcagactaggatcagaccagcgtccgagaccatttttgttccattgacaacgcatctctgatagtgccacatgtcttatctaaggcctctagcagtaaagcaagcagcatcagtttaaaataataataataaaatcatctgtacttccaaaaaagaattgacagttgagctttcagattatccagaaactggatcacagcaggttgctattttagaattcattcttcttggggtgccttggcaaagtcttacgttgctgatccaaatcaaatactagtgaacatttctgagtcccatgaaattccagaaactgtgttattccacttggaaagcattacctcgtgagattctccaattaaaggaagataccagcagaagctcattttacagataagcaaaagaaggttcagagtaactaagtgcctgctcagggtgacacagctggttggaggcaaagccatatttcaaatacaggtatgtctgactgaggagcctgtgccctttaactaggcagtgctggtgtattatctcccagtgcacaaccatgggccctgagccttgaagtcaactggggcaaaagaagcaggaggctctggtttatagatttcactgcaggaaggtacagagctgtaccgaatatgaggttcactgggaaaatgggaaggtgtgaaagagaggttgctggatcggtttccctaactcgaaagaattaagattcgcaaagatactgccttgttctttttatcctaggttcagcagaaaagcagcatatattttaaggagcaaagaaatgtaaaacactttgtagtaatgacaaatgcccaaaggagagtttgctgcataactctataatgctgctctgccagcagcaagaaagaaaagggagggaaaaaaatacaaccttgataaacattagcatattagcacaacagcagaaacaaatgtataaaaggctctaaaaataccaaacatcctttcagaatgcctgtctgttccctcctggagagtatgctagctcaatcatgttgtagaagaaaatcaccttaattttaccctgcaaacagaagtaggcaagatttatttatagataaagaaaacaaattaaggtaatataaacatatactggcatttaactcctaccaaggaaactggcagacctatactttgttcattcatttaacaattttccactgcatccataatgtggtcactgtgtttgacatccaagatctagcagtaatcagcacagacaagttctttgtggtcagcaagcttttgccctaggaggagaggcagggaagaaagacatgaacacattaatgaagagtgtaattacagagcagcaaatgctatgagggaaaagaaagacacacatgatgaggccgggtgcagtggctcacacccgttaaccccagcactttcggaagccaaggcagatggatcacctgaggtcaggagttcaagaccagcatggcccacatggtgaaaccttgtctctactaaaaatacaaaaattagctgggcgtggtggcacgcacctttaatcccaggtactcaggaggctgagacaggagaacagcttgaacgcaggaggcagaggttgcagtgaaacgagaatgcaccattggactccagcctgggtgacacagtgagactccatctcaaaaaaaaaaaaaaaaaaagaaagaaaaaagaaaaagaaaagaaagacacatgatgagctgtgcaggccaattttagactgagtggtcacctttaaagaaatgacatctgtgcagaaatctggagacagaaaagaggtatacctgtgaaggaactgaggcaaagcacagcaggctgagaggccagcatgttccaaggctctggggtaggaaaggggttggcacgtgcacgaacaagggagtatggtgacagaggagcatgaaaatgccagcagggaccagataatgcaggtgctggtaaggcaaatacagagtttagacttcattcactcagttttaaacagggaagtgagaagatcaaattcacgttttagaaaagccactgttttctgtttggagaataaaaccaattgggagagagctgcattaaaccagattaaggttagcaaactttttctataaagagccagatagtaaatattataggctttgaggccaggtggactctgttgcaactactcaactctgcctttgtagtgcaaactagccatcaatcataaataaattaataggcatggctgtgttccaataaagctttatttggctagcaggccagtgtgctgatctctcaactagactatagagaagggcagtagaggtggggacagaaagaaatgaggggattctggataaagtttggtgatgaggtaaagcttacttgtggattagatgtgggtttaaggaaaaaaaaaagaaatctagtattagacacacacacactttacaatgttagttgatatgcatgtggtaaatctgatgtacctgctagtcataaaaaaggcacttctttaaaaacaatcttaacctcaaatcttttgcccaaactggccttatagtttgaatgtttcttccctccaaaagtcatatggcacttaatctccaatgtggcagtattgagaggtgggatctataacaggtaattgggttctgagagctttgccctcatgaatggaccaatccattcaaggatgaatggattaatgggttaatggattatcatgggagtgaaatcggtggctttctaagaaaaagaagagagatgagagctagtactctcagccccttcaccatgcatcccttggggactatgcagaagaggtctcatcagcaagaaggccctcaccagatacagccctttgaccttggactcctcaggctccataactataagaaataaattccttttctttataaatgacctagtttcaggctgtctcttataagcaacagaaaatgaactaagacatggcctatgtattacatttaattattgacatttctgcacatcattccaccacatcagagctgctgggcctttgatcttataactttcttccattatttaatatcaatctcagcgggcaacaggctacagtacctctatctgctacagtggcccatctgagattctctcctaggagagaacacaaggcctcccttgattacagagatgctacatagaaataacaaaaaccaaagacattaaagctaaggattaataagattggcctatccaatggaatactgtaaaatggttccaatgaatgaaccagctcttgaaatatgtcaatgcaaatatatttacaaagcaaaacacaggggaaaaactagcaagtggtagaacaagaggaacacataagagtatgcacacttaaatagaaaataataatagtaaacaatcttaggaagatacatacatagatatatcaaaaccatttggaaggtgacatgccaagtttaggacactgactatgttaaagggtcagaagggatcatggattttccgatgagacaacaacagacttcgatttcatcacttatactttacgtcttttattttaaagtgatctgagcaaatctgagaaaatagtagttggaacttcttcacattggacccacagatgactgtgatattaatctctatacgctgttttatcctgaataaaagttatctatttcatgtagttaatttaataactacatttaattccccaaagatgggtttattaataaaatgaaagaaggcaagctagaaaaagaaaaaaaatctaattacatttaataaaattaataattttctaactactttgaaaagattaataagatctgaaggaaacctgagattatgacaggccaaaagtccatgtgacacatgagtaactgaggcctgaagttacaagagtaacggacactccctcaacaggccagcattaagcacccatccctgtgcttaggcactgcccttgcagcctgccaagacaacatctctgcagaacaggtgagctcatggaagaaggcgaggatatttgtgccaagtagcttggtcttatgtcaggttcatgttcataaaaattgagtctctgctcacttgtggcacaaataactctagaagttgtttcctgaaaattaagtcactgctccatctcatttaaatatatatatatatacctatgtgtatgtatgtgtatatatatgtcattccccccacccactcaggtgagtctctgtggtggcaaaagagggtctgtgttccaagaatcatctccatgcaaagtgttcatttgaaaacaaattgcggctgggcgtggtggctcacgcctgtaatcccagcactttgggaggccaaagcgggtgaatcacgaggtcaggacatcgagaccatactggctaatacagtgaaaccccatctctactaaaaatacaaaaaaattagctgggcgtgatggcgggtgcctgtagtcccagctactcaggaggctgaggcaggagaatggcgcgaacccgagaggcggtgcttgcagtgagtggagatcgagccactgcactccagcctggatgacagagtgagactccatcttaagaaacaaaaaataagaaagaaaagaaaacattaaaaagagtacaatactaggccatgggatcattctttaaattttcaaaaaggggaaaaaatcttgttctggggctattcattattcattaaaacccgcccaactacaccatcagagcagatcctttacaatactcagagaagggaaagtactagatatttttattcaaccatgtggcccaaacacatcaccagtgtgagaggaacaacagcagtgtttttcaagatctctacctcaaatgagcttgcacactaagcgggtaaagcagagatattagcaaaacaccagcttccagggtggctgggataatgtacgtgaaggtgctttgtaaaccctaaagaacctacgtgcacattcaccatcaccattaccaggggtcaaacatgtcatctcaatgcatcagatttgactgtctcacagggccctgctaccatctccacaccctgcagttagcaatttgttagccctccttaaattactccccacagtcctttccaataaatccagatgaaagcttgcaagggacagactttattcaatcaacccactcctgctccttctaaggatctaatagtgcttaatagtttaggatacatttgagtttaatgggatttacctgatagcaagagacttctcatcacttctttatagcggcagttttgagtgacctagctaactcaatctcacaagtttgcctgtcacactggcttgccaaagaaatgacttgtagagtaggaaatgagcgaccttcgctggggaaattcctgagatcatctgacattttgaatgttctctgtgcagaatgataattggtgtctgtgaggtctgaagtccactatttgtgtttagaaagacatttcattcttgttgatgaataaaatactactgctatggaaaacttgatcttagatgcttttaaagaaaaatataacattgcagagagcaccctttctttcacaatttcattgtcaaaatctccatttaaggagaaataataattttgatgattaaattccatggccctccccaatattccacataaaatgccctagttataaaaaagaaaaacacatgccaaatttttccatctatgttagtcatctcttctcttatagtaatttgaatttctttagccagggagggggagagggtaaatcatccaaatattacttttatctataagaataatccatagaagttaaattcaaggtgagctttcagaaaactagatatcatgaaaaggaaactttaaaataatccctgaaaaaaaaatttatacccaagtgcagaatgcacggtagtcaaatgagcctgtcacactgtccaggaaatgtgtgaaatacatactgtcattcatttgaaaagtccactgtgatgacaaagacctcagaaaagtacacacaaaaagactcttacaaatagacaatctgacacagtatctaagcagcaaaggaaacaatatcctaaacatactataccctcttaaaatcagaggagccgaagaacctaagaaacatcaagaaagttttatactaatgactcttcttttaggaacccatagtgaaatgctagatgatattgctacaagctaacaactggcccaaactagaagtgaagagagaatgaggcagaaaggatcaaagtatgctgtaatgtcaagatgacagttctgggagttgataattgagaaataagcttaagtgagtggcatcgaaggctcggtgggtcatcttcaccctgccatttattcacaggtgacctctgtttgtttatgctaactgcaaatatcaaccaccatgaccttacaagtttgctggcaaagtaaaatgaaagatttctgtgaaatctcttttccacctcgtccaggatcaagaagcaacaccagggaggtgagaaatgcaccacagtggggatttggttctatgaccttccaccaggtagatccagccagcatctaattagctacccaatgcaggagaaagatctaaacaactctcccttattggccattactctcttctcttgaggacctttgcctctaaaggaggacagtcagctcaaaattaaaattgatctctgaagctcctgctgcctctgaaaacactagacatgaaagctactcaccttctcagggcagaagaaacaccccaaggaagtataccgatggccgggaaaatgaactgaggccttgagaacaagccccctcccaaaagcaatctgctgaacaccaagtatcacctacactacacggtaagatctagtgctaagcacagtggggacacagaaaggatgaatgtaagactggaccaagctgtctaaaccaagctgctatattcatagcagcactaggggaaaaaaattaatggagtgcccctggtagaggagaatggtaagcagataagaactagattgaagtaggatcccacagtcaaaagagcataggacagggttgtacccaaagtaggagtagctacatatatatatatttacattttttttttttttgagatgagtctcgctctgtcgcccaggctggagtgcagtggcgccatctcagctcactgcaagctccgcctcccgggttcacgccattctcctgcctcagcctcccgagtagctgggagtaatttttgtatttttactagagacggggtttcaccgtgttagccaggatggtcttgatctcctgacctcgtgatctgcccacttcagcctctcaaagtgctgggattacaggcgtgagccactgcacccggccactagggttatcttttgtctgaaggctgggcacccatggagcagagcgggggctcgggcaaccatcaaaatgatcagcaccaagcagcaaggggtatgctggacaaaaacagcaattgtagggtacacgggcccaagagatgaaatagtgcctcaggggactactaacaggaaaagaccagttactggcagtcactggtgacaggatggtctagggcacaagagcaagaatgatgaaacaacacagaccaacatcatgaaagagaaacaaatagaagaactaacgctgaaggagaaaaagttgaaggaggacatagcacaaaactgctttttaaaagtacatgccgggtgcagttgctcacgcctgtaatcccagcactttgggaggccaaagcgggtgaatcacgaggtcaggacatcgaggccatcctggctaacacggtgaaaccccatctctactaaaaatacaaaaaattagctgggcgtggtggcgggcacctgtagtcccagctacatgggaggctgaggcagaagaatggcgtgaaccccggaggcggagcttgcagtgagccgagatcgcaccactgcactccagcctgggcgacagagtgagactccgtctcaaaaaaaaaaaaaaaaaaaaaaagcataatacatcagacagacgtgagaggacagtatatgtatcaaaaaattttcaactagaagtttgaaatgtttttgtttttaaaaaaggactagagatgggttgaaagtagagagactataaccagaagacaaatcagtgagcttgaaattgaagatggggggatttcatggtcaaatatctgggaaatacagttttattttcttcacttagaggttctcgatatatgctttatttgaggttctgaggagcttgaccattaaaaaaaaaaatctacttaactatatttagttatcccccaaccaatttttacttggcatctgctttaaatcccatggaattagttactcctttgggaaatgccatagactgcaaaacaggacaaagtacacaactaaccatacaccatatagaagcaaattggagctgttgcacatctgtgtgaaaatacttttacttggatatttcacaattattttctcattagatctgaacagcatctttgggattcaatgtagtaaatcaaaagaaagatgaagaggacctagacttgggccattatcagtgacgtgccagttatgaagttattttgtctcagctccaaaatctcctttctaggtgttcattgctctgcggggctgataatcctgcaaattactttctctttcgccatctggcttcctattagggtctgcccatatggggcacactatagggagactaaagggctggcagatagagatgatatctgctcctttctaatgttttgtcaccatagcccctggccccacagctcctcatcctggcaaaaggagctggtttcaagactagctggttccagtttacaggtgctaccagcactccctgaccagccttggagccactgaaaccagccaagcagcagcctttccgaaaactctagatcccagctctgcaggacctatgttccaagttcccaagttcttagagagcttcaacctcttccttttatcttgggttgggggtgggggacactgcctcctgcaagttataatctctgttttagttagtggtggttttttttggagttttttgcccttctagtcctccaatacttctttactcaattctctatgttaaattttatctgttaaaataatgggcatagtctctatctttctaactggaccccaaatgataaaagcaggaataggaagacatatataaatacatagaaatttagtaaatacttccctgtttcatactttcttatgtgtactaattttatatatgtatatggctagagcagctccacagggcaatcacttgttttgttcactgatgagtgccccgtgcccagaacactgcatgagacattgtaggcattcgatttagttttttattgaatgaaggcgagtatgaatgtataagatggtcaaaggtagatttacccctatatgcaattgtaaggaatattttgatacactatttgggatgagtggatgagacacccagagggtatgtttaagtaaccacagatagaaagcaaacttccatcgaagagaagggtgtctagctgaccacaggactttttggtgagtggacatggaactgatatggtttggctctgtccccactcaaatctcacctagaactgtagcctccataattaccaatgggaggtaactgaatcatgggggtgggtttttcccatgctgttttcatgatagtaagtctcatgagatctgatggttttataaaggagagttccctgcacatgctgtcttgcctgccaccctgtaaaatgtgctttgcttctcctttgccttccaccatgattgtgaggcctccccagccatgtggaactgtgagtccactaaacctctttcctttataaattacccagtctcggatatctctttatttgcagtgtgaaaatgaactaatacagcaagttgggaattatatatagcaagaactgctccatgttaacacaggagaacgttatcagtgagcagcgggaaaaggcagacaggggaagagaacaaggaagaacagacacatgtgatgagaatgcgtgagaaaagatgttgtggattcagcatgccttcacatttcttctctgaaacctgcagcataatctgttcggtacgctttggtgtaagaacgttttctgctgaatatgaagagaggctgagcaccatattgagttaagcactggcaaagacagatgtcatgtgtggtgttttctgacaccaaatatgtgttatttcctcagaattctccaattatccaacaccaactggttgtccaaaaattccattcaattctcacactaactcccagagttagcacaaacaccacaggttaagggctcagtcccccagactgctcccactccagatgccagctgcaaacagggtggcaggccacctgcacacacaggggttcccactgctcaggttcaataagtcactagaacaactcacagaactctagagaatatttatgattactggtttattataaaggataaacctcagaaatggccaaatggaagagatgcaatagaacatgatatgggggaggggggggcgcccatatgtgttcaccaacctggaagctcccctaatgtcagtgtttcagagtttaatcaaggtttcattacttagccatgattaagaaattggccattcgtgactgaactcaatctccagcctctctcccctacttagaggtgttggggtaggggactgaaaactaaaagtcctatccacccttcttggcatggctaacccctcccttaaaactatttaaagggccaccagcagtcacctcattagcataaaaacccaggtatggctgaaaggagcttaaaaataacaaaagaacattttataagtaacaaaagaagctcctaccactcagggttttagatatgtgccaggaaccaggaaccatgaccaaatatatatatattcattataccacacattacatgctaggaaaatcagctttcattacagcattctctaatcctactctctgcccccttctcatcttgcaaccctaaaaacacaaaagataaattatgtggtacagccaggaaatgcatattgagcttataaaaggattcttatgctgtctctaaaaataaaaaaaaacttttcagagaaatgtattatgaggatacaaggtactgtacactctatttacgataaaggaatgaaacctactttataaagcaaatgtgaaaaaaaaaactccttaattacctatcttacatatttcaaaataaatgttaaacaaattctaattgcattatgttgtttaatattacctataagaaatgtaaaggccttaagcacaaacaaggacacaaggaaagaaaatcatttaaactgtagactttggtggttctattatatagaagattaaatactgatggtcaaggacattaaacatagaatgcaatgaatttcctttctttcgaaaacaactggaataaaaagatgttgccattaacgctataagcatttagtaagtacttatgtgtaggataaatgatttaaatatggttttgtgggaaggcatcaagataaatgtccattcatttgataaacccttttaaaactaacaattgtgccaagcaccttatgtataaagatagatggcaaaatccttgctcgcaaggcactcctagtcgcaaggattaaagatgcccagcacttgtaccaaccagtgctcccacaagctgaacctatgaccgacatcactagtcaatcgtctccttttcccaaaagaatgacctcagcctcacaatcctcattacacagtgttccacatggataccatcaacaggagttgaaatacaaggtgaacctacttgcctagaatactaaactttaatcaactgtcctgaactaacatacgatacaaagccctgcatcagcaagttttactgtaatgcagccatgcctgcccctttatgtactgtctattgctgcttttgcttttgagtagtctcatgcaaaacctaaagtatctactccccgatcctttaagaaaaagtttgcagaccaatgtcctatgaagaagaccaatgtcctataagaagatgcagataaacttcttgagagtccagatgaggaaattgcaggctgatgctctcttacaacagcactgagagtcccacaggagatcctcactagctacttgacagcattcagcagcctcccagtgcaggtatgtgaagacatttgctttactaagcaaatgataaggctctctgactctcatcagaatctccctgctagtcgtcctcactggcctagaccacaggaaaagatgaccctcttgttacctgcagtgatagaggtgaatggttgcagcagggaatgtaaggcccaggagtataaagtatttactatggccgggtgtgagggctcatacctgtactctcagcactttaggaggccgaggtgggtggattccttgaggccaggagtttgagaccagccttgccaacatggtgaaaccccgtctctaccaaaaatacaaaaagtagccgggcgtggtggatacgcctgtaatcccagctactcgggaggctgaggcataggaatcgtttgaacctgggaggcagaggctgcagtgagctgagatcacaccactacactccagcctaggcaacagagtgagactccgtttcaaaaaaaataaaaaaataaagtatttactacgtggtcatctacagaaaaagtttactgacctctcattttacctcataacacctctcaatgtgtaattatacatgtgggtgatttgtcagtgtctgccacgtcccatgagactatgatggtctcaaaggcacaaaccatgtctcatgcattcaccaatgcatttcccatgcctgggacagacctggtgcttctttagtatttgttgaatgataattaattaattagatacaaagcccaaggacacaatgaccctcgatctaaaactggggccactgacttgccttcatagcagacaaataataatggttcctgtgacaacaaattattagacaaggtcaggcacttcccagggctaacagttcagtaatcgtgtttccagaataatacagatttcagcccatatgcccatcatcatttatctctaagacttcaaagctaaaaagtttctctctgcattgagccatatattatgtacaaataaatagacaaataagccagttcaagcacaaattctacagggaaaatccagagttcatttttttttagacacagtttcactctgtcgcctagactggagtgcactggtgcgatctctgctcactgtagcctccccttcttgggttcaagcaattctcgtgtctcagtctcccaagtagctgggactacaggcacgcaccaccacacccagctaatttttgtatttttagtagaagcggggtttcatcatgttggccagactggtcttgaatgggtgacctcgagtgatctgcccgccttgccctcccaaagtactgagattaaagatgtgagccacagtgcctggcccaaagctcattttttaatgagcatctactatgtgtcaggtggcatgcttgagcaccagtgatgctcaagcatacagtgatgtggttaagatcatggacactggatcacggacttgtttgagccctggccccactatgataatgaccacaaccacttattaataatacaagctgaccagggaatggggcactgtttcagcgtattgcttttgaaatcataaggtaggtaaagggtgatctccaattgcagatggaaaacggaggcacagaaagattaacacatgtttccaaggtcacaaggatacaaacctaacttctagagtctatgaccttaatcactttgctgccaggttatcatgtgtaatcaatgagatcctgcttttgaggatacattacagtacctaacacaaagtacacactcaacaaatgctttcattataactatcacatcaccataatcatctacactgtcaagcaaagaactcatttgatctttcacagatttagctaacatgtacaaagatattttataatccttcatattgagatataaatctgagcttgtccaacggtgcttttcaccattctcatcgctagaatccacaagtgtaggaggatgaaggtacaggtagtgcattttttaattaatgtgcttaagccagaaaacaaaatcaagaacaaattaataacgaaaagtaaaatgtttttaaggttattcaaaaggacatgattatttttttgggctgttttgcagactgtctcaagtaaaatttctctaattttatgctagatgaagtacttactagcaaaatgtatccattaaatatttattatatcaatattcataaacaatgtagtacactgcaatcagtttctgtagtaaagtcatttacacagaggtcaaacctttcaaatacagaaaaagcaaaccaaggtctgcatgttttcaaacaccaagttctaaaccaaaagtcagagttattataccctgactccttcattctgtatttgatttcttcatgttctatagcctataaaataatgtaacaggcataattacagtgatttgctccccaggtttggatgaaattaaataaaaattccataatgaaatgccaggaaaatacctagttgtagtaaatgccagttaaagaacaatgcttcctgtcaatgtctatgttcaataagtttacctggcaataataaaacaaaactttgttaggcagaaacattttaatggacagttatttaatgcacgctgtgggctatgaagggccctcagaggaaaagccatgtcaatgtgggtctcgctcagtgtggttcctttccttcaaggatggaatcctctccgctttctgcctacttttagttacactccaagactttaaaatattttaatatttttaaaatatttcttatattttatatattttgtccacaagttatcactgttttatctgttatctgttaatccagtataagactactccattcctggaataaagtattcattttataaccatggtgttcagaaaactaaaattttcagatgtggttgaatacagaacagagctgaaacatcatgtccccactgtagacaccctccatatattatctaagcctaatgctacaacttcctttcgtatccacatgatcctgcatcgtctagcttcttcatagccagtatattgcagtgctcagtgtcttgtaaaaagctctttggtgccacaacaggcagggaattctctttcctttgctaactcttcaccaggaccactaccatcaccaaggttactatcaagagtctgtaggactcttcagctgggcacagtggctcacacctataatcccagcactttgggaggccgaggcaggaggattgcttgagcaagacccactctcaatttgtaaaattatattaaaatttaaaaaaaatttttttaagagtatatgcttcttttggagcagatttcaagaattctggtgcaaacaaagtcaactattagttatcttataaagtttattttcatcatttcattctaattaactatacttaataatttgctcctcaatatgaatgaaaatttcagcagtattctagctacaagagtcagtaaaccattgcctacagaatctaactcatctggataagcaaactactcagtcactatttatctctttaactaaaggttcattcaatctttgggctctcattagtatttcttagtcttttccctgccaagttcatgccagtaaacttgacagggcacagtatcatgaaaatggtatttttcatatttatcttcctcaggaatctgctgaaactcagtgcagacaatacctgtcttccaattctaaccacatgtttgagaatgtgcacgtgtgtatatgtcatactaaccaatcttccttttcctattagttcctggctttactacttaatagctgtgcattcaaccactctgtgcctttaatcctcaactgtaaaacaagaataataaacaggattgctaggagaataggatgagtaaagtgcttagggcatctgtcacgtaaggagagctcagaaaatatcagctattctcatctattatactatgatttttgcgatattcaacactgcttccaacatcatcatgaagagccagcaaaacaacatgaagtgacctaggacattcaaatacatgacgaaaatcttcatgacacaccagtaattgtgcaaaagaggtaggaactgtggcagaaccatcacccttaaaaattcatatcaaattcctgccttggctgaggctttgcactggttatcagtttttcagacctcttgcctgcctttcaaagcccaacaactgtgaactaagcatatgaaactgagacaggcaactgaacagtgggaaaagagaatatttacattgtgtgtatcagacataagtgaaaaaagctgagatcccagtgaagagtgattcatgggtgacacatattcagactcaaactgcaaactctgtctcttgggcagcagctcaagtcttactttagttcttttttactttagctgggccacttacagtcagccttatgcatgtgttgttcatgaaataccttctgatttggtcagtttatacacagaatccaggactcctcctctctgactctctcctttctgagacaccctcccacccccagtttcccgctgcttagggatcctgaactctgtccttcagttctccagtgcaaaaagactacaggttttctaccggagtttagccaccattgcaccctgtcatcaagaccaaaaagctggaagtaaaagctggaagtaaaaactggaaactcaaagcaggccttttgtttcccatttcaactcccctccttccagtttcgactcccctccagggtctcccagcctttggcactttccaaaaccttcaagtacttgttttatattttctccaaagcagatagttactagctatgcaaagcccagtctgttaagagcttacatggtcacacaggaaataggatctgtcaatgacacatattccagagggattcaagctcaagcggagatgttcttttctattccacatagccagggaacactaactcatgaacagggacaatactttgaaagttcatcctattaaatgacaaagagtcttcaccttaggagaggaagtcacttccaagcagaaactccaaagaaatgggtaaagactggccaaagaataagtccaggagcttgtttgggatgaacaaactatgcagacagcctgagagctatgaaaacacacacaaagtatggtaatagaaagggtctagaaaaggagaagattctcattcaaagaggtaggaaaatggacaccaaggcagaatcctttttttttttttttttgagacagagtcttgctctgtcacccagactggagtgcagtggcaggatctcggctcactgcaagctctgcctcccgggttcattccattctcctgcctcagcctcccgagtagctgggactacaggcgcccgccactgcacccggctaattttttgtgtttttagtagagacggggtttcaccgtgttagccaggatggtctcgatctcctgacctcgtgatccacctgcctcggcctcccaaagtgctgggattacaggcgtgagccactgcacccagccacctggctaattttttttctatttttagtagagacggggtttcaccgtgttagccaagatggtcttaatctcctgacctcgtgatctgcccacctcggcctcccaaagttctgagattacaggtgtgagccaccatgcctggctggcagtatcttttttttttttttagaatcagctgataatgtaacttactcagagatcctggtggaggatataaacgttcagacccaaaacagacaacatccagaccagggatggcagagcctcttaactctgaccagctggaaatggctgcccagggagctgtagaaagtaagacctcaaggctttgtcatggtagacatcaataatcactcagaacagcatcatgagtgattattgatgtctacgacaggaagagagaggggcagctcagtctcaggtattcacaagccagaatcaagtataaggttataggacttgagaagaataaggacagatttgtcaacatcatcattattaagattactgagtttcttcaatatgcccagatgatgtttagagtaattcaaatttaagtgaaattaaaaagggatatcagacaggctaaaataaaaaagtgccttgaatcttaataagcccacagtatatgaactgcctctaattagattcaggaatatgactccttttgaaaccaaccaggagaaaacacttattcagaagatttcaataaaaaattaataaccacttgcttccactttatcatgcacagtcctcaacggtggattttaaaaaacgaaagtacagtctgtctcaggaaaattgtacttgtgagtccttcaaaagctaggacattttaatcaataaagtgtgagggcaatttactgacttacataattcaacaaaatacttgctattcaaaatgagtgaagtctgtcactgaaattgttaagggtttatataaatacactactaaattaacaaagaaaaaagcaagcaaaggctgccctccaacctgatcttcatgctccagggaaccagttctttatcaggataatggtggttgacgtttccgtaagttatctggtactctgcctttcttttttggagagagatgacttgcccaaggtaaatccagttcagaaagggagcatccatgccagtaacttttgatccatgtagctttctcctataccacattatgacttgctataagaggacagttaaacaggataattacagagggcaagtttcccaactaaatgacaaccattaaaattagacatgaagttacaaaaaaagagtgaacagagggagattttcttaagtactagtaaatttctacttaggtcctaggaagtgctgtttactttataattacatgttaaactacatatatgataagtattttttcagtattttatgctacattgcacaattttaaaaagctttaaagaagagtgtaagcttctaagtctcacagctgtgaattcaaattcagactctattatttacaagttggatgagtttagacaaacttctcaacctctctaagcttcagtttcctcttgtgtaaaatgaagataaatgatagataatgataatgatagtacctatgttacagattgctgctgagtgtcaaagagaaaatgccattggaatgcctagcacttagtggccctctctggactggtctctccactgcaaaggcccaaaacctgccccctgcattgtttccaagctgatatacatcaacacatttccagattgtagctacacttggcatttcacctcctagttgacagtgtgaagctgttcatactgctatagggcagcacacagctgaatgcaaacacagttcttttgccttacctaggagctccatggatcaggagatgccctacagctgagagacaggcaagtttggtggataaagaaagccagcaagtggacaatcgaacataatttggaattactggtcatcaaagtctaattccagaaataaatcaattcaatggaaagcctttatagcaagcagacagatttagaaaggctgtaaggcacagaagaaatcacgtagacttgggagtctgacaggtgggtgttcaaatcctatcttggtcactaagcagtaacccaattgtagcggatgttgtaagtgactcgccagtatctttttctaaactattcagcagcttagccaataatggagatttccaatttttgccaataactggctcagcaatgagcatatgacctaatccccagcagtgataacctagaggaagtctaatgggaaggttataggaagaacttcctccctcatagaagtttaagaaaataagaaaaaaaaattatctagattaactatctagagctattccgtggccttgtccagctgcaaggcaagctgggagatccagtacagccatgtgtccagagaaaagaagagctggcttcagttaacggataatagttcctggcatgtttttaaagaaagctctgtcaaggctttcttctgtgtaatttattgtaatgtacattcgaaaaaaatgtatatgtatcagtaatttaccaagcccatactttcatggacactattacttatggaggggctcaaatgtggatttaaatatttttaatagtgaatagatttagaagaaaaatgtgaagtcaatgatattgatacttaaacatcacaaaaagccctgaagaggtattaccctagatgaggcaccgaagtgttaaaccagttgtccgaggcacaaagctagtaagtggcttacatgtcacattagccatggaagagccttgcagcagatgctctcagtgctccatccgcatggcctcagatcgcgccaccatttttatacagactcactgtgcactcttactcccaagagcagccccggcaggtctttgtcttaagatgctgaagacaacatgcccttaaagaaccttgaagagggtatataaatacttcaactctcttgcccctaactacaactctgaggtgtaacctacacagtttccatagctgtcctgtggaattaagcaaagtcaccctctttgggattcagtttaataacacacccttctcagcctccttcccttcaacttctctaaacccctttgagtttttcctgagaatgcctccccgaaaagccactttcacatgaatccttttctcaggatgtgtgaccagggaacaataagaaaagtcttggggttactatggtccaaggttccccaaacaagaatcactcatacacaattcttgctacatctagagaacactaataccagtatcagtttatttatgatgtttattttaacttaaagatagagaaaactttagagcactacctatactgtttgtttaagtagaaggagatagcataattaaaaaataaaagggattcaattctgattatttgaggtatgaagtcctaagctgaagatcttaaaagcacacaagcacaaaactgaaaatttctccgtgacaaaatcctaaggttccaaagacagtaacaatgaattcagcactatgtgactcactggtattggatgctgcatccctgcgttacctaaactcatctcgtgtactgccaatggatgtgtcccgtgctctgggcagcactgtttcaacagccattttgcaaagttaagcatgtatctggcacacagcataatccctgatacatgatagatgtacaatgaatgttaaacagagtttagtaaggaaactgagtctcttccctaaagccatgctgttgatcagtgggccagaaacaggcacaactgaaccttttctctgcataccatctgcctgcatctagaacagagatgtgattcactcctaaaaatccactacgattcttcctagatgacttcatctacagcagtaaatctacacatttatatagattttttactctcttataacatttgttttccccattctccccaaaactcgttgagcattccatggaatattattgctggctaattttcaccactatttgcctattggcataaccgcacccactttttatcatgctcctttttcaactactgctattactcctttttttctttcattagaaccctcagaagtgatttcacttttatgttcattattgttcatttacaatcagcttttgattgcatgctgattgttcttaaatttcaactttagactgctgaagaaaaacagtgcttggtgttagcttctgattaccaaagatcagctgaattaagttacaaaactgtttttcaaaaggcctggaacataggtagtaaaatgttagtgtttttgtttaaccttgggtgagctgtctggataaagagaatggttaaaaactaagtgagattaaaaataataatgaggtttgctggatttacttaaaatcaaaataaaaaaataccaaaattgatacatctgaacaaggctctgcatttattccaatctcttgctattgtttaaaatatttctagagctcctatttgggaaatgacaataaacctgtgcccctttccttgggatattcttctcaattgcaactcgtctgtctttaagttgatttcactcatagaaatggtcagagcttctcaaatccaacaccagcaaataaggtgtaggaaacaatgttttagttggaaaacaagtgctggaagcataaagcaaaagaactcatggcagtggtccatgggctagctctccaagcagccagaaaagcatgcatctccagcaaaagttcagagactccagaagtgccaaggtgaaaaaacaaaggctcatctggtcacatattaggttggtgcaaagttacaaatttcaaaaaccgcaattacttttgcaccaacctacaatttcagatgtgtttgatcaaaaaaatcaaccacacccacgttgtctcaatgcagggtggttctggaggtctgtgaggtcaaaactattttcataataatactaggatgactttgtcactctcattcttcacaaatgtacagaccacaaaaagttcattgatgtgtgtattagtatcctaggactggcgtacaaagtaccacatactgggtatcctaggactggcatacaaagtaccacatactgggtggctgaaactacagaaaggtattctcttgcagtttaggaggcttaaagtctgagatcaaggtatcagaagggttggtttcttctgagggctgtgagggagaatctggtccatgcctctctcctagcttccagtggttcacaggcaatctttggtgttcttggcttgcaaaagcatcactactttcatcttcacatggctttctccctgggcgtgtgtgcccgagtataaattttctctttttataaagacaccaatcatattgaattagggccctccctaacgacctcattttaacttgatttcctctatctatctcttaccttctatctcctttaaagatagagtctttacagagaaaatcaaattacattaggtcacattctgagatactgaaggttagatttcaacataggaattttgtgggggacacaattccacccattatcaggcataattcagtggacccacgtgagtggcatcctgaggagatgtgcagggcaacagctgtgacaacaaggaagttgtttaagatctctgagccgcagtttgttactctttaaaatgggcttagtagctaggcatggtggctcacacccgtaatctcagcactttaggaggctgaggtgggaggatcacttgaggccacaagttggagaccaacctgggcaacaaagcaagaccttgtctctacaaaatttaaaaaaaaaaaattggccaggcatagtggcatgcacctgtagtcccagctaatctggaggctgagaacagaggattcattgtgcccagaagttcaaggatgcagtgagctgttatacgatcttgccactgcactccagcctggatgacacaacaagaccccatctctacataaataagtaaagaaaataaaatgagcttagcaatggctataataatgccttcctcctagggctgccatgaatactcaacatgataatcctcctcaagtgcacagcaccaaacctggcccacagaatgtgcttgataaacatcaggtgtctatttgtacatgtgcttcatttcaggttatccagacaccattaatagccattgtacaggcaagtccagcagaaaaggactctgtgtgtgtgtgtgttatccagacaccattaatagccattgtacaggcaagtccaacagaaaaggactctgtgtgtgtgtgtgtgtgtgtgtgtgtgtgtgtgagagagatggcaccctgcaagggaatggcatcctggttcctggcaaacaggttcctgccttgctccctgagctactgggatgggcatctgccacctgtgacacggaactggaataaaatgaatgaatgtaaatgattgtcaaataaacattcatcaagtctacaataatcataaaaacacactaaacaacgtggtccaaaagtactcagtgtttgtgtttgtttctgaactttgtggtgaaaggaggtgctccctaccattttcactttgcaaacatttattctgtgacttaaactacaacgactacgaccgccatcactcacttatcaccagaaactgggtaaatcattatcttacttgtttttattaatctttttgaaatgtaagtagagcttacatttaattcactgtttaatattagcggtgtttttggtctttggaagtttgatgatgtttctgtaacctgaagtatgctgaacttaaaactcttgtttacatcaattagcctatagaaaactggtttgctttatggtgaaaccatttctgtcctccaaggctgtataattaacttcttatcctcttcctacattcagtgctggaatgggtatggaagcagagaacaaattggaatgtctttagtgaggacttacagtatccccagagggctggggtgctctcacaacaccaaacacatctcactgtaattgcccatttctcatcagtctccaacaaatgagactgtaggttccttaaaggcagcaactgtctcatatccccaagcttcctacaaacccaccatctgcaacctccgcctcccaggttcaactgattctcctgactcagcctcccaagtagctggaattacaggtgtacaccatcatacctggctaatttttgtatttttagtagagatggagtttcaccatgttggccaggcttgtcttcaactcctgacctcaggtgatccacccacctgggcctcacaaagtgctgggattacaggcgtgagccaccgcctaatagtgggcctaatagtggacctgtgctgcatttgacccactgaaagaatcaatgaatatgaatatacaacagaaacattatcaggaaagatatttcttaatagacattttagttggacatgggaaactgaaaatgtagcccaagctacatatgatacaacatttctactcaggtgaatgttaacataaggtatacctccacggaacactcatgttcatagcagcattattcacatagccaaaaagggaaagcaacccaagtgtccaccgacaaattaatggattaaaaaaaagatatatacacatatcatggaatattattcagcctaataaggaaggaaatttttgcacatgctgcaacacagatgaactttgaagacattatgctaaatgaaataagccagtcataaaagaatagctatagtatgaatctttttagataaggttcctagagtaggcaaattcacagagatcaaaagtagaacagtggttggcagggactaggggaaggggagatgggggagttagcattgaataggtacagagttttagtaggggaggatgaataagttcaggaaatggatgatggtgatggctgcataacaatatgaatatataacaatgtccgagtatggttaaaatggcaaaatgataaaaatggcaaaaatggttaaaatggtcaattttatgtcatgtatattttactacaataataaatatataataaaaattttaaattaaagaatatacacattcatattttttagtatctttagaagctttggaaatcaaaaacaaggtttcagagacaaaaaaggaacttaatgatccaaatttttaatcaaaaaagcaattcttttgccacctccctcaacaccctaaaagtcaatcagaaaacactgctttgtgtcaataattaattttacctaaattatgacaatgttgcttaacatcaaaattccaggaaaaatattccactgacctgaaaagaaggactctgaagtatgcaggaggaaatagattcatcctgtagcacatgacaacacatcttcaagaaaggaacactatgactcttggcttaccataagcgtaacattactgatatactgccaatattaagcaaaatgaaataccactactaaatattctcacttggggccctttaacataaagaaaatttagtatttttctctcatcttcctataaagtttaactctgtaagtctccccacatattaaaattatattttatacaaaatatagtcataaaagctattttatactggtcataaaagcctcatcatatactcatatcaaacaaaaaagaaaggatccattagacactcacaacatgctatgctgtgagttttggacgtgggactccaatcctaaaagcgtcctcaggcccaccctcgcttaggacaagtcacaagccttctgcctccatttccaaccatcctattcaacactcagccattcagtccttctgcatcattttaaaattcatgaggataatctgtttacaacttcaccatctcaaaatttacttagtttttctaatgtgccaaatagcacgtatatttttttccatggtaattataaaaaagttaaaagctgaaaaattccttttttccctgtattgttggctttcaattttaatgatacatcactttaaaagagccctgaatcttaacaaagaaacactcatcattaatagtttattcccttaatcaaaaataattcataactctccactttctattacttattaaaggcccacgtaagccctcaggctggaatgagaatgcctatgagaactggttttccccctttctttcaaaggtaggaaaggacttactaactcaaataagtccttcaagtccagatggtatagcatagcatctcaacaacaggtaagagagtacaagcagaagctggggacaaaaagcaaaggataaaaaatagttccttataaaaatgtgaagagatctccattgataaggagaaaaccttaatattttctggtaaagctataatgctgatccctacttctattcaatgctgtgggcaagccaatcaatgctgtgggcacggggaagggaggggaatggaggggagggcaggggaggggaggggaggagaggggaggggaggggagaatatggtgccctaaatggatcaggccactccccagacactgtacccagagccctgagccctgcttcaggcagggaggaaagcatggtgctgttcctctccacaggcctcccgacttcagccacagacaataagatgggggtggatcccttacttaaaaccagacaatatcgaaacaataaagtttggccgggcacggtggctcacgccttaatcccagcactttgtgaggccaggtgggtggaccacctgaggtcaggagttgaagacaagcctggccaacatggtgaaactccatctctactaaaaatacaaaaattagctaggtgtggtggtgtacacctgtaattccagctacttgggaggctgagtcaggagaatcacttgaacctggaagatggagggtgcagtgagccaagatctcaccactgcactcaagcctgggcaagagagtgagactctgtctgaaaaaatataaataaaaataaataaattcagctttcagagacactgaaatgtgaaaaagaaaaaaaaaaggtatcttacaaagaaatataagtaattgtcacaagatcacaaagctatggagtgctgaaggcaagagttaaacccgggcagtctgattccactcacggtgtacgtctagtatcctggcataatgactcacagcattgaatcgatgccaaagtcgcccaaatgatctccattcttgcatttctccaaccctctccacactatatccagaaagagtactctacgcattaaactgcccttgccacttcactgtctaaaacccttcaatggctccctattgccctcctcaagaacaagcttagcttcattaccaggcctaccaggatcagcgatcttgtccttgctcttgtctctggcctcatttctcaccgtaaactctacaaggcagccctcctgaacctccttagggctctcaagtcacaactctgggactaagacagcccacaaatggaaatacagcaagcacagggagaaatggatgggagcagaaaaaagatgctagtccccccactccaacccacaggacccaaacttacacaaaccatgccttgtgctttgccatgtctccattaacaattcatatattatgtcaaatccctcgaattttaaaataaaaataaaattcaaaggtaaatgttagaaatctatgcatttatggctactgcctaagtcctattcttttggaatcatttctagaaagggtaaaagctgaccatactcagtacactggtcaaagtctgaacccagaataccaggaaactccatcctccaacaccatcccccaaagcccactctgcaaaggcaatgacatttcacaatttctccagcattcttgaaacgctgagggcagtagtttgtgctaagcacacagtgaaagtcatgtccagttggccgttggttcatgctgtggctactgccaattctttaagtgttccctcacctcaaatctttgatgcacgaggtccagcagtcgtcactactaagtcaacactgagacatgtaaatgtttgtgaaatgagtaataaccaggatggtacaattaagctccccatgagctcctccccactgccacctcaggcctcaccagacattcatcccaactgtggaatcctgaagataatcagagcccgggaggcagatcttcacccctctgagcctcagattccccagaagtaagctgggaacaataactcctatttcacatggctactgcaaggatgaagtgaaataaaatgtatggaagcaccaagccagtgactaatcctgagatggcagcacatgataaatgcttactgaatctgggaaagcaaaattattctagctcaataaagccttttaaaaagaccagcgaatttagcttcaaattcagtgcaagagaaataatcatcctgggcccaccatcgggtcatatgccaaatgtcttaaatatcatcttatttaatctttgtaactatctgtgcaaatgatccccttttcaagtaacagtaaattgaggctcagtcaggttcaataatttgctccaggttgcagagaaagaacatgggagatcccataagaatttgaactccgttgaatttgaacccagacttcgtgtctttaatctccctactactctgttgacaagaccctgaagccagagagagaggaaggtggataagagtccagaaagggcaaccatgccaagttgatcagcacaccttcatcagcacaagtccaaatgaccaaaggcgagtgtcactcaagggcaaaaagatggggaaaggtaagcaatcagtttaactgcctagttcagcccaactaggatctttcagtgacagagcttaataatttaacagcataagtcctttatcagcatgaggcgggtgactccctggcactgtgattttaagcaaatgactatagggcctctctatgcctctgactgcttctataaaacatggagactgtgaaatctcccctgcagtgatgttgtaagggttaaagaaataatgtgtggagattacttcacgcagccttgttatatactacatgcccaaggaacagttctatgattatgaggaccctttcacaactaggatttctatagccccttccttcttcctcatttgctgaaatgagccacatcatccctcaacttctcctgttccttacctccctctcccttctctgtgcaccctactcattgactgagaccacaaatgcttactgaataccaactccggccagctggggaatcactcacgctgttacattaagctgtatcactttgcctttgtggagcttacattcttaaacttgtaggagagcggggaagacggccaatgaacaaataacactaccaggtacagtcaagtgttataaagaacaaagcagataagggtacagagaataatccctggaaaggcagggctgggtaaggtaattaggaaaaagcctatctgaagaatcaacgttgaatcagaaagctgatgaagacagagatcaggcaatgaatgatcagagggaatagttctgcagacacagggtaagtggttgacagaggccaacagtatcttagaaggctaagaacacagctcaattgcagtacccactatgttttagtataactacaggtttataggccagttgtacctctgtgccctctgaaggtaggagctgtgtttcttattcctgtctgcattcactcagtcatatttatctgcccaacattctataaagaatgagctgtaataagcattcagaaaatatttgctacataaatgatatttgtttgatttttcagttgtgggggttaattttattccctgctgaattctgggctttctgaagccccatttagacttctttgtatacccaaaagtgccattgtccctcaacttctgctatccacctctcccttctccatactaaactgctcactacaactactctccccctgttctctcacctctgcctctgcatgaattcacctggactgccttcttcatcacctccaccttcctcacaaactctcaagattaatctccaaatttcattagtgtactgatattatcatttgttcaaatatttccaaatctctcaagttcttcagtaaaacttttccatcaagtaacagaaagtgatgcatcaagtgacaattgcagattgagtggtaaagacagctgaaggacaaatgatctgaggttacttatgtaatttcttttcctcccccaaatatgccatatttcagtgactttctgggctttgcgcctgcagaactagaccagggtacgagggcaggaatgttctcactactgtgggtctgtgcactcaatcactcacccataaaagaaatgccttatttacagcaaacaaaaccaatttaggacaaagctatcacttaacggtcttccccacaaggaaggtcaatagtttagcatctaaattatttgagatggattcccttttctaaaagcagaaattgcagctgtacttcattttaaaaaaagaaaaaagtcaaatatttattctcctaggcaagagggagatacaggtaagtcacaacttccaatgcagccgccacagcctcatttagctgataagaacttgcccataacctttagtccttcacttacaaaagtcatgcattcatctttctcctcccacttccgtaaaggcagaaaattaggctggagccattctttctgagtatacaacagcaggggcatgggtttaagcagtttctttgacaacatacattcctctgtaagtccctggacagaagctctgggctgcacagaaaacatacaacaaggattctaaaataggaggcctggccaggcacagtggcccacatctgtaatcccaacactttgggaggctgaagggggcagatcacttgaggtcaggagtttgagacaaacctgaccaacatggcgaaaccccatctctactaaaaatacaaaaatcagccaggcatggtggcgtgcatctgtggtaccagctactcaggaagccgaggcaggagaatcgcttgtacccaggaggaggaggttgtagtgagccaagatcaggccaccgcactccagcctgggtgagagtgagactctctttcaaaaaaaaagtaaaataaaattggagacctgaaaggcagtgcttctcctacaagagagctccatgaacttccactagccaaagagaggggaaataccctaagagacaacaaaactgtgcttagacttaagaaccatttcaaactcagtgccctcagccaacatttcccctaagacttgactggcagtatgtactcatatcttgcccaccatggcagtgcctggctatattacaccaccaagtactgcacacacttttcacttggctatatggacacagcaacatggcccctgtctaccaggatttaggtctttggaaagacttctaaccatggttagacccttactgctaaattcactgaacaccactctgctaaaagtttcaaagccagcctaacttagatttataacagggggcgtgtacagtacattaattacatgcctgtgctttggctgccaggactgggattcagcctctgtatggtttaaacccctgaaacctccttagcagaccctgcaggtctccacatgatttggcccttgtcttcctctcagacctagtctactaccactttccccctctaattacctagacatgcccagctcattctcatctcagtctttgcacttgctgtctgctctgcctaacacactcttccccttagtctcacctagctggctacctttcatcgctcaggtctcagctcatatgtcaaaaaggccatctccaggatcacttacatataatgctgagcaatgtgaagtatgtgtatgcctacatataatttcacctaaagtacaaaactgaacaaaaccagcgttataagtcaggggactggtgaccctttgtagggtggaggtagtgacaggcaggagcaccagggggcctctgggttgttgttaaatgatcgttttcttcatctgtacctagttagctgggtttgcattcagtttatgaaaattcatcaagttgttcatttgtaattgttcatttttcagtatgtcttatatttcagtttaaaaaattatgccaatcaaaaacacaccatatcaaataggtctcctctgatcatccagtctaaactaccctgctgtgaagcaatccattctccatcccatgaccctgactgattttcttcacagaatctgtcattggctgaaatcattttcattattggttatatgtgtactggctcactctctcccacctccattaaaataaagtatcacgtggccaaagactctgcctgcctcattcaccatccccaaaccccagggcctacaacagtcctgccaaatggtatgggctgaataaaaactatatgaaaaataagaaatgactaaagtggaccctttaaggacgtactatcaatcaaaagtcaaaacagtaaagctaacagcaaaggtgaaaaaaaaaaaaaaacttcaatgacactaagcatcaggaatatgtgtcaaatgttaaatttaaccatagggaggaggtagacaaaatgtcattctatgggtatctttgagagaccagttaaagttatttctctaagcagaaactgggtcttttatttctgtacagacaacagtttttcacaaggcctggtggtataaaataggtctgggccaagagtggcaacagatttctgagacacttggtgaggattcttaagtatgatgagagaagtgggccatgtttaactgcaatgtctgccacgggcaagggactatggaaacgtaatatcaaatcagtgtacatgaaacagatcataggaagcacccaagaatttgaaaatagcaatactcaccatttttatggacaattctaagatggtcataaagaaaaaaataaaaatgtgtcagtggtgctaatgacttggatgttatatagttactactggcatgcagattaatttgcatgttgatataatatattttcatgaggaagtatatactcaccaggaaacagcatggtgtaacggaaacgtaaaggtaagcctttactctggaatgccacaaactctcactgtatcgttgaatatgtcattgaacttctttaggcctcaatttctctacccatgaaatgagctggctggactaaatgattgctaatgtccatttccagttcttggacactgtgtacctttctatctttaaaaaaacctacttttaccttctaagaatttacagaaaaacacatcatccacaaatatgtaaatcacagtaaccagatggggcgtgctaacagatctttttacccagttttcttgacaaaccaagagtatctctccccaaccagattttctcctgtgttgcgttcagcctcttatttcttggttagggaagtaggcttcacatatttcagctaaacactctgcattttcagtttctctgtacaattcatgagttttcactgccctgggccccatgtttctcatcaattcaagtctacactcatggtaagcaccctagttcttgttttttctaacacttaaataatgaataggacttcatctcctagagctattctccttactctattacaacagttattagtgagttttaattagacaaaactgccattccttttgctacctcactatactgtcaagcacctattaagaatattacagtagtaagtattagcaccttttaaatttacattaacaataacagagaaatggggaggcaggaaatgaaaggagaggggtaaaaatagctcacagatgtcataaccaaagtttagaggaactcaaaaaatcattaatcactattttttaaattttctaaaaaactatactatgcacatcctggttaaaattgtatgagtgataatttgcctctcatcaattaaaaatggggaaataggcaaggtcattaactctgctgtggctgaatcccagactgtgctttctttaaaagggaagagagatagtctacggagactaaccagttcagtggttgagtgatttctacaagagtcatcaccaactcaaaactttcctgaagtccttctgactattttaacgcttgccatctgcagaaggtaaaaatctgctagaggccaagttccaatcgctatccagcccaccactgaccctctttgatttcattctccatcaacaaggaggacatggacagggtcaatggtctaatgcgttttagtgacagccctgatttttcattggaaagaggagaaagatcgtttcccatttttctccttgacccacggatttgaccaactcaggcacattaaaagtctgcaaaagcaggtagcctgcaggaagttcaccctagggggtgagttcctagttgggctgaaacgggtttccaggcatgtttatcacgtggtctaaacgtgctcagggttagtgccagaagtttgaaaagcagaattagtagagctgacaataaaacctcagggctccaaaacccggtccaagaaacttttcttaaacttgcgtccagcgcctgcttcagcgccttcgccatgagtctgcgcgggcagacagcggagactctagtgcgttgggtcgctcataccccgaggcacccggggctgccgccgcgccgcccctgccccacactggagcggggttccctgctgcgcctggacccggcgccgcgtcacctcccgaagtggggcgcccgaggggccgcgcagggggtcaggcggagaccaagagtagcagggggcgagggaagcccgggcaggccggcgccgctgctggcgcccgcagctcctgcccccacgctcacctgggacccggccgccaggaagcggggccgcagcgctagggctcgcagaagcttcccggcctgcgctgctacgggggacgccatcttaaacaggaaactcggcacggggcag

SEQ ID NO: 1373 - DNA, 279898 bp, Homo sapiens
tcttacagcttacaaaacataattttatttaaatttgtatagataaaaatctaccaaaatttaaacaaaaattttatccaaatcctttcccacaacaaaattggacatcatggaaaaaaaaaacacattcaaataaggttcccatctttctaccataaactggtagattctgggaggatgaggagtaagagagaaacgaggagagaagatagtgatactaaacacaatttgatcttcagtgttgtctcatcttgaaatatcttaataacagagatttccataagaatcaggattcatttttgacacaaaaatggaagcttccactcccaaaatcacaaataaggcttctggttttctttttagtgtgaggtaaacagtatattcaatattaaggcaaatggtaaaaacacatggatggtatattaatgcagatattccattattaaatatattttggaatactcacggatttttcaaacatatgttagaattagaaacctgtaaaatctgcagtagtgtgtaatagctatttgcttgaatgtcttagcagtgcctttttagtagctaatatgttcagtgtaatcttatgcctttttagtaattaatatattaaatataatcttgtctgagtttttaaatggtctgtttttctttttcattatgtaggattagatgcccaccaaaattcttgtaaatgaagcaggacttgatttcaaattctgtctatacacacaatatttggccacatagaccactccccaaagtctgcaaaacactgcctactgggcaggcttacagtgacagaaaagtatgagaacacaagatattatttttataaagaccaaaatcagatttaggctgtctagatatcttattccagaaaacacagatttaagatttttcagtgattcttgccttccccctccccttttcttccccaatgagataaccatttctttcacaatgatgaaccatccctttttacggaaaaatggctttctttctccattggatcaggacaaagacatcacttcttggccacactggccacagccttcttggctgcatcctccaggtcaatggctgaagtaatggggagtccgctgttgttgagtatcttctgggcctcttggacgttggttcctagaagggggacagggaacaatcactgaatgaaactagaggtggcgccttatgaagtttgcacaaggacacacaagactcacctgtctacagcttttcactaggaaatgaattaaatataggttctcatcaaggtcactgacagaaaagattatgtgatgaaatttatctcaagctgtggtccagctagaaaagaagatgaaagcaagggcttgcaagagggaaatgaacatattttactgatggaagctgagttgtctgctgataatcacagccatgtggatttaatgcggttttggcccacaccagaagtcacttgtcttaaagccctctcagacgtcatcaggggtttgggctgtgacctgatttgagaaaggaagttccgagaatctgcccagctatgtccacaaatccactgctttggagactctggcgcatccagcatgtccatttctgccttctcctcactctataaaatgaaatgggctgagcccttcaaaacgggcaaagcagcctctgatggcaatctcttgactgttcctggtggatctggagtatcttctggccaagtcacttcattcaaaggtgtgcttggggactatttaacatgagaactgcttttctgccattttagagtgaacaactcctgtaggagaaatgtaatagaatttaagtgtctaatgaaatatctcatcctacatcatttcctgtgcttttatctagttggcaagacagagcctatttataaacaaagaccttgaaatataggccttggagaacttgccttaccacaaagagtgcagataaaaagaggcactgggtcagcacatttcatataaagaggcaaatgctggattaaatagaaatgggtggattgaaaagatgatgcagcactgattcccctgggaccctgggtctacccaagcagcagtgaagatggccgcttggcactgtgtcttcaccttaaggctcacctactcctgtttttacagaggaagctggtgaaagtcctctctggaaggtgaaagcataaaatgtgggaagctgctacctaaaatctccatgctggctctgccatgtacttgttatgtagttttgggtaaatcgtttaacttctttgagccttaacttttgtttccatacagagcactatcatcctcgtaatcttcccaagaactaatatcattaagtgcttatgtatgccaggcacagtgctaagtaacttatacacagcatatgaaatctttacaaaaactatgagtagtcctattgttcctattttacagataaggcaactgaggcacagagaagttaaataacttttccatggtcacagaggcggtaagtgtcagagatgggacttgaactgttctctgtaattataaacgctgcatgttctaaagatatgctagtctgcttacctacttgaaaaatgaggacagtatagctgatggtatagattgtgatgagaagcaaatgaaatgagtgtaaaagcatttttgtaaatggtgcagtatctgtggcaggcctggctggctttgcaccacagactcctgctcctcttctgcagtagagtgctattgctggaaagcagctgcccagccagaaactacatttcccaggcccccctgcatctcgaaggggacatgtgactgagttcaggccaaaggaatgtcacatggccatgacaatctccaaagggactcttcacactcggttttccttgtctgctttctggagtgttcctagctggggcagccctggaagtcacctttttggttctggttgtgttttgtcttgctttttgtttttgagataggctctcgctgtgtcacccaagatggagtgcagtggtgtgatctcagctcactgcagcctcagcctccggtgcccaagtgatccttctacctcagcctcccaagtagctgagactaaaggcacacatcaccacgcccagctattttttgtattttttgtagagatggggtttttccacattgcccaggctggtcctgaactcctaaactcaaggactccatctgccgtggcctcccaaaatgctgggattacaggcatgagcccttgcacccagccaaatcacttcttgaagatggcaatgactccttcagcctggatactttaataactctctggagccaagcatcttacccactcaccctcttagaccttatgggaatgagaaagacccttctataatgttaagactctgaaatttctgcatttttctgttgttacaggagctagcattattttgactaacatatgactttgtaaatgctgtggaaggcagcttctaaaatggttttcaaagatcaatcactcttgcctcctggtagtcacatctttgtagaatccgtcccccttgagtatgatctggacccacagccttacttctaatagataagaacatggcaaaagtgatggagtgtcacttctgagactaggttacaaaagcctgtggcttcagtcttgctccctttaactcttttttcactctgatgaagcaaactaccctgctatgagctgccctctggagagactcacctgggcaaggaactgagggcaaactctggccaacggctgatgaggaactgaggctctgggtctaatagccaaggaggaagtgcatctggccaagaaccatataagggatcttggaagcaaattcttccctagtcaagccttgagatcactacagctcggctgacactgtgattgcagccttgtgagagaccctgagtgagaggatccacctaagccacacccagattcctgaccacagaaactgtgagataataactgttctttttgttaagctgctacattttggggtaatttgttaagtgctgataggtaagtaacacagatgtaaaaatgtattatttcattaacacaacctgcgtgcactttgattcatttgactgtggcaggtgttagatagcaggctaaggaatttagaaactaatcaaagcatggctttcatggagtaatgacagagtgtgaaacaaaagccctgatggacacaggagcaaaccagtctttggaccagaaggtaaatgacagttacacgtgtaaattttgttttagacagagtcttgctctgtcacccaggctggagtgcagtggcgtgatctcagctcactgcaaccttcacctccctggttcaagcaattctcctgcctcagcctcctgagtagctgggatgagaggcagtggccacctctcccaaccaatttttgtatttttagtagagatagggtctcaccatgttggccaggctgatcttaacctcctgacctcaagtgatccacttgcctcggcctcccaaagtctgggattagaagcatgagccaccgtaccccatgtgtaaatttctatctcctcctgcagagacgtagactaggcccttcttcctcttcctttcttcttttgagcaccttccaatctcaatgcagctctaagacctccagataggtgcaggagtggcgctcctgatgtcttcctccatttcagatcctgctctttctggagactagttttttatcacggttcccacttattcagataacttcttattcagttttacctgagttcctttgcatgtgtatggatgaaatgagctcttgatcttcttaattttttgagataactttaatgagttgtgcttccttgcaaccaagtaatctaaataatttagttccttaattaatatcctcttttgcacccaacttagcaccagtattcccaagggaaaagaaatgatttagaaattcatgagcacaaagatgtgctgggccactgcccttgctgggctttccacccagagctctgttgggctgacacctctctccactgggctgacacccattcattcacaaggcatctgttaaatggtatttctttggggatatctttctaatcaccacctccccatgccccaactaaagcaggggctggtacaatgaacttctggagcaccttgtatttctaaaatcttaccatggatgaagtcttattgggatgacttactgatgcttccctcgtcccctctaaacatccactttcctttgtcagacttgcttactggatacctcccaatatccgttagctagcagtacgtgctgaccgacggggtaactccagatggattcccacatacaaagtgtgcttgacgagaagaggagtgggcgggtactttttgatagatctccttgctgtcctaacaaccctttcctatagggttgaaatagataccgcaaactgctcaaggtgcaatcaggagggattttttttttttttttggagtcctctcacagttacctaggggttttgggagtggctccttttgctgggaagggcccaggaagagctggctgtgctcactgccctgagtgaggactccaagctgttaccacttctcccaacctgtagcagcttcaagtgccccagtcaagtgaggccttgctccaggctaacactggtggacagggccagggaagaaaggggacggagcagtttcccagaaaaccacaacccttctctcctcccagctgctccttcagtgccatgtgaaaatgcctaattgcttcataattctaggatccacaaaagtgaattttaattatacttgcagttacactttaattaccaccttaattattaagcatatactaggcatgctcagaactaagcagtttttgaagggattctcatattcaaatatgaagctcatctgttatgagaaatgggtcatatgcagagccatcatgaccaggtagaaacttgttacagaaggggaaaggggggtagagagagagagagggagatagagagagagacaaatgaagagagagacaagagacagagtcatggggaatagctcaaaaaggaacagacataagaaaaaagacaggtagagaataagagaaagtaaaggaaaaaaatgagtttgccaagtgccttccacaccagcccctaccctgatgctggcaccatctctttgcagcattcaacctggtttctccttgaaggcatagctctactgcccactgaccctgcccttgtcgttaactaccacttgcttcctccttcctgttgagggaacaactggaaggggaggtggggacacgcagagaagagggattaaaaggaaaccagctgggcatggtggcctgtagtcccagctactcaggaggctgaggtcagaggaccgcttgagcacagaaggtcaaggctgcagtgagctgtgattgcaccactgcactccagcctgggcaacagagtgagacccacttctattttcaaaataaataaataaataaataaaataaaataaaataaaataaaagtaaaacagcagagagtggaaacaggttattgaaaaagaaaaggaagaaaagaattagaggaagccttggaaatgactgtgagtttctgcattccttttttgcaaaatgatattatttgagtatttaaggttattttcttcttaattcaccaagtgtctgacatctattccccaaccctctccctgcctttacttctaaatagaaattatcatagctgctttaaactctgacatggaattaagtgttctaaagagtgtttatgcctgtgcacagaattacaaaggaaattgatctccttcccacatttaaatggtgctactgacatgttctaatatttattaaatgctacattgctttttaatgagccttcaggacaacacttttaataaccacctgtacagataactgatcaactcatgctggtggaacctcaggcacttcttaatatctgcttgttgagagccactcagctaaatggttatctacccactgcaggccttaaaaatggaaaatcaaaggggaatgagtttaaaatgaaatcttgctctactactaggggatattataaataataacaattattaaaatgttaaaaattcgtgacctccttggcatgttaccagtgactttctgccactgggtggagtaagagagctgtaaacaaagatgcaaggttaatttatcaaaatttcttcttcgcttttattacacacaagagaaaataaaggtagtgggcacatggtacaggattttgttcgcaaggtgcagacgcctcctgccttttatcataaggctgtgaagaaaatcattttccagtctggaaatatgtagaaactgtaatttaaaagttattattttaataggaattcagttttttaaaaaagaatacagtagttagcacttattgagtacatattaggtgcaacaaatgtttgttggatacatgagttaagggatttacaagtatcatgaaacttaatcctcagagcaaccctgcagtcaacatcattttaatccccattttacaggagaggcaacaaaaacactgggaggcttcggaactggcccgacatccccagcaagtcagaggctgagccaggacttgaacccaggttcacctgagggtaaagccacataaccacgcagctggcctttaagtgctagaaggaattcactagaggaaaatgaggcccagagatgtcagacaatttgcttggatcaaacaaccagttaaccctgacaggtctgattcttggtctagtgctctgagtcagggctggcaagttctagtttttgggcaaaattgagccagctgcctctttttgtatcacctgcaagttaagaatagggtttacattttcaaatagctgggaggaaaaaatcacaggaacattttatgatacatgaaagttacatgaaattcaaattccagcatccataaataactttttcgtggaacatagccaaactgatttgcttcatcagtggctgtttgcgctttgcaatgggaggagtcagtcgctgtggcacagacagcatggcctcgaaagcctaaagtatttcagcccctctgctggaagtaactgagtttttttctccccactgggagaggggaattcagtggaaacaagccaaattctctaaagcagcaaattcctcctcaaatgtccactgctcctgtacccttgcacctccttccttagtctcctttcaagtggcaattagatagaggaggtccattttcttggtgacctgtaaatttagataacttttcatgtctcttttgccttgttactttatgtcagaaacagaataattcattgagaatcagaggcaaaacttctgctatgtcagcagctcttatttctttgagatgatatgtgcctaatacctagcaccgtgcttggcagccaacagcattggccatccatgtggcctcagtcgagatactgacaagggtttagataataataaggatagctaacatttactgagccaaggactattgcaaattatttaaaaactcatctgctccttacagcaaccttatagagttgccctatttttattccattttgcagaggaagaagctgagattttaaacccggttctgttcccaagtagctgaacaacctggggaagttactgcagctttgaggctttagatttctccttgaatgtgaatcatatctaaatgctttgtacccctaacattttatgaagattaaagatgacataagatattctgtgtggctgtattgtatccacacctaatctcctcgatgatttcttctcgcacagtaagaagaaatcaacactcgaggtgtgaatgtgatagttattcggaccatcacagcaggagcccccagctccagtggcaggaagccaatggctaagttcttctctacacggtttcaaagaatggtgtgtatgtgctatgatcatgcaagcaaggtttaggatcaagtctaacatattcactgagagctgatgctacgtgcttatgctttcaattacgttaacccttgaaaaaaagcaacatagatactaaaccaaagttaaaggagccttaatattaaacaagaatggaatgaaccctctggcaagcaagaacaccttacacttctgtgctcacctgccatcatctgctagggataagacaattcttttaaagaagggatgttttatacacccaaacatctgcatgtgaatttacctttcatgctttccttgaatcttcctcctagctttcaagccatgcatactctaatttacggatgatttaagaaattttcaaaggtaattttaacagtgtgagacttttgtcgaaaatgctgactttggtccaccattactgcctaggacagaatcacattcatcactgtgtcactcagtgtgattctgtccttacgtggggaaatgactgagtggacctcattgctaatattttccttgggaagaagtcagattctcagagcttaatattgcctgccaaattcttacttgactctcacgagacatttcagagcttaggggaagggagatttagatagagataacgtgaggattttccagaattctaggtcttgctgctggcctcttttctacactagggatctgcaagctatagctcacggaccaaatctgttccactatctgtttttgttaaaaaaagattactgtgacacagccatgtccattcctctacctattgtctactgctgcttcaacactacaatggcagagctgagtaatcacaacagggaatatacagacacaaagcctaaaatcctgccctttacagaaaaagtttgtagacctttgctctatacaatccaaatttctggccttgtggctaaagggtcaggtgaagacaagaatcatcttcatctggtgtttcccagcttgcagtccctacttctgacttgatatagtggtaagcagctatatatctaggagaaaaaaacccacctatggtctctttgaattgacaatggcaaatattggctcgaatttccactccctccaccccttcccacatgtgtggctggaaagatcatagaactctttttccactgagctgggatatagcctcagaatctttcttggcacagcactgctcaggcagccactgccaataaagagaaggtggcatgagatgaaagctgtcttccctcatctgaaacatttctcatgaagtctttccccataggtagttctgcctcaggacagcctcaaggtggcgctctctggaagagtctcagcgggacacacttagcgtctataagacactacagactgaatcacctgtaagtctcgtcctgatagcaatgtgctcgctcgctctttttgatggctcatcaaatatgactttcaagtggaaattgagtcaggaagaaatgaactgactagtcactcagaagatacccgagagcacgcagtggtgttctgacactataaggcagcacttaggatatgcgagtcctggtacctgcccagttttaaaacctctccttataaaaatggccacacccacagctgctgctcagggaagcaacttcaggctcttgttcctgaagggatgaccactgcctagagtggggcagctacccgaccaaaggcagcccactcctggggcagataagacctgtgatgtgcactgggggatgtttccttccatgcagagggacagtcattagtgtaacccctcctgttctctttgcctatcactggctccatccgggagtggtgatggtgtagggagctgactgaatatttgaatggagaaagttggcatgggtagtcccgccccttcctctggccttccttttagggatatgccactcagagtgagtccaggtcatcctctgctccttgggttccaccctgggatggaaggtacactgaagtctagtggagcctgtgactgggtttacaaagctgcctaattctggggcttagagtaaggaagctcactggtggtcacacaataaggtgcatcctccaactacttcttttttctttggtgatgaaggtaatacttttgtttcctcagtctattttatttcttactgggatcagaacccaggtggaaaaggatctgttgggcctcttcaaagaccctaaccccaaggcttggctggatgggctgtgaacaatgggagcagtggctattaggtaagctaattaggttggctacctatgggatctggacttttaaggaacaccgtgggatcaggatggccttcctgagaggctagaaggtctcagagggaccaagaaaaaacacaaaggagtgagaaagtcagttctgtggaccatactctgagaatcaccatagtaacagcagtaacagacactttatttatttatttatttgagacggagtctcgctctgtcacccagactggagtgcagtggcgcgatctcggctcactgcaagctccgcctcccaggttcacgccattctcctgcctcagcctcccaagtagttgggactacaggcgcccgccaccacgcccggctaatttttttttttttttgtatttttagtagagacggggtttcaccgtgttagccaggatggtctcgatctccgacctcattatccacctgaataacagacactttaatatgataactatccaaaagtcttgtacacttcatcaacaaactcagattactatactcaagcagccccactgagtcaacatctactgtattagtctgttctcacgccgctaataaagacatatccaacactgggtaattgataaaggaaaggggtttaattgactcaaagttccacatggctgaggaggcctcacaatcgtggtggaagagcaagggacgtcttacatggtggcaggcaagaaagggcatgtgtaggggaattcccctttgtaaaactaccagatcttgtgaggcttattcactatcaggagaacagcatgggaaaaacccaccaccatgattcaattatcttccacagggtgctgcccacaacacgtggggattattacaattcaagatgagatttgggtggggacacagaggcaagccatatcatttacagtatcattcttggaacagctcagttttcccaagctctgtgttgcagccataattccctggagaccttctcaagaaaaagtccaaggatattttgactctgctggtgtacccccatcctttgacatgaagactcccaaacagttgtagcctgtgttgttctctgtgcttgcctctctctttgtatctctttcttcttccactctctgccactctcctttctctttccttccctgagactgtctgcctcacatgtttagatctgcacaatatggacttaatagaaataataatcacaaaggaaaaatgaaaatggcagacacgccagtcagcaaagcctaatatgaacattaaaacatactgatgaattaaatcttcttagaagtgtaaatgcagcataattgatcccaataaaagtaataaaaggaaaataagtgacaaagctacaatgaaaaaaaattgatcaaggagtcaatgagtgcatcagtattggtgtatttctgattaaaatgttgatgtcagactgttttcagggtcaaagtgatcagagaccctcagattttaagagtcaactcttctcctgttcttaaagggggaaaggtctctatcagccaattatattattgtttgtcactggaaataactagaaatgaatgcacactacgattgacccattctttctggggatcctttctgtgcctgagttgtcacagaggcccacaatttattagttattcatacatttcgagaaaagctagttaccctgccttaaatttttcccaaaagatttaaaggagtgcatcttttattttcatactctgcttagtattccagaagaattaagtgatttttataatacgcagatgatattcatgctgaaatatgcaaaataccacattcaagattattttccttaatattctctgctgattgcatcagaggtctatctgagatactaagaagaagatttgacatttctaaatttgttagatgatcagatttgaatcttttaactaaatgtacttccaaggtttatgcctgtggttttttaattagttaattagtatattagtaaataccatgtgcatgcaggtcaatgaactttaggcattaaggaggatcaagagagatgtaaaaaaaaatgtcagctactagatggctgggaaaataaaatggaaaaaactaacaacataagacaatatctataaaatggtaacaagtgttatctgctaataggacctgcttctatcttagtaaaagtagccatcaggggatcccagacagccaccagactggtttgctgaatcttcagaaatattgataacttcacaatgtccactgtatcatgaaggaattgaatgtgatagctcaggatgagatcaaagagggcactgccttccaaatttatgcaaagaaaaatatacatagtgacccttcttagccactaccctctttccactattatagctcctctcttaccgtaagaatctgggatctttatcaagagagaaaaagcaagagagctttggacatttctggagtcctagctggtgtccttttcttcctcttgtgggaattggcatcttgtgtgataaacgtcctcggatagatacagggtctcacactcaacatgaaactaccagggatactcactaatattcatatgtgtgatttctgtgaatggagcagacccatagcaagacaagacctatcccaacattgtattgaccatgcctaataaagggaagatgaagcattctgttataactgtattcttggcactgatcataggtgaaacaatgcagaaatttgaagaaggtattatccataaagggaactaaatgcaaatcaagccaatgctttttagactaaggaaatgcagactcctaataatgtgtccctttaagggacaaaagtcagtgcctagtgtagctctgctcactttcattggcataacccacttttatgcttattcaacatggactattatagttatagtagatttagagatgtgagttagcaaagaagtagtataaaaggagaatttccaagttgagtctggaggataggtaagaattgaatcattgcaaaggaagaaggaaggagtgggtagaggatcagaagtcagtcatcaagtaagtcatcatccatacctgagagttggtattggggtcgtaacagaggtaaaaactgaagcccaggacctgggtagatcagaaggatgtcctggagagagtaatggctttgcagcaatatgttacggctaaaagaacagagtgggaaaactgagtaggtaccgagtcaatgacattaggcagaaccaaaaacccaagcagaattgccacagatataaagtggtatggaggcaagagcagagagaaaaggagatgagacaacaaggggaatctaaggaatttaaatctgtgaaccagaagaatgatggcatagttgatggacttgggaaagtcagaaagggaactcaatagagagcgtgggagaggatcagagatgaagctgcaacactggagagagtgcatgtggagaaagatgtatgaatacagggggccatccaaggagagatgtgacagacaaatggagaagttatggtcattttaaaggcccttcataaaccacatgcagaactgtggttttcaaagatagctcagtgaaaatgaaaaaccaaccaaaaccaaaaatatcttgtcacaaatagtggttctcagtacttccagtggagaaaaagttgccaactacagggacctttgcgaaatgtcttttatcttccatctaaatttttcatttgctttcctctatgtcaaaacataaattcttattctctcacaattttctctacatttagttgtagtttatccaaccttagagtatgatttggttccttctgttttttttttctaaacagagcaagtcttcatttgtctacaagaacaaagaaagataaagtggtacaaagagatggaaacattttggacgcttttagtggtagtttctatttgacctgacattacactatactctgttttgatggatgaatttctcaaggttctttattcatatcaatattaaaattggctcagactcccacaacacacaccattgtctagctagggagagtgaggtgaaaacgggtctccatcatcccagtagctattacaaagccaagtgacactaaaaatgagatgtgatggaaaaatgttaccagagactggattacaatggtacataatttttattgctaatatttattaagtactttctaagtttcaggcacgctgccacatgtttatcacagtctgaagaactgtgagattttcagtgatccagataacagacatttcaaaacccagtggcacattttgtaactactacctatttcctgtgaataaagtaagtggccttcttgtttgtttggtgaccattcagaagatccagggtccttgccatcagtctctctaatatgcagcccacattttaaagattctgttgcccacccacaatgtattaaaaatatcctgatgagaaaagttttaatcaatcaaatcaggcttgatgtagtgggattttgtggacaaatctttgttctcagctgtataataattacaagctgtttcaccagtggataaggaaaggattattctcctctttgaaaatggtaactttataattacatgtatttacttgccttatcagaacagaactcaccaactgagacagaggattatttttgttcaaaagactcttgcgtgaaatgaacagctacatatttgggggaaattcagcctttgtaaccaattgtttctggtgtgaataaagaacaaattatctgaaatgagggttttttttttttcctttttgaaacgtataaaaaccttggcacaaaaattgcctagacggttaacttggcccaacccatgaaactgttgagaaatgtacatttattgacagctctatacagtcagtgtacaaagcgttttggccaaacgcagtaaacaaaatgttttgagtggttttacagttctttatcagaatccaccaacatcttataataattttttaagaattccttttattactgtcctatttaaatctgcagcaaacttctatgtctcagatatgtctgaagaggaatatgcttgtttctcaggtgttcattatgactccaagttgagctcttaatatattaataataaacctcgagataatttgtagactggataccgtttctcttagccaaatcttctcaattttattttccacccaataccaaaaggtttgtttcagcaacataaacattttgtttttcttttgccaaatgtctttaaaaacaattatcccacccccttcattcttacaaatctctctaacattccctaaactttctctaaagttgttgtgaacataaacatattctgtgtctttcgctttcttgactaggcactgtacctcctctgggtggacactttcttatccttgattctgaaatactgataaactggagccacaaatagaagagtacaaatcgtgtccttcttagcatggactcggtatgctaagaaggacacaatttgcactcctattcgctacatgatggtatgtgatcctttggtctgctggaggagagaaagaaacctttgggtattaaagagtttagaggcagccatagagttttcagctgtgtcccatatgcttcgtggctattcattcttcaagtcttcagttatgctaggttctaagaccaagagatgagagcagtaataatgcctttacctcctatcaaaaaggcagcctcggtagattgactgtgggccgagtagctttgaaaacattttcattcagaatattagagcccaagatttgctgctaacacccagaatacattgagaacgggcccttagctgagtggtggaattgttctgggcagagtgaatgcagatccccagcagagccaaggtccagttctgtgtctgatgatgtcccctggcctctttgcacttttctggatttaggcattctctccgctgctcgtttccaacgtgtgttctgtacggagttaattttccatcttctattctttactcaagccctgtccccttgcaaggtaagatggacctgtttcccacctccacccacagcctgtctgaggtcgttctgttgctgctgtcattggagacgtggctcttggaggagggtctgatgtttttgtcagtgcatgcccctgtccttctgtatgtttgagtctcattgtcctttctcttcttactctccaggtctccattttctacatgtcctgttcatcactttgctctctgcctcaccagtgcccactcacctcttcatctccttcctccttcactgacccctgtggacatgtccttactaggaccagtttcacttcacagtgacatctttcacctctcctgccttatcactcgcatcctctccaccttttccctgcagaacccccttgctccttcctcctggtgttcaattcttcatcatcagcttaaacccagtaagacattgagggaatcccatgctgccgtcaagcctcaaatctgctccattgtctaaaaaacacttcttaatgcttaaactttaccacacgtaaacattagacaaaggctcacaggacctgatcaaagtattagttaggctagctttcttagatcgaatatatcaatttccaggtaaataatctactatatttggccctttgggttttcattttacccctaggataatgtgagtaattgaaatttatcccatgttagacatccactgccttaccttagagaaaacgtcctaatacactttaggcaggggcagaggggtgctccttaaggtaaaaaccactttcatagttaatagtggcagtaataataacaataagagaagactatgttggcatttgtactcataggttgaaagtaatggtaggcaaaaccgctggcatgttatcatggaatcaaggcagtggcaccatactgtgctagtagtcactgtacttttttttttgagatggggtcttgctaagttgcccagactggagaatattgtcatgatcatagcttgctgcagccttgaactcctgggctcaaacaatcctcctgcctcagtctcctgctcagctgggactagaggcatgcatcactacacctgagagatcactgtactttttactaccacatactcacagtaagaaaaaaaaaattggggaaggcagccaagatggccgaaatggaacagctccggtctacagctcccagcgtgagcgacgcagaagacgggtgatttctgcatttccatctgaggtaccgggttcatctcactagggagtgccagacagtgggcgcaggacagtgcgtgcagcgcaccatgcacgagccaaagcagggcgaggcattgcctcactcgggaagtgcaaggggtcagggagttccctttcctagtcaaagaaaggggtgacagatggcacctggaaaatcgggtcactcccacccgaatactgcgcttttccgacgggcttaaaaaacggcgcaccaggagattatatcccgcacatggctcagagggtcctacgcccacggagtctcactgattgctagcacagcagtctgagatcaaactgcaaggcggcagcgaggctgggggaggggtgcctgccatggcccaggcttgcttacgtaaacaaagcagccaggaagctcgaactgggtggaacccaccacagctcaaggaggcctgcctgcctctgtaggctccacctttgggggcagggcacagacaaacaaaaagacagcagtaacctctgcagactttaatgtccctgtctgacagctttgaagagagcagtggttctcctggcacgcagctggagatctgagaacgggcagactgcctcctcaagtgggtccctgacccctgacccctgagcagcctaactgcgaggcaccccagcaggggcagactgacacctcacatggccgggtactcctctgagacaaaacttccagaggaacgatcagacagcagcattcgcggttcatgaaaacccactgttctgcagccaccgccactgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagacaaaaagtagataaaaccacaaagatggggaaaaaacagagcagaaaaactggaaactctaaaaagcagagcacctctcctcctccaaaggaatgcagttcctcaccagcaacagaacaaagctggacggagaatgactttgacgagttgagagaagaaggattcagatgatcaaactactccgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacttgaagaatgcagaagcctcaggagccgatgcgatcaactggaagaaagggtatcagtgatggaagatgaaatgaatgaaatgaagcgagaagggaagtttagagaaaaaagaataaaaagaaatgaacaaagcctccaagaaatatgggactatgtgaaaagatcaaatctacgtctcattggtgtacctgaaagtgacggggagaatggaactaagttggaaaacactctgcaggatattatccaagagaacttccccaatctagcaaggcaggacaacattcagattcaggaaatacagagaatgcctcaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccacccaaactaaactgcataagtgaaggagaaatgaaatactttacagacaagcaaatgctgagagattttgtcaccaccaggcctgccctaaaagatctcctgaaggaagcactaaacatggaaaggaacaaccggtaccagccgcggcaaaatcatgccaaaatgtaaagaccatcgagactaggaagaaactgcatcaactaacgagcaaaataaccagctaacatcataatgacaggatcaaattcacacataacaatattaacttgaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacagaaaaaggcaggggttgcaatcctagtctctgataaaacagactttaaaccaacaaagaccaaaacagacaaagaaggccattacataatggtaaagggatcaattcaacaagaagaactaactatcctaaatatatatgcacccaatacaggagcacccagattcataaagcaagtcctgagggacctacaaagagacttactcccacacaataataatgggagactttaacacctcactgtcaacattagacagatcaatgagacagaaagttaacaacgatacccaggaattgaactcagctctgcaccaagtggacctaatagacatctacagaactctccaccccaaatcaacagaatatacatttttttcagcaccacaccacacctattccaaaattgaacacatagttggaagtaaagctctcctcagctaaagtaaaagaacagaaattataacaaactgtctctcagaccacagtgcaatcaaactagaactcaggattaagaaactcactcaaaaccgctcaactacatggaaactgaacaacctgcccctgaatgactactgggtacataagtaaatgaaggcagaaataaagatgttttttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaaacaagagcaaacacattcaaaagctagcagaaggcaggaaataactaaaatcagagcagaactgaaggaaatagagacacaaaaaacccttcaaaaaatgaatgaaaccaggagctggttttttgaaaggatcaacaaaattgatagactgctagcaagactaataaagaagaaaagagagaggaatcaaatagacgcaataaaaaatgataagggggatatcaccaccgatcccacagaaatacaaactaccatcagagaatactacaaacacctctacgcaaataaactagaaaatctagaagaaatggataaattccttgacacatacaccctcccaagactaaaccaggaagaagttgaatctctgaatagaccaataacaggctctgaaattgtggcaataatcaatagcttaccaaccataaagagtccaggaccagatggattcacagccgaattctaccagaggtacaaggaggaactggtaccattccttctgaaactactctaatcaatagaaaaagagggaatcctccctaactcattttatgaggccagcatcatcctgataccaaagcctggcagagacacaaccaaaaaagagaattttagaccaacgttcttgatgaacatcgatgcaaaaatcctcaataaaatactggcaaaccgaatctagcagcatatcaaaaagcttatccaccatgatcaagtggtcttcatcactgggatgcaaggctggttcaatatacgaaaataaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatgaagggtattcaattaggaaaagaggaagcccaactgtccttgtttgcagatgacatgactgtatatctagaaaaccccatcgtctcagcccaaaatctccttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacctaggaatccaacttacaaagggcgtgaaggacctcttcaaggagaactacaaaccactgctcaatgaaataaaagatgatataaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagccagcattgccaagttaaccctaagtaaaaagaacaaagctggaggcatcacgctacctcagttgaaactatactacaaggctacagtaaccaaaacagcatggtactggtaccaaaacagagatatagatcaatgcaacagaacagagccctcagaaataacaccgcatatctacaactatctgatctttgactaacctgacaaaaagaagcaatggggaaaggattccctatttaataaatggtgctgggaaaactggctagccatatgtagaaagctaaaactggatcccttccttacaccttatacaaaaattaattcaagatggattaaagacttaaatgttagaactaaaaccataaaaaccctagaagaaaacctcggcattaccattcaggacataggcatggacaaggacttcatgtgtaaaacaccaaaagcaatggcaacaaaagccaaaattgacaaatgggatctaattaaactaaagagcttctgcgcagcaaaagaaactaccatcagagtgaacaggcaatctacaaaatgggagaaaattttcgcaacctactcatctgacaaagggctaatatccagaatctacaatgaactcaaacaaatttacaagaaaaaaacaaacaaccccatcaaaaagtgggtaaaggacatgaacagacacttctcaaaagaagacatttatgaagccaaaagacacatgaaaaaatgctcatcatcactggccatcagagaaatgcaaatcaaaaccacaatgagataccatctcacaccagtgagaatggcaatcattaaaaagtcaggaaacaacaggtgctggagaggatgtggagaaataggaacacttttacactgttggtgggactgtaaactagttcaaccattgtggaagtcagtatggcgattcctcagggatctagaactagaaataccatttgacccagcaatcccattactgggtatatacccaaaggactataaatcatgctgctataaggacacatgcacacatatgtttattgcagcactattcatgatagcaaagccttggaaccaacccaaatgtccaacgatgatagactggattaagaaaatgtggctcatatacaccatggaatactatgcagtcataaaaaatgatgagttcatgtcctttgtagggacatggatgaaactggaaatcgtcattctcagtaaactatcgcaaggacaaaaaaccaaacaccacatgttgtcactcataggtgggaattgaacaatcagaacacatggacacaggaaggggaacatcacactctggggactgttgtggggtggggggaggggggaaggatagcattaggagatatacctaatgctaaatgacgagttaatcggtgcagcacaccagcatggcacatgtatacataggtaactaacctgcacattgtgcacatgtaccctaaaacttaaagtataataataataaaataaaaaaaaagaaaaaaaattatttcattaaacctcaacccttgattacacatctgtttgatactctttgtgaccaaattataaacacacataaagcacttctgcagcatcttgaactgttctgaggaaaagtgttcgtgcaactgtctgggtatcaagctaaactgctcacttttccatgaaatgctgtttctttcttggaataaagactgacacactatagttgctcagacttggttagctggcagacattttcttaaatatgagtgaagtgagtctgtcccatcaaggaaaacaacttaaccattttgtggctgataaaatttgcactataaagtcaaattcaaattctagacaatgtgcacctgccctgtgaacttgacagcttcctactaaaaagcttttctaatatgatggtggtaatattaacaaatgtgattttttttatattgtacattgaaatgagacaacctttggaagatctgcataatcacaaattttctggatcatcagtgaatgattttgaaccatgcatggataaaactcccttaatgtgtaacacagaccaatgggttttaatggaatatgaaaagttcatcgagatagttccagattccacatggaaactaattttcaataaactattaccaatagacttttagtgtagtaccaaagaatattcagaactatatgaaaagagcattaaaaactccccctggctaggtgtggtagcttaagcctataatcccaacattttgggaggctgaggcaggaggatcacttgaagccaggagttcaagaccagcctgggcaacaaacaaaccctgtctcaaaacaaacaaactaacaaacaaacaaacggacaaaactactcccattttgaaaaacacatatgtctgtgaggccagattttcttcatatacttcaactaaaacatgttataacattttatgcagaaacagacatgctaaatgtgaaaagttatttacaaacctgtaaaacaatgtcattattcttactaaaaattttttaaaatatttattgctataaaatatataatacatatgatatataaaatataccataaaatatacaaattattttttaagagttattttttaaattccaagtaatttcagttatcaaattaatttatcaattaaatcaattaataaacattgacaaatataagccaaaaaaccaaagctttttgggatcctcagttatgatgcatgattctcagagaaacatttctcagagtgtttttccccaaacactaatctcataaaatgattcataaataaaagggcttttgctctggggtaatttttcaaaatctggagaatcataacacctgccatacttggagagctaaaagccacattagtttgctagaggcccagggaagtcctgccgtactgtgtttgtttcatcttacacaatctagtgtttcgttctgttatctcaggaagtttgtgaatccagaacatgctggtcacctgaccttggagaaggggtgctggcacagcggaaatctaccatgactcaccttcaagccggaccaccaggggcaccttgagttctagctcccggcaggctttggtgatcccattggcaatgatggcacagttgacgataccaccaaatatattgacaaggatggcttcaacctgaaatcaaaaataaaaagttaccaatcaaaatgctgatcgccaacagtctcaaaaataactggttaaataatagagacaattaaaataagactgctcgtttttttgtttttgttttatacagagcataaaatacaaaaatggcccagaacatgttaagaaagctcatattagtaataaattaataaatatcacaatataacattaccaaattttcccatcaatcactcttttcaactcaaaatgaatttaatcatcattcattcgtctattatataatgtcttctttttctgaaaatattattgtctattctttttatgagtagtatcatttaaaatttcttgcatttaggtttttttcctccacgatttacaattgcctttttatatgtcatggtgcctcacacaatatttcaaaatcagaaaccatttattgttttgtattaaaaggtaaaaaagattcaaatgttttcatgcttccttaatacctctttgatatgctagaggtatgttctcaaaaatcagagatagtttaattatcttagacagcaaccttttgattaaaaaaagactctcgaaataaagagatccaagcttatagcataagtaagaatgtaaggaaagtcaagctactgactggagcttcttagaaatgtaaatttaaacccatcacccatcatgttaacttgtttgtacatattccatattcaaaggcatgtgggccaaaaaaaaaaaaaaaacaaactctacttgtcctgacttgataactaggcataagaaaatcctgtataattaacatgaagaacgagataatgaagagaattcattacctagattaattgataacacccacagaaaaatggctgttcatgaagctggaggcatcaaaattccaacagtagagtcacaattaaattatgccacactaattgtaaagcatatatatatgtgctgcatagaatcctattatttctgtctgttaaattacctacaccaaacatatgagaagagaatatcttacatttgtatagcatttaaatgtttagaaagtgccatcacacaaatccttattttttattgtgagccttcccagaaccctatttattaggtagggtgaaggttggctctctagctgagaaagccatcgggcgcattggggcatgttgtcccaaggtcacacagctgtcatgtggctgtggccaggcccaaagccagctccctagattgtctactgatttgttcattgatgttgttgctagggctgggaccttggtcgagttacagaacctctcttgaacatttcctcatctgtattatgggaataaaaagaggacctagcccacaggatgttgaaaggcctaaatgaggtaatacatgtgaaatgtttaccacatggctttaaatgtacttaatgggtatttacacttgcatttattcagcaagcattgatgaaagtgggcaagtaagaaaacctttttcagtagactgcagctcatgttgaattcaaatataatggaaatacaaacttattgaaattcaacaaaaaggtaatgccttaagaatcaaagaaatgaacaatatttttcaaaccaattagagattggggctactcccagaaaagaaatctcccattactattcacagtaggacaactggtaagcagaagcttgctttctaatgacagctattaaatgctgttagcattgaggcttggtacagcagtagtttccaaataactgtaggatggagaggaacttgccagaacaatagaagaaaaacattcaagagcaagaatgactccatggggtccatgatagaaactcaggacctgctgaggctcagtaaggtttgtgcagaggaacttggcattctagtaaaacacacattggcacctgcatgcctctgccatgttccagtctgcatattccttaaggacaagttcggatgtcaacttctcagggaattctcattaaattagaatcactgactctgtttaacccatctaaagctttacgatcattttacagagtatagtttacatcataatcttatgtgaattcacctaaacaggcaggagtgagggataggagcaaaaaggagagaaggggcttgagaccctgtgattcaattctacttagtgggtgagtgcctggagtaagtgtcaaacaggaatcagtgttgcctcaggtggcatcagttcccatgagtctctcatgtgttagtatctcgtgtttaattagagtccgatgttaaaaatagatactcttcatataaccacttgcggttaaaatttaactactttagttggtgctgaaccccaggaaaagccttcttttctaactgcagagggataactggttttgttagacttactgagaaatgaatagctgttgttctccaatgtactttattctcctcttaccttcctctccccatcccaagatgcaactcccgtgtttggatcatctttgtgcttctctaaaacaaagattatgtattttcccatttttttaataatcagtagccagcacaatccatgatatggcataatcacgtaaaaataatggtttaacaatgaatgaattaatttcaacagacacttgatcaacatctcccttgtaccaggtacagaattaagttttgggatatggagaaggatgaagtatcatcactgtcctcagggaagaattcaaagactagtttgagagccagaccaataaactgacaattacaaatacagggtctacagatgtctcacacagccaagaccaggggagaggcggtgatgcaggctgctgacatgacagaggatttttggaataggtgaggttctagtagacaggaagaaaaaaagagcaggatctgagataaagggagcagccaggataaaggcagatatgtcacccaacttagttcgctgaggaactaatggttgaatggtgaagtaagttaagatgatacaggtgaggccaagattgtcaggtgccagatgccagggatgggaatttggatcctcttatttcttcctttttagtttatttatttattttttgagacacgttttgactgtttcacccaggctggagtgcagtggcacaatcttgactcactgcaacctccgcctcctgggttcaagtggttctcatacctcagcctcctgagtagctgggactacaggcagctgccaccacacctgactagtttttgcagtattagtagagaggcgattttgccatgttggccagctgtctcgaactcctgacctctactgatcctcctgccttggcctcccaaagtgttgggattacaggtgtgagccaccgtgcctggcctcttccttcttcagaactgggtagacgcaagtcttgaaagcaggctccctgaaacgccgaagagaagttataggaggggaacagaaggacagagaggagagtgagtgcatgagagacaatgagaaatacagaacaaccatgagagagcatgggagagagagagagagagagaatgagtgaacaagaagcagtaaagagaaggcatgagagaacacaaaagaataagagagagagaaagtgcaaaaaggagagtgagaagtcatgaggaagacaggaacagaaagagtatgacaaatactaacaaagcaattgagatttctacaagaagagcaacaggacatagaagtacgcaggctgcttagctcagggaaatgggattgtttaggacacacgatacaccacagcaccctaagaggaaagtcaccaccctgggtggtgagaagatcccactcaaccagagattatgccattctcgccttctctcccactgtaaagtaatttgctgcagtcatgcactttaatggaaatctgatttaaggtttaactctgggccaacttctataattaactactgtaatctgcaatctcaaactgggaatgcaattaagacagtttaaaaatgaaagcctcgtgacatcattattattatttagcatttataaagcatgtcaaattttcaatatgtgcctcacgtgttcattcattttacaaccactaactgctgttccatgatgataccaacagcaacttttaattatcttcccccagccccctggcaaagagaatttttttttttttttttttttaagaattcagtgttaggtctatttaagtaaccagagactctcccggaagatcccaagtgcttttgggaacagaggctttttctaattctcgggtgagaattatgagggttgctatttactgttttacaaaagtaaagatcatctaatgaggcagttgaagtgccagatacagggcccgggtccccagaccccagacagctgatcccaaggcaagtttgctctggcagctgtgcaggtggtcaggcagtccatacacaagtttttcaaatgtctgggtgttttgctttgcaaaacacactctagctgcagattttagtacacaattaaaagtaaaaactaaactttgaaaaaagaacagctacagcccttgctatttatcaagcttcttttgacatcatccccactgctcaaataaacaaaccaacaaaaatcaatactaaacctcttctttggaacatggatccttttgaatatctgatgaatattagggattcctcagtcaggtgaattcacaaacacaacatttttgggggataatagtagttaagtcccatggctaccctgctcctacaggatatggcctccaagacctccaatggcaagtggtaacctacagcatatgcattcaggatagggctatgagtttcagataatggcaagtgttagtgcacaccatatgtattcaggagagggctatgagtttcagaggaatagtgaattcttcgcagctgtccacagaatttttgtctgaatgtgtatttttctgggcaaagtgtacataatcctctagagttgatatatgaatagctatcacaaatacaaccataattaacgttactaaagcatttagcaggttgtactcagtattctaattattgtatatgtactaacgcatttaacacatgagtatcacaggaggtgggtataatcatccccaaattgaggtgaagatctgggagaatcaggggttacagctttatctactgtcaaatatccttccaagccagcaaacctagagaagccctacaatgagtgatggcttagtctctttgtgttcattaccacaaccaactctgccatatacttgtgagacagatattacctacccccctttcgcagatgagaaaaccaagactcagaggtagaaacaaattgtgccaaattaggcagcctgtttgctgtcagtctaaaaaattcagctctttttattcaacatgatcctgagtccccttaatgaaataaaaatattgcaagactgctcaataaaaagttattaatttaatatatattcttcacggcctactatgtgccctgtgcttgtaggcagtagctaagccagcaagaaagattttaaaattagacaaaaaggttctatatatctaaaactgcaaaccacgataatagttatgaaggggaggaaaatgctaggtcctatgtgagtagcaggacaggacctatattacaccaggtggtgagggagggcctctcataggcagagacatttaagctagagtctgaagggcagttgggaagagggcaggtagatcaagattaagagagggagaaaagtatcttaagacaacagaataccatgtatacaggtggaggaacagaaaagagtgtggtgcatttgagaaactgaacagaatctggagtatcaggtccctggggcctgagaagtagagtgatggaaacaagatgggccccctcgcaaatcatgcagagtctcacagagcaaacgccatgacaaagagtttgagaagcctttggttttgagacacctacacagactacagtaaggtcaggaaggaaattaacatttattgagcatctacaatgaatttacaataagcttataaatgtatttttaaccttcattttatagataaactgagtctcagaaaatttagggtttcctagctattaagcagttacagttcaaaccaacactgtttcaccacagcacatgcagggcagttaggaatagctggataatgataaaggagccactgacattcaccagggatcgacaacatcttgcttttaagagctctatcagtatatattttaggttttttgagcccgtctctgtcacaactacttacccttgttgcagcatgaaagcaatcatagacaaacaatatataagtaaataagcatggtgtattccaataaaactttatttacaacaacaagcggtgagccagatttggcccacaggtcatagtttgctaacctgacacagatgtgatttggttcatttcccctcaaattcatggcaagtataccatcacccctccttcttcatgtcacttgatatatctttgataacacttttcagacattacgttgtctttctttgttgtgttattttcttgccatcactgataacacaaaggtacccaggcagtagtggtggccaattacataaaggagtccaactttaataacattcctttaaaacaaaacctgttacctttaacaagttcatagaaggaaagtctctgttttgttcttttttcctccctgacattggttggaagtgaaaaaatagaaaactttcagagtaagccagctactttgcaaaggttattgcaaatagttaagtactgcattgtatttaaaaacactgtagcatatacgtgaagcacagtaagtgcaactattaggttttgtctgtgcctattccaatcacgaatgctaatttagtcccactgtagcaggcatgaggttgataaaaatcaagcaagcatgtttatattagccaagataaggacttttttaaaaaaatcacaggttattttaattctgaatgttgttgctcttgtttaagcatctgtttttgtgaaactgtttttcttttttgttgtttttattttcctgatgaattctaatcatgtcttctaatccactggcagccaacgaaggaaaataaatggtgaaggaaatgagatgcagcttggataattgatgtttgtatgcctggatttaataaaaaatactctgctaaattagaggggagtctaaatagattcagtcaataaggaagtgattcaggtgaggaattcaatcttgggctttgttgtaataatacaaataaaccaacagattggttcgattgggaccagatttgccttctgctgaaattatggcaagctgctcaggctcacttttctacctttggtatattcttggagtttgaaattattttcttttgtgtgacttcaaatgccaggatccttggaataaagcaactcatgtacctccaaaatagctaaaactgacatgtgaaaaacagcattcctcgaaagataccctcccactctgcccttttaatttcttccaaggaaaaaagaaataattttagtgagtccacgatcctgcctgaaaatctcagaatcaaaaggaaatgtcttatacaacacccttaatacaaaacaagatttgggcattttaaattcatcaattgagatgaaccaaccattttattccaacttctctgaactgatagcatggaaacgacatcttatggagagatcctctggggacagtaacttgatggagagtcaagtttccattcaggttgacctctgaaagcagtcaggggaacctagggaaatgggtctaattagactccaatctgtccttattctgtctattctcttcttcctaaattcttcactttacttatattctataatttactccttggtagaataagcaaaactgtatggaggattaaggtttattgagtgttaattttcctaggtgctaaaattatgtattataactttccctggtaaataaactcaatgagcttaaacatcacacagcagtaggcaatggtgtcaagatttaaattaaggcggtcttactgtaaagtccatgttcgttccactccctctggcagtctctctataatcagagactcccaagatgagtcaggagttccagctccatattggtcctatttccaagcttcaagaacgtgcttctgagtcctgtattctggtgcccaagtatttcttgctttcaaattttgctgctgaattaaaatcaatcagaggtaagatatcttgtataggtttgtggaccaatgggttttagttctttacaatacagatatttcctgtttactgataaaagagttgtccagagctcatggttttggcatttcctagttagatggggctggggaggggtcatgaaggtacaagagtggggcctggccttcaaacactaaactctgtcctgagctgaaacagatgttcctaacaagaactctctctgcagactgatagctcctcctctccatgtctgaaacactgaaatgtataccattgccactattattctttgaaattatggccataaaaattctaatggtgagacatcatcatcaatacagattttagatatcaggcagtggaatggccactggtaggcatggtaactctgtaagtggctgcttgaagaatgatgatgggggcacattctagttagttccatggcagagatctttgaactgttaacaatgtctgccatggaagtggaggaaagagtcaatgcaagtgtataatacatttgtttccctaactttggagttacatgacacatatttacacataattacacataattacaactaaaggtttagtctgtcaacattgcccctcctttaataacttttacaaagaaaatatcaggcagtaaagaaatccagttcacatcctgcataaccaccaagaatatattaattatgtatgattaggtatatgtaaagcaaaaaatttaaatatagacttccagctctaaatagaatgaagacatcttccattaggaatactggtatagcttaacaggttaaaaactaatgtgaatactgcaccatataaattataaagccatacttcctcccaaaacaaggatctgtttccttaaatcaaagttctccaaagtatattgtacgaagtattagacctaagtaatgctccttgaaaaaatcttctggtcaaataatttggattctaccttaatgtgaactttagcagaccatctgtgttctaaattataacaccttaatttagttattttctgcaaaagagtcaatgggttggaaatttgatctgcagagagctgtcagaaaaggtgttcaggagctggtatgtttgtggttaggtggcacagagatctatggtccttctttacaaagatgctaatcatttcattatttaggtcaaagttatagtatctacaaaagtagaaggctttcacaagcaagaacagcaactacaaaggccctggccaggccaagggtggcatataaatgcttctgtagttgtcagcagacagggtagtagtggttaagtcaggtattaacaggattttcaggagaagaaaaatctgaagatggaaatattgaatggcattataaataggaaaaggagacaaggagttaaaaggactgaagggcacagagatttgggggaatagcacaagcacagtttctatttttttacagccatagttcccgtatccttttgaactgagaatcagaaccactgccatgattacaaaaaccatttggacatttagaatggcaaatgcaacgttcttttttgagtgctgtgtgtttaaaataaatcatgcaaaaactaccataatgtataatttggccacagagatattcaaagctaaaaaaaaatagagcaaagagattttggtcatactatttcataaaggggcatcaaaaggcttaaaaaaagagtcatataattctctcttaacaaatcagctattagaattgactcttcagaaatatttggttacaaaactgtctttccagcttaacagataattgctttcaaagcaggatactcattgcttataatgcagtatctatattttatttgtaatgggagctacattggtgcagattgagaatatttattggcacattctttctgagccatattttgttcaatcatctcagacttatgtcatcttgatgcatgtaaatacgtatactccatcatcatttgttggagagttaatatagagaacacccataaaattggcaacttggtgaaggatccatttattaatctataaacaggatgtctacccatctattgttgcaacatatcagtctccacagggttactgtccctacaagcaagaggaaaaaatatatttctatgagtggtttcttctcctttatttgtgattaacatcaattagaaaaaaaaatagctaagcagagagagccaaaacttaagaccacacagattcacacttcacaccacagagaaatgaagacaaatttagttaatggcaaaacccactgtttctgtaaataacaaatctaatgtaaaacgatggtggaatataatgatcctgtgaggttttaggcatctgttcaaataaacctatttgatcatttagttttctggaaaaataaggggttgacaaagattcatatcaaaaccctagtggataaatatctggctggaaagagtaaaaacataagattccagctatgatttcagtgatctataagctatttcttatagactaaaatttatattaaaattattttaagtaaaagcatttttaaaacacatacatgttttattcattacaaatctcactagtatatttgtgaaaggcaatttactgccaaatttctttacaaaaacaagtttccatttcatttccccaaatccccaccttttgttcattccagtaaaatgactctaatgccaaacctgacactcagaatcttaaattctgaaatttcagaattttcagtcactgctgaaaaaattcattagcatctcaaacttaaattcaggtaaattaagaggaaaaccaaataaacaataatgcaagaaagttacacattcaaacatgtgttataaaaatcaacaccccatttgaattagggctcctctgaaatccctgggcagggctggtgcctggtaatatttaatatcaggaggaatggaatcttgtagaattcattctacactgaccagcagtattaagtgtcactgtcaccaaaaaaacattctcagctgtagacaatattctaaaattactaatatcactgtctgaccttgctgttatctgttgtgtggaacagagatctatttatttagctgttcagcaaatgtcagtataccatgactggagaaaattagaaactacattggcagagcactccctacagcctgctaagtaaggaattgaacaaaatgctttctacctcaaagtgtctaaatcattgattggccacaccttctctcatccatggttaacctttcatggacctagtagagttctccagctattagactccttttgcaaaaggattccagaatatcatattctctgaggcacatgttaaacagactatgaaaacatcgtgatttgggacctagctgtgctgcagaattgtcaggggcctctccagatcctctccactcttttgcaacctcctcttggccctgggaggctgactagagagaacggattaatgggttccttttggatctgatgtctggggagccctggcaggaggagagggaattgggggcatttattcccccgtccctcccagcacgattgtcttgggtggctgtttcctccacagaaggtatcagagcatctcaaaaaagtcttcattacaggatattctcttctggtcaagtagtcacctccttctctctctctcagcattgggacagaagcgatcccacgctgccagccccaggttcctttaaccccacatatattgtcattatcaatatttttaaaaataaactttcctccatatactgtgagatgagtgtgccattgtttccttttaagactaactgataatgtgccattttgaccaacccagcttgctcttgggaaaatccattcaaccttctagaactggaaggttaacattttgttcagttaccccctctccacaagataaccacggtcatgggttacacaataaaataaaagtcaaataaagctgcacattctcagcacaagccattaaatgagtattatcacaaacatttctttccttggctctttttgggacatggctaatacctaagaatctgaaattgttgctcattagctgtctggatctacaccccagttaaaggcagaaaaaggaaaacaagctaaaggctttattatcttgggtcctgtccattacaaatgacagatgatggcttgtcaggtgaaaacgagcttctcagcactaaaacggcttcattcagtttattagccacaaacaaaactaaggaaggcccactaagaaagtgacttgaaatccttattttcagcatgatgaaagatgggctcaataagactgaatccccatgtggtcttccagtctgtctaaagaaggaacatgggtaacatggagacaaactcgagaagatggttagtatttaaaaatgtaggtctgcaaccttgaacaaaaagtgttaacttccataaaatgccaatgacccagctgcaagtagtcaccatacatttatctcaaaagccacattattctgttctactaagcaaataaactgtgtcattgagctgttaacagtcaaccaaaaaatatacccaaagggaatacgtataggatggcttaacaaccaagaaaaaccatgcggaaggaaactaaagctctcaaattccacatggcttttctaggaactgagcagcatccagtaaagacagatacacacacagtacctaagtccacaacgtagacaagcatttgctttccagatatgctagagcttccttttgtcttccctgctctgtaactctcctttattctctgaaatgtctggacaaatgtccctgtttgcagacgcctacctcatccatcttatcacacatgtttctcagtgtgggtttatctcatgaacatgtattttccaatatgttaaatccaaaaaatagtttttaacttatttaatgtctattttgtgtcctatcaaaaaaaagcttcttgggttgaaaaaaatatttttgtaaatgtcttgacctgccacctttttattttcatgattgctttgaatatcatgtcaaagttcttactccggaaacctggatggtcttctgtgttgctcaaggctagctgagggcatctcccatttttttgtttgtcttgagtaggtgatgcttcctgtaatgcccatttctgctacacgagttccctttcatactatgccatctaactcgactccgaagttcttgccacctagttgagaagactgtaatctctgccttggcagatttgagaacaggaattccatcccagtttcatgttacagttccaaatgactgtttttatagatgtatcgagtacattgatgttgggggtacttcttatgggagattatattgactaactgacttgcagagtgttaattttaattggaaggggtggtttcaaactcagtgccagacaggtaagtaaatgagtagagaggtattagattaagacaacagaaaatactctgacataccagcaaggacatgccttttcaaatggggcagttgctacacaatctatccaattgttgccatgcgaatgtaggccttttatgcccagatctttcctgttttcaaaagccaaaattctggatttttaaaaacactaggcttactagacaaaatgtatctgagagcagcatctgtccttactgcttaatctgtgtatctcccacaactaggtagatgtatcaacatcccagaagatgctttccaaaccagtgcatctttcctgatactatcactaccctctctaacttttggattttcccactccctcaaataatctgaaaatttctatttcttttttctttatgagatgcaatcttggctctgttgcccaggctggagtgcaatgtcgcaatcacagctcattgcagacttgacctctcaggctcaagtgatcccacctcagccgcctgagaagctgtgactacaggcatctgccacatgcccagctaatttttaaaaaagtttttggtagagatggagcctcgctatgttgcctaggctggtcccgaaatcctgggctcaagtgatcctcctgtttaggtctcccaaagtactgggattacaagcgtgagccaccatgcttggccagaatttgaaaatatttctgcatataatgaaatattcgaatggaaaactgttacatgtgtgaatgttggaatgcagaataaagctacacagagagagaaaagaaaccaagcaagtttggagaaggacacaaggatttctccggctacaaaacgaggattgaagagttatacaacatgaatttacacatgacagcaatcatgctaaggctgaagtagctaacacttcttaatcacttactagatgctaggcactgcctaagtattttatctatcttaacttactgatatctcaccacgaccctataaggaaggtaactgctttccatattttacagatggcatacagtatagaggcattaggtaactcctctaagccacacatttgataatcctaaaccctcatgtgactccagatctactgtgtcatatggtttgccttatactcttctactctaacaccttcagtcaccttactggccaacttggctgaaatccttggcatagcctaaaatgtcctttatatacaccagatgcaacacattccttaaacatgagacaaatcctcccttgaagatctccttccatggtagttttaaaatatgcccacaaatcccttaatgttcctctcttcaagatgtagagcttaatcttcctcctctggagcatgggctgtacttagtgattcattctaatgagcagaatatggtacacatgacagtgtgcgacttttgagaccaggttatgaagggtattggggctccttcctatttgttctctctcttggatcactcactctgggcaagccaactgccaagccataaggacggacactcaagagacttctatccagcaaggaaccaaggcctcaggcctcctaccaactgccatgtgagtcattttggaagcagattgatcctctagccccagtcaatcaagtcttgagatgacagtgaacctggcatacttcttgactgcagcctcatgagagaccctgaggcagaaccaacctacaaccaaaaccagatgtcacttatcaataaactcaaggttgaattgttggctcactgataggcagagttttgaataagaatttaggtagctctttcaataaaatatttttcacatttaaattaatggcagattgctgaataaaatgtatatgcttttaccatttaatgaccacatatgaaaattgaaactaatcctttgccatactgaaatatactaaactgcaagttctaagaagtgacatagatttatactttttaacagatgattttcctaaattttatacttaaaaaatcccactataataatactgctttggaaaatgctagcttttttttcttaatcaggactatgtacagggaatatgagacaatttggtatcctattagaatcttatttctctgacatgagtaagttgggctgatttctataatgatctgttacatatgccttaagtcttcaagtgcaatgtgagttaaatgaaaagtactgtggagttaacatcacaattacatcttaagaaattgcaggagataatctaaatttgttaaatatattgctaagtatatgactatccacataaagcttaatcaatttcataataaaatctactttaaaccctccaaagttctgattgtgttccttaatatagactattgaaaattattaaaatatctggtttagtgctacaataagtgaattaaggcaagatcagtatgaactacaactgagacaggtatccactagaggccagtgtacttcggcatggagaaggaatttataaccaattcctgtggaaaaaccaaccttattcctaccattcaaaagtggaggtcttgtgaagtgaagaaaaaaaagatgaagaaagctattttgattctctgaaaagaaagcttcagaggataagaaagatgagttaaggaaggatgagtcatgaaaaaaaagagcaaagagaattcttgtctagagaaaaaaaaatagtactaccatacactgtactgtttgatgtttcaccaacgtaagtgtaaattttcaagatacttggtgtaactgtaagctttttcataaatgtttcatttggcaatatattggaaataattaaagatctggagtacctagaaagtaccacagtaatttcattttcaaggcagtcatcattgctagctgcctagacaaggccaagggttttgaaatgggatggaacaaaactgcatgtctgcaattttcttcccttaaacaactgtattcagaacaagtaccaaatggttccttctcaaacatggaataattcatataaattcacctagcactacattcatattgtaaaatacatttcttaataatggtgcgacacgatgcctacaatactttttaacaaggaactgaactagtttctcaaaactaaaaatcggagtggaaatgaaaatctgattctttagtaaaacgtagacaataatagttggtaggatcctgagtaggagattttactttgtaagagtgaaggctgaatgatttaacacataacccacagatgtgtactctttccccttttcctccagcagagaaaggcaccttatgtaatgtgggcatgccggggagatgaatgaaccagaaaatcttagagctaggcaggacctgagggttcagccaccgcagcttgaaccttttcaaagacaaaagtttcctcctttgcaaggtggcccattgcatccctccattgcattgttgaggctatagctgtttgaaagttattctttaatctttatactgggggacctcatctgacacaacaaaatactgttctggttcctgaggccaaaaagaggacataagatacaaagataaataatacatgatcctgacttcgaggagctgtaaaattctacccatgcagtaggttctgattctgatctctgcaacaaaagcactggctctatcacttattagctgtgtgaattagctaacttctttgggcctcagtttcttcatctttaaaatggggataataatattagtacctacctttgcagggttggtgccaggattaaatgagataattaaaataaggcactaagcccagtacgtggcaagtggtaagtacttattagcagtcagcaattattgctactcactatttacctggcatataagtaattcaaccctttccaaactcctatgagctatgattttattaccattatttttagagacaggaaaactgaggctcagaaagctgaagtagtttgccaagatcagcagctaattaatggctagacaaggatttgaacacaggtttatctaatgacaagagctttaaccattacactaagctgttctggtgaacagtaaggcaacttcctaatcctaaagtgacagggccagtattcactgacaaaatctatgacaaatccaaaatttttcctttctctgatataaatatagttagtgccaaaagctaaccacaagattcctcccttcctagccatgggagaacaggagccctggagatggaagaatctttgaagtccctgagccctgcttccagtgagccatcctgcctgctgttccaacctctgttcctggagcccataccatcctggttaatctctgcctctgtagaggtggggcttccactacctttaactgttcttcatgggataatcacaaacggcctggacctctcctggaactcagggataacaaaaaagtattgagagagaattatctagtcgggaataaagacacacaggtgaatgttataagaaatgcattcagtgaaacctttgaaatagctgtgtgctctctatgccaagtcatggatttaaaaaaaaaaaaggtctgcacaatgttaggatcagaatacaatggtatgacacttaagagtacttccaggttgcttgcttcctgatattacaaaagcacgctcagtcatctctgtcctctatcaccaagcactcagtcctgtgatgaaaggatgctggcattctatttacatcagctaaatttacaaagaaactgactttctgttgatggcctgttgagaggaacaaattaaaataactctaaatcatgtctgtaattttctgaagagatacgcttatcacaccccacttagaacaccaggtcagatgttatctcggtctctcctgatatagattttctactcctttgaacttacaagatacagttctgcctattcattaggaaggtacataagaaattggcttacaaactacagtgaatcagaatgtctaattgtctgactctggctctgagaaatgtaactaaaatcatgaaccataatattaacaaaaaattatggtcctttatctgggaaggtcttttatgaatgtgctttcattagctagtaaggccagaggaaacaatttaaactcaaatcttagtgactgttttcttaaagtcttatattaggagcattctgtctgaaatgttaatgagaagagaaatctatgttgatttgacccccaatttatgacagtatgatatgaaatttcctcctccttgtcaaaaataaggcttctccaaataagtgtcaaactattatgatttacaatgatttaaaaactgttattgacatgattcacagagtggacaataaacaagcaggaaaagaaaataggataattgtgaggtgaaaaatatttagaatgacaggttgcatgattaaatgagaagctgaaaatcaaaagctgctgaaccattcaatcatttcacagaggcatgtttctctttaagatgtttaagaaaaggtgagggaaacagaaaagacactgcaaggaaggcagggatggtttgattgcttcatgaagataattaattggaatgtactaggaagctgtaggctttgatatgggcagcagcacccagttggcttgatttattattatggttacacagaaaccaacttatctgcaaagcataaagtacatacttgccatcctaaattcaggagaaaaatggggaaaatggacttgggtgaaaaaaggaaaatgaaattgaattgagtctgaagtgacttactatcaaatataagtccaaccatttgtcacaagtcaggtatctcatctacaaaataggcaacgtaataaactgactttactaaaatgtactgacctgaaaattgtttgtgattttgttttataacaatgcagtataccacactggtggtaagtgagaaagataataatctagaatgtgttccaaaaacaaatttggctgtatattggcaaattatattttcatctctgacttcaagagaagtaagggaaagaatgaaaaacaaagtagtaggatgagtattattaagtatgagtgtgggatggtgtgggaaataatagactattttcttgttactgatttgcaaaagtccatacaccacaaagtaaaactatgttctttctctgttaatttgatattgaagagcaaggagaatctcaaggggactatccaatccacaactatcctacaacatgacttacagacacatgtaggagtccttttcatatttcaaaaaacaatcctccattaggcagcatgataaagtaaaaaacaaaggaatagatacacacacacaaagacatacaccatatgcatactgtgtatgtgtgtgagtgtgtgtgggtatttatcttaattctaaagaaggtgcttgttgtgtgttccaatgagagttagtaagaaacatgactgtcatcttttcctttccccttgcagtaatcctagttttactgtcaggcacatatgggtttttcaataaccataactcagataaacatgtaatatctaagaatagttaactttttattaagggtgttagtctgtgtgaggtgtaatgctaagcacatcataagtatcaggtcatttcatcctcacaagaagttcaggtgttgacactggagatcacagaggttagtaacttgcccatagtcctacagctgcttaatgtctgagcaggaatttcaatctgggcccatctgaccatgcagcttacccaaactcttatccaacctgataccccatctaccacatttaaagacccactgtcattaaagacccattttaaagacccatttaaagacccactgtcctaccactgccagagtaccccacatatgctattacagtataacatgaccctagacacacgctaacagagtcctttttatatttcccaaaacaatcctctctcagcaaaaaaacaatcaaagaagcagggatgcataacatttcactagcagtcagttgggagacctgggttctagtcttcgctctgccctgctttaggtacaggaccttggacacatctcttcatctctcaggacctcaataacatcacctgttagaaaatccttgagaaacatttctgcacaaacatactaaatgtataggcaagtaatagaagtcaatcacagtgaagatcactagcaccagactgttgcttttattccactatggtatgtttatataaatgttttactgctataaaaatgaaagataaatagtattcattgggagaaaggggcttagcaactccacattttgtcatctactattacatatctaggtcaaatttggcttttattaataaatgaagaatgaagacaaaaattgcaaattggaagagtttaattagaatataaagactgtcaagagaactgaattgcatccttgacataaactggactagaaaaataattaaaattggctttttaaagtctatttcggttatgttgaggagcaggatattttgatgagaaatgttttcaattctttgaataaaagcaaagaagatttgcacagtcatcagtccacatgtatatagtacagtccttcaaggcaggaagaagtttactcaaatgaggcaagtaaatgcagaacagaactgaatggctgtcagccctacctgagtctcagagactaagcttcaaaacttgaggtttttctttcaccctaaatagctctgatgagcaataaagtatgacagggaagtttaaaaaaagaacattcaggctgggcacagtggctcatgcctgtaatcccagcacttaaggaggctgaggcaggcggatcacaaggtcaagagattgagaccatcctggccaacatggtgaaaccctgtctctactaaaaatacaaaaaaaattagctgggcatggtggtgtgcgcctgtagccccagctactctggaggctgaggcaggagaatcgcttgaacccgggaagtggaggttgcagtgagccaagatcgcgccactgcactccggcctggtgacagagcgagactccatctcaaaaaaaaaaaaaaaaaaaaaaaaaaaaaagaacattcaacacaattttactaagatcttacaatatgtgtacaactgtgttgagatgtggagacaaaggaaatctgtgaccagaaagtcatagtctttgcctttgctaattttataatctagtggtgaacttgatgttgagaatgagaaagagatttcaaaggcatagctcaactaagaacatcttataaaccataaagtcccagtttaatagctacttcaccatttactaagataatgcctatagggaggtaactgtggactttttattgtctgtgcatcttactaaagggtgggcaactgacggatagggcatctgtatcatttacacttaataagcatcttcagctacaccaagagagatggtcaatactcagaaggttgtgaggacacccatcacattaggtggaagcttctggacctgagaatggaaggtagaattatgtggtcagggtctttggagacaaatttattaggctgaagaaggtaggtttttttggaccaggctgccagggttgatttagtcttgtttgtggatggttaataggtgcagtgatgtggtttggctctgtgtccccacccaaatctcaccttgcactgtaataatgcccacgtatcaaggttgggaccaggtggatgtaattggatcatgggggcggttcccccatgctgttcgtgtgacactgagtgagtctcacgagatctgatggctttgtaagtgtctggcatttcccgtgcttgcattctctctcccaccaccctgtgaagaggtgccttctgccatgattgtaagtttcctaaggactccctggccatgcggaactgtgagtcaatttaaactcttatctttataaattacccagtctcaggtgttccttcctagcaacatgagaatggactaatacacctaggaataattttatgcatttccataaaatgcatgtttgtaatgtttccattacagggctaacctgatatgagtactcaaagtctagacactacaattccctcctcccaacatccaccaacttcatttaggctctttctgtgcctggcatttgagtctatcttcctcatgcctccctcacctcttggagcccaaatactcacacatcatgctgcctttgttaatatttgcccagttttctcttaccccctgctctacaagattctgtaaagatcagagcagaacttacttcttatttccgctattttaaaataaaaagcttttagacattttaacatttttgacatcagaatcccccttagaatgaatatctccctttactgaagtgagttttgctcctaaaacaccattattaaaacagtgaggtatcttactatagctaggattctagagcagaagaaatactgcatttctgttgtttaggtcctgaccaataacaggactgacactgatactaactatacaccacttcccttcctcttgttccacttcatgaagtctctaaaggatctcatatgtttggtggaaaatcaaaactgcagaaactgataaatactctgattttgttttctctgtacttgatcttcaaggattgctttagtagaatataaaagcaaatgatggctcattcaaaaaaggtcagtgaatgacaactcttaggaactcttttgtcactgataaaaatagttccatctacctggaataatcttgtaatccatttaaacatttgtacataattcttcaatctctgatatacaatggtgaggggactcagcccactgtgcctggggaagaggagaaaaaggggggaatctaaagcccaatttaccactttctctcacaaaccggattatctttttgacatctctatttccattcacagagattcaaggactctttattttcccagttatccttctctggacggactctagtcaccaacatccctcctaaaatgtaggatgatgcattggaactgttgctctctgtagctacttactgtccagtggtaatacagggatgtgtttagaaatacggaatatagtgtaaaattgcccgggctcaacatactagctatacccatactagctctgtgtcctctggttagttatgaatctcttctatgcctccttttcttggctgtaaaatagataatcatgtcttaaaatacaataatccacatgaagtacaagatcctggcaagtcataagagctcagtaattgctggccgttactaaaaccaccagcatcacttctgccaccaccattctcactactgctgcttgatggaggaccccaaatgaactgctgcaggacaacgatgattatagaagtggcagcagcattccttgccctccaagatttggccccattttatctggctgaatatgttgcttagcattccacttttagccaatctgaacaatctctttactgtattctcctgctcaatcatccagcctaaaagcccttaccttctcttacacccttccaactcttctgctatcaaggctgctcattgagcctactcaacatcttccacccacaatcgcctccccttcccccacacctttagccagagaatcattttgcatttgaattaagcgctcttctagttttaaattcaatgtcatataagattactatgatttatggcttcctaactgacttatgaatttactttgtttttctaattacagggcaaagagtttcctatttttacttggtattgccttcttgtacttagcatcattttaggcatacagaataagatctgggtattatcagtggactgacccacacctctgtcctaagtgtattatttatccctagaattaatattgggatgcttggaaagtacgataattaattttatatgtcaacttgactggaaaatgggatatccggatatctggtaaaacattatttctgagggtgtctgagagtgtttccacaagagattagcatttgaattcatagactgaatagagaatacccaccctcaccaaagtgggtgggcaccatccaatctgttgggggcctaagcataaaaaaaaaggtggaagaagggaggatttgctctctctgtgtgattatttagctggggcatcttccttctgccattgccatccctggttcccaggcctttagacttagactggatgctaagccattggctctctggctctcaggccttcaaactataccaccagccttcctgggtctctgccttacagacagcagattgtgggattccttggccttcatgactgtatgagccaataccttataataaatctctttatatctcttatttgtcctgtttggtgaactctaaaacaggtgtagtaaattttcactggacaccatgatactgcataaacattcgagctgtcgaggtttccaatgacccaaaaataaaatttagcctcaaatagagacttgtaaaatattactataagctcaaaaggattttaatgtacagttagagaggaattccagctcaggaagatcctgcttttctgtaataaagaatataactcaattaccaactgtctcacttaatatatgacacaattcctatgagaaagattctgtactctgagagtattagagaatgctaagtctctattccaggaggttagacaagacaagattgccaagctttagtattttaaaatgtttgctttttcttgagctaaaagaataaaaaaaacaagcaaacaataacaaaatcccataatcatgattatttcactacttataaaactcagtgtcatattagcacctgaggtcattaaggttggtttgtacaataaccaaaacatacttgaaagcaagtaaaacagacatataagaaagaatatattaggtgaaaaagaaagctctgattacccaaaatgctaataatggctctgcacaaacaattaaaactcttcatttcaaactccatttgttcagaatgtgaatatggaggactcttccacaatttacctttgcaatatttaaggaaaagtatttgctgagtaaaaaaatatatattacagtaagactgtaaagaacatacttaccatattcaagaaaataaacttttctccagtattgaaatgtctcatttataaatacttgattccttaatagcatgacactcttttctgctaattaaaataggtggcatgctgggcgcagtggctcacacctgtaatcccagcactttgggagcccaaggcaggcagatcacgaggtcaggagatcaagaccatcctggccaacatggtgaaaccccatctctacaaaaatacaaaaaattagccaggtgtggtggttcgcgcctgtagtcccaactacctgggaggctgaggaggggaatcacttgaaccctggaagcggaggttgcagtgagctgagatcttgccactgcactccaacctggcgacagagcaagactccatctcaaaaaaaaaagtggcaaaatccatccatttgaccaagcatcctttgcctactttaaacacataaaataataagtaacactaagaatgtaatttacaataggatttcttcctaccgattggccttatactaaggatgaacaaaaggttttatatattacctgaaagaacggtttttttgctgaatgaaactgattattagtaatggttccagtcacctaaaatagccaaaggtatgtattttatgttatcactcttctttttttagaaaaacattttcctttaaaagtagcctaccaattcacaggtgaaactgaatttattgttgtaagatcaggctttaaaataactttgaggaggagaagcccttgacaagaaagtaaacaatagaaaccaggtcagcaactgaagacctgattttattgttcatagacacaaatgcttggtttcagaaatgccttaatatcaaggaagctactggtcaaaagtatttctatgggcacattatatcccagaactaatgttgtcaattgactatctagttggtaggaaaagtcagttcaaccttaaaacctaagttaaataggaagaggttccaagatggccgaataggaacagctccagtctacagctcaagagaagggtgatttctccatttccaactgaggtacgaggttcatatcactggggcttgtcggatactgggtgcagcccatggagcacgagccgaagcagggcagggcatcacctcacctgagaagcacaaagggtcagggaattccctttcctagccaagagaagccctgacaaacagtatctggaaaatcaggacacttccacccaaataatgcgcttttccaacagtcttagcaaatggcacaccaggagattatgtcccatgcctggctcagagggtcccacaaccatggagcctcactcactgctaccacagcagtctgagatcgaactgcaaggtggcagcaaggctgggggaggggcgtccaccattgctgaggcttgagtaggtaaacgaagcagccagaaagcttgaactgggtggagcccactgcagctcaaggaggcctgcctgcctctatagactccacctctgggggccgggcatagctgaacaaaaggcagcaggaacttctggagacttaaacatccctagtggttctcccagcacagagtttgagaactggagaatggacagactgcctcctcaagtgggtccctgacccctgagtagcctaactgggaggcacctcccagtaggggccgactgacacctcatacagcagggtgcccctctgagacgaaacttccagaggaagaatcaggcagcaacatttgccgttctgcaatatttgctgtcctgcagcctctgctggtgatatccaggcaaacagggtctggagtggacctccagcaaactacaacagacctgcagctaagggtcctgactgttagaaggaaaactaacaaacagaaaggacatccacaccgaaaccccatctgtgcgtcaccatcatcaaagaccaaaggtagataaaaccacaaagatggtgagaaaccagagcagaaaagctgaaaattctaaaaatcagagcatctctttccctcaaaaggaatgcagctcctcgccagcaatggaacaaagctgaacagagaatgactttgacgacttaagagaagaaagcttcagacgatcggtaataacaaacttctccaagctaaaggaggacgttcgaacccatcgcaaagaagctaaaaaccttgaaaaaatattagacaaatggctaactagaataaacagcatagagaagaccttaaatgacctgatggagctgaaaaccatggcatgagaactacatgatgcatgcacaagcttcagtagccgatttgatcaagtggaagaaaggatattagtgattgaagatcaaatgaatgaaatgaagcgagaagagaagtttagagaaaaaagagtaaaaagaaatgaacaaaacctccaagaaatatgggactatgtgaaaagaccaaatctatgtctgattggtgtacctgaaagtgacagggagaatggaaccaagttggaaaacactcttcaggacattacccagaagaacttccccaacctagcaaggcaggccaacattcagattcaggaaatacagagaatgccacaaagatactcctcgagaagagcaactccaagacacataattatcagattcaccaaagttgaaatgaaggaaaaaatattaagggcacccagagagaaaagtcgggttatccacaaagggaagtccattagactaacagctgatctctcagcagaaactctacaagccagaagatagtgggggccaatattcaacattcttaaagaaaagaattttcaacccagaatttcatatccagccaaactaagcttcataagtgaaagagaaataaaatcctttacgggcaagcaaatgctgagattttgtcaccaccaggcctgtcttacaagagctcctgaaggaagcactaaacatggaaaggaataaccggtaccagccactgcaaaaacgtgccaagttgtaaagaccatcgatgctaggaagaaactgcatcaactaacaagaaaaataatcagctaacatcaaaatgacaggaacaaattcacacataacaatattaaccttaaatgtaaatgagctaaatgctccaaataaaagacacaaactggcaaattggacaaagagtcaagacccatcagtgtcctatattcaggagatccatctcacgtgcagggacacacataggctcaaaataaagggatggaggaagatctaccaagcaaatggaaaacaaaaaaaagaaggggttgcaatcctagtttctgataaaacagactttaaaccaacaaagatcaaaagagacaaagaaggccattatataatggtaaagggatcaattcaacaagaagagctaagtatcctaaaaatagatgcacccaatacaggagcacccagattcataaagcaagtccttagagacctacaaagagacttagactcccacacaataataatgggagactttaacaccccactatcaacattagacagatcaacgagagggaaagttaacaaggatacccaggaattgaactcagctctgcaccaagtggacctaatagacatctacagaattctgcaccccaaatcaacagaatatacattttttctcagcaccacattgcacttattccaaaattgaccacagagttggaagtaaaaaactcatcagcaaatgaaaagaaaagaaattataacaaactgtctctcagaccacagtgcaatcaaactagaactcaggattaagaaactcactcaaaaccgctcaactacatggaaactgaacaacctgctcctgagtggctactgggtacataacaaaatgaaggcagaaataaagatgttctttgaaaccaatgagaacaaagacacaacataccagaatctctgagacacacttaaagcagtgcatagaggaaaatttatagcactaaatgcccacaagagaaagcaggaaagatccaaaattgacaccctaacatcacaattaaaaagaactagagaagcaagagcaaacacattcaaaagctagcagaaggcaagaaataactaagatcagagcagaactgaaggacatagagacacaaaaaacccttcaaaaaatcaatgaatccaggagttggttttttgaaaagatcaacaaaattgatagaccactagcaagattaatcaagaagaaaagagagaaaaatcaaatagatgcaataaaaaatgataaaggggatatgaccaccgatcccacagaaataaaaactaccatcagagaatactataaacacctctacacaaataaactagaaaatctagaagaaattgataaattcctggacacatacaccctcccaagactaaatcaggaagaagttgaatctctgaatagaccaataacaggctctgaaattgaggtaataattaatagcctaccaaccaaaaaaagtccaggaccagacggattcacagccgaattctaccagaggtacaaaaaggagctggtaccattccttctgaaactattccaatcaatagaaaaggagggaatcctccctaactcattttaaaggccagcatcatcttgataccaaagcctggcagagacacaacaaaaaaaaagagaattttagaccaatatccctgatgaacatcgaggcaaaaatcctcaataaaatactggcaaactgaatccagcagcacatcaaaaagtttatccaccaagatcaagtcagcttcatccctgggatgcaaggctggttcaacatatgcaaatcaataaatgtaatccatcacataaacaaaactgatgacaaaaaccacatgattatctcaatagatgcagaaaaggcctttgataaaattcaacaccccttcatgctaaaaactctcagtgaactaggtattgatgtttactgtgacactattcacaatagcaaagacttggaaccaacccaaatgtccatcaatgatagactggattaagaaaatgtggcacatatacaccatggaatactatgcagccataaaaaaggttgagttcatgtcctttgtagggacatggatgaagctggaaaccatcattctcagcaaactatcacaaggacagaaaaccaaacaccgcatgttctcactcataggtgggaactgaacaatcagaacacttggacacacggtggggaacatcacacaccggggcatgtcgtggggtggcgggaggggggagggataccattaggagatatacctaatgtaaatgatgagttaatgggtgcagcaagccaacatggcacatgtatacatgtaacaaacctgcacgttgtgcacatgtaccctagaacttaaagtataataaaataataaaagaaaacctaagttaaatacaaacaaataataattacttaggggtcagcagctggtggctcaattgggcactggagaccatgtttgttctctttgggtggtacattgagggtgtctaaccttaagaaatgcaggaaggggatgatggatggtctgttcagattccctttgtcccaactgcatttttcagctgtcaagagatactgttagcaggcactagatttaacaatgggaggctagatgggaggctaactaccttttgaagtacacgcctggcagatgacaaccagcatctttacttttaaacccagcaacagtgggttgctaggcattgttttgctggtttattaaacttgtttcagtaaagaagcagcaagtaactggctgcatattatactagactaagaagctttttacagacagcaattggtcttagtaaatgctgtatcctgcaggtctaggacagtactagaggtgataatattaatttatgatcaacaaggtctgatttgaaatacaaagtcacatgcactggtgaaaccttgggcaaacagctgcgaaggaaactttctgtggtcaactataaacgttccagctatacaatattatattccaaatttgttgtttattttttatctaatttctatccttatgcctagagcttcctttttctttacacctggtaaaatcctgcctatccttagaagcttcatttaagattcttcttgtgacctctcccggcataattacccttcacattcatccaacatggtgaccccgatctgctaggttctaagcctccagttgttaccatatgccatcccattttacctttctgtcttttatatccctctggttcttctatcagaatatagagagaattatcaaataatcacattgtatgactcgctctcaagcttttgaatttgctgaaggacgaaatggaacctttgttatttcggttaccctttcacctagaaggtccttccgtaacaccacagtcagaattttaaaacgaagaggaactccatactcttttattggattgaattaaattgaaggaataactaatttctctcgagcttcctgatcttaaaatcctctgaataggtaagaaataaagctgagatggtatcttgttatgctgtactgttctcccctatgttaggggaaagggtgtctattatttgtcttttgggtttttcctcactgtacttctgggggttgggggaggttgctgctagccatttcctctagtaaaagttcaaaatagcccttctataaaagctaccccatagaacaccactttataaccatttgaaaaaccctaaagttgacctccaggagaaaccacttcatatggcttccccaaaccctgtttaacaagttttaaaatatttagctggaatgttacttcaagctaaatatgctactggtttattttttcattccatttaccagttgtgacctcatctgtgcttgcaattggctgaaaggaaccaattttattcagggaaactttcggatgtgagccgtgatgcccactgaggataaagataggaaggtgcgcacggtgggtgtggaaggagggagaatcctttctagaagatgggggagtgggcccagattcaagtgactgagtgacctttctttttgctagctgctgtgtgaggaaaaaaggctatttcttcctgcagagaactgcgaaatgaggtataaactgagtagcgaggtagatgagcctaccacattagctgattaataagcaaactgctcaaatgcccagagggatagagagttcctagcagaattaataataaatccagacattgggtgaattaaatttaaggtgtaaagactaaaccagggtcatattagctaggaagtatgaggtgcgggatttagtaaaaaaaaaaaaaaacttatttgcacagagatgcttagttagcctagctctacaaaaacatctataaaacacagctttttaactgttttcttgctggtttaataattagcttaatttctgttcacaaaaaattgtagttaaaaaaaagctttcaatacctacgagaactctgtctaattgagccatgagggcaaatccaagaggccaccacacatacactagaggttgacaaagtgcatgagaagaagcaggtctcgtaagtactgatcttgcaaccccaaatcactaaagtacgagtaactgctacaggagcaaatgaaatgatctgtcagaaatctctttgaaaagcagaaaagtgagcacacaaatatatatgatcatttctgttgtttaacataatcaagaaattgatgctgctaaaataagttcaatttaaaattgtggccaggcatagtggctcacgtccgttatcccagcacttcgtgaggccaaggcgagaggatctcttgagctcaggagcttgagaccaggctgggaaacacagcaagaacctatctctacaaaaaatgaaaaacattagtcaggcatagtagtgcatatctgtagtcccagctactggggaggctgaggtgggaggatttcttgggcctgggaggttgagactgcagtgtgtggtgatcatgccacttgtattccagtctggttcctgtctctaacaataacaacaacaacaataacaacaatgtgggactgtgaatctgcttttaaatattgtacatagggtacctaacaaaaaaaggtgttaaaattatttctcaacacttaggatgagagaaggggaaggccagcagtaatattttatactggttgggagaagggtagatggcagtcaaatctgaatacaaagcaaaggctttattttaaaaatgtatttccttctttatcagatttcatatatatgtgactatgtataccacatagcaacatgagatgcaatgagttcatttcttttctcttttcattccaaataaatgggcaagagaactgcacccaaaagggctgggtcaagtccaatctgatacattgtaccagttcttaaatgtgcattctttctacgtctcaactgttgttaggtaagttcttcaccagtaactaatgataattaaatatataaatctgtgaataatgtacttgtgcttctaaatgaagtacaaaagactcaaggtcaatcgtataatagctttttctgcactcacttgctttctcctgtttatctgcttgagtgggtaaactacagtaggacctctcctccatgggctggtgtagctacagctgacaaaggtttgaggaccacagttctcattctcagcaaatcacaagtacacttgtatgactgcagtttgcaaccttgtaatattgatttaggcccaaacaatatgctttcaggatcctttaacaattattttccttttgaacaaaacataggaagaataataaacttaaaaggctataatacctcaaacttttgcttcaaatgcaaggtggctctggctgaagcagaaaatatgtattattaacactagcagttgttaatagtggtaatgataatatgttatctccaccacatggcgataatgggttttttattattaaagtaagatgccacctttatttatagacatcgttaagtcagagaaaatgaaaatgcaaaattactacacagttcaaattgcagcagcccttaagactcagtggggagaatgtacatgcatcatcttatggattaaaaagaatacacattatctaagcccaatgttatgtccacacatatgtgcctctaaggttgcaagaataggaaagctagtgaaagtaaagaaaatattttttagatgtgattttctattaagaaagatgggccctaaatgtaatctgttttgctttaatcaagtacagacaagacaacattatatgctcactcaattatgactgttttccccttaaataacttcacttaggaacaaacacgaacatagctaaatggaatttccactaaccattaaatgtagttagatgttcttttcttcatatattttagactgaagttctattaatactgtttgtaatataagtatgtgaggaatagtgtctcccaaaagcggtcctgaaattgtatttgctatccgaagagatgcatacgttatagcagtaaatttggtacttgggaaactattttatttggtttgagcaattctaaaaaaattaagggcaaacattagttttgagcatcacagaaagatatgaaatgaagtcaagtctcaaagtgcttcaggtaattttaagaaccaaaggctcaaaagtgagaaaaataacctgcttttttctaaagacaaggctactgctaataatgaatgagcaggaaaacaaaatcttgctctgcttcagttcctgcaggagaaaaagtaagtggtctgaaactgaagtaatttaatgttcctgctttccagccctttgccagacacccatatcacagtgacccatagtggaccccaaagagagcccacaaggagatgggctcagtcattatggaaggcatcaccatgctaaataatagactggaggagggagggtaaaccaacatcaagaaggccagagggcaaatcttcattgaatggcatttataaaaatcctgtagccaaacaagaccaacgattcaaaaatcttcactggttgaaggattcggattgggaggaaccaactagcagcgatgtgctagtcaagtctgttgcctggattactataggacttttactaagttgtcactatatcatcatcaatattattactagaaatttacatgatacttttcatcagcaagtgttaggtaaaaatttaccagtatttttgtataaacatctcatttagtgcttaaaaaaattataagtgatgtatgaccaccacacaaattttcaatattatataatcttgaatacaaattatacatttttgtaggtatttaaatacaaatgcacacatttcaacttttttctcactaaacaatcaaatgtttttcaaatgttacctgtgtttaaacacctacatgtactttgtcctttttctttgctttttcttttcttttatttattgttttccttttaaatattgccattttgtaaaataatatatgatcaagataggaaatagaaaaacacaaaaaagtagatcaaatgacagagtcctaacacttaaacacattgagtattattaattttgtatatttccttctagtatgtttctgggagtggggagaagttttatgccaggtgtggttaaaaaaaatactgtgtgtaaacagagagagcaagcagcagcccccaagactgaagcttcagtcttttttataaccgaattatttcatttctattcattagatgtgagtcagcaggtaaagcccacatgcaaggggaggtgattacacaagagcctgaacaacaagagataaggatcaatcactaggggccattttaaaggctgcctgaaaatacaatcctgtgttaaacatcttctggcatcaaaaatgctggtattattttcttaagacaaaataccagacatggactacaaggctaaatgatacgatagctttttaacgtaccagatagaaacagtctttgtgtgtcaggatacatcccacttggtaatacggcttattcatttaatagttgctgactcctattcaataaataaattattacagatgttctcatccataatcatattaatatcagtctttaacttttttggctgtagagaggctggctttattataagggtaaatttcttctatttttttttaaaagaagaggcttttatgatatgtggcagtttataaaatatggatttaggtggggagaatttcatgcatcagaaaatttggttgaacgtaaagttcttaagagatgataatgattatgataaaaaattataatcatcagaataatttaattactaccattactgagccactatgaaatatcactttcccactttatggaacagaaaactgaggctaatgtagtgtgatggttttaaggatatgtccatctttaatactcccttcaagagatggaactcatttgttccttggagtatgggtaggcttagtgactcacttctagtgaaaagaatacatatacgtgatgcactgtcgcttctgcgattagtgataaaaagactgtggctcagtgcaatcaaatcagaactcaggattaagaaactcactcaaaaccacgcaactacgtggaaactgaacaacctgttcataaatgactactgggtaactaatgaaattaaggcagaaataaataagttctttgaaaccaatgagaacaaagacacaatgtaccagaatctttgggacacagctaaggaagtgtttagagagaaatttatagtactaaatgcctacaggagaaagcaagaaagacctaaaatcgacaccctcacatcacaattaaaagaactagagaagcaagagcaaacaaattcaaaaggtagcagaaaacaagaaattactaagatcagagcagaactgaaggagataaagacatgaaaaactcatcctcccacccaaaaaaaatcaatgaatccaagagctgtttttttttaaagattaacaaaatagacagaccgctggccagactaataaagaagagagaagaatcaaatagacacaatgaaaaatgataaaagggagatcatcactgatcccacagaaatacaaactaccatcagagaatactacaaacacctctacacagataaactagaaaatctagaagaaatggataaattcctggacacatacaccctcccaagactaaagcaggaagaagtcgaatccctgaatagaccaataacaagctctgaaattgaggcagtaattaatagcctatcaaccaaaaaacatcaaggatcagacggattcacggccatattctaccagaggtacaaagaggagctggtaccattccttctgaaactattgcaaacaatagaaaaagagggactcctccctaactcgttttataaggactgcatcatcctgataccaaaacctggaagagacacaataaaaaaaggaaatttcagaccaatatccatgatgaacatcaatccaaatatcctcaataaaattctggcaaaccaaatccagtagcacatcaaaaagcttttctaccacgatcaagtaggattcaaccctgggatgcaaggctggttcaacatacacaaatcaattaacgtaatccatcacataaacagaaccaatgacaaaaaccacatgattatctcaatagatgcagaaaagacctttgataaaattcaacacctcttcatgctaaaaactctgaataaacttggtagtgatggaacatatcgcaaaataataagagctatttatgacaatcccacagacaatatcacactgaatgggcaaaagctggaagtatttcctttgaaaattggcacaagacaaggatgccctctctcaccactcctattcaacatagtattggaagttccggccagggcaatcaggcaagagaaataaagggtattcaaataggaaaagaggaagtcaaattgtctctgtttgcatatgacatgattgtatatttagaaaaccccattgtctcagccccaaattttcttaagctaataggcaacttcagcaaagtctgaggatacaaaatcagtgtgtaaaaatcataagcattcctatacaccaataacaaacagagagccaaatcatgagtgaactcccattcacaattgctactaagggaataaaatacctaggaatacaacttaaaagggatgtgaaggacctcttcaaggagagttacaaaccactcttcaaggaaataagaggggacacaaacaaatggaaaaacattccatgctcatgaataggaagaatcaatatcgtcaaaatggccatactgccaaaaggaatttacagattcaatgctatccccatcaagctaccactgactttcttcacagaattagaaaaatctactttaaatttcatgtggaacccaggaacagcccatacagccaagacaatcctaagcaaaaagaacaaagctggaggcatcatactacctgaattcaagctatgctacaaggctacagtaacgaaaacagcatggtattagtaccaaaacagatatatagaccgatggaatagaacaaagccctcagaaataacgccacacatcaacagccatctgatctttgacaaacctgacaaaaacaagcaatggggaaaagattccctatttaataaatggtgtttggaaaactggctagccatatgcagaaaactgaagctggactccttccttacactttatgcaaaaactaactcaagatgaattaaagtcttaaatgtaagacctaaaaccataaaaaccttagaagaaaacctaggcaataccattcatgacataggcacgggcaaagacttcctgactaaaacaccaaaagcaatggcaacaaaagccaaaattgacaaatgggatctaatcaaactaaagagctttctgcacagaaaaagaaattatcacaagagtgaacaggcaacctacagaatgggagaaaatttttgcaatctacccatatgacaaagggctaatatccagaatctacaaagaacttaaatttacaggaaaaaaacaaacaaccccatcaaaaagtgggtgaaggatatgaacagacacttctcaaaagaagacatttatgcagcaacaaacatatgaaaaaaagctcatcaccaccagtcattagagaaatgcaaatcaaaaccacagtgaaataccatctaatgccattcagaatggcgatcattaaaaagtcaggaaacaacagatactggagaggatgtggagaaacaggaatgcttttacactgttggtaggagtgtaaattagttcaaccattgtggaagacagtgtggtaattcctcaaggatctagaactagaaataccatttgaccaagcaatcccattactgggtatatagacaaaggattacaaatcattttactataaagacacatgcacacttatgtttactgcagcactgtttacaatagcaaagacttggaaccaatccaaatgcccatcaatgatagactggataaagaaaatgtggcacacatacaccatggaatactatgcagccataaaaaggatgagttcatgtcctctgcaggacatggatgaagctggaaaccatcattctcagcaaactaacacaggaacagaaaactaaacactgcatgttctcactcataagtaggagttgaacaatgagaacacatggacacagggaggggaacatcacacactggggcctgtcaggggctggggggctaggggagggatagcattaggacaaatacctaatgtagatgacaggttgatgggtgcagcaaaccaccatggcatgtgtataactatgtaacaaacgtgcacattctgcacatgtatctcagaacttaaaaaaaaaaaaaagactgtggcttcagtgttgtgttgagtctcctgtcttgtcatgtgtagccctatggagactcatgggaaggaattgaagcctcctgcaaatatgtctgcgtgtgagcttgaaaacatactccaaatacttctgagactgcatccctaaccaacagtttgtaacctcatgggagacccctggccagaacaacccagctaagctgctcctgtatttccaaccctcaaaaactgggagtgataatagatgttgttctaagttgctcaactttaggatcttttgttacaaagtaatacagataactaacatatacagtaatctacccaagatgacattgctagaagtggcagagttcaagccacttccaacatacttgctgttaggaaagaaggagagggcatgaaaggaaccaagaaaaataactcagaatatttccccactgctgttaatgaaaagagaaataaaagggcaaacatactggcttcccatctgctcctcctcccaaatcttacagaaaacactttgccatctttctttcccatcagtatcttgttctgaaatatataaaatacctgtcaagcaaaagcctttttaaaaagggttgatttcatcaatctggctgtctactttctttcttttttttttttttttgagacgaagtctcgctctgtcgcccaggctggagtgcagtggcgggatctcagctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaggctgtctactttcaaatcacaactgaaatccccagaacagtggttctcaaactatggtacctggaacagcggcatcagtattggcctgaagctagtgacaactgcacattttgcgtccccaccccgggctactaaattggaatctctaaaggtggggctgaagaatctgtgttctaaagggctttccaggggattcttatgcacactgctctagatttaagactcctgtgaaaatgacagtggctgtcctagagctttgttcctactgatggctgaaagtgtttttcagatatgaccaaagactttgggtggccttcagcctaatcaaaatatttagagatttaattactaaatgccaacccatacaaatgtaaagatttttcctacagagactttgtggtgaactgaatgcattttttaatcaactgcttggcaagcagtatgagttttcttgtttgtaaacatctatactaatgctaaacatatttattcacaacttgacaagaaatattgccctgtaattaatcatttcccagactgaattcagacaaaataaaaatgcactcctgaaatgtgcatccccttcacaattgtaagagtcacacacataaataatacaatcagctctccctatccatgggttctacatccatggattcaactaatcacggtataaaaatattcagaaacgaaaaaaaggacggttttgcctgtgcttaacatgtacagactttctttggtcatactccataaacaatacagtataacaactacttacatagcaagtacattgtatgaggtattacaagtaatctggagatgacttaaactataaaggaggatgtgtctaggttatatgcatatattgtatcatgttatatcagggacttgagcatgtgctgattttggtatctgcaagggagtctggaaccaattccccaaggatattgaggaactaatgaaattagatctcggaccgccgggaggatggagttcagcgggcagcggagctgtctcagtctttgccgccgcgccggcgagcgcccctcgggaggcagcggctggaggagcggacgggccccgcggggcccgagggcaaggagcagccgcctgccttggcctcccaaagtgccgagattgcagcctctgcccggccgccaccccgtctgggaagtgaggagtgtctgtgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcctggccgcccatcgtctgagatgtggggagcgcctctgccccgccgccccatctgggatgtgaggagcgcctctgcccggccgagaccccgtctgggaggtgaggagcatctctgcccggccgccccgtctgagaagtgaggagaccctctgcctggcaaccactccgtctgagaagtgaggagcccctccgcccggcagctgccccgtctgagaagtgaggagcctctccacccggcagccaccccatctgggaagtgaggagcgtctccgcccggcagccaccccgtccgggagggaggtgggggggggtcagccccccgcccggccagccgccccatccgggagggaggtgggggggtcagccccccgcctggccagccgccccgtccgggagggaggtggaggggtcagccccccgcctggccagccgcgccgtccgggagggaggtgggggggtcagccccccgcctggccagccgtgccgtccgggagggaggtgggggagtcagccccccgcccggccagccgccccgtccgggaggtgaggggcgcctctgcccggccgcccctactgggaagtgaggagcccctcagcccggccagccaccccgtccaggagggagatgggggggtcagccctcccacccggccagccgccccgtctgggagggaggtgggggggttagccccccgcctggccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcaacccccccgcccggccagccgccccgtccgggaggtgaggggcgcctctgcccggccacccctactgggaagtgaggagcccctctgcccggccagccgccctgtccgggagggaggtgggggtgtcagtcccccgcccggccagccgccccgtctgggagggaggtggggggggtcagcccccctgcccggccagccgccccgtctgggaggtgaggggcgcctctgcccagccgcccctactgggaagtgaggagcccctctgcccggccagccgccccgtccgggagggaggtgggggtgtcagtcccccgcccggccagccgccccgtccgggagggaggtggggggggtcagcccccctgcccggccagccgccccgtctgggaggtgaggggcacctctgcccagccgcccctactgggaagtgaggagcccctctgcccggccagccgccccgtctgggagggaggttggggggtcagccccccgcccggccagccgccccgtccgggaggtgaggggcgcctctgcccggccccccctactgggaagtgaggagcccctctgcccggccaccaccccgtctgggaggtgagcccaaccgctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaagaaaatgaaagctgcaatagaaactcataaatgaaaaaattatctcctgaccatttttgagagaatgagagacatattctgctcagtgtaaaagtggttattaaagttattttgaaaaatttcatttaaaaaaaaaaaaaatgtcatagaaggaggaactggttattctcaactgcagcgacaagttctgtgctaatgagtaactttcttcaaaatggggtgatttcttagtatagcagactacacagacataatcagatgtgacctatcccttcagccatagttcatccttgttaagaatatgtttattcaaccttgaggaggttgggatgatgcctaagagaagaaccaacttaggcttctagacggacctatcgggagacctgttccaagtaccaataatgtctcttcttcaaagatgtgggcattggtgacccactattagagattttatacaagttttggggctatcagggaccttagagatcgtctagtctggattcaaacattaatccaggtatcccatcctcaaagattgccagggagctgcataagcttcccaggtgatgtcaatgcgcagctggatttggaagtgaatgcctaagtaaaaaggataatttaggcaatcacttcaaggttcatccttggaaagtggattgtttctactttttggctgttatgaataatgctgctataaacatttgtatataaaaaaaaaaaaaaaaaaaaagaaattagatctctccggtatctaaatatgtacatatgtacatttttttttttttttttttttttttttttttgagatagagtctcgctctgtcactcaggctggaatgcagttgtatgatctccgctaactgcaacctccacctcccgggttcagggattctcctgcctcaccctcccgagtagctgggactacaggcgcctgccaccacgcctggctaatttctttttttttttttagtagagatgggatttcaccatattggccaggctggtcttgaactcctgacgttgtgatgtgcccgcctcggcctcccaaagtgcctggattacaggcgtaagctattgcacccagccatgtgcaggtctttttaggcaaaacaatgccaggcactcaaagaatgttggtcattaaaagggtatttcacttttagaaaaatatataactacacactttattcactataatcactattcactttattttaaattgtgacatattaaaaaaagattatctattaattgcatacttccattaatgtaatccttaataagatgcaaatttttaaataatcctttatgtttgaggaagaaaatggttaaaaatcaaaaaaggttaacattagttttttgaaacaggttaaaatcatcactagtaattagctgatgaaaattcattgttctctggttcactagttttatttaagtgtgttgtcaaaatgcagatgttaacaggaatcacctactgaaaaacatgctaaaattcaaggtcaataaaactgagttaattttaaaaaatcattttacctactaacatctaggatttctacctcatttctcaactgtaataatactagaagtaccataaaatactataattaaatacaaaattgactataaagttgaaccccaacaatgagagggaatgtcttaacaagtcattaccaaaaagtgactgtttaaatatagaaaatatgattttataagtgtaggaatgagtttttttcctaccatcttttcaatattcattgagcagttattacatggcaggcattgggatagatgcaggtagctacaaaaatcagtacaactctgatttgattatgcccacaatctgggggtacagaaatggaaaaatgtgtgtcatggagggcaggagaaatgcagaatacaatacactgaatggatacagaaaacaggaacaagatacttcaggaggaagctttgactcccacaacagaagtattgggtaattaatgaactatattccaaatcaacatatttgccaatggaaaagaaagttcataaaaacttgaaaaaatttgtcccattttatttatttattgagacaattattaatgcatttatttattgagacggagtcttgctctgtagcccaggatggagtgcagtggtgcaatctcagctcactgcaacctctgctcccgggttcaagtgattctcatgtctcagcctcctgagtagctgggattatagacatgtgccaccatggccggctaatttttgtatttttagtagagacagggttttgccatgttggccaggctggtctcaaactcctgacctcaggtgatccgcctgcctaggcctcccaaagtgctgggattacaagcatgacccaccgcacccggctgagaaaatctgtttcaaaaagtagataacaattaaaatattaatatgttgctttagccgttttacttctaacaatttatcagaaatacaaaagttcataaggatatatagatgatattcactggatgaaaaaaatccccaaaaaactatgaataacttaatagccatcaagatgggacttggtaatacattatcattcattttatggaatgcagtcataaaaatgaatgaaatagtttcatttgtattaacataaaaatctaagacctattaggtaaaaatgtaagtcacagaatacatatatgatgggtccatttatttaaagaacaaattaggagacatgtaaacatatcagaaggggaacagagaagagtcacacttaaattctgactctgtagcccaggctggagtgcaatggtgcaatctcagctcactgcaacctctgctcccgggttcaagtgattctcatgcctcagcctcctgagtagctgggattacagacatgtgccaccatacccagctaatttttgtatttttagtagagacagggttttgccatgttggccaggctggtctcaaattcccgacctcaggagtacctgagataccagctactttttgtttcaaaaagtagataacaattaaaatattaatatgttgctttagcagttttacttctaacaatttatcagaaatatgaaagttcataaggacatatagctggtactaggaaacaatacacttttacaatgtttaaactgcatgaaaaaacactatttctgaatcaagtgtaaaaaaggtttttttttcttttcttttagtgggtaaagtctagttattctgactgcttatcattattactgttgattctggtagtgaaaaaaaacttttgaattccattgagatagtaatgaacacagaattgtaacaatagacagatggaagtaatataaaaacactgttgaatttgaatatttcttgcttttttgctttcacagaaacacattattttacatttactttatataagtgaggtattttatggtgttttctaaattctattaagaacattctaaaaagaaaaggtgactgtgacagacagattaaaatccaatccacaggcagtcccctttggcaaaccactctgattaagtggctctattttatttcaagaatatatatctcttgcccctttaggaaatatgtgaatgttttccaaaagcaagtaaagagtgccacatcttaagcactagaaagcctatgagctttatctgggatctttgctttcataggcttgtgaagaaaatctgaacatgcagacaggcagtcactgtcacatattgaagtttaacagtgactagaggaactataaaagcccaaaactctatattcattctgcagtcatacaaagagcagagggtgaataatttaacttccaaaacaattagtccagtcctttacttcaaattcttcaataatcctccttttcctatagcagtcatcagacatgtacataatacctctgccttttttttttttaccacaacagtgcacactatctgtttgctatttgctgaatattttatttttattttattttatttttgagtcatagtctcactctgttgcccaggctggggtgcagtggcgtgacctcgctcactggagcttctacctcccaggttcaagcaatcctcacgctcagccccctgagtagctgggactacaggtgtgtgccaccatgcccagctaatttgtgtatttttagtagagatgtggttttgccatgttggccaggctgatcttgaactcctggcctcaagtgatccacctgcatggcctccaaaagtgatgggattacaggcatgagacactgcactcggccatgctgaatattttaaagcttaaatacattatttgaaaagagaacagtatcactatcaatacgaaaaataacatattaattcctataaattgaagataataaaatacaaaaaaacagtattttttttaaaattaactaattaatttagagacagggtcttgctctgttgcccaggctgaagtgcagtggcataatcatagcttactgcagccttgaactcctgggctcaagcaatcctctcgccttatcttccccagtagctaggacaacagacacgtgccaccacacctggctaacttttaaatatttttttgagatgaggttttgctatgattcccaggctgatctcgaacacctgggctgaagcgatcctgtcacctcagcctcctgagtggctgaaattacaggctcaagctaccaaacctgggaaaatgtacaatagttttattaaattgtaactagatacaggctgccagtggctctgagccaaagcaaagtgtttaagccatattggcaccaagagactttcttgagattttctggaattgaaaaagaactaaagagggaatacactttctcaattttccccaatactgtattgtgaaaattttcaagtatacagagaagttgaaaaaaattgaacagtgaacacctatatgcccatcatctagatactatcatctggcatttgctgtatttcctttttcagacatcatctttctatccattcctctatggagaaatcaaggctatttaatttaatattgttatttaactacctagagggagttctctcaagaatcaccaggtcccaatccacaattttggaaagactattgtaaaagataacaacatcatttcccaggccttggcccatcccagaaggcttgctactgtatctggcccatggctatctttcttccttatctctagtccctaacacataagtgcaaaactaaactaactctgcttgccataaaatgccattcacaacctggccctaattcacttctttggcctcatggtatgtccatcaggtagcgtttattgagcgcttactctgtgctaggccttgtcctaggaatttcacttgcttatctcataaaacccttaaaacagttctatgaggaaggtcttccttcctattattcccaatttataggtgaccaagtgatagcagtgtcttataactgaacaactcaacacactgtccaatttttgcagtggcctccactcagcccatgtacatttcttctaacacctttcacaattctaaatctgtagttttggctgcttgaatacatttcctacacttccttcatccaaactttactcatctgtttagacctaactcaaatgccacctcctccatgagacatgctcaagtattttaagaattaaataaatgaatcgatatttgcaaggtcaaaatgtacatttgataaactaactgaaatattaggtcttcgttttcgtaagtaagtcttaagacaaccaaaatgagactatttctcacgtacagttgtcagaaaagagtgacaaaacaaaaatcaaccagatgttaaataatcctcaagggaggtacaccaccatgtttaggctaggtacaggcaaattcacattttgttgtcctagcagttatctcttttctggtgtcttgagttcttcagctcaatcatcaatggaaggatattctaccacaatgactattttcatagatacaaattttcatcccctttcttatactttttacttctggtgggggtggggcggcaattatagttggagttaattttaaaagatggtaaatatctcagaatgtctgtaatataattacttttgaaataagggatcactgatttatacagccttaaagtttgaatggactttaaagataatataatctatgatgtagtggtacaagggaagaggggggctggggaagaacctgatgtgtagtgtttgccaatttccatagcccaaccccgtcaatgaaagcatgagtattctgaggaccaggataactgaaagagttgttgaaggtaacagaaaaatgtgtgagcatctgcattagaagccaggttaactgactccatgtaatctattcattgtcaactccctagaatcatctaggaattgtggaaagatactttgccaagcctcacaccagagtaataaaaaaataacttctggtgattaactcctctccagaaatacaaatacaaataaaaaacaaaaactctctatgtgcttctaaaatatctaagttccagaactcccataattcttttccccaattttatgttgcctagtaagaaaatctcatccctttatattaacttggggaatgaataaaacatacattaataaaaagcataagttatcataatatttttaaaggttgtaagtttcaagtattttccatgtgtggccatgaattatgcctattgaaatattttctaaaaatttgggcctgcttttacaaagacgagactggtttgtaattagtgcattgattttatgtgaatgagtgcttttgaggtgcttaatgagccagtaatgattaatacttttaacagactaagaatacttttacttctattagtttctttattaaaccctttctaatatgtagaaaacaggtaagtttcagttagtagctcaagttaccacaaattccttgtcaaatttactaaacaatccacatccagtttagctcttcctcccttcccactcttcctcctttccgcccttccctctcaaatatttattgagcatctagcaagtagattactaaatccaacccaagacactcccctgcatcagagataacatctaataaattcctctaattgtcattctgtgactgaaattgtattcaggaccgcatttctaaattatagttcaattagtagctttgtttacaagtcatgaataccattttaattttgcagatcttggtaacacatataagaatcttctagccattgcactgccttttgaaactgcataatctcgcacgttttaaaggagcctctggtattattttcttttcaatgtaatcatagatgaaggtctaaagtagaccttcccattctctttctgaactcctttaagttctttaattataaccctgaaatgcatctcttttgcgtgcccaacatcttcagcatatttctcttctttaccctgcagctgattagcaaggactacaacactgaatatcaaatattatgatttttgagttatatgagcattttccttttcacaggaataatatgaagaaaattacctcagtacattcagacttcttttttttttatgagtattttcttttaattcttattgatagtctaaaacaaaacaccattaactggatagtttataaacaacagaaatttatttctcacagttctggagtctgaaagatcacaatccaggcaccaacagatttgatgtctggtgagggcctgtttcctggattacaggtggtgccaccttcttgctgtgtcctcacatggcagaaggaatgaaggagctcccttgggcctatttcataaggacactaatcacattcatgagagcccaccctcatgagctaatcaactgctaaaggccccacttcctaatatcatcaccttgagggttaggatttcaacttacgaatggtggggagaggggcacaaacattcagaacacaacaaaattatttagcatgaatatatatatgtattgccttactggttaccaggctacaaatcaggaagtaagaaaacaatcttccaatgcagttattttcaagtagtgggaaactcttgatattccttaatagaggggccacatcaagcctttggctcccaagaaggcaatgcctcttgaaaactactgtgttcactggtcacatgtgtatcagttacaaatgtgaccatccagttgaaacataattctagctgtgtatgccagaaatatatctagatataaccagaatgccacgatgtacttgggcaaacccccaaggttgtcgttgtcgtgcattttgtgtgtgtgtatgtgtgtgcaaatggcttaaatattccattactgcctattgttcttacataaaacttttcaagaaaattagaagttaataggctgactgatgacagccttatatcaatataaattgcttaaaatattcttaggcctaagtggatgtaaatttttatgttcattcccaatgttggataagaagttgacagagctgcacaaaaattgcaaaagaaacattctaaatcatgagctctttaagtacagggacgagggacgacatcttacccatttatatatctccaggatttggaacagtagctggtatatagagtaattgttgaataaataatatgaaaaattggtttgagatccaggaacagagtaaaggatagggttgtggtcgcactggtggttacaaggcaatacttttttacctttcaaactaagaaaaacatcaaatatataaaaaaaaaatagaaggtgaaataattatacagcctacccatgtatcctctacctacctttagtagtatttaacgatttgccatatttgctttctccctctcttcctctctatatctatctctatagagatatatgtagctatacatatatagatagatggatagttgttgaagcatttcatactgagtggcctacatcatgacacttcactcccaaatgcatctcctaaaaataggaacattgtcctaatcacactacaacatgtaagaaaatgggccgggcgtggtggctcatgcctgtaatcccaacactttgggaggccaaggcgggtggatcacaaggtcaggagatcgagaccatcctggctaacaaagtgaaaccccatctctactaaaaatacaaaaaattagccgggcatggtagtgggcacctatagtcgcagctacttgagagactgaggcaggagaatggcgtgaacctgggaggtggagcttgtagtgagcagagatggcgccactgcactccagcctgggcgacagagtgagactccgtctcaaaaaaaaaaaaaaaaaaaagaaaatgaacaattcccctattgtcatctaatatgcagcctgcagtgaaatattcccagttatcccaagaatgttttatagacacacatacccaaagcagtatccattcaaagttcacacattgcatgtagttcttagggtctatttcacatattcagtgttttagatttacttatttcaagttttctatttctatatatattttagtccatttgtccctgaattgtagcaagtattttcaaatccataacttgaaactgagctttgtggattaaggcaaaaaggacattgtagatgcctctggcccatcctcctcacactttgagtaagtgagggtcttctggtccatcctcctgcacatcaggcgttatttcactcttgacatacacttgtgatgtggggcataaatcaccataagcatctttcatgtttgcctaaccaactcagtttaaatcccatgactaaaaagggagcctactttccagaatcagactggaggaaaagaggagattttaaatttcttcctgctcctaaaaatggaatgcttgaaagtgatatatactggcaatgtaaaatagttttgatggggagagaatgcagaaattaactttctaacttaaacaatttcaattttgtaattctcaatgttagcacaaacactataatcaaaattcactgtactgtgctctaggtactgggtggaggaaaaaaaaaacactgatgggacaaagatcttcttagggaatatggcagagaaagtgaaaaagcatgaggaataaagattttcaaatatgggtatctgaaagggtaggcctttccattttgttctactacccagtgtttcaatcccggcaagaacaccacaatattccaggtctttacctccatcaccctgccctaaggatatgtggggtaaggggcactgttgtgcccaaggctcttcaaatttaacgtattattaccactgttattatatttaattctaccactggaagtagtaagacctcaatcaggggtgattcactcccatgatattgatcagtataaggcagagactattgggataccaagtgttaattcttctttcattagtggcagtatctcaacagaatgtcaattttataatatttttcagcatccctttcaacctggaatcatgtgattgctgtctgggtagtgaggtgggacttccgggattcagcctggccttcctcctcccttgatacatgaatatcttaaattatactgcataggactctcttcctttattaccaatcaaataaaaaattaattgggtcaaaaatatatggcccattatatgcaagggctataacataggcaggtcttagggaatatcagcaaagcgaaaggaaaaaataggtccctctatggagaaaatcaatgctcctcaaatgtaactgaaaaacatgtttgtctattcaatcccggtataagccctcattggaagatttactggaacacactgaattgaatatagatagtaaaggaagatgtagctgataataggaacagagttgccctgtgatccatggtatgtgagggcatagggaaaaacacattcaactcaaacaagggtatggtaatttcaggcttcattagaaacacagcgaggtgaaatcaattgtaagccagacaggaaagaatcaaaatcagttagaaaagaaattttaatttcaagcttctaaggagaaactataaataatgcaaggtttaaaacatattagcaaaaatacatcacggtatctctctcaagcaaaacagctaaacttgaaactttcttgaggatattcagctctgaatatttaaaagcaaatgcacatatttgccagagagaaaaacatgtttagggggaaaatattaaaatgaagtctgggatgatacacaccaaaatatgaatgtggacataaacaactccaggttattttccttttcttctttatacctttatgtagtttttgaaaattttaaattatgaatgcataatttttgtaattagacagataaagagctttagcaaaaagaaaaacattcaagtcatcatataataacattgtatgaacattagacatggaaggctcatcacaagcaaaccccaaatatcctccataagacaatctaatgacttgctcttaatgaaagaatggtccttcctctctccaatctccatttttgggtgctgctaatggttaagacctgtgcctctgagtttgtagactctagtatggttctccagatcttcagcattaaatgtatccggaaacaggtaagcaatcagttcaaaagaaaagaacagattttcaatttccttctcctaaaaatgtcatgctctaaagtgatacatggaaatgtaaaacaattttggtgggaaacatgtgcagaaattaactttataacttgaataatatcaattttatgattctcaatgttacaattattagaagtacagaatctctgtccctaactcagacctgcttgaattggggaattggggaacttattggggaattactgattaaaggaatttattctaccctcctacttacagaagatgcccgaggaaaactgtggatagtggtgttatttaaactaagagatacagaaataaaattatttcattttttaaaactatataaattgttttccatctatatctacttataacaacaaaagaacaaaagcagcttttttttttttttttttttttttttagctgtttttactcctaaaacagctaccactactattactactatactgcaagagagcaataacatttatgggacctttaccatgcatgagacacagtggtacatgcttgggatagtccattacaatggtgttctataatgaaccttgtcaacgtttataaatgcccttgcatagtcccttccctttggatcctggctgagtctgtgacttgctttagtcctgaaaatgtggcagcagagatgctgaaccagtttcaggccaatgccttgagaaggcttgggagtctctgcctttgccctctcagatgcttaagggccacatagggaggctggttactttgctgaaggggccctttggagatatcacatggagacagaggggccttcaacaactggggatgagggaagaggcccgccttcccagaacctgccagctgaatgcagtcacacgaatgaacactgacaagaacagtggaagaatggcctacctaaccccaggccagattgctaaatcataagaaaatggttctatcaagttttggggtggtttgctatgcagaaataataaccaaaacagtgctttatagacatttgactcattttaatctcacaacaaccctaagaaataggcactaataatatcatccttctacagaagcatttatccaatttgaataacgcctcctataataagtcgagggggtagggctttactgcatgagaacaattctgtatattatcaaacacacagcagttccatttctcatctgagggtggggcatttcctattactgactgtgtctcatcatctctaaagtaaagagagtcaataactcactgaacgtctaagattcttttcagctctgaaattccatgactctaaatgagtagccggtgcttattgtttatacagtggttttcaacacatcacatcacacacactagcaaaggtcggaggggaaaaaagcaccttgagaacatcccatcccaactgcccaggccatctgagtaacaggaaccaccccaccagtcaggaagagacggctgaatgcatattaaaacactccaagtatgctgcccttctggaatatcgttaaacaactcagtctgtcatatggtcctttgagtttttcaattaaaaaagaaatggcaaatgtaaatattaccatctctttttcagtctgctaatttgtgttcaggaaagtcttccaacaagaaaaacacatggttaatcacctttgagacccaatataacaaagtagcctggaaagagaaaaggggcttttttatgatttaaattgttatgtggtcaatcaaatctaatctattctaattcattcacatggaaggtcaattatccaaatgctcttaattcaacctgcctctgatcttggtgaccagtgaaccattcaaagggcagctgttttgtgtgtgtgtgttttaatatgaattcgttatcacagttttacgttttcctcattctcaactatttaagctaacgtggcctgcttgacgaagcacatttaagtagagggaaacacacttagttctctttgtattctgaaataacaacattctctatgacctttctggagtcaatgtacacagaaaacccacaagattcatgctatcaccaactgttggaaggaaaacaccaggcaggcagcaaatctacttcccaggccaattaccccattccctaaaactattccatcttcaaaacaagcctaaaatgcatgtcaagaaaaacatccatgtgtctttctttactctttttatgaaggcttttgcttggtgatttgctcaagggtcaagtttaaatttgggtcagtttgtttatttgtgatataatgaaaaagaaatttaccagggaagaacagaactattggaagtactccatggtaaatgagagaaagtatgccaaagctcttcgcaccaagactaaataaattagttgagaattgtatttggatgctaggaacaaagaaataaatataaggacttaaacatacaaggatttattctcttacataaaggaacactggtggtagataggcctgggatggtaggatgctaccaggagtccatcaggaactcagatgcctttggtttgtctcctctaccatgcaatggtaccgttctaaggttatttctcagtctaagagggctgctggagcccctgccattgtaaagtcattccaagcaacagtgaggagcagggaaaagggctcccttcccagctgcttcagcttcttaaacacagccttgccagaggtcccacattacacttttgtttacatatcactggccagaaagcagtgacgtgattccacccagctgaaagggaggtggaacaatatcatagaattgacattttgttgagattctactattaaggaagaaaaaaaaattgatattggatatctcagtaggccctgccttataccaattaatttcttggtagtaaatcactactgattgaagtcttattatttccagtagtagaagtgtagctaagaataataacagtggtaataacaccttaaatctgaaaaacttctatgtaaaagttacaatctggttcacacaataatcacatgatagtacaataaaagtgacaataataatgatagcagaaattaacagcagtatctgtcatttattaaacaccaaattctgtgctgagtgctataataccttattctcatcaatcttcacatcaactttgtgaggttttcattaactccattttatgaagacatggacttcagagatgggaagtgacttttctaaggtcatacacttcaggagggaaacagaactgcaattccatcaaagccctcttgatcacactggtgttaatcattcccctgatgaggtcattaatatcacattttacagctgaggaaactgaggtccaaattatcggagtgctttaattcactgtaatattgaatcaatggtaggacttttattataaaaatcctaacagggccagaaaaggacttaggaaatctagcttctcatcctcgctctatactttaatactgattttgatctgatagtaaaaacaatacaggcccactgggaaggaaaaattaaaactatacagtaaagaagagagtaaaaaatcattcccaacactaccagttggagaaaatataggcaatgcaaacattctagtgagcattctctggggtttatctgataagatataaagaaggggaggggaagtggagagacagaggttccataatttgtctaacgtctctgcactacagagccagcactcaggttcactgcccaagtgcccagtgtactctctgacccaagacattcatgagtcgtacctttcctgctgaaagacattccaattacatgcaggatttaaaactctatgacaagggactgctctttctttttatgagtttttaagaaaatgccttttaaaatttctcttccaagctctgagataaagaaaactgaaatacgaccattaacaatttacccacagcatgcatgagtttaacgctccaaacgatactcagggttctcaacattaacagtgcattgaagccaactcatttctcattttctgttgccaactccataaatctgcttgaagtcttgaaagtatagattatatatttaagtgattcttgtattctggcaagtaaaaacataaaatgtaattcgaattccatataacggtattggaagaagcacaaagatggcattctgagggggaaggggtttgtgcatttaatattttcggaatcatatattatgtatcaggtactgggaaaacagagatcaatcagaaaaggaggaccttccatctagtactagtactagtactagaattttcatctagtatctaggggtccccaacctggaaactagtgtcattttaggctggaaaatgccttgttatggtgagctgtttgtgtgctgttgaacagcatccctgacctcttcctgccagatgctagtagcatacccactccaaaatgacaataataaatgtctctagacattgccaaatgtcccctgggaggtagcatggcccccagctgagaacagctgatctggtccatcccgccccagttcacagaacctgggaagatttccaaggagaaagggataacaggcaggcaaagtgaggagggagaggaagaacattctgggagaagggtctctggaacagatggtagagatcatgccagcaaggggaggtaaggtcatgcggggccggatgatacaagcttctgaatctctgactcagaaattcagaatttagtttgcaggaaatggggattgtggtattattttacatatatatatgtatgtttttgtccacagttcctagctcataactcccacagctcctgttacagccttttgttataatgttggggcactttaggtctcagaagcaaacctcaaaaaacaatctctctctctctctctctgaaattctcctgccttcctttcacctgctcctttttcttcccacagcaggctttagaaactaaaaatatactctaatctccccccacttttctgattatgggtcattagaccctcatttccgaaggggtcctgtgtcatacctcagaagaaggaatgctgcacagagaggccaagaagcatctgtatagacaggcctttctgggtgttcccactcagtctactagcattagatcataccctttttgtctagtcacatttcaaaatggctgtcaatcatgcccatccaatggactctccataaaaggtccaagaggatggcgttcaggagcttctggacggctgaatgcatggaggtttctgtagggcggcatgcccaggaacgggctagaggctctgagccccttcccataccacaccctattcatttctttatctgtatcttctgtaacatcctttataataaaccagtaagcataagttagtatttacctgagttttgtgtgccaccccagcaaatgaattgaacccaaggaagaggtcatgggaaacccaatttatagccggttggtgagaaacacaggtaaaacaacctggagcttgcaatcagcatcggaagtgaggcgtggttttgtgggactgagccctcaacctgtgggatctgagattatctccaggtggagtgtcagaactgaatttagatagaggatgcccagctagtgtctgctgcagaattgattgcttgcttactggtggggaaaaccccccacacatttgatcacagaagtcttctgtgttgactattgtggtgtgaaaatagagaaaatacagtttgtgttcttccattcagggatcaagtttgtgggcagaaactgcagtaaaatgcacaaaaagcaagtcctatgagttgagtgtgaccgtgtgctgctgccatttgattgctttaattaaagaaaaataggggatgaagtaattacaggccctctctgagactgtcttcttaacaaggtggctgaatgtcattgaaaattttctggattttaaaacagaaatacactgacacagagaaaatattctgcacattgcctgacacacagagtaccctcaccaatgttaattccttattattaccattcttgttgctggctgtcttaaagcagggtggggcactgatggctgatgtcagcatttctcagtatggcccaaggaaccctggtgccttggaagtgttaataatatctgtacatacatacagatgtgcagacacagagaatcattttctttcagaaatttatcttttaaaaaggaaactatgacaaaggatgtagaataacagaaacatttatctttatatattttgttataaatgcttacctaatttatactttcttaataaataaggagaagagtatctaaataaaatgttttcttgaattaatttgtttatggggccatgcttttcctgttctctctcaagagttcctgttggtaccccacttatatttaatttagatactgttagcctggaaaatattgccctaatccagttgactggggttgtatggaaaaggccctggctttggtaaccagagattatgccagggccgggggccgtcttgaaataaagagaaagaaagtgtcatcctgtgaaaaggtcaaggaggaagccatctcaacagctgtttgcaaacctcacttcaaggcaaccaactgacagagggagaaataatctcaaggaggtatgaaaacagcagcagggctagggaaacacatctgtgaatgcccagataattgagcatcattgtttaggagttggagggccatctctttctgtgcatttgaagcaattttctcttgtgacatactatgttttgtgttcccgaacatttaacctctggatttggacagcagagacctggcccaagcccattccttttaggagtcctcaaatggttactgaaagtgacggttttctaattattctgtcaagcatcaatctcagaagttcccagttcctccatgctctgactgacagggcaatcagcactttacttaaagtataagcaccaacctcttctggacagcaagagcacctcacatgcccaaaaacagaaaaattcacagctctaagaaagtaagaagccctcatgggtgtgcaattttacaagcgtgtgtatgcatccttcctgggaatagcgctttttgatctggcatttctttcaaatgggacatccccaattccaaatttcaaccatcatggctatgattttacatactcactgtgctgctgaaaactcaatcaaaatgcacagcaaaaagccagtctcaaagatctccctcaatcaaggcagaccagagtggtcagaaaagaagcagatgtctacactccttcaactccaagtcaaaacttataattccactttcttacatgctactcttctgagagaaaaatgtgggcaaaaggaagcataggaactgtcacaacgagaaaatattcttattaatcacatttaggcaaattccatttatttgtttttctctaaaagtgacctccatatattaacagatgccctactttactttgtcttttagaaatcagttgcttgtaatctctgagacaatatatagaagtagaaatgagattggtggatcagtcttcaactggtttgaaggtgatggtaaaagtctatgaaagctgccagcatggtgctaaaactcaaagagggcatggcatagtgacatgggttatatgatgagtgagagctgccaggacgaatcggaagaggggcttgacaatcgattgcctgaaatacattacagggcaaaagaaagcagggcacctgtggttatgtccctgatataagaagatagccactgtatcttcaagatcccagaggcatggagaaaaagtaggtaattcaaatggaggcaatttggagacacctagactaataccattagtctccaactagtctctgttttctcttccttttccacaatgcgtactcctatctttgtctaagatttcattgttctggtgcttaaagcctttcagaggcttacaattttatccagaatgaattcaaacttcctgatttggcctgcaagtcctttcagagctgggcccagcttcactctcagcgcctcctcagtccttctcgctcactctgctctgaaacactcagagctctctcctgcctttgcttttccgctgctcttttcactttgccccaaatcaacaaggttcactcatttacatcattcgggtctccactcaaatgtcacctcctcagagaatccctctctggccaccccatctacagcaattgctgtctcactgctaaggtcctgagaatgcacctcacactctgaactgcaggcagcatgactggctgcactgggggcaaggctatgcttcccctgggctgctcccagccgagtaggggcatccaatcttccttccctctctccttcactcagagtcagacctgcatcatagtctgatggccaggccagcctctcctggctgctttctcattttctttcaaagggatttctgctgataaaatccttgcacatttaatcttgtcttgatggcatctgggaccctagcatatttattatcatcctgttttactatcttcttagtaccacagaaaattatctagtgtggcacccagcaatcagcattttccatgcccttcaggcagttctgggacatgctcaagtttgagaaacaatgacctattattatatggttaattatagtcagagcaagaatcaggacccagctgtaagaattcccattcatttctcaccaagcagtactcttttaatgacacacacagcccttacgttgtatctgcttaaataccctgctttaaaaaattggccaggcatggtggctcactcctgtaatctcagcactttgggaggctgaggcaggtggatcacctgaggtcaggagttcgagaccagcctggccaacatggtgaaactccgtctctatcgaaaatacaaaagttagccaggcatggtggcatatgcctgtaatccctgctactcaggaggctgaggcaagataattgcttgaacctgggaggtagaggttgcagtgagctgagatagtgccattgcactccagcctaggtgagagtgagactttgtctcaaaaaaaagaatttatgctggtcatatttttacatccatttaaaaagatggatttaataaaatgggcattaacatactaggtaaactgaaggaatttgtagaacactggtttgatcaaggctgactgcctccatctatctaactggctttgtagctttttaggcagtaaaaataaacttagtgtatcccctgtcttgtgagggaagcttaatctgatgttgtgctattactaacatggaaaagcagtcatgctatcaagatggcatccggcaagatgagatgacactgaagtttgtcgctatcgatttttatatggcaaaacctgggtcttgttctcccttttctccctttcgatcaagtactctcatctccaggaggaaatgctactgttttggtagacagtggctgcccagccacagtgcaagcaagtgtgataacgacaaaatggattgattactatcaggaaacgtatggacagtaaggtatgaaatattaccagctgaacaaccaagatacaaagatataacatgctttactgcttacaaagggaggcagccattaggaagtttgctttctcacataaatccttgactatctttccctggaggggaaaagtatattacatctagtccaatagaacatttagatacaagtcaggattctgacaagtaggaatatttaatttgttttgaattaagaattgagaatcggaacttccactatgatatgaatacagaaaccaagaccttccttactaattaatgacctctggcctataaagtcttcaggagaatttctaaatgttctctacaactttgtgttttctcttacctcttgagattgataatataaacacacctagatacacaataactatcctccgaaatcttttactatactagctacaatctctcatacatcaaaacagcagctctagtatatttttctcacctgaaatattgaggaataggaagttattcagtttctcacaattttcttaagctcaaagggtttggtcaaagcacacgtcatacctgcttaatctctagagagaacaactttgacaggtgaagcgagaaaaaagctgctccactgccttcacgtggaaaaaagatgaaatgtaaaggcctgcaatgacagacttttcaaatagggttttagtaaaagaatgatgtctttggaaacttaaactgcaattttaccttgaacaagtataggataggatatcctttaaagagattatttgaaaactataaaatatttattcattcaacaaatatctaataaatgactaccagatcagtataacaccataaccaagagttaatggaaatgaataataattaaatatgtaatatggtaggagacgtatatgttttatcctgtcatttaatactcatagcaaccctgctgagttgtttctattaatatacccatttcacaggcaggaaaaaaaaaatgagacttagaggagttaactcacttgggaaagtcacagatgtaagaggaaacagagcgggaattccaatcaaggcttactcatgtttttaactacatggtctaacaccaaactaagcaccctgaataatataatgcatgctgtcgagaaatgctattgtgaaaatgaataggagagaaaagagccataatacagatgcccaaatgagtgctacaagaggggcaaaagtgtgaaataaaagcaggccgggtggtgtcaaattctgtatgatgtgtgggttgaggaggtagagcagggagtctggcctctgaggaggcaaaaaaatcgaactcactcaaacttgttttctgagcgaatcttcaatttgtctaagacttttccctggagttaggaatttgccaaaaaattatcagcacctattaggtgccaatatagtatagacatggaccctgtcttcatgaagggcacagtctagcagaaaaagtagggcagctttcaaagatggtcctgtaatattttctgcttcacactcttctgcagtgcaactttgccattctcacattaagagatggggtctgtttctctaatccatccagctccttgaacctgggcaggacctgtaactgctctaacagaagatggcagaaatggcacactgtcagtcctggcctggaagtttccatttcctgcctcttgggagccattcactatatatgatcactctgagaccaccatgctatgaaaaggccaaactacacagagagatcagatggaatgtgaagagaaagaaaaagagatgggccaaggagcaatgagatgccaggcatatgaggaagccatcttgtgtgtccagcccaattgagtcatcacacggctcgggctccatccaccaatgactgcagctgcatagcagactccaagcaggggccactcagattagtcatgtgaacccactgaagcatgagaggtagtgataaactgctgtttttaagccactaagcttcggggtggtttattaaggaagcaatggataacggaaacagagctgaatacaaaattacctgtatgactacataatcaaacaagaaagagtataatttgagaaatcctaacgaggaacatgcccctgccttcaatcaggtgtaaggagtgcgtacaaggctctctgcataattacattcagctaagacctgaagagtaagctgaagaaagaaaaacatgagaagggaaagtctggagcagaaagaacagctcagtcgaagtcttgaagatggagatgccctcatacattctaggaagggagaaaagattagtaaccaaattaaagcagatgtataaaatgggcatgaggtaggctggcgagttgggcatgggctagctcatacagagttataagctgtggtaagcattttgagctgtatcccaaaagcagcgggagctaaacaaagggatggaagaaagatttgtggccactgtgactgtcatgagagattcaggagaaatcagtggggaacctaactggacataagttcttaaagatcaaggagaggataccctgaagggaaactcaacctttaccctaggcctcacatgactaggaagttcttagctatactttattttaaaataattttttttggctgggtgcggtggctcacgcctgtaattatagcactttgggaggctgaggcaggtggatcacgaggtcaggagttcgagaccagcctggccaacatggtgaaaccccgtctctactaaaaaatacaaaaattagctgggtgtggtggcatgtgcctgtagtcccaggtactcgggaggctgaggtgggaaaatcacttgaacccaggaggcggaggttgcagtgagacgagactgtaccactgcactccagcctgggtgacagaatgagactccgtctcaaactaataataataattttttaaaaaagattatggcccgggcacggtggctcacgcctataatcccagcactttgggaggctgaggcagccctatcacctgaggtcaggagttcgagaccagcctgaccaacatggtgaaaccccatctctactaaagatacataattagctgggtgtggtggtgcatgcctgtaatcccagctactcaggaggctgaggcaggggaatcacttgaacccaggaggtggaggttgcaaagtgccaagatcacgccattgcactccagcatgggcaacaagagtgaaactccatatcaaaaaaaaaaaaaaaaaaatgttgtccaaggaattaactttctcaattcaaactttacatctcatacaatgagtttaattgtatggtctatacataaatctgatctaattcagggaatagaatgtaactaactttaataaactaaaaaaaatgtaaaaaagaatgacacagttcaaatgagaaacttaaatcaacttttcacatttcatgtggtattctcaggcccaagttagccaaaaatgtgcacataatgagcttcttatacttcagcctctgctttattcctctgcttatttctctcgtatacttcagactgctgagtctgtaactgcattttcttatttacatgcttttctctacaatgatgcaatggtttgaatgtctcctcccaaactcatgtttaaatttaattgccattgtaacagtgttaagaggcagaacctttaaaaagtgattaggtcatgagggcatagccatcctcaaatggatgaatgtctttattgcaaaagttggttagctggagtgggctcctgataaaaagataagttcagcccccattttctctctgtctcatacactctcttgccttttcactttctgccatgggataatgtaacaagtaggccctaaccagatggttgagcaggtgctagcatcatgctcctggacctcccagcctctagaactgtaagccacataagtctcttttctttataaactacacagtctgtgctattttgttatagccgcagaaaatgagttaagataaatgcctcagagttctcagttgccaccacttagatagaaagatacccactgccatcctttctatccttgccctacaaaccaaacaggtgaaatgggggagctgctgctttttaagcacagctgttacagacctgaaataccccgttcttctgttatgcctgttaactgggagggtgatgggttacgcaaaaagggacactagagcaagaacccacaggagcactgcaaagagaaaaacttggagaagatagaaaatattgctaacactgttgggatcagagtggtgttcatttcaattttgtttccttttgtgtatcctctagataagaaagagttattggagaaatgattatttaaatcacattactggtgaattgagatggtattcaaatggcatttggccagagaaccctgggaagtctgaaggcttcagccgtgattatgaggctgccacacaagggtgatgagggaaataaatgtacaagcaaagtgaggctaggcaatatgacctctattatcagctgaggtgagagcatccaaatctttgtaagacagaataactgggttgagggcttctttacccagttaagttaatgacattaggacatcacacttgccttttcaacttccatgacccaactgcagcccctctaaattcaagctccttaacttaccactctattgaaaccagaaaacttcattcttctacagttacagggaaagtagccagagagaaagacagagaactctccagaaacggctaaaactggtctggtctaggctgacctagccttctctgggggagaatacaaaaaggtgtgggagagaaatgatgatgatgaagaagaagaaggcggcaaattaatttggccagttttaggggagaaccttggtctgtgttacccctcagccaggtcctgagggtagcagagaacggacaacatggctgggctctggatctcttaaccaaacccagcagctccactcaccaaggccaactaaatatgctttcatggagcaaaccacatccataactctcctcatccttgtagtagtttcgtgagaggtgagaaaacaagtagacacaaagaactgtttcctccagaggccacaatgtgattaaagaaaacatattagatatatgcatacaccttcctatgtttagagtccttaatgaccttgttttaagacaattattttcataaaattactaaaaataatttgatgttacattataaatggataaaatcactgaaaaaaaaatcaaatctagtttcatcttgatttcctactttgtccatccatgaagacatataaaatgagtccaataggaacaagcaaacaacttctttcttggactctaatttgaggcattgttaacacagtgatgttcatttattctatacatggaaaaggtgatgtctaaaaaattcacatgtccatattttactactgacttgtacattaaaaaatatttttttaaaaaacaagaccatgtttcctttcatgctggatgtgaatgaagtctgtagcaaccacaaagtgtcatgtgttagatctagattaggaatctggtaatcatagacatattacatgatatactggattttactctataatttttacattttatcacaatggctgttttctgggttatcttataatgaaatattcttgatgaaaataatttatttttacccaactgtcactattacacttagatttatttactttaattatatgcagaccctctgaagccatctgttaatgtctaaatatctattatacttgttaataggtttttatttaatatttgggatcatttagcaaaatgcattgttcagcagatgacagaagccaatcaatcttaattaactaaatggtcaccagaggactattttagggaaggatagcaaaaaataaaattcttccaacttgtaggtgtagggttaaaaaaacaaacattcaatgtagtcccatgtctccaaggcgggctggagtggggataatgatatacttcaaattccatttataaatgtatactactaaacgtatctaagatgatggtgacagcaaaaagacaggaaggcagctaagtatcttaaacatggggaaatgactaaaagtataagggtgtaatcatataatggaaaataaaatggccactaaaaatcttgtttcagaaaaatatttaatgatgtcataaaatgacttcagtatgttattaagtggaaaaaacagtatgatctagactttaatttttaaaaatatgcatttatacagaaatgaaaagaaaatactggaagtagataagtcaaattttaatagttgttatttctgagctaaggaattatggatgactttatttttatttattttttttgagacagggtcttactccagttgcccaggctggagtacactggtgtgatctcagcccactacagccttgacctcccggactaaggtgtttctcccacctagcttgatgactttatttgtgtacttttctgtattccaaatcctttgtaatgactattgtaaaggattacattatggagctcaattatttaggaaataaatccctcagacacttaattctgaaatttgtgattttttttttaaaagcaccagtgatgaagaatagaaattaacttagaattccaaaaagaatgagtattaaaaggtgtgttttagagactgttaaaaataaaaatcccttctgtaccaacctcccaggcaatcattaagagtcttttgactacacgatacaacacacattaagagtggatattgcacacttcattttagagggagttttatttgaattttgacccaacttcattttaaaatgatattttgtttggaaaagacttaaggctgttttctacagataacttccgagtagcagtaccaccagtctttaacttcccaaaacttgccaagtgcagcgataaaggtataaactgtgtttaattaaaaccacttgctttaagtaaatggagtaagagtttatcattcacatcacctcccaacttctcttatcatgccagctcagctcttctctgaaggaggctactgctgttatccttagtgatggaaaacgggtacaaggtcaacatcatcttcttgtggtcactgagtttaaagaatacactaacaggtcaggcatggtggctcacgactgtaatcccagcactttgggaggccaaggcaggatgatcacgaggtcaggagatcaagaccatccttgctaacacggtgaaacccgtctttactaaaaatacaaaaacaaaattatccgggcatggtggcaggcgcctgtagtcccagatactcaggaggctgaggcaggagaatggcgtgaacctgggaggtggagcttgcagtgagccgagattgcgccactgcactccagactgggtgacagagggagactccatctcaaaaaaaaaagaaagaaagaaagaaaaagaatacactaacagactaacattttctagagcttaatttctatatattgaagagatgaatattactgtgataaaatgccgcaaaataatgcccccaaatgaagcttatttgctactttttcgccggtctcattctatagatttctgtggctataccaagtagctgacagagatgagacaagacgtgatttgattggtgactataaatgacttggccccctttcagaagaatatgccaagtcttcctatatttgctcaaatttaacttgcattatgatattgctttctttcacatttagaagggctcatgtaattctaaaatactgttacatataaagttttaaaatagttttttaagaagcttcactttaaatttaaacacacactttactggctgaatgcaaccttcctttaatttatctttactgaattttgtcctggttatttgcagttttaaaaaatgcccatacacatgtccagggcattcacaattcttacaagtcttttaaactccagagatttctcttagggaagccctattcccagctttccacaggcgtatgggttgtgccttcatctctttctagctctggagatagtggtccctacaacaccaacataagtaggctctactttcccaaccctcagaattgctcactcatgatgccaacaaggtgtgagtgtccagctccaacccttatttcctttcctggtctaaaaaaaaaaaaagagaggaaaaatcatgcttcccagaaatgaataaaaatgcaagcattgtagtcttaatgtcatatcttttgtattagtgtcacataagtgaatggcataagtgatcaacaaaatattaccctacatacaactcagagttcccaaatcatgagttggcaactcctgacactgtaggagaatgtagttaagtcaactgcctattagcaaaacagaaagaatgaaaacgatattaaaccctacctaactgaaacaagacattaagggctcaccaaagaaaatgtttttcatttgtaagaaaactgagtgatttctcttcattgcaaaaatggcaaggaaactttgagtttctactccacctaagaaaagctgtgctggttggaagttctgattaaaggcgaatctgtcacaattctgagagcacatccccaaagaggcaggcactcaaggggacagcctctaagggacatgcagaaattaaacatttccaaagagatcctgtaacttgccagcccaatgaaatgtcctattataagttttcaatcaaaagacatgtcttgtggtccaaacctttaaatcaaatgatttgctgagcatgaagcattcaggtgctatcacccactatgacataccgactttacataggcattttcttttatgtgttcacctcgcttccgctgccccataattgattttccttcccctccttttttttttttgagagcgagatggagttttgctacactgcccaggcttgtctcaaactcctggtctcaaatgatcctcccacctcggcctcccaaagtgctgggattacagtcatcagccaccatgcccaacaaaaatgtttcccttttgcaagtgtgtacagttataaacctgaaatactgcctggaaggataacatcattgaagtatgatatagaaaggccaatttaaaaccacagaatttgagtattccttccctttccttctccctctctctctctctctctctctctcacaagctaattttgcctatcaatttaataaaatttcaatgggattcaatttatgtgtaactaatttataaacacaatgttaacctttaatgttttatatgttgattctgagaaaccaagagtcaggtgcacattcatgttatacagctgtccctaatccccaagccatggaccagtactggtccatggcctgttaggaactgggccgcacagcaggaggtgagcagtgggcaagcaaacgaagcttcatctgtatgtacagctgctccccatggctcgcattaccacctgaattctgcctcctgtccgatcagtggcgggattagattcccatgagcatgatccctattgtgaactgtgcatgtgagggatcaaggttgtgcgctccttatgagaatctaatgcctgatgatctgtcattctctcccatcactaccagatgggacgatctagtaggaaaacaagctcaaagtgcccactgattctacattatggtgagctgtataattatttcattacatattacaattaataataacagaaacaaagtgcacaataaatgtaatgcacttgaatcatccccaaatcaccacctcttcccccgcaaccctgcacccttggaccctcactcagtagaaaaactgtcttccatgaaaccagtccctggtaccaaaatggttgggaactaataatgtaagataagaactggatttgtctcataatattctcctaacaatgtagctaccaggctaggcaattcattaattccaaaaacttcaggtggcatgagttaataattccagagactgcagcagtggaagataacaggaaaaaatggaaactggtggatattttaaatcaatggcgtctacatgattccatacttagcaaaaccagggatagctgattccaactctgattctggtcttgtggagacgccatgaaaattttcttgtgataaccttgaggaggtctctggagccagaataaccgttatctattaccccctgaacaactgtcatgattcttgaatctacaaatatatgtaaattctgcttgtatctatctgtacctgcctcccatatgctcagggttatcaccctctgtatcactccttctcaaagtggccgcactgtggcatcacctgaacagcttcaaaagtcccgatgcctcactacctcccccatcccaagaagttgatttaattgctctggagtaaggtctgggtatgtggagtgctgaaaactcccctcagatgcttctaatgtgtacaagctccaccatttggctgacttttttttcccctaaaggcaaactctagatcttagtcatctcctgattctcagtgtcctcttcacagtacttctcacaatcagtctgtaattagaaaactggtgagaggctgggtgtggttgctcatgcctgtaatcccagcactttgggaggccgaggcaggcagataactggaggtcaggagttcaaggccagggtggccaacatggcaaaaccccgtctctattaaaaatacaaaaattagctggccatggtggcaggtgcctgtaatcccagctacttgggaggctgaggcaggagaatcacttgaacccgagaggcagaggttgcagtgatctgagatcaagccactgcactccagcctgggtgacagagcaagactctgtctcaaaaaagaaagaaaactagtggaggttttactaagtctgtctgacccacgacactgtatgctccatacaattaggaattatctctcttttgttcaccacatccccattcctcaaagagcagcagaaatatggtacagaatgaatacttattttgtggaataaaagaaattaactgatctacagtgaaaaaataaaaataaaaataacagcagctagcacttacacagacactgtttgccagaaactgttttaacagctttacaaatattaacacatctattaatcacaacaaacctacgataggtactattatcatgtctactttatagatgaagaaactaaggcacacatagattaagttgcccaaggccaagcagttagtggcagagccaccaggattcaaacttaggcaacctggctctagaatcccttctcttatcagctagctcaacaatgcctggccggtgggagaggccacttaaccgccccttccatataaatgaccacaatacccatagccctgaagacggccaccacggccacaattttatggaatgacaacaaagtaccagacactgctgagcacttcacgtgttatttcctctaataatggattaactgcatcgtacagaccaaacaagcgaggtgaagagattctgatcaacttgcccaaggtcaaaaagccagaaactggctgagaaggaactgaacagacctctgtctgtcattgaagtgcaagctctcaatcaacatatataatgaccctttcggttggataattgaatattaaacaaacaaatgaaaaatcctaaaaatggaaaactaatatgcatgacaagaatacccttcaacaattccttgatccctggttgttttcactgttctctccgtactttcattaacatgttatgtagtatcatacgtcaaagttgcatcacatacacatttaatttatgtaaatccaactattcaggcacagagacagaacaagtaagtgagtgggaaagaaccaaaattaacgaataaaatctagtgggaggttgcaactgctattccattcaaagtacacgagttcctgagacagaaggaagagaatgagctctacataccctcatcgggtcagcgtctcaccatactactgggactcttgtgcttaaaggcactaaaatgtatgggtcacttaaagaattttcaaagttaatgatgatagtaaatatgttgtgccttaagaactgtctttagaccttcaccctcatatagggtgtaacaccactgtgcagtggctacacagagctagagatgcccaggatctacaaatgggaattaaaagtagctcaagtcatgtcttctctggcccactctctaagacagacatgaacatccaataacatgatataacctcagaggtggaagaaacagcaatgaagtctcatcttgatagtgaacgtatgaaataaaagaaaagcattcaaatctcaattcccaaatggtagttgacataaagactatttatccaatatctagaaaaagtcacatgctgattctctgaccacagagtaatctgtaaaaggagcttgtacaaagagccatcaaagtaaaaaaaaaaaacaacaaaagaaaacattaaattctatttttaaaaaaagcagtggttttttcattcctcatacataccgaggaaaaactcagcaaagaccttatgtcacatatcattatgaatcaattttcttgaccaaacatcaaagttgattcaacatctccatcttgaaacactctattatcacgatgtttgtcaaatactgaaagatctgaccactgtccttttccccagacagcacaaggaacacagataacaaatgaaggttgtactctgtagcaagaatagacaggagactgaatcacagcaaaacacttataaatcaagaggcggaaagaaagcgctaagagtgattaaatgcacgaagagcagtaataggaaagaaatctcttgtgaaaagaagcagttgatggtaacttaacggggacaaaaatgaattagatctacctcgatgactgagctcaagatgaggtaatttcataaagtttatagaaagtcacttaaaaattacacaacttgatgtagtctacttttggagagaaggaaaataaaagtcctccatgagggagttgatctttagaaaaatgcatttacaaaccacattgatgaactctacctattatctggaagattatccttaattctcatctgggtaacaaagtcactttagaatggatacagtcctctgcatttcagggacagattttgaaacagaaatagaagagaataaaaatcttcaaatataaggggttataaagcgtatggggaaggaaataaaaataagtgttaacagaggtgagctctgggccaccataggacgcaagagtgtgctgaggcatattctcggtttggttaagaatagtactcatggtatgtgaaacaggactttctgtgttgtcagtgaccgaaaatcaactctaatttaaggggttaaagggaaccagttggcttacacctgggaaggatgctaaagtaactcacagaaataaggaggagctatagagctgtagtagacattctcaaatgcaagcaaacacgagaatcatctagaaggcttgttaaaactcagattccggggcctcatcccagagtttctgactctgaaggtctggggtggagcccaagaatctgcatttctcacagattaccagatgatgctgatgctgctagtccaaccacacttttgaaaaccatggagtcatggaaacctaggctagaggaactaagccctatgatggcaggagcctccatcatagcatggcaggagctttgctcctggagcttacacaggctttcaccagctactagggaatgtagcctcctgggccacattattttctttcatgatcccagaggtaggtggcctctttcatgagcttccacagaaaacccctggggaaggttctaactagcttgagggacttgtggccagagaccatccctgaaagtaacctacaatggcagggatgcagtaaagcaattggcctggcctgggcgaaagcttactctgtgagcagtagctagggaagacaggatccaagtgaagacatacagagagaaagaaggcatcacattttacagcatcaccaaggtcaaggaagtatccccaaagagacaagaggaagattcatggaaaagcagggtgagcaaagaataggacaatgtgattaccgcagcccataaggaagttcactttggcatcaagatgtacaatcacattcacttatgacactgttttttttacaaacatatcatctacactcatagagtgctgcttcttacataatctgtgatgatgaatgaatttttaaaaataattccctaactcattgacttgtattattataaaatgtaataatgcaaattactaaaaaattgatattcctcttgcatgtcatggcaagggtaattagcaatacaagtttctaaatgcttattctcagtatctgtacttatcacaaacctaaaacagctcacaaacaggcactggtacataaactggcatgggtccaaccacacactttcgagcattactgctctagaccacgtggaccaggacttcttggtcacaacttcttaactccttaagaaagtgaatgagcacagctgtattccggtacaactttatttacaaaaacaggcattggccaggacttggccatggactgtagtttgtctgtccctactttagaccagggcttttcaaactctaacgtgcacagcaatcacctggagatcccatgaaaacacagactgtgcatttctaacagcttaaaaattgttgtcaacactgacagtccatggctgacattctgattagtaagccttcacagacaaatctcagtaaacctagagactggtatgtgaccttaagtataatattgctctatactgggtttttattgagccttaaaaagactgcagaaaagactacatctgtcattcaggtacctacctttctctgctttaaagagattattacaatcagaaaaaaattgataaggaaagccccattggaaccaatagcatcaaatatcggatggtttcctactttctcgattagctcctaacttgacacatagtaggtgctcaagaaataattgttggcagggcgtggtggctcacgcctgtaatcccagcactttgtgaggccgaggcgggcggaccacctgaggtcaggagtttgagaccagcctggccaacaaggcgaagccctgtgtctactaaaaaatacaaaaattagctgggcatggtggcactctcctgtagtcccagctactcagaaggctgaggcaggagaatccctcgaacctgggaggtggaggttgcagtgagccaagatcatgccactgcactccagcctgagtgacagagtgagactatctcaataagaaggaaggaaggaaggaaggaaggaagagagggagggagggaaggaagaaagaattgttgattgcaggctggatgcagaaataccaagctgtaaccactagaagagaaatatagtatgctgatggggcttcactttccgtcctataccttatttaaggtatttcacactgtaggataaattggtgcaactttcaattggcagtgcctttaaggaagtacctgtatagaaaaactgaatcaaagaatttgttctttcagtataagttctcttcatgtttctatacttttgtatttttttactttagcttcattcacccttcttatttgaataccaaatatctattctttggaatttggtcagcactgtcagcatttggattaactatttggtcgttcagcttaatggagaagaaggctccactcatgaaatgcaactactgatcacaggttataaaacacagaaaatatcagaaatcatctaaatatgaggtgattttggtgttttctctcacacctgctacccaaatgccaagactcttggatcataatgacacacggaagattctaagtcacttttgtctccctctcagagaaatgtgctacttgggattaacgagcaagtgaaacctagaaggtcaagggttaaagctccaaatggattttctgcttgctgtttacgatcttcaggcctttcagtattagagcagacacctaaacgtttgctcaaaaactttctattgagttctaattgagaaaaaaggatgtgtccagaatacttagagataacaattaatgaaaaaacccacagataagctggaagaaaaataattaactcggatttgtaccagatggcccttgggaatgctaatatgtgtgtttgcagtgctccatttcagaagacctcaaaggtggaaatgaagcattctcaggagaggttcctgggtatgcagatgaaatatccattgatattcagaaaggacctctaattgcgagagagttgccacccaaattagggtaaagttgctgcgtaaactatttaagtggacaaaacttaaaaaaaaaaaatctgtaataaagcaagcaacattgctcagaacactttggtaggtcaagacaagagaaaggaggacaactccgaggggcagattctttcattgatagcattcatgtcattacccacaaactccaactccaaatcatggaacggcgatgacatttctttctctaaggtcaactatcagagaggtctgcttggacaaatctatcagaaataacaaacacctggcattttcaagccccctttcatttttatatttcaaactagcagacagcaccagcagatatattgcataattttcttttactagttactcaccagtgtaaacgattttctatcctctttaaaatggcacctccagtgaacaagacgagatgtatttcactcactgctttatcctcagtgcctataagaatgcctggcagggatgacacttaatatattcttgtttggctgatgtttctaaatggcttttaatccagtttagtcattctgtggtctgaggaactagtaactgatttcacaaaggggtctttgcagagctgccccctgacatgctggagaacacccccctacctactcaagtcattcttgctgtggaatgaatcttgagctcatggttgacaccctgacttgtacctatggctgagttcctggcttagttatctgcctggtacttgagtctccctagaaccaagctttggcttacaggaggcttgccatgaatggagtttggcccttgcactagtgtgggattggtggtactggctatttgttaaaagaattacctatatgttgtttgggaattgcctccctctgtgtgtgctctggctatcttctaacatgctgctttcaggtaaggcccctccctactgccacaatccttcctgtacaaccaaccatttcctgtacgcattgcctctggctgctggatggaacctcatcccactctctgcaaagagtccttccttccaatgcttgcctgactctggtgaacaagtctagtcctagagtatggcccccaccagactgccccattgtattacagtcttgccagacacatggcattggcatctagcctggaaactgaatcgtttcagaagggcaactcattgacttattacgcttttcttcctggctgagaatattcagctagatgacttatatggaaataaaaaaataggctgacaatatgagtttgttctaaaaagatatttttggggcatctaccatgttctatgtaccattacaggggctacagataatgaagtatacaatagttgcataaaacaaaaaccttgaatggggagaaaattcaggaaagctctataccttgggtatttttaaagaatatggagcaaaaagcaacaagaaatgtggggatggggaagggggcaaacaaactataatatttctgagcaattttacagaatttttaaaaagaagtgaataaataaagagattattcagcggtgaggactgtaaattgtaaatatcacatgaaaaagaaaaaggagataggcacaaattatccccaaggatacatctgatgatggttataaagattaaaaagacgcttaatttagaagttcacctggagtatgttgctcctttacaaagacagaaagtttggtgggaatgcacagagaaatcagtggaatcttaagaggtttttggtaaaataaatcatttgaggattctagcaagaaagagaatggaaaaataaaggtgagttcattttctgaccagtaccaagtctcattcttgacgcctcctaacctcactgacctgaatataccaggaagacattgaacaggaagatattaaactgaaaaactcggaaggtgcattcagccacctctggaattcttaggtagtttagcatcccagcaacttagagggactgtgtcaaatattaataaatgacttgccgttaattctgagataattaaaactaactcaaattagaagtccacagaggtagtaattgtataaaatacataaaaaatatgtagcttggtcctgaattatgttaattttccttttttattgttataaaactgttatgtacccccaaagcttttctttttctttcctaagtcttatggcttactgtgaaacaaagctcttcatacttgttactattatatttgatttctgactgtataattccctgctttaagcaaatctggtttacaaagttccacatgctttttgaaagatattttatatgttaggcttctttaaataaatatctaaaattaaaaggtccattatactgctaggaaaatgatgatcaagaagactaacaacatgagaagatgttcatcaggcaatgacacataatgctggaagaaaattttttaaaatgataatagtggttgtattacaggaatacaattaggaaattttttaaaatatcacacttttagtaggaaatgtaaattcgtaaaggtgaaacagcgatcattatttaatatttaaaaacttccaaaaacataaagtgaaaataacctaaatttgtaaggaaagcattcttaactgaaacgttgaaaaactaaaatttcctcaaactttaatcattccatagctataaaggcagtatgtctaaaaagccattactggcatattctaaaggttctcataatcaaatccttcctttaggggaacaagtaaactatgataagaaaagttttttactttacatttagactgggggtttctgattgtcctttctttaaaagtgtctcagcttggcgttgtggctcatgtctgtaatcccagcactttgggaggctaagaggcagatcgcttgagcccaggagtttgagaccaggcagggcaacaaaccctgtctctacaaaacaaaattcaattagccaggtgcagtgtcatgcacctgtagtcctagcaactcaggaggctgaggtgggaggatctcttgagcccaggaggccgaggctgcagtgagctgtgatcacaccactacactccagcctgggtgacagaatgagaccctgtgagaaaagacagtcaagaaagaagaaagaaaaagaaagaagaaggaaagaaagagaaagaaaaggtgtctctatcatataatctatgaaaagctgctcataattatccaaaacactacccaggcaattctcattatccacagtagttatggtctatacagtcactaaaaccactgaattagcaaatactcaaccattgttcttagcggaaaaacacagttacatttttatgagcctctagtcacaatattttcatcagcagatcaattcctaactttgttttaagtatgcttctgtttaaagacaccttatttaatatatattgttgcttctcatggccaacagcattattaactcatgccgaatgaagcttatctagcacctgtatgctctctgtagggtacatcccaggcttctgacacttaggaatgctagaaagcattcaatactatgcttgggggccaacagtgaaatcatacacacaaaaaaggacaaaaatgcaaaaaacatggccataaatagactgcaaaaggacacgttttacagtatgaaagctgaaacaagaaggcagaggattgcctttttgatctcatttgggaacatgtgcattgggtgactaaaatttttcaccactctgcacattgccttgaatgaccttgaaagtgctgtggaattacaaatgacttttggagtacaaattaattttagcacacaggcgaatttccaaatacagaacaagcaaataatgatcaactataccaagaatactaagagaaaacaatgtagattagattacagtgaaattcctccaacactctaaaagcattccttggaaataaaaagaatcttattaataactagaggaacatgccacttctgatcctaatattcatcttgctttaaacagaccaggagaactgtttcctttgtgggaggggtggggggaataccatttttgacttgaaattgtaccatggtatgttgattcatgaaatcacaaattttaaaactctaaaaacaagtttcatgggaaactaagtaaatcatagtaaaagacactaacatgcatgaggtgatctcaatatactctacacaatagtatttcaagtgtacatactttattatagtgagacatcaaaatttatataaacaaatttaaagacaagagtcaagatgtgggaaaacatgactgatgacataaataaaactgcccattcccttgatctcaaacacacatatacacacacacacacacacaaacacacacacagagtcctgtgttctaaatcactgtgagaattatgtaataatggaaaactagacaaaaaaaaagaaaaggcaagtcataaagaggcattacaaatgctgaatagaagaaaaagaatttaaaaatgctacctctcctgttggtaaagaattacagcaatgatagccaagacatgggaaaataaatgggcagtcaactcactgatgttagccctctacaagtccttcaactattactgaggtaattcagcaatgcatgtgaaaaccttaaaatgtgcatacattttgacccttacacttctaggaatttatcttatatgaataatcccagctttatgtaaagttatgagaacaaggaggttcatggcattattttaaatttgtaacaccctgaatatcaaataacagagcactaggttaagtaaacttgtatatccatacaagtaaataccattccgccactgaaaatgttatagagaactgtactaggacaggcaaaacacataaaaaaaagaaagaaagcagactatataatattgtcaattatatgatataagtctagttttgtcaaaactagtgtgtgtatatatatatattttttaaaaaggtatatataaatatatctgtgtaatctattttataattttctcttttgtttgtccttattttaataattaggaaaagggactactatttataaaataacctaaaataaggacaaaagactatttagcaaactactaagtcgagccaatttcttaggcaagcccatatggacatgttgctcgtttaggaatgagaccatctttcctaattcctaattctctgacagtgggtggggcagcatggaaagaggaaaaaaaggattcacagtatctgcaatctcctgaatccatggggcacatcccaccagactacatctcacctctgctatacaggaaaggaatcagtccaaaggatttcagccttgttcttctgaatgattttcctaagttcactacccacatctaatgatgcctttaccaggctttatctgaattttaaagtaacatctcaaaaatactaatagtacaactttcagatgccctgccacataagattattcttaagatgcagagattcttgacattattcccgaccattattgattgtcttgctgagaaatgcactgttttctaattgttgcattcaatgcttcattttctctatgcaataacattaaggaaaacaacaaccctaactcttctaataattatatatttttccaaactatatggcattatactttgattcatggtccatttctctttaacactctacaaaggcatctacacagaggactcgtaatcaattccggagcttgctgggactaacgacaaaatttactaagccccaaatctgttaaattattcaagtcacttaccataaaacaaagtaggttgcattaaaacctggattttgaagacagagtaaagagtaaaaatcttatttttggcttgtttctgagggtatgtcagtgaggagcatgtaaatagattttgagtgttctattagggatggtttgaaaatgtggtagctagcagatacaccgatcatgtggaagacacaaaaccaaatgcagtcaccaggacccacttattactgagaagtattggcaggtaaaatggaacaaatgtgaggtgggcaaggagggccagatattcttggaaattttaattaactagacatcaggaaaagatatgcaaaaatcaacatttatgaattcctcacactgggaaaactactgccgggggaaaaaagaaaagggcccagagtggtagatggttttccatcctctagcttatgcagagtgacttccctaaataaagagctattctaagtggaagtggagactaaatgaccagctgatcaacacaaaattaatcattctccacagactagactatcaggtcgactaccactagaaagaatggctgcctggaattttaatcttttccactctatatgaaaaaaatacatattttcaagcaaacctgcaagaatagaaatgcagggtagtcatttcaaaaataatgcttgtgttgtataaagtattgagcactatattcgaaaataaattcctacaagagttctacttccctacaaagaaaacagtcgcttgcagataaggtatttcagcaaacacatgtggtgtgtaatgaaatgggttttgctttgttacaataaattaaaatggacaccagacctgaagaatctctgagcagacaaagccagttaggcctcataagtgatcttaactctgcttgatttgcagacataaacaaaacttgagctatttcttgtaaatgcctatgttacagaaaaatgaaacttaaggctaaccaattggaagcagaaagttctagttatctaacttatggttacataactagaactttccaggaggatagaccaaataaggcaacagtataactgtaaccaatccagtattttctttgctttactttcgtgtttgccctataaaagtcttcccttcacattcttttgatggagccctggaagcacttttggtttggagctgctcaatccgtgaatcactggttattcaaatcaactcctgacaattttacggcacctcagtttaagtttaaacagctctgtgcctcagttatacgcatgtatctgaaagaaaacaggatattcttctttgtacttaaataaactctaaatgtgcaataatttaaaaatatgagacagcacaagtgaatcctaaaatatattaaaacgtaaggcatttgcatatacctgattctgaaaatatggcatgcagttttacttctctggcttcacattctaaagtttctgaaacatataccatagagcacaaaaagagctggcctcttctcaaatttataacaaattatattttgttcttctttcaaacatgaatttaatcctccctttattaactgtttccttggttgtctgagtagagaatcattgtaagctgagtcacttacaccttccatcaatttcaaaacaacacatgaagtaacactgattatcactgaacctgtatcagacacctcccatttctgagatgtgcatttattctaaatctaagttttggaagtgataatggaatgaaacactcagaaaatataaaaagccaaagttttcactatgctttagaaaggtttgcaagttggtacttaaaacaatgctttaaggtattattttcatgtctatagatgaggtaatacaagtttacagagtatattcaaatggctaataaatacatgaaaaggtgctcaacctcattagtcatgacagaaaggccataatgagataatgcctcatacttacctgaatgactaaaattgaaaagactaaccagtagcaaaagtaaagtaaaagataacaaatgcaaaagagtatacagtacatgattccagtgatattaagtttaaaaataggtaaaacaaatctgtgatattagaaattacctttgagggccgaacacagtggctactgcctgtaacccaagcactttgggaggcccaggcgggaggaccccttgagatcaggagtttgagaccagcctgcgcaacaaggtaaacccatctctactaaaaatacaaaaattagccgggcatggtggcagacgcctttagtcccagctactcaggaggctaagtcagaagaaaaaaaaaaaaaaaagagagaaaagaaaagaaattacctgtggagagaaagcagggtaggaaaatgatggggactgcatgaggaggaggcttccaggatccctgttatgttttatttctttttcttttactttttttttttttttttttccagacgaagtctcgctcttgtctcccaggctggagtgcaatggcacaatctcggctcactgcaacctccgcctcctgcgttcaagcaattctcctgcctcagcctcccaagtagctggaattataggtgcctgcaaccacgcctggctaatttttgcattttaagtagagacggggttttaccattttggccaggctgctcttgaaatcccgaccttctgcccacttcggcctcccaaagtgctgagattacaggcatgagccaccgcatccagccatgttctatttcttgatctggctggaggttagatgatatgttcactttgtaataattcatcaagctgtatacttaaaatttgtatactgttctgtatggagattatactttaataagtttattaaattttttaaatgatactgtcatatgaaattattttccctctaaatgaaaagtgtgcgtgtgtgtctcaatatgtgtaataaaacaaccctctgaggtaagtactgctattattaccactttataaacgaggataccaaggcacacagaagttaaatagcatgcccaaggtcccacaaccagtaactggtaaagacaagactggaacccaggcagtctggcataagaatcccactaagagtcccttccattcttcaacttgtctttggtgcttaggtagcacatttcttcctagatatttcaagggcttagaaaatatgattcaaagttggatctaaaccaggaagtacaatcaaatccaatgaggtgcctttactaatgccaatcgtgtacttttgcttttcaaaactaggcctccagagagcaaaagatttgcttatctttggccaacagagttggggtcatggagagattcgtgccaagtgtcctttccttgtattcacttcacaagatgtttcgtgtaagtgaacactaggtgttttgtgtaagtgaacacaacatattccagatgttacatttgctacacctttggaattctaagttcagaattaaaatacaaaccagagtataatttggaaaacaaaaacccaaggttaacattctatatagtgcttttcttttaaatgtctttaaattcttaacagaaaaccacaaaaccctacttctatttcctattttatacatttttgctctttatgatttaaagaatactaatgcttagaattctttaaatcaaaatgatgaagaccaccagcagaacaaactctattacttttctctcatctcaagctcagctggaaaataagagaattataaaatatttaatgatatactttatatgaattcagttcagtaagtgagtttatcttgaaaaagactcttgttttattcagcttggtagaggaacttcatttcatatatatgataaaataataagaaacgtattagttgtagagatacttgtgttaggtccaagtgaaaatcagcatttgggttaacagtcaagcaaaataactaaaattttcagctctatgactgacatcatgagtggaaatatatgtcaacctgtaataattttattgaatgacgtgtttactaaacagaattatcttagacacactgcaaataagcagttgtaaatatcagttgataaaagtttaacaaaaactggtgttctgtaattttgactttctgtgtattcaactaactaatccttacatctaacaagacaattgacacctttgaaataattagctttgggctctcaggaacctctacttttgggcaggtggacacgaaataattactgccaaaactacagccagtttgcttgcaaaatcacatcaactcatctatactattttttaggttctgttctctaaattttgtgaaacgaagccaggattgaaaatactcattacatttctatgttttttaactggttttgaaatttcaagatttggaaaaagtactgtgagatgagctgtgcattcattttcctgatatagcatgagaaaaataaaataactcccacatacctttatctacccaagatgacagttaatctcaaaaaaagttgaaataatccaagcatttgaaaatgttccataaagtcaaaattttggaagagagtggtttttttaaaagaaaaatggctctgacagtaatttttccactatccctccccatcctacaggttttacaaaattaaaatttgaggtgagccactaagaaaagctatttcaacgaaatccaatgattgtcctggtagatttcatctctcagtggctctctattatcctttgcacagagtttcagtagacgctaaaagttcagtattttattacaatcgtctgtcctctgggtactgtgtggttcaagcagcttaaggagctgtgtgtctcggtatttacagatttcaattggtttgggaatctctgggaggaaaatgattcttcccttagaaagcagtaggaagaaagaataagtgaattaatacatgattagagagccactgataggtgtttctacctaaccaatgaaaacaaagtgcttatgtaagtggaaacattgttctttttgcgaataccttccttatggctggctgcctttgaacttcaataacttggctattcctgaacggcactggagaactgaagataagtgctaataataccttgccgtctgttttgtgagtcagaagaaaagacaagcaaaaacataaggccaccaactatgtaagtcatgaggaaaacagacaagtgtactaccaatataagacaaaattttatgcatgcaaaacaaaacaggctattgccagtatatttattaatgggaagcttccatatttagttcagaccacatttcttttttaaaaaatctggtattattttcatttatcattctcttagtaacaattcagatttcccacatcttcagatattttagtaaccaactcaatatattagatactctaacaatattgagacaatgattctcaaataaaagtttaggccaattgtgatggctcacgcctgtaatctccaagatctgagggcctgaggtaggaggatcacttgaggtcacgagtttgagaccagcctgagcaacacagcaagacaaaaaataaaaaaaaattggccaggcatggtggcatgcacctgtagtcctagctactcaagaggctgtgcgaggaggataccttgggcccaggagattgaggctacagtgaactatgataacaccacagcactccggtctgggtgacagaacgagaccctgtctctaaaaaaaaataatcaaaaaattaaagaaaaagttttatatcaaattgttgtggcatatacgtacttcacaggcctgttaaaagaatgaatgaaaaccgtgtacattagactttcaaaatattttggtctttctacataacaagcatctacctaaaccatgttatagtcaactgagtatctacaggtgaaacaaagcatactgatatttaacttccttactaaactagctgattaaatattaattgaatgcccacactgcccctagcatgggtgtggtagctacattctagttagctaccctcaagttaaaaagatgcacatgaagcagcaatagtaactatgaaaccaggtacagttatttgctacttagtacatatgttacaaactaatggtcagagataaaaattagaaagcatacaaaagaaggtggggccattatttcccagtgatttttgatcccataaccctaaaattttccaatatatggtaataccttcagcatctttatggaaggaatcatagtactcttccctctaaatcatgtaagcataggaccagtcacttctgtgtaaattacccaaataaagttcatgccaaccaatgtttcgactggcacactgtatcttttttatttccttccacctctcaggactgtacacacaacctctgaaataagatcccaagccttttacccaaaacgagttaaatcatcacgtattccaatgtgatataagacagaagttgtgggctgggcgcggtggctcatgcctgtaatttcagcacttttggaggcctaggcgggcagaccacgaggtagggagtttgagaccagcctggccaacatgagaaaccctgtctctattaaaaatacaaaagttagctgggcgttgtggcgtgtgactgtaatcccagctactcaagaggctgaggaagaagaatcgcttgaacccaggagacggaggttgcagtgagccaagatcgcgccactgtactccagcctgggcaacggagtaagactccgtctcaaaaaaaaaaaaaaaagatagaagttgcatctggggctgcagagtacacatattgacttatcaactctcaccaggaagaacaagtgagctcttgacggtgagaaattaaaactggcatataatctccctacaaagagaaaggttaccttaggatcagctgtgagcaatttgaatgcttgatatacttgagcttcctttacaccacctccaagatccaagaagttggctggcttcccaccattaaggaaaatgatatcacaagtagccatggcgagcccagcaccattcactgtgaaatgcaaatgggacacaagacaggctacatttagcaacatgaaatggtccataaacattttccctcccccatattgccaagagagaactctgtcattgccaggccaatttatatcctgtttggaattccattaaaccagattagttcatagacttttaggataaagaatcaggacatgtatatgcaaacaatgaaacaaaaaagacttaggaatgaggaacaggatgtattgggaagttaaatcaatctgaaaaacagaaagaaggaaaggtttaagtaagtaaccgatttgggccagtagtaaaaaaggaagttttaggttctgcaaagtgtaagcttaagagaatcaggaggcagagaaacaagctattggaagttgctaggacctatgaattacattctttttaatatactttaagagacaggagtaaagaatggaattctcaatgttttgtttgctgagaatatggtcctttgaatgtggcatctgtgggattgaaccacaggcttcccaacttcagtgggattttatacttttttacacttagtacagtcatacatgtttacataatgttacctggataaacttagaaacaaatgaacaaatgactgcacaaaaacaatattcttatccccttgttcctctttcaaattaatataagcaatgctcaccagcaacccaaccgttaaaactggaaccaaaatgtgccaacatcttaggagcctttcttaagaaagtaggtagagagttttaatatcaaaagtcttgttttccagagctaagttttattgatcaattgcacttattttgcttcttaagcttaattatataaaattactttccttgagagagaaaaaaaaaactccagaacacagcagaaactcacaaggtaaagtacctttcatttttctgaccctccaattccctagaaaagcctatgactgtgactaattaaatttggagtaactaaaataaaaatggtttacacagaatcttaaaacaatttgaaatgtgtaaatcatagattttgaggctgctatgtggtcaaaccatgcacattcctacagaggctataaataatctgtatttaatttggtttaaacccatatacctttcccctttctaaatgcctacaaatattgagagtgcattagcttatcaggatcagaatgatgtgagtgatctggtacattatagttattgctccaatacaaagcaagagcttttggtatcacttgtaattggatgtcattttctattgtattgaacagccacctcttggatgaggtctcttcagttctgaatacaatgatattgctggtttaatgagctacaaatcatttttattttaattccattaagattaagacctcagtttccagtacaatgaattgattctaccagaaacacagtcttgtgcaattaagtcagaagcatataaatctgagcactataagctgtgaacaataatagaaactgtattgcttctacagacattcttatctcagctgaagaagccattttcacaaatttagatgagtgtgataaaatcaattgttttattaataaactagcataatggattaaacatttcatcctttggttatcacagaacctgaaactttagcaacgtgattaaagtgtatgtcctcttctatttcctctgataaaggaattttgttttaaacctaaatttcagaagagttctgcatattaatactgagttgagcagcaaaggttctaattttttactaagcaaagtttaactgagatgttttaagtcaatatttctcagttggggtgatttttgcataccacagccatttggaactgtctgaagacatttattttaatttattgatttacatgggtttatttgtcttcacaagtgggggttgttagtagtatctagaggttaggatgctaaacatcttatgatgtacaggacagtaaagaattatcccacccaaactcccaatagtgccagagttgagaaattctgctttacaccagtgaccattaatcaaaacaactttgagaagaaacttggatactttcctaagacttttcagctacaaaaaaacttatgtgcttacttcttcttggtaagtgacatttcagaaatcaaggtttcctaaattctataagaatccacaaagcattcttttgatataactgcttcttaccaaagcaggcaatgttcccatctagtcctatgtattttagatcatatttggcagcttcattttcaatgggctcattctctgatttgtcgtccatagcaaatatgtctttttgtcggaattctgcgttgtcatcaaagtttatcttggcatcaaaacagacaactaaataaagaagaaaacaatcatacttgaatatctcttgaggatctataaattaagttcttcaggctggtaggcacaagcgaagggaaagttaagtactgtcattttttttcacatgttacaggcaggagaggctgctttggctttcttgacctttaaattttagggtttggtccctgttgtcaagggacttacgttctagtaaagaacatagtaatttctacctgttgttctcatttcaatagaataaccccaaaagttgccatcaaccattaaaagttacagactggcacagcttcatagatacagctttgattcattatttttattatatatttttagtatttaaccactaattatcacctttctcttctatgtaaagagagactagacaatattattaattattttgtcccctattgtccttttcttgatatggtaaagtgaaatttttattgaatcagtatcctgtctagtatttccaaaagatttagtggaaagaatgccagactagaatcgctcgatttttatttgatccttaactaactctgtaacatttattaaaaataaaaattgtatacacttgagtcttgaacaacatgggtttgaactgtgagggtccacttatagctggatttttattctcaagatgtaaagccccagagggtcgacttttcacatacatgggttctgcaaggccaactgcaggaattgtgcaatatgaacgaagtttggtatatctgagattcctggaaccgattccctgcatatattgagggacaactgtgtatttaaagcatacaacatcatgttttgatatacatataacacagtgaaataattaaacacagtgaaatgattactacactgaagcaaattaacacatccatcttctcatatagtttttggtttttctttttggtgtgggagagcacttaaaatatatacttttagcaatttccagcatacattactaactctgtaaccttgataaaataacctagttcttctctgggccttggttttttaattggaaaaaatggcaataacaatccttaaaacaagggccatgcccttgattcgtgcaggaccatcttatggtgcttcagattcaagttataagacacgaaaagaccaagactggtcagtcacaaagccaggatgccaggcattattagcacaattgtctctagtttctggagctggtggaaatctcctggacccagcaaaactcattccataataggagacagactacagggcactttccttgatttacagatctcctatacatacaatcagggagagactgcagtggagagggtggcattattggtatctgggtatctgaccccttttattatctctcttagtgtagaaattagtgttctgtgatgccatgtcatcataatgtttgtttgtttgtttatttatttatttatttatttatttcggagacagagtctcactctgctgcccaggctggagtgcagtggcgcaatctcggctcactataacctccacctcccaggttcaagcgattctcctgcctcagtctcccaagcagctgggactacaggcatgtgccaccatgcccaggtaattttttgtatttttagtacagatggggtttcaccgtgttagccaggatggtctcgatctcctgaccttgtgatctgcccacctcagcctcccaaagtgctgggattacaggtgtgagccactgcacctggccaatgttcttttacttaacttgggatattgatagccaggaatctttgaacaataatttacagatactacctattctcctccagcattgctgacaggcacctgactcttgaaagggaaacagccacagaacatttctcactcactgaaaagcagtggctataatctcctaattatacttgcttcttatgaaaataaaacatggctgtatatggcatcttggcgttagagaccccaggtagagggttttctccaagggtttccctaccacaatattcaagcactttgatacaaatctgtgtagaccagcatattaacatctaagaatacttgttataagtatatatatagaccgcacatgacttaaagtagcactgagcgacaagagagaatcttatatggaagttaatgtctgcttaaatccttagtcttgccccaaaatgcccaaccactttgtccacacattgtgaatggttggagtgaatgagtaattactttccaaaatattgaaagcttattgacagaatcctacaattaccaaacgaattggccaatgttctctgcttgctacaggggaattttctcagcagttaatgactggtataataatcaataaaaaagcaacttcgtacatggctttccactaggtttataaatgcattctaattaatttattagtaattttagctcctccattactcattggcaagactacttataactgacaccttcaaaatgaatgggctaaggttatcaaattgacttcctaagggaagagtttcaaataaaggaattcttggttgagatcaataaacaagtaaatcaaaatagtttcaagctgacctttgctccttacaaagactacagttacaagctgcttcagagagagaataattaatgggtatgtattcaaagttcaaaaggcaatcccaactaaatgcctgcaaagctagattttcagaggatgtttttctgtggtatgacgttctctccagggaacaatcttgacagaactttgcagttaacccagagcttcaagatggtgactatgggataaaaggggtgtatatctacaacggtcctgtgccgactgttaatttgtagagaaaactaaacaacctaattggatcattgcatgtatgtctaagtgttttgggaagttaaaaacactacctaaatatgaagtaatttatttagaggacttaggacttaagaaaggggattcaaattgaactgccaccttcaagaccccagtctttacttagtgggtaagggaagaaaaactttaaggatgtaaagggattctttcagacacatatttgttacgcctgttttatattttaaaagtagtctgtgatactgtgatttataataaatatattattttggtcttcatccctaattcctagcatagagctctaaaacccttgtgatttcctaagcaataggggtgctaggagaatcttgtgttctaacatttggcctttgaccctgattcctgatgcagagctcctaatcccttgggattttctgggagataggagagtcttttgttctattaaggtaagtcttggtggaggcttctgtatggggctggtcgccagaaagaccaaactatgattagaagcttggaaatttcagccccacctccatgctccagaaagaataacagatcatccctatgtaataaagcctccataaaaatttctcaactccaggggactggagagcttacaggttgccaaacacagggaggtgctacagggtggctcacctgtggagtacagggaagcttgtcaccccttcatgcataccctgccccatatacctcttcatctggctattcctttgtatcatttaaaatatcctttataaaaaaataagataaaaaataaaataacctttataataaatcagcagtagtaagtaaagtgcttccctgggttctgagagccattctagtaaatgatggggcacaaggagggagtcctaagaacccccaatttacagctggttcatcagaagtaccagaggcttggtcttacaaatgacatccaaagtggagtcagtctgataagactgaccccttaacctatgggatctgactctaattccaggtagatggtaaaagaattgaattgaatcataggatacctagctagtgtcagagattagtcagtgttggaaaaactcacacatctggtccaagaagtgttcttctgtgttgagagtttggtaggagaaaaatgtttgtttttccctattatacatagtaccaaacaaacaaagtgctttcctatcttactatctacaatgttgtgccatctaaatgattttccttgaacctgaccacttaatatagactggcatcaaaaatatcagggtataaatgacaactcctggcacttcctagccagctatccttaagcacattaacctctcttaaacccgagccttgtctatacaatggggatcagagtatgttctactctaggtgttggtggcaggagagattgtatgcaaagcgcttagcttcctagacagtgggtactagcaggttgttagacgaccacaccaccctctaatatgcacatgcttttttatacttaagagcttcccattattgtagcccaggctacagaactctcctctcttcctaacaataaaaattatctgttcctttataatctgagatttctgtttagagcaaatctaagcaaatgtctcccatagtttacatatgtacaggttacccatggttttcaataaaaagccatcttctgaatgaataagaattttcccaaaggaagaatattaatagttggcattttaggcatcataaatagtagaaaacaagatttttggctaaaagataagggtaaaataggctgttggtgactctcaaatcacatcacacctgtgcataaggccaaggctaaagattggtacagaatagctccaaatgaagatctaagcaaagggtagcaactaagaccctcaagccagccctatttttatgaataacagattggaacatagcctcgttcatattgcctatggctgccttcccaagacaaaagcagaggtgagtagttgcaatacagactgtatggcccgcaaacccccaaatatttactaactggtccttgacagaaaaagtttgccaatccctgctaagtcacagttctcacacttgtatccacttgtgtgaaccaagtgatagatacacaggtgtcatattttatagtgaaggagaaacttagaaaaagtgcattccattaacatgaaaaccaaaaaaaaagtaaaataacaaagaaaataaataaaaacctgtggctacgcaaaaggagtagattaatcctggaatactaactgactcttacatgcttatttcctcctgtaagacgcttctaaatgcacttcttgaattgacgtgttaaaaatggattgatgtctatgtcaacagcagggcgataaaataaacttgcctgcttaaacccttagctttctcatttaataaaacaacaaacaatacaaaatgcattttcagaggtgctgagcttggtccggaccttaagattgtcaacgtcacattaatgaaactcaattctaaagaaaattcatcttgaacaaaggccattttttatacaaagtgggtgaaagaaacatacctattaatatttataaaacaattttcaccatcaaaagcacattgttacatgcttgatagattatacaaatgtattttccttctgaacgaatatcaaagaaagctgtggtacttatatgcatagggtgttttgttgttttgtttagtggcgtgagattctgtgagctgctaattcaacaatctcgatagaaaacatgactggcagttagaggcctctgaccctagaattttaacagaagaatgtgtcacagaattaaacaaaagaagaatacatttcagaggggaaacttacacataaaaggaacataaaacagcaggaaataagactatcataattagtttgaaaaataatctgtcttcaagcaacgtactgcgtttgatttgtgataaataaccataatgtactattgaaacacgccttgccaaaatggccttaaaatgctgatactttcaaattagtcccacttcccattaaatattgatgttctgagagttgtatactttttagaacttttttttagtggctgtgaaaagagaaaataggtatggggtgggtaggggggttgggggaggtagagaaccgaaaatgttcttgaaaatagagtcttgtgtataaagacagaaacagagaaacacccaccaacaacatgggcacttgctaacaagaagcaacggggtggttatttagggaaatcaatccgaagaaagaaaggaatttgatgtgccagttaactgtggatcacccagctttaattctcacggaatcttagccagatagtcactgcttcaaattggatctcattcctttggcccagtgaatggatttcagcttccaactgatgaagatgccccaaagcaagaattcttaatctctagactatggacagattgggtgaggtcgttctctgtgaacagggaccatcctgtgcgttgtagtttagcattatccacgccagtagcatagcctccaagttgtgatgactaaaaatgttccctgggggacaaaatgcccacccttcccatggagtacaacttgctttaaagacatcagaaaaaggagtctgtgtacagatagagctggctgaaggtgagaagaaatatgacatgaaatttcacagtggctagcaaaatgaatgaatgaatacatgaatgcgcaggtagataaataaataaataatgataaaacattgcttcttgcttggctgcagaattaatgaatgaattggcactgcatttggacaaacaaggaaaataacgattaatttctattgactaagtaacagtttatttttgtttcaataaggttgcatctttctggtaggcatgttttgactcagtgtcccttcttccattaagaaactgtatgtctcctataccatatgattcttgctcagtggctggcatgggcatagacatgtgacccaagcagggtcaatgagaatcatttgaagggatttatggggctgctgagggagagttatggagcactgggagccatctttgctgccagcttctgagagcctggctgagaaagaagccaatttggaggcaagcagggctggagaaccagcaaatccctgattctcttcaggccttaagccagtccacaccttagacttccctgttacaggaatataactttttaacaaaaacaaagctaatataactttctgtcattagcaaccattataatcctagctaagagtcactaaactacattgcagttagtagtgtcaaattatattttttgaatcagattattaatcacataggaaaaaagagctcttggactgcagttctttctccgtgtcaaaaattccctatgggtgacttagcagcatagatgttatcaaggcccttgttcttcactcaacacggcatcacttgttgtacaaatatatgaacaataacctgaattattaaaaatagcactcactgaccaatggaaggtcaaaaaaagtttcctacaaagaggtgggtacaggccaggcacaatggatcacacctgtaatcccagcactttgggaggccgaggtgggtggatcacctgaggtcaggagttcgagaccagcctggccaacgtggtgaaaccccgtctctactaaaaatacaaaaattagctgggcgcggtggtgggcgcctgtaatcccagatactcgggaggctgacgtaggagaatcacttgaactcgggaggtggaggctgcagtgagctgaggctgtaccactgcactccagccttggcgacagagtgagaccctgtctcaaaaataaaaaagaaaaagaaaaagaaaaagaaacaacaacaacaaaaaagagctggtacaatgtgatgctgagctccttaaacttttaaatttaaagaataattattaaatcaaagtttcaatgtggaaattttaccgtgaaatgttctgctactactgatctaaacagaactaacaaatactcagattataaatattaagattatcaatattgctaaaatataaatgactgcttttacagcttctaaataaaagatagcttgaggggactgtgataatgatgaagatcaatttgtacatttggtcattaatcaccatttcctaattgggtttaatttgactactgctcattagagttataaaccaacatactcatttaattgtgattataattcaattgctgaacttttatggtacaatgaacaaattaataactaaagataattttgctcttaaaaatatcacataagacttatgttttaatgaactgtatataatgttttatgatgattcccttaaaaaaaaatctcaagactcttccattctcttaataattaaaaatcaaacttcagactcatgacgttttataaacacagtctaagaaaaggttcccatacccctgttccctgaagcgagaacacagctcgtgactgcttcccaaagggttgaataaaaaatgtattgcagccatttttatcccactccatagctacagctacatttccatttttcttcatgcaaagcaaccaggctgcttgtgtatactagttgaaaaagcaatatatgacctttaagaacttttgttaaaccttctccttcatttcttggatttaattgtcaacatgaattctgactggtattccctgccaaactggagactacttctaggtcatgtacgtgaaagcaaataagtagtttaaatgggagaaagtagaaaaggcaggtagctgcagttgagtctggagtatcagaatcaatatgcacgctggactcagagggacatgggttcaaatcccagcttttgtaacttctgactagcccctgggacagtcacaatggtttctcaatcctctataaaatggggataacaactcctaatttttcagggttgtggtaaacaatatgaaagaatataggtataagcttatcacagtgtctggcatataagctcaagaaacagcttcttccccttcctttcttagctttataaaatacacacaatttgatagccatagcaactttaaaaaaaatatttatgaataaaggtagcttgtttataaatgagcaagcacagatttctatcggatggtcatctgtataaatcatgaaatatattatcttcaatggcttcctaaacataaaatctttgcttgttctcgtctgaaatctatactattcctgggctactctgagactacctgagaagaggaatttcattttatgaatgttagggactagcctattttgtatctgacactgcatgcatactcatatatgatttcatcttattttcacaacactctatgagctagacatcatttctaccacttatttgattgaaaagattgaaaaaaaaaaaaaagacctgaaacttaggcaggctaaataacttgcccagatccgtagccaaaacatggcagatacagaatttatacttaggcctctctgggttcgaaggaaatgatagtgtagtttctctgagtctagctacagaatctctgaaatgtgctaaggagaaaatattgtctcatccgtcttggtccaaaagttgatgtgtttacacataatgattcaccccagttaacaattcaatgcaaattactatttactgactgtaacaagctagacaacatgcaagacaccggaggtgaaatgtactaaaaaagaaaaggttcatggtgcttacagtctggtatccctatcctatccacctgccattccactgttttgacagcaaaagcttgtgaatttgtgtgtagaactccactttaccccttaccacacacacatttacaagcttttgctatcaaattaataagaacttatggaatatttgctgtatgcaagaaacagtgcagtggtggtaggtactgatatataaaagttatttatactctacaactacctgatggataggagaaaccttcaccacaaaaatgccacctcctcctgcctgaagcagaaactgctctccaagtaaggtgaaagagttcaactgggggggacttggggctttaccaaggtgatataaatccagcccagaacacaaggtgaaattatatacagatttaggcaaactaaagacgttcgaaaagttccagttccataaaggcatatgccttcattacacccaagtgtgtggctcccatttctacacaaatctttaccttagtagcagcagtgatgggcctaaaaaaataaggtggagagaaagaggtgaacgaatgtttctttccttttattatttattattattattattatttttgtagagacagggtctcaatatgttacccaggctagtctcaaagtcttggcctcaagtgatcctcccgccttgtcctcccaaagtgctgggattacaggcatgagccaccacaccaagcctgaatgtttttaagtaaaacaagcagtagcttccttagaggcttggcatttggctacaaacaaacctaagtgctgaaatgttcaactgcatcatgggagcatttcaaactatggcagaaattaaattactgaaagaaatttatgcaaagctgctgctacagtcttttgtgcaatttatagtttgcataaataattataatacattcatttgttttctcaattcttttttttttttaccttgtccttctggagtttcaccaaagggattcacttccacctgagtagcatcaattttcaggaagagattatacagcttcgtaatttgatctgcagcctaaatgtgatcaagtgaaatagaattacaccaaagcagtaaaagaaaatttattttgctggattaatgaaaccttaaaaatagcaagttatgtctttattttcagttaggttttctgaagggaaaaacagaaaagcataattattttaatttccactgctattcattaaaaggaattgctcagctctcctctagacaccagaagagaccattatcaagaaaagaaaatattttcagtacggcctaaaacgttgttaatctttttgtaaattatcatgtctctattagcagagttatgctgcaatataaattacaatcattaatacaaacaagctccatttaagtaaaaggtaaacatgattttgagagtttataatgactaggttttccttattgtgctgaaataaaacagttattatattcatcaatccaacccataatctgtgaaacaacaattactgagtgtctaatgaaaattgttgcaaaacaggaagatgaaagtgcttaatagtgtagttactgaacagcacaagttcaaactgaaaatagcttgtcccaaaggcattaaccacaaagggcaagaatatccaaggttgccctgttatgccctgacttcatttttctcacctctgcttgaaattcactcattcattcattcattcttttcaaccaacatttctccactgcctatgacacagcaagctggtatcttgtgagctggcgcttgaaataagagcatgaatgagccatgcccctaccctggaaagctcctggcaataacaaaaggagcatgtgatgcacagagcaagagggtggatcgtggagaagaattaggtatcagtctcattcccagctccattttccaagccaaagttttcccactgccacatttcactcattgtgccagcctcggattacttgcagcagatccgttttcagttctccaactctactctgtatatcagagaaggtgactcttacaggctgagttttctaggttcctgggtcagctggtttccagctggggtcagccaatggcaagcagtggtgagagatggaggtgggaagaagggaagagccagggtacttccactcctctctttctatctgggcagcacctcctcctctggctgttgctcccactggagaagcccaccagggctctagcttctgtatacaaggtccagtaacaccactgcctcatttttgttcctggagcatgtggttggatatgctttaggttgcctttctgtcaactcttaaagtactcagctcttgcagcgcctatgaaacacatccctaaagtaaatccccactggtgtaaatattgcaagtggttccagatttgactgaagaactccagatttaattcatgctatcttaatgtattttataaacacctacaaacatttttaaatccaaatttgagggctagtagatataaacgaacccacataatgagtatgattaaatatttttaatattaaatatttgcataggtagataatacatgtatatgatacaaaattcccgaagaacttaagggttttccctgattgtaccactcaaccacacaggcccccagtggcagccaactcataaatttagccttcatatgagagacagtctatgcctaacacagtacgcattcctccttcatctgtcttaaaaaagcaaacttgttccaatacctctttacttaacagaattttagagacacttcatcagcaacacaggtagatcaatcatatctttttaattgactaaataatatcttactgtattgatatgctataattcctttaacctttcacttaaataatgaccaactgcattgtttctaataggttgacattacagcactgccttatttatctctgtatatttaacatacatgtgattaaacatttgtaggataaattacccagagtgaagcaaaaaggaatgtagccattttaaacatcaaaaggttctgttaaattgttcttttttttttttttttttttgagaccgagacttgcagtgttgccagcctggagtgcaatggcgcgatctcagctcactgcaacctccacctgccgggttcaagcaattcccctgcctcagcctcccgagtagctaggactacaggtgtgccaccaagcctggctaattttttatattttagtagagacgggttttcaccacgttggccaggatggtctcaatctcctgacctcgtaatctgcccacctcagcctcccaaaggtgctgggattacaggcatgagccactgcgcccggcctaaattgttcttcatagaagctgtccctgatttccactcctaaaaagtgaaaattatcagagacactattttccaattcacaatcattagccatttgtatctttgtcagtgtgttaggtgaaaaagggtatctcactggtatggttgggctctgtgtccccatccaaatctcaccttgaattgtaataattcccacgtgttgcaggagggacccagtgggaggtaactgaatcatggggacgggattttcccatgctgttctcatgatagtgagtaagtctcacgagatctggtggttttataaagggggggttcctctgcacaagctctcttgcctgccaccatgtaagaagtcccttcactcttccttcgtcttccaccatgattgtgaggcttccccagccatgtggaattgtaagtaaattaaacctctttccttcataaattatccagtcacgggtatgtctttattatcagcgtgagaacagacgagtacactcacatatagttttaatttgaatttattttattatgaatgagtttaggcattattctatgagtttaagagacatcttattttttttgtgtgaattttgcctatttttctattgagattttggtcccttattaatttataggaagagtgtgagtgtgcgtgtgtgggggggtgtgtgtgtgtgtacaagagagtgttgctttgtcacctagactggagcgtactggcataatcatggctcactgcagccttgaactcctgggctcagatgatcctcccacctcagcctttcaaatagctggactacaggcacatgccactaggctgagctaattttttattttaattttttctagagatgggggtctcgctatgttacccaggctgctcttgaattcctggtctcaagcaatcctcttgtctcagcccctttaacatttaccttttgaacatgcttttgttacttttgccacatggaaatttcacaataatgtcactcttatatggcttctggctttgtgtcagacttttaaaaggctagtcccattctgagagtatttttaaaaattctcccattattttttctagtattctttataatttcttccatttttttaatccaaataaaatttgagttaaagtgcgaagccagcaaatacttcattgcggaatattttttgtattttagggggttttctaggtcatcaatgtgaccttgcaatgtgagttgcatggggcaggcatcttatgtatcctgggcaccttggcatccactgtagtgatacaacctctgcagagtcaacactcgataaatatcggttgaattaaagattaattcagttctaagtggggactacataatagaaataacttctgggtacacatatatatatatatgtataatctaatccagctacttcaaaacttcctttttaaaaaattgtgataaaatatacaaaacataaaattcaccatatctcaaccatttttgtctacacagttctgcagggtcaagttggtacattcacattgctgtgcaaccaattcctagaacttcttcatcttccctcacactctgtatcgctaaacaaactcccgttcttctcttcccactgcctctggcaacatcattctactttgtgtctataaatttgactattctagatagcatctctctctctgcctctctctccatctccatatatatatatattttcacacacacacacccccctctatatatacgcacatatatatctctccatatatatctccatatatatgtatatagataatacgtatagatatatatagataccagatatatagagatattagagatctctatatacatacatacataaaataaaagatatgcatatatatacatacactagatacctgtggaatcatccagtgtttgtctttttgtaactggcttatttcacttagcataatgtcctcaagccccatccatactgcagcatgtgtcagaatcttcttttacaaggttcagtaaagttccattatagtatataccacattttgtttatccattcatccacagatacacacttaaattgtttcagaacttcttaagcctacaccaattttgcttagtacaaggctgcattttctgcacattaatcccattgtaattatacattagcacagcattttggggatattttctgttttaatttttactgttgcacaaaggcagaccataatttttttgagcaagactaaaacataatctgatcttggagacatctccaaaccaagctggttctcccttgtagatctcacaatgacaaacccttgtaagatgtcttattccagaggctattcactaaatggttataagggctaagcagacagaatgtgtgtgaccaggtgtaacagggaatggcatggcatgtggcaagttgagattagtattcccactttctacaaaagttaaaaataagcacaggtcaaagaaaacattctcctggtcaacttgcagtcagtcgcttactactgccatctatttctcagctcataaccactgcgtacaaaaagtttttctgcacttttgccatcaattgttattttgtctgttaagtaatttttaaaaattaaaattcgtaaaatcaaatatacgtacatgaaaatctgacaagtttataaaaatctttaaaaatgtctcaaaaggagcataaggaggaatggcctcagaatcgtgcaggcacagttgtgcgctgcatcgccaagatgccattcccaaagtatactccatcgcgcctggccactccaccctcgaccctctacccagcggaatacgacatatccctggaaacccagcaggcgcaagccgagcggttggccataagagcacagctgaaacagcagtacttgcttcagtacaacgaccctaactgctgacggctcattgaagatcctgccttgatttgttggacctatgcaagatcagcaaatgtctatcctaatttcacccctaaaaactcactcttgggagctttgtgtggaattaggcacctgttcttctggtatgatgtattcaaaactgacaggaataggaaagaaaaacttatccaggaaggaaaattggatcaaacatttaacatctcatattaagtctggcaatgatgactatgtgtattcttgctgaaataaatcgtctattaatcaaacaaaaatctcaacaggttaagaattttaaatatttttcttgcattccagaaattatcatcaatattcacgtacgcctctcaaatctagccagaagtacaaaccacttcaagaggtgttagtgatcttgcactgacttggaccatccgatcttttcatcagcctaaaccttagaggcacatgttgacaattcgtggcactcatgttttcagaaatgaacagtatagatgataattaagacacacttgacaaacttgtaagtttcagtcatacaatagtcaccctttatcctcagtttccctttctgtggttttagttacccatggtctactgaggtccaagttattaaatggaaaggacaaaattatggaataagatccttggatggaacacagcactaaagtcactgacggattacaacctctacagccacacttagatgacctaaaaagaaagagacaaacttctaattatgatgttcttctaaaaggttgtggtgaaaaaccttcagctatccaggatccctgaccattgacatcatctgttcctgacatccagccattgacacccatggtttgatgatccaggatcatccaaagtagatgtccctcacgaagtattgccaggaggtcatgagaagcccaatgctacatcgcaatgctcacatcactcaccccacgtcttaccatgtagacattgcatcatctcacatcatcgcaagaagggtgagtacagtacaatgaggtattttgagaaagagaccatattcacatcacttttattacagtatattgctattgttctatttcatactgttgttaatatcttactgtacctaatttataagtcaaaatttatcctaagtataaatatctagaatatccagaaaaaaagagtatatatagggtttggtagtaggtaagcttcaggcatccactggaagtcttgggacgtatcctccacagataagggggaactactatattaagctttcctatgtcttaacgtttttcaacaaattctcacagaaagagactttggttgggaacaaacactggtaatttttatgtaaagcaaagtatcatctttatttttgttatgtctaatattcatcacattttagagacaacaggcatgagtcacaggaaagatattaataattttataagactatcattttatatgatattcaaccatgagtgaggtacctccaaatgcctaaaccacatcctagatgaaaattaagtaacttaactttcaaagtcacgttgaacctaaggtacctctaagatactatttccttaggaaaagatcattgatgattgtttaaatgttttcccttctacactgtcccatctgctcattgtacactggccctctagagcatttcactaatccccacagcttgagcaagccccataaagcagagattcccaagcctacaactctaatgcacagctttccctgggatcccaagccatatatcccttctactgtagaaatacactcaggtgtccctagatgaacaacttccaacatgtctacagctgagatcaacctctctctccctctgcccgctgccccctcccccactctctccttcacattcctttatccgtccctcttcctgtatcctctcagccagcaggcagatatctaccggtctgtgagcccctgaggaacaatggttatttttcattgtctcttttccccaaggcacagcagactgagcagcaccctatcagtgctcattccaagctgctgagaaaatgaagatttaaagcctttcatggagttagcagtgaaaaaagaaaaaaacaaattaaaacattttatttcctttcctcgataaattaattcaaaggtatactgacaatatggccacttacttatccctcagttctcacatattcgtcttccttccataggtaactcatttaaaacctagagtgtttcaggtaccaggaaaacaagaataagccatttaagagctgtaaataactcttaattttctcgtataatatgtagtgagggggcagtatcttgtgatgtacattatactgttattaacttctctagaactctctattatgttcacctcctgagcttttaaatatgtggtcagcagattttgcccactccagatttatttatctgccatgaaaagccacctattgctgagcctctaggaacttcttcaaagtggacacctagaagtgttgtttcacctagtcatgcacatgacaaatgtttcttgggcaataaaaatagatgccaagcactttgccagctgctggcaacacagcagtgagtaggatggacaaagtccctgccgtggtaaagattaggatctagcaaaggtgactgcaaataaataagagaaatatacagatgtccaaagtgatatggaggaggcagacagggtcactgtgcaactctggagctgactgccagacagtgcagctagaccacagtggctgtatggaaaacgggctcttggtgaccaccactgctacaggagaagccccttaataaacatcaaatgaatggctaatgtagctggtatcctcattctcaggaggtgaaaccaaccactgtagcacatattcaggaatcttccaggatcttcctttcaacagatcactttcctggcatctctttgctagtctcagaaatggcaattagttcctctaactgtccatcgaatcctggccctttctctctcatcctgaggtttagttccagatgaccctgttccattctaccatcttcaatcttttgctttcaaagtgagcctttattcattttcaagtaagtggtttcccttcatttaagcatatatattttttaaaaccttattctgttttatccctctttgacttgcctactgttgccattaaacttccagagagagtcaatcaaaagaaaaagacaagacagaaagaaaagagtgcatcatgtactgtcttatgggaatagtgctgcccaaccaaattaaaggacatactctgtaaccttttcataaagccccaggccagagaacatacacacatgcacacatacacacaatctagggccattaaggtggcctctctgagtaacagaggaaggaacaagtaagtttatctgatttagctgtgggactaggaagcttgccccactagacacataatcaggtgccatgggctggaacaaaggcagagcaggggacgatactaagacagattctgtccctcaacagctctgaggccaatgttttggtctttgaagccaagggatattattacaaaattggcatattttaagctgttctcaataaaatatcaagtttatgccatcaatattcatttcaaatgcccattagctatgaaagaatagcaattagctaaataacatgtattattaatattaataccattaagaacagacctttatggagcagtacaataaggacttttacacattattctactgaatccccacaataagcctctcgggagttgtcatcattcccattttatagatgatgaaactaaagttcgaatgagctgtatcacatgcctgccaggtggctaagtaccagcaatgctacagaaaaaatagagattaccatctatcatgaagtgtatgtgtccacatgcaatacacatgcacacacataccaaaacacattcaaagacacatcataaacatcctcttttaaaacatcagggaaatatttttcttcatcataaacagctggaggaaaaaattataaaacaataaataatcctgtttcctggtaatcacaaacactagaggcaatgaagcaagttcccaaatgttttctgaaacaagtcagacacaccatcccccaatggcttatatacctggcttttcaaaggcccaacgaagcctagattttcggccatccgctgagcttggctgtcctttattccttcaaaaatgtcaatttgctcctagtaaaaataaatcaaataaacaaaattcagacagtcaactgagaagatttacaacctcaaaagaaaatgcttagtatttatttgcaaatgagtaattaaagtgtggcatctatccagagatctctgagcagggctaccgcagatgcctgtagggtatgttttaattagcagaccatctataaaaaagcccttccaaaaactatataattcttcatggtggcatgctgacaagaaaatctgatgccagttttcacttttaattactatacagatggcattgatgaatatttagtcagttaattttttgacatcttttggaaggtttccaaagtaaggttttcctgcctactagtagttaagtttaaagcctgtcatagataggttaaatattaccttatgatttaaacactctattgatgataattattactgttaccttagctctacaaaatgatattgtctcaaagacaccgagcactgtcactatacattatttcatgcattctcttaacaaatggaatggcctgctttaaataatgtgaactttgaaaacagctaggtgttgttggtaagtctgcatataaagtctcaattcagtttccaaggtaattaacttattatataatattagtgaaaatattttaaaaccaatcactgcagtatgagtacagcaggtcttcaaataacgttacttcattcaaggtcgttttgttataaggttgagaaaaaaaaaaatcaattcccagccaaggccactgtctctgtgtagtctacacattcccctcttgtctgagtaggttttctctgggtcccccggttttctcccacatcccaaatctgtacatgttaggtcaactggcatgtatacacagtcccagtctgagtgggtgtggtgtgtaagtgtgctctgcaatgggatggtgtcccatccagggtgggctcttaccttgcaccctgtgctccagccatcagagaccctaagctggaaaaactggataaacaattatcttacttgtttttatgaaatctttctgaaacgtacatatagctcctatttattttaatgtgtaacattagaagtgtgctggtctttatttaggagttgagtgatgttctgtgagcagaaatatgctataggaacttaactcttgtttatatcaattagcctatgtatggtaacattggtttccttatacatcgtttccattcaagtcgcagtttccaagaacctgttgaggatgctaagtgggtgtttattgtacattatttagacaaagagatttaagaaataaaatctccccttctcaaagggaaacaaaaaaatcattttctaaaagaaataatgaatgtttctggtggaaaattgtaatgtaattttgaccccaagaacccagattaaaaacttcaattttagttctgaaaacttatgtttttctcctcatagctgacgtaggttaagaagcactttatacacatcacctcatttaatccttataatctcacatggtagaaatcaccccatgttcattttactgatttaaaaatgaggtttggagactttgagaaacttgtgctctgattaaatttgacctcagatctctgacttgaaactaatcttaatatcaataaatgagtcaagatttcaaggattgaaaaaaactgatagaatctagacttcataaagattctagtttacatcaagagtactgagagaactcaagacagtttctagttcacatctgctaaaagagaattcattcatctcctaggagagaatttccggatcatatataatattaaatgaaagagagttaaccataagaaatgaaaatatagcagtcctctcccattggttaattcttgaggaagattggatggaaaggaatcagggaggaagaaaaggcaggaagaagtaaagaaggaagggtgggaaaagcaaagataaaaagtccttgaacactgaataccttgattccacccaactttcaactggatacccagaaagaaaaagggctcagcatcttcttaccttaaattgtagagacagatttagtgctcctggccttagactccccattaaatatttaacagcttctacaataacaatcaattaatagcaggtagcccggaatttaaacataccttaaaaatgagctccgggtttgaagcagccacctcttcaatgtcgacgcccccctgggggctgcccaccagcacggggccattgcaggaccggtccatcagaattgccaggtaggtttctctggaaatatccaaggcttcagcaaccatcacctaccacattagtgggaaagtcaaattaattcagcattaagctgatttctacttggaaatctatacaaacttgctacacgaatcaaatggcttcattttcaggctcttacagcccagggagtgagtttgcagagctttgagagttctgctctcatggtgcacacaatgcccattttcacctccttaattttgatcccattaacttgttcgagtgacaggtatttcgtttgcctcaaggaaccttcccactttaatcttcttttttgtccttcctcaagaaactgtgtcacttaagaaataccctagagaagtggctgttattttaatttgagatattaacagtacacatatatattactacactgacttttctcagatttcactggtggaaaaccaagcatgattgccacagacggattcttttacagtatgtctgatgcttcatatgtttgtgtatttctgtctcttcgatcactatattttacttcattttatacttccttttaatttataaaaagaatatttgcttgttcaaaaataatgcaaacgataccaaaaatatataaatgagaaagtgaaagcagcttcctgctgcacagctctacctcaaataaaccctcgggccccaggagtcagggcagatacgagcctaccaggaacctccgtgataactagaaaaaggcaccccttcctctgggaatatgtggtcatttgccagggccatgactagacaggggacaagtgggatggaagaatgtcattcaattccacaagtgagtggggactcactgcctcagccaggtgtccttttgctctgtaggacttgaatttcatgtaacagccccaccaggaaaaaccactgctgacattctagtccttttctatgtatctgcaagcattgcagtaatggaataatcctacatgtggaagcacattatatacaacaggatgcctttcttttttttaatcttttttttttttaaaaaaagacagagtctcactctgtcactgaggctgtagtgcagtggcacgatctcagctccctacaacctctgcctccctgcaacctctgcctcccatgttcaagcaattctcatgcttcagcctcccgagtagctgggcttacaggtgcctgccaccatgcttggctaatttttgtatttttagtagagatggggattcaccatgttggccaggctggtcttgaactgctgacttcaagtatctacctgcctcagcctaccaaactgctgggattacagaggtaagccaccacgcctggcctcttttttaaaatcttaatactacaacttaaatatctttctaaggtcttctctcttcattgtgattacatggtatttatatgacaatatttatttaaccatgttcctgcatttatttatttatttatctatttatttatttgtttattcattttgagatggtcttgctgtgttgctctcaggctggagtgcaatggcacaatcgtggctcactgcagccttgacctcccaggttcaaacgaatctcctgagtagctgaaactacaggcacgtgcctccatagccacttaatttttgctttattttttgtagagatggggtcttgctatgttgcccaggctgatctcaaactcctggactcaagcaatacactcgcctaagattcccaaagtgttgggattacaggcatgagtcatggtgcctggcctgctgacagacatttacatgaacttcaattttcctaaaatgctactttagtgagtatttttgtacatgtatctttgttcatttcttttagtatccctgtagataagtatcctaaaagtgaaatgtctaggttttaaactgtgaatatttaaaatgttgataagtactgtcaaagtgcttgagagaggttgttccaacttacgcacctaacaagaacagtgaaagatatcttggatgtttaaagaatataaaaacaatcccataaataatcagtaatagatgtgaaaacaatgaaagcactaacattgcttttctttctttttttttttttttttgttgagacagagtctcgctctgtcgcccaggctggagtgcagtggcgcgatctcggctcactgcaagctctgcctaccagatttacgccattctcctgcctcagcctcccaagtagctgggactacaggtgcccgccaccacacccggctaatttttttgtattttttagtggagacggggtttcaccatgttagccagatggtctcaatctcctgacctcgtgatccgcccgcctcggcctcccaaagtgctgggattacaggcatgagccaccgtgcctggcctaattgttttgtatttttagtagagacggggtttcaccatggtctcaatctcctgacctcgtgattcgcccacctccgcctccaaagtgctcggattacaagtgtgagccaacgcacccggccacattgctttttttacaagtagtttagtgatgggttccacaaaaaaaagttacagattaagtagcattagattttaactactcagataccacaaaaacacttaagttttaggtcacatgaaatgggataaatatataatgatctaaaaagctataatggaatgaatatagaactcctctttttcaaacttttgttgaatttaccattagttaaaaataaaatatataggtcttcatattgatttatcagaaatggaagttcataagtatataaaaactgtttctcagcacatggtgttagaattagcacagaaccattctgatttcaagttggttgttctcaccaacaatgaaggtcaaaccatcagtcagtgcctaattctcccagtcttcaggttgcttgaaaccgtaaattctttcagaatttctgattgaggggtaggacaatatttgaagcaaaaatacttagccctattctttccttataaaatacagtaacaacttgtcgtttatagaaataacataaagtctgcctttctaagcatcaacattaatacaaacattttaagaaattaagataatcatttcttctaaaactttctctagaagagaaagctgttttaagaaatttgattggcacaaaatacaaaatgaggagtgtgtttggtatatgctttcaggtctactggcataatactgttcattttctaatgcagagttagtttagagaataatacttaatgactttcagtagttattcttagaggcaacacaaaattataactttttaggataagtgtcattcaagagtcctattcttaatcttcaaaaatgttgacagacgtgctctgtattccaccaaatttctatttgtgaagcccagctactgtctgaaacagctcttgcttcacaggaataatgcatgactctttaagaaaatgtcaccaggaaaatgataattatcaagagataattcaagaaattttatacaacaaagaccagtttgttgacatcgtcatgccttccaaatgaccgaggatgacagagtatattaggaagtgttacagagaaatctaaatggaatccacaaacactcatcccggagcaactccattagaaacatttcaaaagagcttcacctgtgagttacacaaagaatatgttgacacatcgtctttgtggagtccaccagtatagaaagctttttaactttctttgacctatctactgctgaatctgtttccttaaaaatatcatgctactggaattgtggtcaggagatgagtgctagcgtacaaactatttgtaacacacccatgaacagagaagattaaaagtacattctcgaattttaaattgattacagagcagtaaccactattggtactgaatcctggaccgcatgatgagtagcactgtctcacaggccctagtactagccccaggaatacataacacattggcacagacttagaaaacaaatatctgatgtgtataaatgtgtgtatgtgtttaaatagcttctgaaataaatttagaatcaaaaggttctataatctggggacttatacttttgagaagatggagtagacatgtttttccctattcttcccgctaagtacaaataaaagccttggacatatatatacataaaacttaaggtgactctgaaagttatagagaagaagggagactagctagggagcttgaggtccaaggaagcgtatggtagtgagtctcctatgttttctttggcctcataaatctcaggcagggtgctgggtgctagagaagccagcaacccaaaaacattaacaggcacagacaaataaatctccaggctcacatggtttcactagggaacttcaccaagcatttaaaaagaaatcaacaccaattaacaatgagcatgttggacactgaaattaagaatccaatgccacttgtaattgctttaaaagagaacaatgtatgtgtaagactgacaaaacatataccaaacgtatatgctgaaaacaatacaatgctgatgaaataaatcaaaggagacctaaaagaaggagagacatatcatactcatgggttgcaaggcttaacataacaaaaaaccaattccctccaaattcatatacaggtttaataagattcctatcaaaatcttagcaagattttttcgtaaagataaaattgttctagattgtacataaaaaggtataggaactagaacaggtaaaactgttttggaaaagaagaataaagtgacaagagttattctactcaatttcagaatttatataaatacagtaattaagactctgtgatattggtggcgggacagccacaaagatcaatggaacaaaacagagaaccccaaaacagacccaaagaaatatgcccagctgaattttgacaaagatgtaaaagcaattcaatggagaaaagataagccttttcaaaaaatggtgcaggagtaattgaatatcatagcccttttgccccttaaaaaataaccttgacctaagtctcacaacttattcaaaagtcaactcaaaatggatcacaaacctaaatataaaacataaaactataaaacatctagaaaaaaacatgagaaaatttttattatgtagggcaacgtaaagaggacttagacctgatactaaaaaggtataatccataaaggaaatattgacgtattggacttcatcaaaattaaacacttttgccctgcaaatgaccctgttgaaaaaatgaatatatacgttatatagtgtaacagataatacttacaaagcacatatccaacagtggactagtacctagaataactcaaaactcaatagtaaaaacataatctaattagaaaatggccaaaagaaatttgctttgtctcttcatgctgctgttacaaaatacctgagatttggtcatttataaaggacaaaaatatattgtttcacagttctggaggctgggaagtccaagatcagtgcaccgccatttagtgatatggcctttcttgcttcatcctcacatggcagaaagtggaaatgcaaaacaggtctaagctagttcccttcagcccttttataaagcactaccagggatgtccaatattttggcttccctgggccacaatggcataagaaggattgtcttgggccgcacataaaatacactaacactaacaatagctgagctaagaaactaaaattgcaaaaaaaatctcataatgtttagaaaggttacaaatttgtcttgggccactttcaaagccatcctgggatgcctgtggcctgtgggccgtgggttggacaagcctgcactaatccattcatgagggcagagccttcatgactaatcacttcccaaaaggctctgcctcttaatgcaaaccacaatggggattaaatttcaacatgcattttggagggagcattcagaccatagcatccatgaacagacaattcaccaaccacaatctacagatggcaaataagcacatgaaaagatgttcaacatctttagccattagggaaatgcaaattaaaatcacaatgaaatatcactacacacccataagaatggctaaaataataccaccaccaccaaatgcgggctagaatgtggagaaccctgaccacttacacattgctgatggcaatgtaaaatggaacagccatgctggaaaacattcatcagtttcttaaaaaaactaattatacaacttccacataacccaacaattatcccccaaaatgaagatttatatttataccaaaaacctgttcatgaatgtctagagtggctttatttgtaatagccaaaaacgaaccaacccagatgtctttcaacagatgatggttaaacaaactgtggtaggtacatccatatcatagattgctacatagcaagaaaaaggactgtaacgggattattacacattgtatgcctatatcaaaacatctcatgtaccttataaatatatacacctactatgtacccacaaaaattaacaaaagaaaatggaactaaatactgataaatacaacaacttaagagttttccacaaaactctccctgaaaagtaaaaacaggatgtcaccactgcagtgtcctgcagcatggtgcattggtagagaccactgatctgtgacgctatgtcaacagagcagacagctgccaccccaaaatgcaggaccctaattcgctgttaggacaggatcttctaaccatggatgcttttcagggctgacacatgtgatctgtgtagttgtaaagggatttaatgtttagctatagctgtcttgaaattttaacacgggtccctgcctttttatttggcactggattctgcaacccaggtagctagttctagtgtctggatacacaaaagggatggtgaaaggtagattggcaggagggagagttaggttctggtctcagctctaccactcacaatttcatgactgaggcaggccactttcctctgggctttattttctatgtgtggatgaggggtgtgtgtccacatgctatacatacttgggtacttcagctgaccttcctaatgcaatatacccccagcaataaaaatggctcaaaattacagtcatcctaaaataaggaatggggcatttagaaaaacaaccacaataggtaattctgacagacacgcctggggttgagggccactgtgtgggagcagcgaatgtccctcactgagtataaggctgtcacagcaagcgcttctcaactaaatagaatgcatctgtgttctcagagggaaagccattgctcggtcactcaccctcacccactttttgctaaatgctaatgataataaataatattactatcatagagccctttttatttctcctccaagacatactacttactaaacagattagatgagctttaaaaaataaaatggcacactgccaaagagcagtacttcattagattctgtcaaaaactgaaggatggttttcttttctattttttaacacatatatagaaaatgacccaaagtatccatattaccttgttaactttcacaccttcttttggagtttgttttgtcgctagattgtacccaatcatctgtttagccagctgtcccacaacattagggctaagagaaagagaaaacaagcagaaaatgaatgtttgttgaaaatcatttaaatgagagtccttacacagagcctcatgtctacactgcaaagggttcaccttcaccctcacaaaatccatgagtctttctgcttatgtgctgcgtgtttagcactgtactagaggctcactgagagcaaaataaaagtgagttcatgaatgaataaatgaaacaaaagatgctttgtgacctcttcacccaaaaaagttacagtcatagtaaagagagaatgctgaaatgcacaccagattcagataagggttgactgaagatccgacagtggaaaactggggagatattgaacaatgagagggaaaggaagagggtaaagatcaaagtaaatagtaaaaaggtgtgtgacaggaacagggaggagaggaaagtgttcagtgctaggagatgcaggagatgaagttgaaaagacaggctcaaataaaggaaggcttggactatcagaggggaggtaccccagatgccactggtaatggggagtcccttcaggtccttgaatagaggagtgacattatggaagtagcatttcagttggaagtggtatcatttccaacatttatgatgaatcattgattgtttaggacagaaggactgtcaagttttcaccaattagtaagaaaaatcattttgtgggggcagaaggaaaactagggcactgccagagccctctacctatgatttcagtttcttctagttgctttggcccgctcctaccccaccacaaccaacctcagtgtgcctttcaatcttgagcaagatcttccataactgcttggccaaaagacaaggaataacaacctccagacttactcttttgttaaatgaacacctcctttcaaaccactattgaagacaccttttcctcttcctccagctaagatctgggcttttaaaacaatttcttttgcatctgaaaaagaaaaatccagagttggtagctgattttaaattctttttttgttttttaagcaataaggaaagcaataatggcacataacttccaagtaactggtaaaagctctctcaaactaactttgaaaataaatgcaatgaagaacttcaaaaaaacatctatgagcctaaatacaaagcttgtttactgaggatattcaaatgcttcctaccagtttaatcatctaatacttgaccttcccaagggaaagcaagacatgtgttcccttgctcttttgagtgtgtcagaagaagctaaataaatcctggaaggaggtattaattttactgtgtaatggcactcccatgtggcagaggcaccagttggccagtaagaggagctaaccatcagagatgtcaaagggaagactggattatgcgggggaaggtttaaagacaagacacaaaggtcatagttaataactgcattattggaaaccaacagttttctgagcagttgttctatatactgatagggttgggaaagggaggaggaaatggattaaaactaaaagcaagcaatattttaaaatcattggcaaggtaacaaaatatcctgggggaaagtggttgtggaatctttgtttctcatcacactccacgaatgaaagaactctctaatcttgactttttagacgagagttattaacacaaatatcttcccttgcagggaagttgggtgcatgaagtagcccagtgacaaatggggcctttagcaaacagggtagctcccctccccaaccaccaaaacaaaacaaaacaacaacaaacaaaaaactgcctccaaatcaaatatgtttaataaaccaaatagcacacaactgcagaccacagctgatatcctctgtttgtgagtcatctttatttaaaatcacagaacccagctgatcccctataaggccatgagagtattctggttcagtataccagatttagaatctgcaaacccaggtttcaatctggccttcatccctcacccagctgtgtgacattaggcaagttacttaatgtctctgaaactcggtttattcaactgtgaaatgatgacaagggttgttttaaaaattaaatgaacacacatgaatgctttatcccagagcctgaaaacttgtgattaattaaaaactattgcctcgaccagttagttcatttattacctttgtatattgtaaagaatgaaaggaatcattacagagatggctaaaccaaaaaactaacaagcgctccattaagtttggttatttcagctattactgtcactgtcatcatcattgttacccacaggcaagcaggtaaaggttcaaacggaaagagctgtggaaggttttatcatcaaggcaatggggagctacagaagtattttacagaaggcattcagccagctgatgtcacaccattgaggctccttcactgccttcattggttagtcttcttgtctcctatatttgcttacactcagaaagctgaagcccaccttcttctcagaagcaaacacagttttttcttagaaggctgtcctgtgtaccctctggcaataatttctgccctggatacgaaccatcacaacattggtcaagccctgtcttataataaactggtttccatcaagctgagtagaagacaaattaattgtcagaaactcacaaggaaagcaaccaagtaaaatgaatacattgcatatttagcttactgcaagaacagtagtaagagcaaggatattggagttaaacagacctggttaaaatctccaactctacctatcactttctttgtagagaagaaacaactgagattcagaaaggtaaaagtagcatgcccttctgtaaagtagtcatattaaagaagtctacagtgtaaggatgatgtgaagaataaatgaaatacagtaaagtgcctggcacatttttttaaagtcaaaatatgatagctatcaacattataataattttcagcaattaagaaaaaatggcacacaggaagacatttcctgtttttctttggaagacatcaagtggaaaaaatactttttgctgtctactcaaatttttaattgtgatcacttcaaattctttacataactggcattccattgccattatcatttttcatatccttgtcatcctgaagagatgctttcctctctgagctttccagcagcaaaacttgaaagccagagagaatacctaattgggcattgttaattggcactacataggcttgattagatcagctttagtcactaaccatcaagacacagaaagagttgtatcctcaatgaagtgttgtcaattaaacgtgtcgccatttgacctccagtcaaagtattccatgcaaaacagtgttggtagaacaagcaaccagttcagagactatgaaaccagagatcaggacaaatagaaaaagacaacaacctacgcacatctgcaacatacaccccaggccaaaaatgagttcactaaaatcatctcttctgattacatctcaagtgctaaatcaatatagtaagtcagcaagtcagcagcccaaagtaaagcaagtttttctcatcttgagaaaaactctcatgaagtaatttaattcaaggcttatttactcaaggtgctgaaaattaagatgacaaatcccactcaacagtaactcgtctcttcattcagtatttaccaaattgattcacatgtactaaatgtcactgtttctatttatttaaagatctgatctctcccaaaactcaaatttctgtttttatttaacattgcctcttgccccaatcctgaacggtattagaaaagaaaaaaaaatcccatatatgaaatgcaatttttgtctgaataagacgacttaaccatcctttagaaaaacaagctaaaaggacagaggaaaaaattaactctaatatgagttggggttttatttttgttttttgttttagacagagtctcactttgtcacccaggctggagtgcagtggtgtgatcttggcccactgcaacctctgcctcccgggttcaagcggttctcctgcctcagccttctgagtagctggggttacaggcacatgccaccatgcccagctaattttttgtatttttagcagagatgaggtttcccatgttgctccagctggtctcaaactcctgagctcaggcaatctgcccacctcagcctcccaaagtgctaggattacaggcataaaatagattttatatagaagtagacaacaacctagacattgataattatattattggactctgagttggtataacttgggtctggataactccaaagtctttgctcttaattgctatttttatacgcagtagcctaagtatgcaacgtcttcactaaattttgttcctttcttagtgagtttctgaaaataaccagtactcatggttaggttttcactcagtttaataggaaccagtttattagaatttacatatattttagtagaaaacactgtaagacatatctgacaaacttataaatatgtaagactctcaaacacagtatcacttaagagaacaatatttagagcgatttaaaaagtctaagcaaaaccttactctgtggtctttttttagtctatcagctgaattataacaatgcttttacaaatattttcttttcattctttaccacaagtgttattctaattataatgcagttttatagcaatttttatagatccccaatagtcacatgctagataataaacattcttggaagcagtaggtctaaagggaaaaaaatcaaatcattaagaaaagcataatctaaatagaatacacatttttaattaagcaagctttgtaaaatgtggttcacttaattttcttagagatggctttctgaaaacatatttacacaaagtaatgctcacaagacatatttcagagccataataggaatcatagtaaatgtctgaaatgttaatcaaatatattgacaaaagtaagttattttcaactattttttaaaaacagttcagtgatgagtcaactatttgtgttactgagctggtttttattcagcattgctcttttctaaattataatactttcctaaatgctaaatgtatcactgatactgcaatgagatgactactacaatgatcatctatttggagtcaataatattggacttgcagaaactgatttctgtggttcactgactggagcaaaattggaatatccagttctcagcacaactgcatcgtgtaatatgtagcatggcaatcaccttccctgagagttgatagaattcctaattgagaaagttaaattgtatttcagaatttcagatttacctattaccagaaggcaaggagaaggcaaagtggaaggcaagagaagagtcaaaaggtattgtgtaaagatgaactttaataaagaatatacaattatatagagataagttagaggccttggtgccaatttctcaaaggaaatgagctcacttctatgtttgcgttacgacttcagaacccaaacataaaaatagagagttaccaatcttcaatcattactatgatatcacctatagaatgacacatatttcctcaagttgtaactgggtcaatgggaataagatgatactgtaataattctccatatgtcaaaaggcatctttgagactgaaataattatttcagctttcaacatgtctgacatggacttttcaaatttgggacagagagtttcaaacacacagcacattagaataaaccatttcaccattggtcacatcatttgactgaatgagactggagatacatggctctccagtagactgctgcccatcagagatttgaatcgtgtatgtctaaaacagccactttcaagtataagtacaagacagaaatagaaccatctccaggacaaggattttatgatacaaataggaagttatccagggagatattatttcaaatcaagaaattcttgactgataaggctttcatgtaagttttaaatctaaaacttccctttgaatatgattccctattatgaaaaaaaatcctttctttggatactgtgggggcatgataaagccattttgaagagtttgattatttaaaaatgataatatcttaacaaaaaatgtatttatgctttcgacggaataattttaattttagtccctataaaaattcctaaattaaagtttattaaatcacagttttttcatatttgccatatgcttaaaaatattgtatatttattactatattatgggccacattaaaatctgtaatataaattaggctactcctctgatcttgtcactaatcttacttactgctttcataaccgttaatacacattttgttggtgataaaatttttaaaggtaaataaaaattatctctagaaaaacccaattcagttgtaacatcttactattctcagtaaaagatacaatcttgctcttttcatgtagtttaatactagtaagccaatcttacattgtgtcaattatattaaaagatatatttctacaaaaaagccttaggacagaactccctaacactgatggcaaaaaaaaaaaaaaaaaaaaaaaaaaaaaaaatgcccatgtgacatcattcaacacctgtaactaattaaagaatttctaacattgtaagaatgaaaccacaggacattaaacaaatcttttgcaaatgaagccacttgaagaaatgacagtttttcagaaaaatacaagtttcttcaaaagaacaaacttccagaagaaatctctactgattaattacaggacaaagcaatcctattatgatatacattgacagtaaaaatacctgtgtaacacttgtaatttcaagaggtgctggaaacagtcatggaagatgaaaagcatttatgaaagccaaaagtatttctactgtattatgtgtatgtatttaaaggaagttaaggaaaactagctataaaaaaatcatgtctccccctgattttcaaacgaaagatgtgagtcagccagggttcaattaaggaggcagaactactatgacttatagacaagggatttattataggaatcgaagcttgcacacttacaagaggagctgagaaaaggcacgtctaaaagtgaggttggagggtcctaggagtccccagccagccaagcagaggaatcagcacctccagatggagaagtggatggcaaaggaggagctggggaaaaggacttgggacttgctgccaagtgctacagtttggatgcttgtccccacaaaatctctcgttgaaatctgacctccagtgttggaggacaggcctaatgggaggtgcttgggtcacgggagacgatcccttatgaatagattacctggaacttaaaagaaaattaaatttaaaaataaataaataaatgaattacccatcctcaggtactcttttacagcaacactaaatagactaagacaccaagcatctcaggatgggcctgggtccatatggctcagcaggatcagcacttgggacaaacagctggacacaatgcagagaagagcaagaaaaggctggagcctcttgctaacatctccacatctgtctgtcactacctaatcacaatgaactgcagggagtaatcacaaattctgtgcaaactcctcttttagtcaactcaaacccaaaactacacagggaaggggattctggaaaacgcagttccagctaaacaaggtgacacagtacaagtcatcacacctgatagctataacatctgacagcagagcccacaagtgttgcgggttgaaaatgaacagctctgaaacgtttctgagttgcttgagaatccacctctcctttagttgcatattattgaaggctacttgacattaaggggattctctcgtcgaccataaccagtgatgaggaagggaagaacaaaaggtggcaacagccagaacagctcttggtgtgcacacactcatatcctgctggtggaacataaactcatgaaggtttcattttcagagccaattggaatgaccatgaaatttaaaatgtatgcaatatatacactgtctggctgcacctatatttaaagatgttcgtttcacttttacagcaatattactaatttcagagatcatctaccttcttgaatagaaatcttgtattttccttattttctgttatttaaatctgttcctctctcagaccctcctccattggtgataggcgccctcacaggcaatcacaactactgtccagaatctttgccctgctgtctgttcactgccatcattcactgcctatggtctctggaccatactcctgccagttttcacactaaacctgagacctctgtgcctgcaaatcaccaagccctgctgcccagtcgtcttcttctcatttagacacatcatccatcaggaacccttcacctctccaacctgttctgctctttagaggaactcattctccagacagccaatgcagactgaaatcaaactccctctcacagactcctgagcccagtacaaatcaaggattcaggctgggcaacttatttcatacagctgaaaaatgcacaacagttaaaaagtacctggaatctttgaaggcaattaggagggccatctgcttagggctcacagaaaatcctttgatagcgcaatcctacttccatgaaaattgacaagagaactaaagattttcattgcaatgtagttataatagtgaaaaaactagaaataatccaaatgtccaccaacatttggacactattgggaaaataaattttatgtatccaaataatgaaacaataaaacaccatatgtacagtcattaacaataattaagtatactttttaaaattatactttaggttctgggatatatatgcagagcctgctggtttgttacataggtatacatgagcaatggtggtttgctgcacccatcaaccagtcatctaccttagatatttctcctaattttctgttatttaaatccgttcccctctcagaccctcccctacccccaacccaccgacaggccccagtgtgtgatgttcccctccctgtgtccatgtgttctcattgctcaactcccacttatgagtgagtacatgcactgtgtggtttactgttcctgtgttactttgctgagaatgattgtttccagcttcatccatgtccctgaaaaggacatgaactcatccttttttatggctgcatagtattccataatttatatgtgccacattttctttattcagcctatcactgatgggcatttgggttggttccaagtctttgctattgtgcacagtgccgaaataaacatacgtgtgcatgtgtctatatagtagaatgatttataatcctttgggtatacgcccagtaatgggattgcttggtcaaatggcaatttctagttctagatccttgaggaatcgccacactctcttctacaatggttgaactaatttacactcccatcaacagtgtagaagtgttcctatttctccacatcctctccagcatctattatttcctgactttttaatggttgccattctaactggcgtgagatgatatctcattgtggttttgatttgcatttctctaaagaccagtgatgataagctttttttcatgtttgttggccacataaacatcttcttttgagaagtgtctgttcatatccttcacccactttttgatgggtttgttttcttctttcttgtaaatttgtttaagttccttgcagattctggatattagccctttgtcagatggatagactgcaaaaaatgttctcccactctgtaggctgcctgttcactcggatggtagtttcttttgctgtacagaagctctttagtttaattagagcccatttttcaattttggcttttgttgctattgctttggcgttttagtcatgaagtctctgcccatgcctatgtcctgaatggtattgcctaggctttcttgtagggttttgatcgttttaggtcttatgtttaagtctttactccatcttgagttaatttttgtgtaaggcgtaaggaaggggtccagtttcagttttctgcatatggcttaccaattttcccaacaccctttaggaagagggaattctttccccattgtttgtatttgtcaggtttgtcaaaaatcagatggttgtagatgtgtggtgttatttcggaggcctctgttggtctatatctctgttttcgtaccagtaccatgctgttttggttcctgtagccttgtagtgcagtttgaagtcaggtagagtgatgccttcagctttgttctttttgcttaggattgtctttgttttaggggccctttcctggttccatatgaaagttaaagtagtttttactaattctctgaagaaagtcaatggtagcttcatggggatagcattcaatctataaattactttgggcagtatggccattttcacaatattgattcttcctatccataagcatggaatgtttttccatttgtttgtatcctctcttatttccttgagcagtggtttgtagtcctccttgaagaggtccttcacaaaccttgtagttgtatatctaggtattttattccctttgtagcaattgtgaatgtgagttcactcatgatttggctctttgtttgtctattaatggtgtataggaatgcttgtgatttttgcacattgactttgtatcctgagacttcgctgaagttccttatcagcttaagggaattttgggcagagacgatggggttttctaaatatacaatcatgtcatctgcaaacagagacaatctgacttcctctcttcctatttgaataccttttatttccttcccttgcctgattgtcctggccacatcttctaatactatgttgaataggagtggtgagagagggcatccttgtcttgtgccaattttcaaaggaaatgcttcctgcttttgcccattcaatatgatattggctgtgggtttttcataaacagatcttattattttgagatatgttccatcaatacctagtttattgagagtttttagcacgaaccggtgttgatttttatcaaaggccttttctgcatctattgagataatcatgtggtttttgtctttggttctgtttatgtgatggattatgttaattgatttgtgtatgttgaaccagcttggcatcccagggatgaagcctacttcatcgtggtggataagctttttgttgtgctgctgaattcggtttgccagtattttattgaggattttagcatcgatgttcatcagggatgttggcctgaaattttctttttttgttgtgtctctgccaggttttggtatcaggatgatgctggcatcataaaatgagttagggacgagtccctccttttctattgtttggaatagtttcagaaggaatggtaccagctcctctttgtacctacggcagaagtcagctgtgaatccatcttgtcctaggctttttttggttggtaggctattaattactgcctcaatttcagaacttgttattggtatattcagggattcaagttcttcctggtttagtcatgggaaggtgtatgtgaccaggaattcatccatttcttccagactttctagtttatttgcacagaggtgtttatagtattctctgactttagtttgtatttctgtgggatcagtggtgatatcccctttatcattttttattgtgtctatttgattcttctctctttttttattagtctggctagcagactatctattttgttagccttttcaaaaaaaacagctcccggattcattgatttttttaagggcttttcgtgtctccatctccttcagttctgctctgatcttagttatttcttgtcttctgcttgcttttgaatttgtttgctgttgcttctctagttcttttaattgtgatgttagggtgtcgattttagctctttcttgctttctcctgtgggcatttagtgctataaatttctctctaaacactcactgccttagctgtgtcccagaaattctggtacgttgtgtctttgttctcattggtttcaaagaacttatttatccactggcttgaaattcacaccgccagcacatcagtctgaagtccacctggggtgcttggtgggaggaggggcatctgccattactgaggcttgagtaggtggttttcccctagtagtataaacaaagctgcttggaagttctgactgggcagagcccaccgcagcgtggcaaagtcactgtagccagactgcctgtctagattcctcctctctgggcagggcatctctgaaagcaaggcagcagccccagtcagggacttatagatcaaactcccatctccctgggatagagcacctgccagaaggggcggctgtgggcacagcttcagcaaacttaaaagttcctgcctcccggctctgaatagagcagtggatctcccagcacactgctggagctgtgctaagggacagactgcctcctctagtgggtccctgatccctgtgcccccttactgggagacacctccagcaggggtcgacagacacctcatacaggagagctccggctggcatctggggggtgcccctctgggacaaagcttccagaggaaggaacacacagcagtctttgctgttctgcatcctccactagtgatactcaggcaaacaggttctgtagtggaccgccagcaaattccagcagaaatgtagactgtagcagaggggactgactgttagaagaaaaactaacaaacagaaaggaatagtataaacatcaacaacagggacatccactcagaaatcccatccaaaggtgaccaacatcaaagaccaaagttagataaatccacgaagataaggaagaaccagtacaaaaaggctgaaaattccaaaaaccagaacacctcttttccttcaaaggatcacaactccttgccaccaagggaaaaaaactggatgaagaatgagtttgatgaattgacagaagtaggtttcagaaggtgggtattaacaaactcctctgaactaaagaagcacgttataacccagtgcaaagaagctaagaaccttgagaaaaggttagatgaattgctaactagaataaccagttttgagaagaacataaatgacctaatggagctgaaggatacacaagtatcaatagctagatcgatcaagtggaagaaaggatatcagagattgaagatcaactcaatgaagattacagaaaaaagagtgaaaagcaacaaacaaagcctccaaaaaatatgggactacgtaaaaagaccaaacctacgtttgattggtgtacctgaaactgacagggagaatggaaccaagttggaaaacactcttcaggatgttatccaggaatacttccccaacctagcaaggcaggccaaaattcaaattcaagaaatacagagaacaccacaaagatactccttgagaagagcaaccccaagacacataattgtcagattcaccaaggttgaaatgaaggaaaaaatgttaagggcagccagagagaaaagtcgggttacccacaaagagaagcccatcagactaacagtggatctctctgcagaaaccctgtaagctagaacagagaggccaatattcaacattctttttctttttttttttttgagacggagttttgctcttgttgcccaggctggagtgcaatggtacaatcttggctcgctgcaacctcctcctcctgggttcaagcagttctcctgcctcagcctcccaagtagctgagctgggattacaggcatgcaccaccacacctggctaattttgtattttttagtagagacggggtttctccatgtaggtcaggttggtctcaaactcccaacctcaggtgatccacccacctcagcctcccaaagtgctgggattacaggcgtgagccaccatgcccggccctcaacattcttaaagaaaagaattttcaacccagaatttcatatccagccaaactaagtttcataaacgaaggagaaataaaatcctttacagagaagtaaatgctgagagattttgttaccaccaggcctgccttacaagagctcctgaaggaagcactaaatatggaaagcaaaaacccggaacagccactgcaaaaacataccaaattgtaaagaccatcaacactatgaagaaactgcatcaactaacgggcaaaataaccagctagcatcataacaacaggatcaaattcacacaaaacaatattaaccttaaatgtaaatgaggtaaatgccccaattaaaagacacaggctggcacactggataaagagtcaagacccatcagtgtgctgtattcaggagacccgtctcacgtgcaaataggctcaaaataaagggatggaggaatatttaccaagcaaatggaaagcaaacaaaagcaggggttgtaatcctagtctggggtaaaacagactttaaactaacaaagatcaaaagagacaaagaagggcattacataatgataaagggaccaatgcaacaagaagagctaaccatcctcaatatatatgcacccaaaacaagagcacccagatgcataaagcaaatgcttagagacctacaaagacacttggactcccacacaataatagtgggagactttaacatcccactgtcaatattaggtcaatgagacagaaaattaacaaggatattcaggacttgaactcagctttggaccaagcagacctaatagacatctacagaactctccacccccaatcaacagaatatacattcttctcaccaccacattgtacttattccaaaactgaccacataattggaagtaaaacattcctcagcaaatgcaaaagaatggaaatcataacagtgtctcagaccacagtgcaatcaaattagaactcaggagtaagaaactcactcaaaatcacacaactacatggaaattcaacaacctgctccggaatgactactggataaattaagtatatttttaagtgtaaatgtcagaaaatgcccatgcacaaactaagctttaagctgaccttaatgactagcattttttaaaaaatacacctgtaaacagttacatagtcgtaataaaatctaaataaccaaggttgggtgtggtggctcatgcctgtaagccactttgtgaggccgaggcaggtgggttgatttgggaggctgagacaggtgggttgcttgagcccaggagttcgagacaagcctgggcaacatggtgaaaccctgtctctacaaaaagtacaaaaattagcctggcatagtggcatacctgtagtccaagctactcaggaggctgaggtgggaggatcccttgagcccaggaggttgcggctgcagtgagccatgattatgtcactgcactctagtgtgggcaaaagagtgagaccctgtctcaaaaacaaataaataaatgagcaacaaccaaactattaactgaggttaccttaagtggctagggagtagtattatgggtacaacattatatcttttctatgttgacttaattattttgcaattatgtgtcagaaaaataaaaagagtttaaaagctgtgaattaaatgtgggcagttaattcatagtagtttgtcttgaatatttaaatactcatttctgtatcagcctttaccattttaccacatggggtcggggtgtttatatttgaggaagcctctagaagatatcttaaggacacatggctgaataccttataacatgacctcctaaagagtcacgcaagaaaactgggagtggcaggaaaatgttttgcccttttaaaatattagtgagcacttacttattctatgggaattcaaaaaatttttttaaatgtcatggtcattgccttttgtaaacttaaaattgactggaagaaatagacacaaacaaattactgaaaatttttaatttataataagcattaagaagcaaattaggaaggggaaatggtgtcaagtaaagctgagaaggaaaaaggacggaagaactattgatatggtttggctctgtgtccccacccaaatgtcatctcaaattgtaatcccctgttgtgaagggagggacctagtgggaggtgattggatcatggggatgatttcctccatgctgttctcatgatagtgggtaagttcttacaagatatgatggtttaaaagtggcactccccacttcactctctttctctcctcccagcttgtgaagaaagtgcttgcttccccttcgccttccaccatgattgtaagtttcctgaggcctccccagccacgcggaactgtgagtcaattaaacctctttcctttataaattactagtctcagggaagcagtgtgagaatggaccaatacagctataaagagaagagtacttggccaacgtcatgaggaagagctgtgagacttctaggaagatgggactggagagcaaggacatggagtgaaaaacaactaaaaaaaggctactttgcttttctatttatttctgtttggctttcatggtttgctgtttaaactagaaatcactatagcaccacttcaaataaagcagcaaatcatgccaggatcctgcactataaatcattcaaatttgctatttcagatattcagaaaacttctacagattaaagtttatttccctatgttcaagaacagcatataaatagaaaatacattgatcatctttgttaaatttagatattttaccccaaatacttttaagagctctaataattttatcatgccagtctcaaaacagctcccaaccaggtaagctaactctcagataaaacagcccccagccaggtaagctaactctcctataaaagttcctcaaggggtcagtgagattcatactaagcattatttagtagcaacaataataaagtatacgctcccctcctcccatcctgcaaagaaacacatattccatactttaaatctgctataattccaaatgctagagatacagaattccagacaacagcttgatgttgttgccataaaaaggaatccaggaggcatttgtcttcaattttaaagtttgtaaagtggtcaatgacatgctggagttaagcagaagccaggaatgacctaccccaagagagatgaaagatctcagaaccactttcccatgatacacacatctactgaggtccagcataactgttatgctgctttcaaattgcactgagttttaaattgcaatgtcttgctcttttattgcctgtcttgatgcattcattgtttttgaaatctaagtctattgctcgaatgttaaacacagaggggactttagattacatcctggaggatgaaactgagcagtatcaatgaacttggaagagtttatatttggctttcaagggttgtgaaggcctgagaaatagctatttccttttctctttatgccactttctttggtttcctccttctctccttccctgcctcatgctttcttcctttctccctcctccctcctttcctctctccttttcattcttccttttcccacctgcttccctgcaatacttccaagttatttaatttgcatgtttgactatatctcagataactaatttcagttccagcagccagagagatccacatttacttcaaattctaccctccattacactctcccacagaaccactcccaaataagaatgtatccacttaaatccctgtgaattggaacactcattatcaatgtgctacacctaaccacagaagccataaaacctgaacctactttcttggactgttttcaaaacgacatttctgattatatgtgagcattcaaatctcttctggcactttctgcatcttatttttcaatgcctggcttgagctagaattcatactgggggaagtcaggccaagtgttataaatgggaaatgagggaattaacaagctggtataaattttacttcttggagtaaaagaatacaaaattttttgacttgagtttggaattataccacccaagacagcacaggaaaatacttaagagctagcatccatatctggtaaaactgaaataaaatttggcagcttttaagtagttctccaatggtattagtgtggcacagaaatcaagtcctgtttcatatgaaccaagcagtcctacaggaggataccctttgaaattccaatcattacaagaaatttgcactaatgattcatatttcaggccgggcagggtggctcacacctgtaatcccagcactttgggaggccaaggcaggtggatcacttgaggccaggagttcgagaccagcctggccaacatggtgaaaccccgtctctactaaaaatacaaaaattagccgggcgtggtagcacacgcctataatcccagctactcgggagactgaggcagaagaatagctggaaccggggaggtggaggttgcagcgagccgagattgtgccactgcactccagcctgggccacagagtaagactctgtctcaaaacaaacaaacaaaattagctgagcatggtggcaggtgcctgtaatcccagctacttgggaggctgaggcaggagaattgctggaaccggggaggcagaggttgcagcgagctgagattgtaccactgcactccagcctgggttacagagtgagactccatcccaaaaaataaacaaacaaaaaagattcatattgcatcatcacagctggaaagctagcatataagtctattcctcctatccacacacagcttgctaatatggctaatgttttttctatacccccacattctctgctatggtctgaatgtttgggtctcttgtaccccaaaattcataagttgatatcctaacccccaggtgatagtactgggaggtgggggcagagacctcctgcatgggattagtgcccttctaaatgggaccccagagagttccctcatcccttctaccacgtgaggacacagctagaaggcaatatgtgttaaggagaaagcaggctcgcctcagacactgcatcagccttggtcttagacttcccagcccctaaagctatgagaaacaaatttctgttgtttataggccacccagtctctggtatttccttacggcagccagaatgaactaagatactccctgaacacatagtgttttactctattttctactttagttttcagcaacatggacatccagaagtaaacaatacatctatagaattacctgaaatactctccttcgtcctcaagcactggtgcccttaaatccagctgcagcctcttccaggttcctgaccctttctcattgcctcccagcaggaggtggaacagtctgtcataatgcataaacatgatttgactgtggggagggggcagatcttgctaccctagaagaatttcccaggatacctgtccaaaaagctaaaaacagaataactccagaaaagaagatgtcctagccttatgcaaagggaacaattttcacgaatcaactaaattaacactgacttgggaatgctaccaagtctaacaaagcagatgccacctctcctctgaaggcccttggagttcaaaggagatgctacagcaagggggatccatgaagccagggagagattctgtcaaacctaatgaagccactctccagttttgctaatcacaccccttacaccgcctccagtatgaaagtttctaccgaaggacgacacagcatgatgcaaaacaaaatcgcctcattctcctgaaaatgaccagtaccaggcacatagcaggccctcagcatacggtcattcattcacaatcatcacttcctttactctatgaaatcataatcacagtgtttgctaggagcttactgaaaaataagatttgtgctgagcgtattcactatttctatttagcaaatgacccaattgaagttaagggagtttcctggagtcatacagctaggaagaaacagagttgagatttttaagccagaaagattatttgagagactgtgctttaacttcctcacatagagccttattactgatttttccccaatgttctattattaaaatttccaatcacatagaaatgtcaaatgactagtaaatatccacatataacctagatctacaactgttcacattttgtacatgtgctttgtcacatctctcaatccagcacaacccatcttattttttcatgcaattcagagtaagttccgtgcatcagtacagttaaactcttcagtatccatatcagttattagagtttaaaaatattagagtttaaaaatattaatttataataaacattaagaaccaaataaggtacagttcctttggggaagaggtaaaatttaatttcagtgaaatacccaaatctcatgtgtaccaatcaataagttttaacaaatgcatatacttgtatgactcaattcccaaatcaataaatctattattgtttctgagaacatattacaagagtatccttaggacaaatgagcgaaaatattgacaatagggatcacaagtctcttcctaaatacttactgagactaagcataacaaaatatttaatttatacaccttagcacaaagcgcaatgtccaatgcctggcctacaagaggcacccaacaggtatgagactatccaaaggcgtataaaaaaggaatcagcttcccccattaccacttccaaatcagaatactgcttgaaacactcctaaatcagtcacagtcaattatatgcaaaatactgagttcaaatgggaattttttttaagccatgaacatagtaactctttagaaatagaaacaattcattatttatatataagttttttatagtaatgatgttgtgtaagctcagtggaaattatcaaaaatagctgcatccacaagtttccttgcaccacgcttgcccaagtatttctgtgtggctcttccattttcaacaagggattgaattttcctggaaatacttgcaacctccagaaaagccaggatgatacctggagcttaagactgatacttaagcaatgaagtgacgaaaacgactatctttaaccaaaagcttttctacgctatcaatgtcactgtcacctgcctgaagcttaacatcatgggactccagacttttgataagcctgcaggatttttgaaaggaaaccaccagaaagtacttagaagataaaagccaaaacatatctgtggtacaaactagagtacattactttttgcaaactttagaaaatatagacacaaatgtctaaacaaagtctgaaatgatattaatataaagcccacatcaacagtggttatctatagggaataggggttgatctttacctccttctttatagttttgttataatctgcgttctttacaatgactatttataatgagagaaaaactattttcaaatttaaataaaagatgtttctttgacctggtaagaggagtaacagtacattgttatgagggggaaaagcttagcatagtgcaaaatatataccactaaatatatgtacatatacaaatctataactgaggataaatctggaatgaaatatgccaagatattaactctgattactggtagagaaaggttgtaatggataaattttttcttttttttttaaactgcaaatttgctacaaggaacgtatattgtatctgcaaatggggaaaatgacagttatttttaaataagcttattacgtattagattaaatcagctgcctgagatgtgtacacagacaccattcagctctactgggcttaaaccacttcttcatttcatgggaggagtgactcaaaataaagtaacgggcaaaattgacacttctgaattcagctgctaatcctctgattgaacaccagccgtattcttccctgggcctggggcacatacatctgcacttgccagaattagctgacctgctccatgcgggtaacatgattggtctctgtgagactcaggccacattactgcatctcaagtcattgactcctttcgtgaagcagaaaggggtgatgcactctcttgaggtgtcccccaacaccaacatctaagatctataaacaggattgttaacacatcttccttttttttgttttttcttttttccttgagacagggtctcactctatcacccaggctggggtacagtgaaatgatcatggctcactgcagcctcgaactcccgggttcaagtgatcctccctcagcctcccaagtaactgggagtagctgagaacacaagtgcacaccaccatgcctggaaattttttttgttttttatagagatggggttttgccatgtggtccaggctggcctcaaactcctggacttaagcctcccaagtgctggggttataggtgtcagccatcacacccagccaaaccgtctcctttctgtgtacatctgtcttaccaagtttaccatctgtcttaaatttctcctaaagaagataccttaccagagataattaggtgcagtggataagttcatgagctgcaggccagatggccttggattagaactcacgctttgtccccttctaggggtctgagcggctttggccaagtgaatagagccttgattttcttatctacaaaatgaagctgataataaaagtgcttacgtttaagagttactatgagtattaaacggggggtgggggcaggggcggcggcagaaatgcatggaaaatacttaacacaatacttggtgtatactggcttatacttatacatatcaagtaaatggtagatgataatgataaatatgttgcctattgggcaaaataatttttgtaataagtaatctattactgacttttgccaagtgttaagaatatataaaacactcacgtcttgtattttttgcaagtattcagaaataagtaaaatgtgctcatggttgatgagatggttgatgagacagtacaaagttaaaaagggttagatgccttcaaaagctgcccaaattctaaagacatttagtactgccctgccaccttctgatggactaatgcttttatgtgtaaaatgagtacctctggatccttgataggattcgcctgctacaaatgcacaccatgtttttatttatgttttgatagtttgttttgacccaaggcctgtgtcttgtcttgcttttcgatagtctcccttttgatatccatggctgccgctagtgctggtggccttggaaatccaccacattttctggcagagaacacaacacttgattccgtctggagctgctcaactttgggcctcattagcaggctgaggcttatatcagcacagcacatccctcccccaacatcgatgcagggactgatccagccctgtggcagcctgggagggagggaaaatgagctgggaagcaaccagacactgaagcttggctggcgttttgtggagcagagtgagcatacacagctatctgtccttcagtgccattactgatgttgccattattgttactataatggttgggactgttgttctgtgtcttaaggagaccacatactcaccactggctatgcaccaggagctattcaaaggacattacaaacctcacctcgtttatcttcacagcagtcctctacatgaggaaacttaagaaataaagtcacttgcccaatatcacacagctgtcaactccagagcacaagatccagccagagctgaaaccttatccacaccaccttagtatggtgctaagaggccacccacaactctcacctattcaagctcaggtgaatataagaagttggtgggaacatgatgtgacagtggtcagcaagaagccacgccacccagtatcaaatatgaccagaactcctgatgatggcttctggggaaactgactgtcaattaaaatggagaaaacacttgcactccagcctgggcaacagagcaaaactccatctcaaaaaaaaaaaaaaaaaaaagaaaaaagaaaaaatggggaaaacacaatgacccaataatagcaaaacaaaaacctttcctttcaagctatatgaaaggctgtgcccatcacgtatctcacatgtattaatggcttcaaggacaattccttttactgtctatttaaccaaacatttttgtgacttaatataccaaattataataaaacaaggcccactctattggtgtattcatgtagtacttttattatgcatgtaaaaaaagacagtagtctgaattgatgaggtacaaaagtcagagagcaattctgcaaagtaaaggcaatactggctggtcttaacttctctgcaacactgttactgcagacatggatgtctataacataggaatacgagaacgtggatttgagttcagtagtctagcattagattttgtggattgccattccagttcaactctttctacttagctgtgtaaaactggataagtcacttaacctccataaacctcagtttcttcatctgcaaaacagagtataacaataaatatctcatggtttattgggagaattcaaggatgcaatctatgtaaagactttgcacaatgtctggcaacatttcaagtgactgataaatgtaaactactgtgtgttttataccttaaattatctgatttggccccaaatcatttgtaagctatttcagcagtctcatcatctttctttaaaaaatgcaactgttgtctgaacacctgttaggtgataagaaatatactgaatgctttgtatgtgtattacttctaatccacccactaatcacataatttagaaattattgtcatcaattaattgttaaaaacaccagaattcaacagacagtaagacagcccatgctttttctatgacatctcccatcccaaccaagaagtggatatgaatgttatcttgctgcccagggcatcgagatcaggtactgaaggctgacaatccctaatcttgccatcttagcccagacaatgacactagaaattagctttggcatccaatgtggcatccagcccctgtgaagacagcactcttgtccaccacagatcttccatcatggccactgcagcagggaattgttccctttgtccatggtggctttgccacaaagggtccacttgtggtcttcagttaaatatttgctttaataaagtgacaaatgtttaaaacttcatcttttttgtagcctttgagttcaacttgcaaatcttatcattctacttataagctgaaaattataagtttaaaatgtaattcactttcaagggggcttttggacttaaataattcaagttagatacactaaactcccttaagtaatcagtatcatttacaaatttaatttaatttttaatttttcttaaacattttaaactgcatttacaaactcattatacccattttcttttcttaaagtacttcaatttctgacctggaaagcaaaatctactaagtattaaattgcaccagtaactccctaacaaattaaaataaaagattccatatactttaaaagcattgcaatattgtttataatctttgtcaaaaactttatctttcaacataaaaattacaagagtaatggtaactactcaactaaacatagaaagtagaatcaatatctactttgtcagttactttaatattccgagttatcttaaacagtagaaacacatcaactaaaaaatgtacgcagattactaataattgataagcattaattatcatgggtttcagaaattttatcatgtttactaaattctaaaccttccttgggttaaaagtaacataaccagtaactaaatacttttgaatcccatgtcatagacaaggtcacaactctaaggagctggggtagccctctcggtcggggtaggtgtgattttttgcatgctcttgatagccaggttggagctatctttaccagttgccaagacaaatgggaagccccatacagagtgatctcaaagatggcatcccggggttccctcaggatgtgctactacatgtttttaccaaattctgtctgattttggcagagagaagtcagctaccctctgtaaggctaaagctattacatttacttaaccatgtgaatgttgttttgttggagtgttgttgttgttgttaggaatttcagttgctttctaattgcctgagaaccttgatgtcatgcaatagaattctttacactcagctgtaattcttacaaacttctataaattgtgtcacttgatttagggagatttaaattcaaacccctcactgtaacctcaataaatttggtgctacactcctttatgaatttctttactgcctgactgaattcagaattattttcatttccttcttgtctagaaggggcaatattagttataattcggtttggctgttaagggaccaaaaaattaaaataatacgttgaaaactttacataagagagagaagtttctgtttctctcacatgaagtcccaaggtgagttatagggctggagttgcaatttcataatgatcacagttcgtcaacatatggcttccacttcatggtcatactggctaccagtagccataataaaatcacacgcccacaactagttacaagggaggttgggaaataatttattccaggtagccatatattcagtgaaaaagtgacaggtcccctagtacgtgaggacaagtgctgaggggtagaagaagtgttgtgaagatactggcagcatgcatactggagatcaagtacccaggcactgagggatgttggggagcttcctcacaaagacacggtagtagcatatctgacagcaccccaaaactgaagatgttggagagcacgggggttgtgggcagaagagacagaacagctgggaaactgatcacactgattaataacagtaaattaaggaaataatatatagaggatgagagcaagtttcttgctgttggaggaacttccaaatatggaaaggtaggaggctagaaagaaccctgagatttaggaatgaaattggaagtatcaatataaacccaatatttttggtaacacaggtagacaaataaatggttgcagatgcatgtttatgtatgtaaatgtacatagggagggtaaaatgaatgtgtatattttatactcatatatatttgtgtgtatacttacatatacatatatgtgtgtttgtgtatgtctatacacacatactacctcctgagatggcctaaaagcagtaatgcctcaacagtaatgatcacaaacaagtgcccagatcttagtttctaaatacaatctttcccaaaaacaaccagggtttcttagagaaatggctgataccagggctgggacaaaaaagggataagttgacattgagatatcttgtgccataaagtaaggaagtggttaaagaaatgatgaagccatgtcaaaaaggcttagaaatgaaagacaatccactgaataaaacaagaattcgtaagtctttgatgatataaataaggtagaagaacaggctcttccttatactaaaataccaaccagcaaatgatggaaatgagaataccaattgacaaccccatgaaagccaagactggtgggtggaaggtagacaaggaccatgatattggcataatctcagaacatctccccacaaaattcaaatcacttacaaaggaaaaatgtcaaatctaaggtggagaaacctggcatgtaccaatgtgaacagagtgggacaggccatgtgccttctgatgggacatatataaacacttgactatcatttctatggcattttccccgagtgggggacctgattctggccatgtggagacactggatggatccaggttgagagacgttctaaacagaaaaagacctgacttttttttaaaactatcaaagactagaaagacagggaaagatcaaagaaatgttccagagtagaagagatccaatagacatgataactaaatgtgacatgtgttcctgactgaaatcctgggtcagaaaagaaggacaatcgccactgggatagctggtgacctttcagtgggctttgtgtcctggggggcagcagtgcatcaacactgtttcctgacttggagggctgaatgctgatggtgtaggagagtgttttcactatttaggaaatacatacccacaatgtttagcagaaatgcagtatcacgtttgtagcttcctctcaaatgctaacggttgaggaatcaggatgaaaatgatatgggagatgtctatattgtacttggaatttttccctaagcttgaatttatttcaaaatagagaattaaatttttaaaatatcaaggctctattattcaggaagagcgggagccctgagagacagctagtggtgtctgctggtcaagccacaaaacatcctactgtatctgcatatatttcttggctttgttcagctctaaagtcacagaccttcttcccattgtctctgctgcagttttttgctataacaccattatctccttcccactagcccatcaatgagatcccaacctgctttatgtacaaaccagtaagagttaccaaggacaacatgttttggggccggataacaagatgtttttaacatcacagtttctgcgctgcatttaagagctgttggacacaattctgccctgaggcagaaattgagcaggaatagaagaatggaaataacacaagtaaaaaaactggagaacaggcaacatggggagtatgagataacataaatcgtaaagtagaaaacagaaatgagagcaggtttcagagacataggcttggactgcctttctaccatgcacaagaccacctgtcgctagcatgatgactagtgtttattccaaaagtctggtcaatgaatctcccaactagaattctagacatgtttcttttaagtataacttaatgtttgcagacttctccctcactggaagaggaataaaggataggaagaatctccttcctagtatcaaatgcatgcaactctacctctacaatactcaggtgacattttaagaaatactaatatcacatattacatagacgtaacatggctcttagcatcaatttgagatgaacagagatcgttctgatgtttctaatgaagagaataacctttttgctccttttcatattcaaatttatattccataaacatttattgaattcctaccacgtcctgaccaccaaggtgaataaaacagccagtgccctcactgagcccaaggagacagacccataaactaacaaatttcataaaaagcacagatgacatcaaattatttgttcactatttctgggcttaccaaatgaagttgcagacctcatgtttttatttgaacttactttattctgttataaggttaggaaccacattagggaaactgaacacaaactagctgtagtctttatcatttaaatatatagagctgtatgatatatcactgaaatcagtggtttccatggtccatggctgagcggcatcagaatcacttgtagtgcatcttaataattgagaaatccaaagcaaatgaatcaaaatcccaggaattagattcagagttcagtgtttctaagagttccacagagggttttgatgcacaggcaagtttgggcacccctgaaaaatcactgtcactgattctaccaagagtgaccttaggcttgcagaacactagtttgcaaaataacaatcagtcccttggctgtgaaattcacaagactgctgattaattcatttgaatatgattaaactgcttccctctaccctgggtttgtgaatggtgaggaactgaaacgtttgctgcaccatccattattaatgctcttcccttccaaagcctgtccctttgacctctgtttattccggcttgtctcctatatgagtttatagttacttattattatgtgcaattacatcatgctgagtgtgaggacaccccacaagctgttagctatattaacttaataatagatttcagggtgtgatttccaattaatttcattttccatatgcacatgcagctccatggaaagccaaaattatagagtagccatatggtgcctcataagaaacaattaaaactaattttctattctttgacaccaaaaaaaaaaaaaaaaatacggtttacatgccacagagaaaattgaaatttgaacagcctcggtagctctctagaaagaagatgccccactttccacatttgtggcatggatattccagtttcttgcttggccgtggtggactatggtcccacctggcttgtagtacatttgattcctcactgttcttaccctgctggactgtcttagagcagctgtgagaaagtgctgggctttctgtttcacaagagtgagttgagttgaaaagaatagtttgtctccttcagaaacagatgatttccggtaatagaaatttcctactgatccgtttccaaaaggcagtatctgaaacactggggcaatctgcccaagccaaggagaaaaataagcagttccactaaaagcagatgatgattgttaagcaataatgtaactgtccaaggctgaggagggctggagaaagggtcgctcccctggaaactcaggctggtttgttaaccagatcaatgatccttttacccttaccatatggtataattttgttaattcccaagggccctattttattaaaatcatcagctgggaggttaaaaaataaaaaatgaaacatatcaagaccctattcaagataagcagtgtgacaaaaaataaaaatccttgattttattagtctttcatataggtttcaactcttaaaactatcaagtttttatgtgggagcaaataatatcacaatgtattaatagatttactctaaagaataccttaactacgttgctgaaaacatgactaaatctcattattttttattttatgacaaatcccttctacagctaacatacgtgcacaagggtggcagaaggaaccatgagaaggtagagtaagaggtcagaggtctttttcgattgtagtatgaacgagtaagaaaactacctgtattagtctgttttcacaatgctataaatatactacctgagactgggtaatttataaaggaaagaggtttaactgactcactgttccgcatggctggggaggtctcaggaaacttacaatcatggcagaaggtgaaggagaagcaaataccttcttcacaaggtagcaggagagagagatagcacaaggaagtgccacactttaaaaccatcagatcttgtgagaactcactcaccatcatgagaacagcataggggaaaccaccgccatgatccaatcacctcccaccaaattcctccctccatacagggaggggactccaattcggatttcaatgcaagatgaaatattggtgaggacagagccagactaccatctatatgtttactgtaaagaaaaaaataaaattatcagaggtgaaactttgtgaaactgacatcaaaatttttaccaataaaaattataatggcagagaatttttcacagagaattttcagggcaataaaactactctgtataatgctataaggacaaatatatataattagacatttgtccaaacccatagaatgtacaacaccaagagtaaaccctaatgtaaattatgaacttggcctgatgatgtgtcaatgtaggttcatcaatcgtaatgaatgtaccatgctggtgggggatgttggtattgggggaggctgtgcagttgtcgggggaggggtatatgggaactctgtaccttcctctcaattttgttatgaacctaaaacttctctaaaaaattaaatctttaaaatatatctatataatggctacaaggaagaaaaactctaagtccatgttaggagttgaactgtgtctcaggacctctgaaaattcagttgttgaagtcctaatccccagaaactgagaatgtgatcttatttggagattgagttgttgaagatgcagttagctaaaatggcatcattagggtaggccataatccaatacaatagtatcttttaaaaaatgagaaatttgggagactctgcttcacagcctcagaagggccaaccctgccaccaccttgagcagggacttctaacctccagaaccatgaaacaatcaatttctgttgttcaggtcacccagtttgtgctactttgctatggcagccctaggaaataaatatagccatgttaggtaaagaacgtgagatctgggttcaagccctgagtctgccaaccactagctatgcaagagatgtctctaagctagatgtcctctctcaaccaggaaggtaagtaaagcctcctcacagcattgtggtgggggttcaattattaatacacaaagccggtgaggtacaatgtacaagtcttggtgtctaggtaagtgtaggatacctaaatggttctcttcactatgcccccaaccccaggagtaaactcagcctttgggagtgtgggagaacctcatctgcttttctagtgcctcctccaagtaactccttcacacacagaacatcacaccaggtcttccttttcatatccctggaaccacaaactctccccctccttcaggttaggaaacagcaagacgtggaagtttctgcctagccttgagatgccttaggtgtcagtgatcaattaaaacagataagctcccctcccaactccatttttttccttccctcctcacccacactcacaaaatgaatataaaaccagcataacaaacacaaactcagcaagttaatactaacgcaattgtgtactttgctcatctagaatgctaggcttctgactccacaagatgctaaaagaacacaaaaaaatcctctttgatggctaacattttcttccttaaggtaagaacaacacaatcctctcagtcatttagtattatattagctttatcttattcccaggggctgcttgcaccttgttttagtgactcctacaaactgcactggtcagaactactgtagcaagcactgtgcctattatctttttgtagtaaagggttaatgaacattaaataccacatttatttactctcatgctggtggacacagatgagcaccaagaaaatgaagtgggtctttaacatcttttgctttcttgcattaaaaacactgccaacattaagacatccttacatgtggcatttcctgctcagcaagtcttaaagttcccaacaactatttaaaaaatatcctcttgtgtggcaaaataataacaaaaagcttagcaacagcagccccctacttgctttgctaaataaccgttccaacaaaaaatgagctggaagattaagtgtatcttcatattccagcaaaaataaatatttagaaaaatatgttaggccaaacaagtcccccttcaacattcaatcaaccattccctcttggtttgtctttctttttgcccccctactctattcccatcccttccataaaaatgactaaagaaattcttgcagtttcacttttcagtggtgcataatcaaaattcaaaggaaattaaatagctgtcattatcatgagtatcctaggattctttattcctgtacataccagttcaaaaggcagacaaatgcacacatgacacacacttacatgcagagttcttacaaataaatcttgtgtattgctagtttgctattacactgtagggttttaaaagctcaatacatcatttgaaaaggttcctcctctacttatcagtcacttatccatgaagcctttggtttccagcaaggttttggcccctcttcctacacccctgcccctactcccttctgcatttttgatgggggaaatgggaacaggtcagtgagaggatgaacgactactgtaaatacttaaagacatcaattgaccattcatccccccttcccttagggtagagtccagtagagcacaaacattctcactgtaaactcttccttgtgtaatcttcagtcatagtggcattccttcatgtttgcactttaaatataccctaaaagcccaagttctccaattcagtttttttgtttgtttttttttttgagacagagtcttgctctgtcaccaaggctggagtgcagcagtgccatctcggctcattgcaacctccacttcccaggttcaagtgattctcctgcctcagcttcccaagtagctgggattacaggcacaggccaccatgcccagctaaattttgtatttttagtagagacagggtttcgccatgttggccaggctggtctcgaactcctggcctcaaatgatccacctgccgcagcctcccaaagtgctgggatcacaggcgtgagccactgcgcccggcctccaatttagattttatttggcaaaacattcccccaattttatgtaataaagatgcagcacgatggttaatggtcaagtgtatggcaagttgcatacactttttcaacactaatttccttgtctgtaagaagacaaccactctggtcacctcataatgacactgaagaatttaaatgacttgatttttataaattgcctcaatacaacatctggcacatagttaaatgctcagtaggtggtagtccctactattactgctattagtattatccttattaaggctaaaaagtcttgcaaaccttagtgaactgtgtatgtatgtacacatataaaaaattatctatatcttttaataccgtaatttctaaaatggaaaactatataatttacacatttttcattttaatgattaaattaataaagtaattatatgtttgatatagcttaggaattataatgtgtacgatttacattctatttattattttaattatttctattatagtttatttataattttaatatataatacatatatacataatatataatacatacattttttaatgtattctctgaaaatgtcccaataccacagaatctgactggaaaataccttgggtactcccaaaaccagagccagaaatcgctatattagaaaattagttttgggattctaactgctgtgaacagtgaaaaacagtatggtctcttaaggagttccaagcctcttgttctgactttgaacaaggcccgtcatgtgtaaaatgctctattgttcctcattccctaagtttcaagtcctcaactagctcagaataacacatttagcctttaacaggaatagtgagaaaaatgagacagtgaggatgtgtaagtaaatatgatacgtccataaactagaacaccatgaagcgtttgaaaagaatgaagctgttccctatacactgacctctaaaatattgttcagtgaaaaaatggcaaagtacagaacacaatgtacaatatgctcccttttaggctgaatggggctcacttaacttcttaaggagcctgcaactgaactttagcatatgctagaaaagaagtactactagttggccgggcgcggtggctcatgtctgtaatcccagcactttgggaggccaaggcgggcagatcacaaggtcaggagatcgagaccatcctggttaacacggtgaaaccccgtctttactaaaaatacaaaaaaaattagctgggagtgatggcaggtgcccgtagtcccagctactcaggaggctgaggcaggagaatggcgtgaacccgagaggcgagcttgcagtgagcggagatctcgctgctgcactccagcctggacaacagagtgagactctgtctcaaaaaaaaaaaaaaaaaaagaaaaaagaaaaagaaaagaagtactagttgtccctgaagctctcttttgccaattaagtgatatctgtgaaagaatagagggagagggataaaaagagaaaaacattaagaatattataatttttcctactagaaaaatcaagtgtatctgcaacagcaatgtaatttgaccaatcgaacatactctttccttctgtaaacagagcggctgccagcacaggaagtaatagtgtccattttttggactgcattccacttggaagattatctccaaagtactggattccagcatatacactttgttgagctgatctacagggctcactagctttcccccctcccctcgctattaatagtactcactctgatctttacctcacactttaccttgacttagactttcagcaacctgcaaagtaatctaccaaaacagagaaggaaatatgtcagcatggcaaactgtattagtgaaactagttagaaacaaaacgccacaggtataaactctacattcaccaaaatggacatgagttactaaataaaatcctctcctgcaggtactatgcatccctgtcttaatcatctgtgtttcagattctatacaaaacagttagcaagcttgtccaatctgtggcccacaggccacatgcagctcaggacagctttaaatgtggcccaatacaaatttgaaaactttcttaaaacattatgagatttttttgcacttttttctttttagttcatgagctatctattgttagtgtgttttatatgtggcccaagacaattcttcttccactatggcccaaggaagccaaaagactggacacccctgagtcagagcttgaaatccaggtactgcagtggaaaggtatcatatttttaaaataattaaaataagcctttcgtgctatttataatcttagaacaatatttttcctttctggtgaaaataaaatgtaccttgtattctaacacaacttctattcttcccactgcttttttttttttaacaaccaagcatacattaagttttcaaactgtagcatttgaaattaaagtaatgagtgagtgactctggtacctaacagactcaatcaagtcttaacttaaatagtattttgacagggaaacacattaaatatgtgctacgtgctggtcactgcactaggtgctgagtataaggaagcaaataaaacaggttccttgatttcactaggattatgtctaggggagaaaggtcattccacacaaataatttcataaactatttgatttagtcacatatactctatatagttcctgatttatatagagttagtaataaaaactctactaaatacaatatagtcttcttttaaatcaatgtactgtagcactacagggtgccttggaaatatctatgtgaaaagtagttattttattatttcagtcttaccccaactgtataacccaatattagctattaaaatacaaatatgccatacttttaaaaaattaaaaactaacctatttcattggccactggcttaagtacaaactgtgtaacattggcatataaacaaatacccttcattgccaacagcatgagatatgccactgcccctgagaagcatttctgactctctagctaaagtttgtaaactctctggttgccacaataatttatccaaatttccactgtgatgtttatcatattgtacaagagtaatttgtcatcctccataacctgtgagctcctcaggtgcaggaacaatgtctcattcacaacgtatccctagcactctcactagcgcctagcaccttggagcctctccacaatggtctactaaatgcattggtgaaaaagggtgaattgaacactacacggcagctgtcacttaaagtacattttgagcttccacaaggcagattcactgctcaaattggaaatgttctaaaagtcttgttcatcttagctgtctatcctatctgaaaatcattccttccttttgttatatttgatttactgaggcacactctgttccagggaccacagtaacaaccttgactcaatcaggcaaggagagtatagcggtggaaggattcacacacctgtccacttaagacaagattttgcattcaacgacaagcacttgagtgagctactcaagcatcaggcagctgatgagcctttctgtgatcttactgattttccgaatacggtgaacattctagtctgtctttgacctcacaaagttatatttttacttctcaggttgcaaatttgcagtggtaaaatcatcctaaaaactttacaggaagaaaatggttaagtacgttttaattcatcaaatgagagactttagtataatcattagaattacatttgggggggatattttaaaatatggaaaaaatctcatataccatgttaatgttaaaaaaagctgaatacaactgtataaagtataatcaaaattttgtgaaataaatctatatgaaaatagtcacatatacatatgtatctccacacagaaaaataacttaaaggagtttcaactttttcaactatgatcatgtattatttataaaaattctgaaaataatgcatgcttttcttctaaagtaaaaaacataatttcttaaccggctttatggtggattttgcaaagtaacaattcctctactatcttccaatgattcacttttcttacaattttaaattatatcttattcatgaaaaacgcatataccagaagtaaagatgaaccactatgtttctctctgtggtgaataaattacacttttaagaaatttaaaagatacaattacctaggacattaaagattaatagtttcctttataattatagattccttccatcctatgtttttatgcctcataattgcagtatgtctaacctcctttaaaaggcaagaaagactgggcatggtggcacacgcctgtaatcccagcactttgggaggccaaggcaggtgcatcacttgagctcaggaattcaagactagcctggcaacatggcaaaacccatccctaccaaaacacaaaaaaattagctgcccatggtggtgtgtgcctgtggtcccagctactcggaaggctaagctgggaggattgcttgagcctgggaggcagaagttgtagtgcgccaagatcgcgccactgcactcaacctgggtgacagagtaagagcctgtctcaaaagaaaaaaaaaaggtgggaggaggaaaaatatcaatggaaacttaaaaatacttttaaatataaagtaatgctgcattttaatatggcagaactatacttcctatatcaggattttttttttttttaagtgacagggtatggctctgtcacccaggatagagtacagtgatgtaatcatggctcactgcagcctcaaactcctggactcaatcagtcctcctgtctcagcctccctagtagctggggctacaggtgcacaccaccacacctggctagtttttttcgttttaacgttttgtccaggctggtctcaaactcctggcctcaagcgatcctgccacctcagtttcccaaagtgctgggattataggcataagctaccttgcccagcctcctatgtcaggaatttaaagactaaaggaaaatggtaatctgaaaacttttttggcaaccactatattcaagtccttctttattcccacttatacagaaaaacttcatttccttttgttcttttttcacattcgaagaccctaaaattgatttttccccagttgagccaaagtggaagagggacaatgttttattaaaagattcatttcccagcataaactgtcttctttatttatatacaaagaaaatctgtctttttattcttgtgaaaatgttttctgaagctatcattttacaaagttaattcaattgtacttgactctaaaaacagacagagagggagaaaagatgatgatgacaacgctgttagccgcctcagcaaaagaaaaagatacgcactgatcagctctcttaagaatggctgcacaaattaaattccaccaaaatgtaagaacaagggcatcgtggtgaccagtcttcagtgacttctgttgtgtgtgtgagagagaccaggacagcaaaagaactgtggtattagagtcactgaactggttacaatttaagaaacattcatcgttgggcttaaatgtactgaagaaaagggtattcatgtgacacaaaagacaagagaataaggagaatccaaaatgatccatcaaatgaaacagactgaggggcatggttttgggccaagtggagacacccagctggctacaacactgaagggaaagcatcgaatagattttaaagtagcaaagtaaggaagggataaaaataaataaaagactaaaaagtaatatgattctttgatcctatgtaagtctgagattccacagcaacacagaaagagataaatgagagagaaaacgtgagaaaatgaatgttttccatcctggtcttaaagaaaacttaagtggcatctttttaaaagaaagcataagtattttctgaacacaaacttcaaatcattaaaattaccttccctcattcttcctagagcagcaagcttttaaaaaataaagagtgagccgggcgcggtggctcacgcctgtaatcccagcactttgggaggccgaggcgggcggatcacgaggtcaggagatcgagaccatcctggctaacacggtgaagccccatctctactaaaaatacaaaaaattagccgggcgtggtagcgggcgcctgtagtcccagctactggggaggctgaggcaggagaatggcgtgaacccgggaggcggagcttgcagtgagccgagatcgcgccactgcactccagcctgggcgacagagcgagactccgtctcaaaaaaaataaaataaaataaaataaagagtgaaagctctaagaacaaatttagagctatatggagtttccactttttcagttttcaattcctaagtcagagttaagattgttatagttgaaactgtattagaaacatatttaggaacgatgattgtaccgttgagcttttcagttatgatccccacccctatcctaactggaatcctgaaattatcaagcttaccaaagctaatgcattaattctctcatttcatgattcattaactcagtaatttcctgcaagatacatggccaacaaaaatctcaaaatatccctgaggatattccagattaaaaatgctaaattcttaggacataatctttctagcactcatagagtttactatttcttagtttgttacaactatttgcccagatgcctgtctccccaagtagactgtaacctccaagcaaatgaagattgatcaagtaggattcaatatttctttttcttatacacagatctgatcatatttactctcacctggactcttaggggcggggctatcactcagagccaccggggcatggctgctgcccaagtggacccagaaggctggactttggcctcagtgggcccagaggcagagcatcatggaaacaaagagaattattctcaagccttaaaatacaatggactttgtcctgctaggttttggacttgcttgggccccaggattcctttcttccttctaatttgtccctttaggactagaatgtttattgtatgcctgttcgcctatttgggaagcagataacttgtctggtttcacaaattcacagcttgagaagaattctgcttcaagatgtatcacacctagagtctcatccatggctgatttagatgagattttcaacttagagctgatgctagatgggttaagattttgggggctgttgggatagggtgaatgtattttacatgcaagaggaaacaaatcagggatgggagggggcatgcagaaggcagaatgctatgggctgtttgtaaacctccctaaattcacgtattgaattctcaacccccagtacctcagagtgtaaccatatttagagacagggtctttaaagaggagattaatttaaaataaagccattaggaagggacctaatccaatacgatgatgatgtccttataagaagtgggagagacatcagggacaggagtgcccagaagaaaggccgtaagaggacacagcaaggaggtaatcatctgcaagtcaagaagaaaggcctcagaatggaatcaataccttgatcttggacttctagctttcagaactatgaaaaataaacttctgttatttaaaccacccagtgggtagcattttgttatggcagccctagctgactaatatgcctgccatttacattctccctgaattgccagtcctgtggcaacgtaccacactacttcatctacaaatgcacatttgttccttttgtcagggactgtgtagtagaaaatctggccttgcccaaagggtggtctggcttttgtcctcaacttctaggaggcaacccatgtcatccctatgggaatatgttagtcttgggaaagaacaattaaggtggggccagctacagccaatagtcttaggttaggggctgggcatgacagaaagatcaatcatgtgttttacagtggggaacacagaggctgaaatcaaccacatgggcaatcaggcaattgatcatgcctatatagtgaagctctcaataaaaactctggacactgaggctcgggtgagcttccctggctggcaatactctgtacatacagttacacattaacgacaggagggtaatgcatcctgactccatatggagaggacacagaaacctggtgtacagaatcctcctaaactccaacttagttgtctcctctttctttgactgatctgatttcatatcttttccctgtaatgtaatagtaatcatgagcactcagtgagttttgtgggtccttttagcaaactgttgaaactgagggtgttttggggaaacctcacacttgcagtcagtgtgaaaagtaaagacagtcttggagactgggccctctaattttgcagtttggataattccatgtagggatgaaacctcagatgtcactatctcagcaacatttcttgtatctaccctaaacagagttaatcataatttccttccttctcagtataccacaggatgtaatcctaatttacctggtaattacagtgattctaaacctgaggaaattttgccccccacagaagagaacatttggcaatgtctggacacagttctggtggttacaactgggggatgctactggcacctagtactccacctccaccctaggggatggaggccagggatgctgctaaccatcctacaatgcacaggacagccctcacagcaaagaattatctgacctaaaatgtctacatcatcaggtttaagaaaccctgcattagactgttgacatttaccggatgaaccccaggtctgagacaacaactcttggagtagtgagacaatagcaccctgaattctaagggccagtgtccaaatgccaattccacataaaacacttctgtttaatgtcaggcaaatatccaaacccttggccctcaactatctcatttgtaaatgaaactaaaatagcatgtattccacagaattatttacagaagaaataagaccatatattagaacaagttagcaaactatttagaccacagtaaacactggctaaatgttcaccctatatcatttaattttccttgtacaatgtaaaacattttataaaaaatatttgcactgactagattactggtaaaaggtcacaaatcactttttctttggtttagaacagatgtaggactcctggatctcataaatgtgggctactaacaaattaaatgtttctttctatgcaaaatttgtcttctcttaccaagaccacatgttgctctttccttccattatcaccacttatgggtggcttccttgtgtgtccattttcttcagagaaacaaagtttatatcacatatgagagttaccataagaggcaatgacaaaggaaacaatcaagcaatccagaaaggagattgtagtccacctaatacaaccacctgtgaaatgcaactgccaggtaggcagctccttcctttatgatcatcttccaggaaattacaaattgccccacatcagacattattcaggtcaaatgcctatctatgcatattatatctgagaactaaaaaggtttaatttattccctttgtgtctgtgtctcctacaatcctacatctaaagtgaattccccaagaaacaggagtaacttttccctcagatccccaacctatcacaacacctagcacactgtatatgttaattcatcattcttggataaatgtaagaaaagagatacagatggccaaatggatgaaaaaatacaagaccaagtggaggaacaaatacaagaaggaataaatgaataattaaatagttctttagcctataaatagcagtactactaatttctgcttgagcttcaacaacattaaaatatcagtgttcttacaaacatatatgcaggacacaattgttcaacaaaagaacttggcttgcagctataccctgcacagtaaaaaaatgtactctctcagtgttaatgaatgatttaacccagagcagtaagaacaggttagattcttactagcaggaagctactctgcattttgcaacaccacaccacagactacaggttaaaacagccaggaatatgacaaatatcatacttactgggagagaattaatgctactcccctaagatagaaggcaaggtaaggaagtcgcctcttaccgattctactcaacatggtagtagaggttgagccactgcaagcaggcaaggaaggaaaaaaaaaggcattcacactggaaaaaaacaaaaagacataacatggcctattcacagaagacatagttctgtatagagaaaatgttaaggaatcaattttaaacacaatttgcatgaataaacaagaaaaggaaggtcacaggatacaaaataaaagatacaaagatcaattgtatttcaacatacaagcaatgaataatctaaaaatgaaattattaaagtaatgccattcacagtagcatcaaaaataaaatacttagaaataaatttaacaaaagaaatgaaagacatacgcttgaaaaccacaaaatattgctgaaataaagatctaaataaatggagagctattccatgttcacagactggaagattcaatattgtgaagatggccatactcccacaattgatgtacaggatcaacatgaactctaatcaaaacaccagcaggtttactttcagaaattgacaagcagatcctaaaatgtatacagaaatgcaaaacacctagaattgccaaaacgaatttgaaaaggaaaagaatattgaaaaattttcactttcaaatttcaaactttctaataaagttaacagtaatcacgtcaccatgtttctgacatatattacatttgattgcttccattagaaattaccacaaatttagtagcttaacacaatgtattatcttacaattctgtaggtcagaaactcaacactggtctcaccaggctaaaatcaaggtattagtgagacagccacatgggagggggtccctggagaaactccacccagtctgcccactggggtacagcctcgagaagttcaggatctttccagcagaaagcagcctggcccctccttttcctgtgtgaaacctgggattcaaacggcctggtgggaagcgctctatcagggacttggcctggtgagaatccttgtttccccctttttttttctttttcacccaataaaaccctgtcttactcaccattcaaattgtctgcgagcctgaatttttgtggctgtgggacaaagagccccatctttagctgaactaaggaaaagtcctgcaacaacagcagggctacattttttcctggaggcactatgtagcatctgtgtcattgctcattcaggtgattaacagaattcagttcctgggcttgtagtactaagatccctgtttccttgctgacagttctcagctactggaggacacatacattccttggctagtggcccccttccaccattttcaaagccagtaaccacaggtcaagcccctgtcatgctcaaatacctcctcctcctttcatctctcatctctgacctaaaatggaaaggttttctgcctttaaggacttgtgattagattgggtccccctagtaatccaggataatctctcatctaaacgtttatacttgttaagacatctacaaagtcccttctgccacataaataacatattcacaggttccagggcttacgacatggacgtctttggggaactacttttctaatgaccacatggtataaagatagatacataaatcaatggaacagaatcgagaggccagaaataaattcttacatttatagtcaattgatttttggcaaaggtgccaaggcaattattggggaatgtatcctctgttcaaaaaatggtagagacaatagcacaattttaacttagactctcaccgcataccatgcacaaaaatgactccaaatagattcacagacttaaatgtaaaagctaaaataataaacttttacaagaacatacagtagaaaaatcttcgagatgtgactcaggtaaaaaaaaatttagatacaacatcaaaagcattctccaaaacagaaaaaaattagtaagttggactttgttaaaattcaacttatagacttcaaatggcactactagaaacatgaaatgacaagcaacacactgggaaaaagtatttgcaaaatacatatctaataaaggacttttctccagaatttatgaataactcctacaattcaataagacaaacctcaatcaaaaaatgggcaaactatatggccagataatttaccaaagaatttagatgaatggtcagtaagttcatgaaaagatattcaactgcattagtcagttagaaaagataaattaaaaccacagtgaaatatcactctctacctactacagtagttaaaattaaagagacagaaaacaacaaaagttagtgaggatataaagaaatagaaactttcatgcattgataaggggactgtaaaatggtgtagctactttggaaaaagtttggcagtttctcaaaaagttaaccatagagctaatatcatccaataattccaatcctaggtatctattcaagagaaatgaaaacatttgttcacaaagacttacatgaatattcacagcagtattattaataatagcctcaaagtgcaaacaatctaaatgtccaccaactggtgaacagattatccacataataaaatactattcagcattacaaaagaaataactcttgatatatgccaagtcatagaagaacctcaaaaacagtatgctatgaagccagatacaaagagccacatatcatatgattccatttatatgcaatgtccagaaaaggcaaacttagagactgaaagtgaatgaggggttgcctggggctgggggtgagaatggcaattaacatcaaacaggcattagggatcttatgggagggtgaaaatgttccaaaagtaatttatggtgatggttgtggaactcaatgaagttactaaaaatcactgaattatacacttgaaatgggtaaattaatgatacataaactgcatttctataaagttgttttaagaataacttattaaaaaagaaagctagccaacaaggacacctatgagaattatcctggtaggaagcatgtgttcttgggaaattattacaattatgctattgctactgaacctaagaataaaaaaagtccatctcatttagacagatttgaagaaaatgggtgatataacatgaatctagtggaattctagtggattctaggggcagctgttctctggattcctaaaggactgaaacagagaaactaggcacttatcatcaggccattcttgtcacgtgaaatataggtacctccatgcaggggccttgactgggaatcctctttcactgacagctgagtcctttttatcttgaatttccatgtaactgcagctgaatgaatatattggaaaagatgggtctccttgctatttccacagcagagtttctgtggacatgactattgccatgagaataataactaagaaatactccaatcaacagagtagcaaacagataacacaggtcaacacagttctcaagaaatcccagatcaagacttgtctgaaagacaggctcattgagtttgcagggatattgttcctttataacctagcgactctctgaagagagagacacagtatgccatggtaggatttgtataaagcaaatcacagaagtatttcatgtgggccagtaaacaattggtccaagttttaacaggaaaaaaaaaaggtagacttaggaaattttcttgattcagaattgaacagagttttcagaagtatttcccattcacaagtgtgttgaaacattctcctctttaaatagaaaatagatgaattgagataaatatatttaaatttccagagcaatcttgaagagctgcaacagtttagggaaatgtcaagaacaccctccgcttgagacaactgctctgctatgtaagatggagatcatcttaaggaaatagaaaccttctcgaagaaacttactgagtgccacatttttcccaactgttgatttttgtgaatttcagttgagagttactctcactctgccaactaaataaaaatatctcaaactgggttggaggcgaaaagcatgtaagttgagaagacagaaaatactacaggttcacctgattcagagcttgaacacttctaatcctcactaagaattgataaccaaatgcttcaaataaacttcacttgtcaatatcagtcatttaatttttattttatttttttttacaaaaagcccaaaatggattaaccacctgagtttaaagaactctactgattgatcgacccaggtagatggtctaaggaaagaattaagtccaactaggacactcaaaagtgaagtgctggccaggtgcagtggctcacacctgtaatcccagcattttgggaggctgaggtgagcagatcactggccaacatggcaaaatctcatctctactaaaaagtacaaaaaaattagacaagcatggtggcacatgccagtactcccagtcgggaggctgaggcaggagaaaagcttgaacccaggagttggaggttgcagtgagctgagatcctgccactgcacttcagccttggtgacagagacagactgtctcaaaaaacaaaaaaaaaagttaagtgcttatactgaagttacaaataagataaaaggacttttaaggaatattctctactacaaaataattaggactcagagcagagcttggttcataagtttaagtagaatcatgagctagagagaaaaaaaacgaattgcactaagtaaaagaagacatacatggaaatgacacaggaggagagctgatgtaaacattaaattttcacagctactaaatgctaaataaaagacttttcatattatagagttcttaaaatctggtggcatttcaacctgtggagacctaacacattttgctcagggcaaaaatctggcagccaaaagaatctctaccagagcctctgtcttccctggatccttttcctcaaataagggcaggaatggcaagaaagaaggcaaggaactcttcagagcctcagaaagtggtatgcagccaggtacacccctactgtaaaggggcatccacactaccagccatcatgctacatattttatatgcactttctcattcaattttactgaacaatggaattatagttccatttgcccaaagacctaaaggccaagatcaggaaggataccctctcaagatcttaagagcaataggaagaagagaaggtgtcaaatctgaatttcaaaaagcatcatcagttgcagagtgcttggtgagagcaggtgaagtaaggggggaagaccaggggtttattttgtatcttcctttctttctgggcttttatctctgatttggtcaacatttttaactcctaacacttcaaaatcacatctacttttggttaagatgattgatttataagttacacaatgaataaatagcataaactcaataatataaggaacacagagtaatatgtattatatattttatatatatttcatatataaaaaattttacatatatcatatataaaaaaattttatatatataaaattttatatatataaaatcatatatatacatatatatgattttaaagcctattctatatccaagaggtaaagaaatagtggcaactaatcaagagtaagctggtgcctgctggaactaattttccaataagtacttagacaaaataattatgagaatttatgttttcaaaatgtcttagattgacttacctagaaagcaaaagcatgtgaaaaatgtgtatgccaaatcttatgtgagagtagaatctcagggaagccagaaagagaggggacagggcaatgaggccagggaggaaggaaaggaatgcaaaatgggatgttgcctaggtgaccacggctgaaccggagatcacagctttccggaagcttggttatgggagatgggtgtctctagagaggccatacgaaccactgtgtctgggaatcatccctgaaggaagaagggtggagatgaggaagaaagacaaggcaaggaatttatctgcaggctttttctgactcccttctctcactggtcaaagtcagtcaaacattagcgggaacagcctgagacccagagggtctgatgggactgaacctgggcctcagaggagaaaaagggttcccaggcaggagagcaacacggagaggccaagggaggttggggtgacctggcaccagtgttgccgctctctaagaagatccaggaacacctggcctggcatcaattggaacacatacagaatattttctaggattttttactgttttccaaaggctaaaatttctatcttgcaaccctaaaatttcctcagaaagaaaggaattaggaatttcagtatgttatgtgcaatatcagaatttataattaaaataaagctgaaaataaaattatttcacccttaaataaaaattttccttcctcattaatagatcattttacaattgagtttccagtaagttaaagggctcatattcacaatttataaatcatggcaagataaggcaattacaagattaagagtagaagaatttagaatgtcaagtggcattaatttaagtagaaataagttctctacacataatttaattaatgccaagtgctcatagagctttgtttttctgagatgaaactcgaagttggatgagactaacacagtaatcataggctaacaccctgcccttcagaactacaagttttattgcccatcattttttaaaaatcttattactcagactacgtgcaatataaaatcaggggtaaaattcgaacagatgttaataagcttactgccactaaattacaaaccaagaaacttgcagaggggtctctctgtcctggcttctctttctacctgattggaaagtctgttctaggagcacagtgatattccaagctgggcactaacgtccttcagtgtagcacctaaaagctttcaaacaaatcagggtggtgttagaaaaaatcaaattttttaaacttgaacagggtaatggaaaataaagtccacgtcagatatcaaagatactacgatgttatcctttgaaataaagttagtatgtttaaaaaaattaacttaccttgtttataggaaaacacatgacattgagttacaaggtaaaatggtacctattattctgagatacataaacagaaagacacattattaaatatttaagtcacagatgtcagtcagtacaactccacaagacttaaaaatcaaggaggtgagtcaacaaaaagaaaaaaataaaaataaatgagaaaccatcaaattagaatatactgtagcaaatctcaatatatttatgttttatggttttatccatctttatttcttaattatgttactactatacaactatatcctaatacatttttaaaaatcaaacttcatggaataaagaatacaacgtaaaaatccctcctcttttttttctagcatattcagataagcaacataggagaagcccacaccagtacctgttgccatgatatatatatttcattcataacacagacagatacagccatgtttcgtggctgtgtgtatgcacttacacattcatatgtaagtctggaaggtcacaccacaaactgacaaaagtgattacatctgggtgggaaaattttacctgttcttcttcatattttattttttgaaaaatttttcaataagctttttttgattaaattgaggaaaagagtgctaaaaagataaatataatgaaagatacatcttcaaagtggctacctttattctttcacccaacatttgctaagtgcctcctcggggcactgggagagatgtatggaagctggccaaagctgagtccagaaatgaagcctgagacaacaggcaaacggcagagattgtcccttgattaactattatctctacttccagggtgcgaacgttacctatgggtcataaaatttgaagctgtttcatcttccaaaatcattggtcagttttgaacacagttgagttgaatattatagaccgtcaatcataatttcacaagtgagttgtcagggagaaaaaaaaattcctattgcacttggaaatgtcaagtgtaacccaataaatgtcaaattaaattgagctgtttgtgggaaattgtttagagctgtttataatagggggaaaacatgcaatcatcctaaatgggtatatgaacaggaagcctgggaaataccttccgaaaatatgaccacctgtatctattaagaattgtgtttgtgttcctgaaatcaaggatcctccctctctggtaccttgtaaggtaaatggtgctaacttcttctgaagaatacttaatcttttaacacttggatatccagtcacttttctaataaagatatttctcacacatgtatctctgtgtgctgatgcaaagggagttactgcgcatgtcaccaacgctggttagcactttctttagtcattcccatggtggtctttttctcaagagtaaagtccaaaaatgcagataaattaagaaggcacaagatcaaaagtacgtagtacccagctatttgttaatactgaaaataagacttggtaagcagatgtgtcacacacatgtctatggtcaacataatggggctgtcttctgccatatttgtttgtcaaaaggactggaaggtctgtcaatgagaagtgactttctctggacacttaatctttctctaagagattaaacattcagtattttttagaagaggagggcatgcaatgaagtgatggctgcaattctttgctttaattcaatcagtatttactgagcactttcctgttgcaagttctttgcaccaaagctgtgatggtgaaaagtgagccttgaacttttcaagctcaaaatcaagttagggagacagatgaaaagaaaacaaagacaaaagaatgcatgatgtataaagtgcagtggcagcatctcaaaatgacgcctaactcgagtatggaaagtcagagacacttcttggagtattaggctaaggagatgtgagcactaaagtacctacgggaggaaagaataattatagaaagacccggtggtatttaaggcaacttataggattcagtcaggtaaggatgacttctaacaatacagttaatcaccagacatgcatttaatgtgcagaaatggtaaatcagtaagagttgtaaattagctcccaaaaagtcagagcactaaatattaacttacaatacccaaattaagaagccaaattaggaactctgtttagttctcaggttaaaccaagctagatcctttgaaagttttgtacttaacacttaataagtaccagagaaattttgccatgtgcatggcatattaatataccatatttctttaaaaaaaacttatttaacattcaggggtacatgtacagttttgttatacaggtaaatttcatgtctcaggggtttgttatatagattttttgtcacctaggtaataagcatagtacctgataggtagttttccaatcttcaccctcctcctaccctccattttcaagtaggcctcagtgtctgttgttctcttctttgtgtccatatgtactcaatgtttagctcccacttataagtgagaacatgcagtatttggttttctgttccttaggatagtttgcttaggataacggcttccagctccatgcatgttgctacaagagacatgttcttgctcttttttatggtggcatagtattccatgctatatatgtaccacattttctttatccggtctaccagtgatgggcacctaagttgattccatgtctttgctatagtgaatagcgctacaatgaacatatatgtgcatgtgtcttcatggcagaatgatttacattcctttgggtatatacccaatcatgggattgctggttgaaaggtagttctgttttaagttctttgagaaatcgccaaactgttttccacaaaggctgaactaatctacattcccaccagcagtgtataagtgttcccctctctccaaaatcttgccagcatctgctatttttgactttttactagtagccattctgactgactacaccacacatctaaaccattcattttggtggaatgacattcccctcccccaccaaaaaaaacaccttttattacatcacacgataattctcccataaggcaactctcagtctattcattttgatgtttgttttcttccatcaaacttccatcacctccctccagtaactcaactgtctcagggtagtgaatggcagttacttgtatgcagtgacaaaagggaaaataccttacactgtctttcttttaccactgagtccatgacatacctccctctcctctgatgcctcagcctcccactgagactcaccagtggccttggtatgttcaatcaccaaggctctgggataccacctcctgccacaccatctctggccatgccacttccagcagagggccaaacctgctgcagatgcctctgtcatccattgccctgtccaaattccaacttggaagagccaccctagggagagccaccatcctccccgcttgcctgcctcctcactggtctcctgcttctgctcttggctccctacaggccaatttcggctcagcgaaaggatccttttaaaatatcatgtcaccttgagctcaaaaccactgcagtttctcaaagtcttaatttaccataagatctagcaatttcactgctggggatctacctgttttagtttacttttgctgtcgtggcagattattacaaatgtaaaggcttaaaacaatgctcatttattgtctcacagtgtttgcaggtcagaagtctggcaggatgtaactggattttctgtttagagtctcaccaagctaaaatcaagctactggctggaactatgattcttatttgcagcttagagacttcttcccaccttactagttagtggcagaattcagttccttgcagctacaagactgaggtatccagttccttgacacaaggccctcatcttgaagccaacaatggtacatcaaatccttctcaggcttcaaatgtctttgatttctgctatacctctctaaacttctcttctgacttcctctacttcctcttgtgcttttaagggcttatgtgatcatactgggtccatctagttaatccaggataatctcctgatcttaaggtcaactgcatagtaacctcaactacatctgcaaagtcctttttgccatgtaataccacatattcaagggcacaaaactaggggtaaaagtcttggggccagaattctgtctatcacagcacccaagagaaataaaaatacattccacataaagacttggacataagtgttcatagcagcattaatcgtgatagccaaaaattcaaatcaacataaatatctaccaattggtaaatggacaaaatgtgctgtatctatacaatggaatactcttcggtaacacaaagaacaaactattaatacattcaacaatatgaagtaacctcaaaaatatgatactaagtgaaggaagctcgacacaagagaccacatgctgtagcattccatttaaagaaaagacaaatctatagggacacaatgcagattaatggttgctggggctggcaggagtaatgggattaacagtaaagggcataaggaatcttattggaggatgaaatgttttaaaactggactacagtgatggttatataacttggtaaatttactaaacatcatggaactaaacttctttcacttaatatcatgataccatgtttttgaggttcattcatgttgttgaatgtattaatagtttgttctttgtgttgccaaagagtattccattgtgtggtgtattagtccatataattgaatactctctggtaactgctgctataaagaactgcctgagactgagtaatttacaaaggaaagaggtttaattaactcacagttccacatggctggggaggcctcaggaaacttacaatcatggtagaagaagaagcaaacacatctttctttacacagtggcaggaaggggaagtgccgggcaaagcaggaagagccccttataaaaccatcagatctcatgcgaactcactcactatcacaagaacagcatgagggtaactgcccccatgattaaattacctcccaccgggtccctccccaagacacatgaggattatgggaactaaaattcaagatgagatttaggtagggacacagccaaaccatatcctatggatacagtacattttgtccattgaaggatatacttgaaatgggtaaattttatgatatacaatacataacttaattagcttgtcagaaaattaaaaataaatcaataaataaaaccattgcaaaagccagcacccctctagttgcatacagagccctacaggttattctccatgctccaatttcacctcatgtcccacagcttgcttgctctctttctctaatcacctgatacctccaggaacattcctgcctcaggaactttccaattgatcccaccaatccagtccttcgaattaggttaaagttgctttggctccaactctctcttaaattagttgtgaaaacacatggtcttgaccatggaaagaacatgaagcggacactcagtgctcctctctgctccctttgtgctccaatgggataagggaacatataatgaaaaatgatggcactgtaaatactggtacaagttaagtattatgatgcttagagagcaggcaaaggacattcttcagaacacggatattccatcatctgtctccagctgccactggatgccaataagccactagaatgtaagagctgactacaccaggaatgtacatatcaccatcatgctgatgcttctcccagctaccactcatgttcccttgtccaccaagagtactgctttaggctgggcgcagtggctcatatctgtaatcccagaactttgggaggctgaggcgggcagatcacttgaggtcagaagttcaagaccagcctggctgacatggcaaaaccccatctctactaaaagtacaaaaaattagccgggcatccatgtggtgggtgcctgtaattccagctacttgggaggctgaggcaggagaatcgctcgaacccaggaggtggaggtagcagtgagccgagatcatgccactgcactccagcctgggcaaaagagcaagactccatttcaaaaaaaaaaaaaaaaaaaaaaaaaccaaacccacaaagactcctgctttatttcaattattttccctgatagattttcctccacatttgtaaaataatgctgacatcaaccagccaaaaaaatcacacccactttatcagaactacttgtgcagttaaataaatagcatgctacttccaaaagaaacaattacttctattttttaaacaaggatgaagcatcctacttgtaattctcaatgatttccgcagagatcaagtgaggctccttctttactacagccaaatttcccaccaccagattcacaaggcagaaacttgagagttcagtgaatagtaccagttaacctcagagggctgttgtagtttctcagtaagctcctggaacaacctagactgcatgggacaaaattttctttttgcaaatgatgtgtttcattttttttaaaggaagagctatgaataataatgagattcattgatttcgagagatcagaaacaggtaagttttgtagcagagtctaatgtgccaatttcagtccttaggcagtcaattaatctacccttcccaattggtctgatgttcatgatcctatggggtattttttaaaagtaagtaaagtaagtattctaaataaagaagattaaggatgttgctggcttcttctatttttatatgttctgttggatgaccttttgaaatgctctagaccaaagttcgttgcttttggcttaaagcagcacagtatggtggttaggaacacagactgggacaggtggaggttccaattccaaatgtgacatttactatgttcagagatttaagtaacttgttcaaggtcacacaagtagtaattgacatgaaagggatctcaaccaagatagtctgactcctatgggcttagtcagtaccctaagctgcctcccatttactgttactgttcacccatcaccaccacgactatcctcctcctgctcctcctcatcatcatcatcactatcagacagccatgttatagataacaattaaaactgttattaatgtatccagtcttgaacaccaaaaagccacattcagcaaatgtcatccaataaacagtcaccacatccattcatttttctaatgctattccagtgaactagggaagaaaatgtcataaaactcattttacagaatggggaactgagctaaaaatgattacgtctcctagcttccctcggtgactgagaggctgagacagaactggtgacactcggctctgtttgcctggcattatcactcatcttaaaaatatttaagcttcccaaatgaaaataggtaggactgtttctagccgtctgatctacctggagacaaacaaggccaagctggcttgctaagcacattggaataaataaagtattaagacatgagtgagggcctatcatacagaattcccatattgcgtctgcagtcagcataataaccgtggcatttcttttcgttctgcattcagcctggctaattcagtgaaaccttaaaagtgacaaatgaatgttgaaaaagagctggcatttcttccaagatttgagaagatgccagaaggaccctaggaaagtgcagtgacagctggaatggaggaggacagagtttaaaaagcaacttaccacttattttttgtgtttaatttttatattaagaccacaaaaataacatgagattgtactgaaagaaaaaaaataagttttttaattgtacagttaatatttctaaattagccaaaaccagaacgactgtcaaatgtgtcaccaaagcctataatccagtccctatggcatcattcattgacaaatatttttatccatttcaaaacacataaggaaaaaggaaaaaagactcttaaagcttctaccagacctttaaacaggccctaaaaaaatccagagctttataatattttcctactactttgttacatgcacatttgccaaaatttccctaaaacaaaccacttaaaattaataaattacctgtcaaatcccataaaaacagatggtcacttagagacaggagaagatgctagcattctgttttacacagatgttcagactgggaaaagatcatttcattttccataacagacaatgaaccttgtctaagatttccaatattatgcataaaaatgaaaatatcatgcagctgcttctatgttacacatctggttactgttgaagaaacatctttaatagtaaaatgaaaatcattataataaataagaactaaaattggtctttgttttctcttaacaagtatcatgctacttgtaagtcctttgctatcaaaaaattttaagttgctaaatgctcctaaattgaggtactctaatatgctatttaatgcaatcaagaattaatcagtaaactcctatccataagaaagtacacacagctgaatatctgacaccccaactgtttcttcctgttactcctttcaagaaggtgttttagtaattttatcagaaatctaacacatgaaacaataagtcaacacaacattagtgtcacacatccgaaatgagattttgacttgttagtctccaacacattacttacattactataaattgcatgaagatgaagacatttggcacctaagaatagttatgaaatacccaacaccaagagcatgcctgtatttatgctcagagctctcttggttctacatttttagcaaaagacatgaaacttgatagctaaatatatgaccactttttcacattacttgccaggagcaccaatgtttaagtcttcaaaatgtctacaaaatatattggtgacattcaactactctaagagatggggtatgtacagcagggggattcatttaatattggcaaaatgattacaatttggacaggctactttgggttaactgttaagtactgaatttgatcagaagttttcctaacaatcccttgtttaaaatatccagtggatttcactggaacaaaatccaagccccttacagggtctacaaggctctggtgacctctaagaccctgcccatccctctaaccccatctccttccactccctgatgccatgcctccatgatcatctttctgtcccttgaagtcaccaagtacctggccatcacctatgtgatccacccacttggaatgcccttcccttagatcttcttgcagctgttgagcattcacatcttgcatcacaatgtcatttccacagggaagacttctccgacccttggtcccacccttatttttccatcactatctcactaccctcttttatattattcatagcattgctaacttgagaacattatattgtaagtctttacatggttttctgtcttctctcactagaattcgaagccgctcccaagagatgccttactccagttatatctccagcaccaagtacctgtacataatacctgctaaatgaaggaacaaactgcttttcattaaactgactaataatgtgattgaagtggccaaacaatccaatggaatccaacttgtatcttggataccccactactggcctcataattagacttaaccatggaatgaggtgataagtcctcaaggcctaagggattgtccagagcctatatatcccctgccatgcacattccccagaagtctaccgaaatggcccattgtgggcctcttttcaagatggggccttccaagggaagcatctgctgtcctctaattatactcctatgctcaaggggtggctgtgtgcaggagaggtggatggacctgaacacacatactcatgaggcacctcacaacgcacagtgaagctgggggcggaaagaggaaccacaggctagggggaggtaatccctaatccctgtgctacatgttcctgcactaaactccacaaagtccgggaatgcaaaatggaagccaggccttacaggtcactctgaaggtatgtttgtcagggcaagacattttattcaatttgggatatactttagtctacttgatacagcattaccttgatttatatatgcatttatgaaattttatattttgaacatatggtgtatgggcctctatttgtccttctgcctctggtcctataaatgttagggatggggcctaactgctactctgagaacttgatcaagtacctcagttcactgagtctgtttcctcatttcagaaagagaaataattcctgtcctgtcaacaccttatattatgtgaagaacaatacatacaaataaaaaacataattttaaaatatttctattatgttctttcccacatacctccctgtgtattccagcaagtgagaatgatgataatttccatcaccaattccaaggcaactgtggcttttgagaaacttttgaactagacaggtgatatggttttggtgtctgtcccctccaaatctcatgttgaactgtaattcccaatgttggaggtgggagctggtgggaggtgtttgggtcatgggggaagatccctcatgaatggcttgatgccctccttgcagacgtgagtgagttctcactctgagttcatgtgagatctggtgtttaaaagactatggcacctcccacctcccactcgtgctccctctctcaccatgtgacatgcctactcctgctttgccttctgccatgatattaagttcctcgaggccttcccagaagccgagcagatgctgataccatgcctcttgtacagcctgcagaaccatgagccaattaaacctcttttctgtataaattacccagcctcagctatttctttaaaacaacataagaacagactaacacaacagggtttggcttttcaccgccttttcttttagtgttaagtactctttacatttcttctccattctacaaagtttcacatctttccagaaggaaaagatgtccaactgtctaagactttggacattaagagagagagagttctttaacaaaaatttctaaagtaaaaattaaaaaaaaaccttttctaattatttacagttgtagagaggtgccaactaaaaaatatctcatctcctatttagtctattgaatactgacatgttttccaggaaaagtacataatatacactaatgctgtgcatttattgatctctaatcggttgctggaatgaactgaacaagaaatatacccctggggctgttttagatctctctggctgtctgtctagaagcctttcctaccattccagagaaaggatggtctcagagatttaataaatcaagagcacaaacagcgcatacaaggaagctaggacaaacaaagagaaatgcaaaatgagctggcaggtgggttagggtatagcagtagatgaaacagactctgcagggcaagggaaaacagaatgagttttcaatggactgagattgaaaaagtcaaaaccccttttcacaactgatatggttttgctgtgcccccatccaaatctcaccttgaattgtatttcccagaattttcacgtgttgtgggagggacccaggagaggtaattgaatcatgggggccagtctttcccctgctattctcattatagtgaataagtctcacaagatctgatgggtttatcagggggttctgcttttgcttcttcctcatttttctcttgctgccaccatgtaagaagtgcctttcacctccagccatgtttctgagacctccccagccatgtggaactgtaagtccaattaaatctttttttcttcccagtctcgggtatgtcttcatcagcagcataaaaacggactaatacaacaatacgttagatctatcacatggagtacactagtcactgtggaaaaatcataaactgcctaaaactaaataatagaaatctatatcacattcccctttagagttcatcatatcagaactttccaattttctatgtaattaaatagttctaccttgtctctcaagtctacaaatcaaataaatgcagcaggaaacctacctgtaaataataacagcaataataataaaggagttaacatttattgtcttttgtattgattgatttccatacactgatctgagttatcgctattaatttaatgaggactcagcaacaatctgattcaagaaatatgattagttcctttcatagatggggaaacttaagacacaggaaagttaagaagcttgcccaagatctcatgtgggaaaattagaagaaaagtatttagaacccagaaggtctggctttatagaggcagccaaatggttcagagtgtaaggcacagagtgaagaactgccaggaacttgacacttgatcagccagcccttcaacaaatctgtgttcatcattatcacattcaagggtgcaaggaaaaacaaacaacacaaataaagctaatgtgaatccaggcctggaaactcactatcctagcagagaaggaagaagatcttattgataagaccttatggagcaacttcaaatacaatctctcatatgatatctcttcacaatgtccctgaattgctattcccagttcatagagaaagaaacagagaccaaatatgccgagcaagttattcaagattacaaaagtattcagtggcattccccacatatgaacaggtgttaattcaatattaattcaaccagcatccccaaatagtctggggaataggtcctccttgttattcaagacatcaactcaacaagtgggaaaagacattggtaatatctaatcgtaagcatatgtaactctcacatcctccaaaaaaaaaaaaaaaaaacaacaaaaaaaaactgaatatcaaagccacagctcaaatccagaccttctaaatcctattcaaatattgtttctaccacaccaggtacactgtcacctcacgatactgtatagaaaaacccacaatgtaattataaactgtaaatcctgatgggttaggccttgacaaatcaaaatgaagaaaatacactcatttcccaatgtccatggcttccttgcttactatagaagcaaaccactatggtgagcctaggtagccaatgaaggctattaggaaaatgacctttgttagtgacaaccattcttctgatacaatttgtgtacattactataggtccaggtggatatacgtcaacctccacatttattccatcgatttctttaacatggttttaaagatagataccacattacatgtctataatatataatgtatttgcaaatagtggcttgttattatattctcgcaataataactaaaagttgttattctaccctataggatatttgcatattcaattggtctaacacatatagcacattcaattgtgtatccagcaaatagcatatttaattggtctaacacatccccaatgcctaacaactaaaagttgttatcctaccctatagaatatttgcatattcaattggtctaacacatataacacattcaattgtatatccagcaaatagcatattcaatcggtctaacacatccccaatgcctttcttcaactaccccatcccaaacatcaacaagtcccgagctgtccatccaaaacacatctcaaagacatcagctccaccacatctcccgtgtaaacctctcattcacaccaccatcttctctcacttggaagaccataatgacagctgatctctttctcacttctcctgcagccccattaatctatttaccacaggacagtccacagggtgaccgactcatcctggtttgccttaggctttctcagctttagcactgaaagtcccatgttcagggaactcctcatttttgagcaatcaagagcagttggtcacccccgactatggtgaactttttataagatagataagatcaggtcattgcagaaatcactagccccaattcctcatctctccctggatccatgccattttccaagtgactatgcagttcttcccactagaggccctgaccccttgtctttggattccaacaatgggatattagcagatgtgatgcaacaaggagcttgaaacatacttgcagttgggcttgctctcttgcattccagccacttccttgtgaaaactatacccacacctagcccacaagtccgaggaggatgagaggcacgtggtacaggcctggacccaacctgcagtttgcagccaagcccagagagggccacctcaacccactaatatgcagacacttgagcaagaacaaatgactccctgagtttggggatggtttgttacctagcgttgttgaggcaatacctaactgacatggatttcatccaaatcttttggtagcttcccatttcacttagaataaaatcaaatatacttagctgagcacaaagccttatatgatctgggctccaacccatttgccagacctcaccatactatccttttctaaacttcattctcaccgatcccctttctgtttatcaaattgataaagctgtttctagttcaggatctcggcctctcctgtcacctgtgcttgaaacactttcatcccagttctcatgactggctcgtgttcatcctcacaggtcagcttaaaaatcacctcctcagagaagccttccttgactatcctataacatgaaatctgtgtatttctgtcacagtatttctcacaatctgtcaattatttgctaatttgtttgcttatactctgcatcctcaccaagctcaaatattcaaactattttctgcatatgttagtggataccaattgaatggtacccaaaagctcagaaaatcccttagcctggtaccttctggtgtgatgggtaaaagatttttattattgaaaacagaaagtgaaaatcagtaagatagtaaagctatagatgacttttagcaatcattgatattgttttaaattaaaagttcaaaaggggtttgattttttaagagttagctggacataacttttttaaaaccagaaagaattacaccagatttttagttgtatcagtctttccaaatgaaataatacctcaagatcagactccaataacgataccccctccccaccaaaaaaactactttgcttaagtcaaaggaagctgaacaaataaaaatttgtttggtgtggtatgaaattacaagcctttagtgacaggagtaaaaacggaagcaatgaaagtatcattctctatcattagttatacttccatactactggtcatgtggaaaattttagctattcacttcttggcagggacttcgatgttcacaaaagacccctttaaactccaaacactgtgaagttaaaaggcagtgaatcgtgaaagtaggtgtgtttctatattgagaatacctgtgtaatgtgaaacacaacagaccagttccttgttcagctaaagggggctgcttgcagtattaaagacagaggtgaggaggcaccagggcttctgagagttttgactaataaaatcaccccaagaagggaagacacagaacgtcagccaggcctcaagcaggaaaggagtgccagggtgggagtctgcccagtatagggagttttgaattgacctttgggagaaagagggtgtgaagagatggctctgcgtcctaagcgaaggtaagcaacctcatgaacatggctctggacgctggaggccctggtccctggactttgggcttggaagcaaaggccactgactgtttctctatcactctgagaagctccattgtgcctgggcctcttagatgattattttataaactatggattaggacaatggcatatctcaggaagggcacatgaggattcagtgagataaagcaggataaacacttaacagtgtttattacagatacactgagttttcaaaacatttcagccattgtattttctaccacctagcacacacaccagatcaatatttgatgagagcataagtaaatgaaagtctaaggttttgttgaaatgtgctctttgtcttgaaaaggaaaagaattgcataaaggtaaaacaagatgaatgtgtctcctaagacatcaggatggcagatctgaacattctagtcatgagaaaatcattccattttgtaaatgtgccattggcattctggtgtatacatcattctcacaggcttggttgatgaacatccaacctccttagtttgatgaactctgggtgggtacccacaagtttcctgacctaaaaggcaaggagtggtttggtttatttaaagtagtatcccttgacgggttgtctataggatctatctcagaaagcagccttctacacttccatcggaaaacacctctctcttcccctcaacacaagtaactagctttacatacaaacagtaagatgatcacagttattacttctctgtttaaagctagaattgccaacttcctgccaatcattttgaaagataattttcatgagagccaggagaaagaaagaaagttaaggacaaggtttctattctgggtcagaaaaaaactctgtttgttaaatgtattatatttaataatgagtcagaaagggaaagtagtttttgcctcttccaagaaggcttccctgaccacccagcatttacagtggaataggcatcccttttccctgcgtgccatgacatctgggcacaccttcactactcctgtatccctatgagtttacacatctgtctctctaccaagcagtgaacgtcttggaagcaccaactatttgtagtcatccttgtgcccaaccaacctcagtacctgattatttcaggtactcaataactgttaaatgaattaacgtcccattgaaaagaggttacttaaatcacagggggttttgagccctctcatggtttccttatagtcccctcacttataacacacacaacactggcaaggatggagagctactgtctaatactgagcaatactgatgttttttccagaagtaggggaggcagtgacaaaaatggcactgagataagcatatttgggacacctttaaactgaaatgagcacatatccaaagatcctataactgaaagtagagctcatcaatgtaaacagaacaaaaagccactatggaccagggacttttgttaacatgacctgccagggatcagagagaacccacagaaggtgaagctgtctttgtctaaggagattcattcctggtaataccagacctaaccatccccacatttcaactaaggctgttctgtggcatcagacaggaggatcagcctgaagagaaccctggacataaggctggcaacaggcaaagacaccgagttgatgtgtcccttcttaatttcccaacttcccaccattgcccacagggctgctgcttccttagttttaccttctcccttaaacaaagcttacaatcatgacccaatgacattagagaaagtcactgggtatgtatacaccagaagtcctgcttggcaacttttagcctagatggagggttcctggatgtctttgttctcttattaactcttccattcagtaatcacttatggaattcacactacagtccaggtaccaggaatgcaaagatgaatgggaaagttttagccctggaacaaatccagcctcgtcctccctatctatttctgtaccccactcccagtagtcatcccaaactgtctggaaggccctttcttctcttgttcatccttcatttaaaagctgcaagaattgatggaataatatttaaagctctcatctttggccgggtgcagtggctcacgtctgtggtcccagcactttgggaggccaaggcgggtggatcacaaggtcaggagttcgagaccagcctggccaatatggtaaaactccatctctacgaaaaatacaaaaattagccaggcacggtggcgggtgcctgtagtcccagctaccccggaggctgagggaggagaatcgcttgaacctgggaggcagaggttgcagtcagccaagatcgtgcccctgcattccagcctgggcaacagagtgagactccatctcaaaaaacaaacaaacaaacaacaacaacaaaaaactctcatttccttttcctttttttttggagacggagtcttgttctgttgcccagggtggagtgcagtggcacaatctcagctcactgcaacctctgcctcctgggttccagcaattttcctgcctcagcctcctgagtagctgggactacaggcgcatgccgccatgcccagctaatttttttgtattttagtagagacggggtttcactgtgttgcccaggctgttctcgaactcctgaactcaggcaacacgcccacctcggcctcccaaagtgctaggattacaggtgtgagccaccacgcccggccaaaactctcactgtctttcctacaaaacaggcttcctgttaaagacagctgctatcaaagagtcatccttaatcttattcaggtaaccaaaaactttattctttaaatggagacaactttgagagtaaaagggatttgcagttaataatagttctggaataacagatgtatccaagtctgtcccaggcaaaccaatagggatgatcacctacaccgaagagacagaaattctaagcttaaatgccagatgaatcttgaaacctgtccagatttacagaaacacctatactttattttgtatatgaaaagtatcgtgtgaaaggtcacctcacaactatgttgtaaggaatatgtttcctctttctgggtacagaggcaacaggttaaattacaacccctgcatcacccagtgtatgctgtgatgtggaacacactatttaccgtaacagcaaaaagcacatcatctactgatgtttcctatgagccagagactgttaaggcctagatcattcctcccaccaaacccatgagtagacactactgacatcccacattttacagatgaggaaatggagccttcgagaagttacagcacagctaaaaaggatgggactatgcttcaaactaaggcagtctcttccagagcccaccttcttaaatactaccacagtgccttctcaaagacatcactgaagaggtgataagatgagccacaaaaactgggagatcgtgacaatgataatgatcctaactacccattattggaaactttagggtatacaactctgctaaaccttatacacagcatgatctcatttcactctcctggctctcctaggaatcattattactaagcccattttacagatgaggaaactgaggattctagaggctaagtaacttgcctagggttgtgaagctatcgtggagcaaatgcaagatttgaattcaaggcgaactccagagtcatcctcaccatattagaaggtgcactatgaaagaaagaatttggacgaaggcaggaaggaaactgatgtggccacacactgggtaacaggcataaagagaggacaatgagcgaaaggtaaattgtgactgcgtcatgcacagctgactgtgtatgccacagtgagttaaaactgaatccactaaacaaggaacagtagtaagaaattctgagcaagagtgtctcaacgggatccaggttttctcatgtttatgatgctaatggacagatcatttataaagaaaatatatatttatgtaaagttgtttttcagtgctgcatctagcacctgaagattctgggaacaatttgatttttgcacatcaaatacctttagcactgttattttccccctgttatccacgtcccatctgtttcctctgccccatgctgaagtgactggtatatttgctcaaataaaagcctgaagacaaaaaaaaaaaaaaactctaatacttggctcacatttaatttgagagaaatagactcccaaatctcttagcttgttcgatgttgaatgaaagaaaaaaaattacacagctgagatagcttgtttacttacccaattttcatcctaaggtagatcaagtaacacaactcttttaaaccttctcaattcatttcctgacttttttgtccgtaacctagaaaactcaagtacagccttagtactatttatgaacatctgttaaacattgccaatgcctgttacaaccaccttggggaatagtgtagcatcttaaaagcataattccatatgtaatatttattctgttgcaatgtaaagaaagtatgacgctcattttctttaaaaattatgcaacttttgacttacatcttcatctacttagaaaatatcaaccaacagtacacaagtcattatatattcattatcaagttatctgacaagttgtataaaaaaacatagcttcacacttgggtgttattgcaaaagtattgaaaatttttatttttatctgctgttgatgttttaatagttgttttgtatttctttcatgacggctcaaaacactggctcagttcaatccaaaaaaagaagaaaaaaagaaagagaacttggtgagtgcctcatttgtgtgaaatgtgtttcgtttatctttgttgccatctcaatcattccttgaagtatgtattattatcccctattttatagtcaagtaaattgtggtttagggtaatcagtcaaagtagggctgggatgggagctctgttctgactgtatagcctgtgtttcttctaagccttgaagcaaagagacaaagattttcaagattctaaacactactttcagaagagaccactacatgatcaccaaacccatttcttctttttcctaagcatggattgaaactgtatttcccagccacccttgaagttggttgagatcttgcaattacttttagctgaaatgacacagtccatgcaaatttctacatgcaatcctccatggtttttttgccttttgagtggctggaatgggcatactttccaggtcatctttgggagccatgtgtggaagacagcagagtgaaaaacaaaaggagcctgggttcctgtggcagaccaagaacatcatgctagatttgtatgtgaataggaaataacttcttcttgcaccaggctactgagaatggggcagctcatgtgcttcagaagctagcactacctaatatgccaatacagagaaaaacaatccaaaaataaccacaagaggaaataacacagtcaatctagagattatcataaaaccttaaaataatattttggaaaaaaatttaatatttagacaatgttcattttataatatagaattttaaaacaaaaattataaacaaaactgtacttagtacctcaccaaatttataaacaagctcattctctctcaatgatgtcatatacatatgtacacagaaattaatattgctgaatgcatgtgtgcaaaacaaaaatgaaagaaaatatgttaatattagcacaggcttcctctaagtaatgagattagaagatattttttacttattttttacttttttgtaattttctgtattttccaatatcaaaataatgagcatgttcctttgataatcagaaaagatttgtctaattatgtttaagatttctttaaaaggggcaatccacccagacagagcgatcacagcagtgaggtcctatgtcatttaccctaggtaaagtttttctgtttttctgcatttatagcccataaagtaccctctgaactttcaaaactgccaaactttacaatggggtgagtcaaaggcccccagggtaaaatatttcacgggaaagtcctggaaaatgagaccacatgccaacataacttctttgcccattctcaatgaggtagctttaaaaaaacaagtcggccaggcctataatcttcccaacttggcctcccaaaggccagcaatttgggaggtcaaagtgggaagatcactcgaggccaggagttcgagaccatcctggccaacatggcgaaaccccgtgtctattaaaaatataaaaattagctgggcatggtggtgcacgcctgtaatcccagatactcaggaggctaagtcatgagaaccgcctgaacctgggaggcagagattgcagtgagctaagatcgcaccccccaactccagccggggcgacagagcaaaagtgtctcaaaaaattaaaaaattaaaaattaaaaaaataaaaacaagataatacataactgcattaatgacacaccaaaaagacagaaagtaaaattatgttagttaccatggatacacaatcatgggcatgaagagatctggtgacactcagtaccagtccttaaaggaaagtctttccctttggtttagatgaagattccaggagataatatttatgaaatgctcagcacaataccaggcacatggtaaaggcccaaagcttaaacaccaccactattatttttattggtaaaagtgtaagaagaattaatccttgctttagtaggctgttaaaattgaagttaaggcattgagtttcaaagtactgttctcatttgtttctgagaaaactgaaaggaagctacatgtacactcccataaagcctgcctgcccacaacccgccttgatctcgcccttcactctgcaggtctcctgcagagtggtattcagtgaataccacaagacacttagggaaaagatattctagcacagagaaattctaaggagatgaccagagaagaccatttatatttgcagacttaggaagaagaaaaaagaacattttataaaagggggatctctttgcaaaaatacatacaatagaaaatgtcattaaaagctacaacttgttgaatgggatatcctctttataaatacagttagggaaaaccattaatttaaattcaggtgctcctttaaggagcatttgcaagcgagcatgagcaagtgaacattttctgaataacaatatttattcgtgagcacctactgcctctgaggacctatgagaagcactctatctgcatgagaccaggttcttagcagcaagcaacagaaattaactctagctcaaataagcatgaactaaattacgaaaaagaaattgggaggctcacataatcaccaagaaggcaggacaatcagacttaaaaaatgggaaggaaccaaagaggccaacagcaggcaggcacacaatcaaatcacaccacaggaaccatctgtctggtgaggacaccactgttattcctagaaagcagataccgcttcaacctctcatggaccacatatgccattaccctaggagcagctttatattattgactccaaagtcaaaataatgggcagctgatatgttggtaaaaggaaaacttacttcacaaaaatcaatgttatccttgtctgtcattataagacaaaaatgaccgtcatctcaataaaaaggatattaagatctttttgcaagatcctaaccacatgtcataggacaaagccacaacaatcaaggaggcttgcaatgtatttaattgactatgggattaatagtacatatcaatcagtagtcaatgcacaacagttctttttttacatcaaatacaattccttaatggtgttaagtaattcaccaggctttaggatgtgattacataataccaaaagaacaagttatcatattgacgaatggaaacatgttatagctgaaagcaatcaaaagctagccaagttcaataaaagctccttatctccattttaggatgcatgtcattaggccagagaagattaatttctccattcatagttcaattttctttcccaacaaaaaataaaactgagcttttgaaacgcaattttcttgcttaatcaaatggtaagagtctcatgtcaacatgtgtggaataattaataaattgtagagattctaaaaactgaaagatagtgatcctagatatgtttcatctaagtttatatacaaatacttttttaagacaggtatttccagttatatgagagacacaatccttcactcactttcaaagagaactgaaaaggtaacatgaagatcagtcattcacacagtaggtattctgtaatgatctgttgactgtattcattaatttaatccataagagaaaaaaagtatgtacttataagcctcctaagaaaattgtatgcaacgtaaacaactcctcctttaaagcgtgattataaaaggtggctccgataaatggcagcagcaatgaatattatccacacattaaaaacttaattcaaacaaatttgctctctcagacataaatccattttctatgcaagaaaatgaggatctcactcaatatcttaccattatgaacagtgtttcagaaacaaaatgtatgcattacccattttaaacaaatgttcaaattaacaagctttccataactacacagcaaaaggttctatttgctcagagataaaagcaaatgaatcattaagaaaatatctgcagattgcagtttctatatattgcaccttaaaacctgccacatctagttttaatccaatcttctaattttattaatatgcattttccatgtttaaaatgctgacccacacataaaaatctcccaaaaatatcatcatcaagttagcaaaaggaaaatgctaggggagatttaatctaatctgactggattaaaatcccatcatctttgtcatttagctctacaatctcggcatgttttttaactttatcttgcctgtttccttgcttgtaaaatgacataaacaatgactgaatttggcgaccaactgaatatagtagacatgagagacattaatgatgcagagctatttcagctgggtaagtagggtggcgagaagaagagaaggtttgaagcaaccaagagatgacaagttccatttaggtcaggtgtgccaaagacactcatgaacaagtggtcaacagacaactaggaatgcagcttcaggcacaaagaaagagatctgcgagacaatccgcagagaagtcaccctggaaatcacagatatgattaatgtcacatttattttcaaaatattttataaaatgtcatttcaaaacacatcaaaatatgaataaagtaggaaggtaagcaaatatctttcaattatttacaaatctttctaattaaaatatgaactctcctaacacatgattaacaggatagttattacgatgtctctggtctctctgtgagttagaatcacaacagtagtgaacctcctggaatttgctgccactgacaacaatgatgatgctgatagcaataaaatcttatatagaactttctcagtgttagacacataatcattctaggcaattttctcccatgatggtatcataattacaaggtgaagatcccattttttcaggacaatcaggaagatgtgtgcataatccagttttaatcttaacctcaaatctatttgctaaaacttcaatcgtgctcttggttctgtcaatcttgtggtgacaagaatgtaaatactctgaagttttgccagattcttcttgctttgctctctccaggtaatctcagtgatgtgcacacaatttttatatttatgatcaactaatttcacttttaaccaactagaattggttccatatcctcttctaatgctataaatttccccttagatcaaaactattcaacaacagaaatcagaggagaccttccttctaccaaaactactcactgagttcgggaaggattactcattcattcaccaaataaggagcttgaattttccaaattcctgtttagctctagacagaatcacagggaggccctctgttggccataccaccttaaggagcatcatagatatgcactggtgaaacctgcatgcacacacactcacacactcctataagcacacacacacaaccatgcatcattctccattcctttatccagcttgattttgtcaatccttttatcattctcaaccctttatccagtttgtatttcttgagagcatacctgaagaactaattttcttttacttcaaattgctttattgtctctttttttccctcccttgtcccagcccaacacgtcaatgcaacattgctcattcctccagagcagaaattctattaaaagcatgatacagccaggtgcaatggctctcggttgtaatctcagcactttgagaggctgaggcaggaagatcacttgaggccaaactgggcaacacagagagaccccatctctacaaaaaataaagacacaaaaattagccaggtgtggtggtgtgtgcctgtagtcctacctactctgaaggctgaggtgggaggatcactcgagcccaggagttcgagattgcactgaactatgattacaccactgcactccagactgggtgacagagtgagaccctgtctctaaaagaagtaaaaaataaatacaagtaaaaagcatggtacacaatccccaaccacaatacaatggctaaataaatgttcataaaaccataactaagaagtcaattagctcactaagtgcatatctccaggaatatctcaaagagattaggtgttatgcctaagaggggtgaggggagtaatcagctggcctccagaattctctttaaaaaacttagttatacctgcaatgctagtgcttcactgtatttaagaaaataatggggaaatgaagatcaaagaccaacttgaactttacatttctttgctctcacttcccaatccccaaaccacaagagtataaaacaaaaatgatcctttcttatgaaaaggctggaatacagtactaacctttactgagtctattatcaaagttcactgaggagctctcatccaggtttagatcttattttactgggattttttcacagtaaaaaccaatcttgatagcttttaaaaatgaaaccaattttcatttattaaaatataagtcacttcaatttctacatttaacatctgaaagtcacaaattaatttctttctagaacataaattctatgaagaaaaagggcttgcctgtcttgcacagctgtgtccacagtgcctagtacatggttgaccctcgataaatatttgttccagaagagaatgcatatacatttcaactgacataacatagaaagggtctggtgtattagcatctggtagaactttaaaaagttcaaagaacaacaattactagctaaagtacctgcgacttactcttaaaagagcatagaaaattagaatattgaaatatggagagtgcttctatcctaaactctcaacctgtgctactgatacctggacaagactgagtagcagacgcacaactctttatttttagtgggaaataactgcattcccaaggctgaaggatgcacatgcaaatccttctagtgtccaaatgtgcactgtcctagatggtagccactagccacatcagtctcttgagcacctgaaatgtgactagtctgaaatgagatgtgctggaagtgtagcattccaaccaggtttctgaagattgggacaaaaaaatgaacacaaaatatcctgttgataactttttatattaattacatgttgaaatgatgttgttttagatatattggagtaaacagaatatattattaacattaatttcaccctttttttcatttttttaatgtgactgttagaaaactttaaaatactgacgtggctcacattatactcctactagacagtggcaatccagaccgacacctacaaagtctgtatgccacaggtggggatgctcactgaaaggcagacagcaggacctgatccctaatatctggatctgtaaggaggaaaatgagctagatgttctaccacacaacaatcgccctttgatatggtttggctgtccccacccaaatctcaccttgaattgtaataatctccacatgtcaagggtggggccagggggagataactgaatcattggggcagttttccccatactgttctaatggtagtgagtaagcctcacgagatctaatggttttataaatgggagttcccctgcacaagttctcgtctgccaccatgtaagacatccctttgctcttcctttgtcttccactatgattgtgaggtctccccagccatgcggaactgtgagtccactaaatctctttcctttataaatcacccagtctcaggtatgtctttattagtagcatgagaatagactaatacactcctaaagactcgcaatagcattgggaaataagtactattagctttgacctaaagaaactgaggcaaggacggagaaggtacttctgcagaattacaaagctggtaaagggaaggcaaaacactgaagcaaagttagcttgactttaaagtcatgcccttgtctttggtctcctccagtcactcagagggtgctctccccatgttctaagggacttaaagaaggatgtcgacaactgactcaccctgcaaaggcttctcaagcccttcagccatgtttctcccagccactaacccacagctgacagaagtgggtgaaatagtgactaaaatctctgaaaaattaccatgaagcaacatcccatgtgctgctatctcaggtaaaagaataaagttttcctaaattgatgttttttgcttttttaaattgcagttatcatttcctttattagttaacatggatcacaatttcctttttgtgttatcaaatattgttgaaggcttccatccactccctgcacacattattgaacgatgctccactgttgtactattcttcatttcaaaaagagctgggatgaaaacaccctaatgctcatactgtaagaatttctgaggatacaccctccctaagggatactgaaaagaaagggaagttgtttgttgttctaattttttttttttttttaagagagagaaggtctcactctggcgcccaggctagagtatgttagagtgatcatagcccactgcaatctcaaactcgtgggctcaagtgatcctcctgccaaagcctccagagtagctaggactacaggcatacaccaccatactaggctaatttttttagtttttgtagaaacgggttctgctatgttgcccaggctggtctcaaactcctggactcaagtgatcctccctcctcagcctctcaaagtactgagattataggcatgagccaccccactgagcctgttctaaggtttttgacacttaggccaagtgcctccagtgagtgatcctggcggaactgaggacacagaggtgcctgtgaatctcatgcagcatgggtcaggcagggcccagtctagaggaaacctctaggtgtgccagggaagaaaggctctattctcctacacccaggccatcacactgaaggctgtcctgtgattccacatctcctcccaggtcagcaggactgaagactcacagggacaaagctctgaaagcagacccctcccttcacgctgcagtcaccatgtgattcctgcacacttacacacatgtacatgaggcaatctggacttttttgcttttgcagttctaagctctcccctgtatctgtccctgtcagtttaatccacaacaaaaaaaattaactagtgggaagccactacctgtgaattcactgatttgggcaagtgtatttcacccattatgaatcagcttacttagtctcttagcagcctcgagagcttcatttgcagtgtctgctacaaagaatctttgaactctcactccgttgtcagacatcagtttcttgctctggtattcctgcaggttcagccatcttctggaggttaattgaactgcctacagaaattgaaggagagaggtaagaacattcattaatagcaagaaaaataaaagtcaacctacatggccagtcttagaggtactgttgactggcaatctgcaacccagagttgagagaagcaaaagaaaaaaaaaacccacttaaattcatgcctaattattttttaacaaaaactgttaaggacaactacacacacacaaatgaatgcaggttttttaaaaatgctgaaagctgagtgagctctgtgatctagttaacagtaatacacaaatatcaatgtcttgcttttgatattgtaccacaactacatgaggtgtcagcattaggggaagctggatgaagagtacatggggctgctatactatttttgcaacttcctttgagtctacaagtatttcaacataagttattttaaaaactgttaaggactctattacatggatatggctccccccttctcaccccaaataaataaagagcatagcattattttaataactgtatatagactgttaatcattgtaaggtttttcaggaaatttgtttaaacactctgaagtcactgggccacagactaattcatttctttaccacagtttttaacagagtctgggtagggccattgtgtgtttaacgagattatctctttcatccaccaaggttgagtgcaataacctgaaagactgactattaattaaactagttcctaaactgcaacttgtgtattaaaggaaatttgcttaagtttcaagtagaagtggttttccaatatgcactacgtgtttatctgtgttaaaaggacacagtcaaaggacacaataacatgaacaaataaattccttacattttatccaataatatcaacagtattccctaccaaatctgtaagccccatttttaaaagaaggaaaaaaaaaaaaaaccaggaaaaatgaatacacttaatgtaaactcctttccatccatgagtcatatgcaaaggaaacattactcacaagaggaaggatgacaatacagttaatgcacaaaccaaaaaaatcaatcacacaactggatcacaagactggtagtacatggacatcatctgatacaatccctactggcttctgtccacggctttggtggatgtccaaggcagtgtcacacagatcataaaagtgaggcccacagggcttcatcacatggagccattaccttttgggacatctactgtgtccttaaaatgtcattttcttctggtatccccaagctatgatgtattcatggagctcttttgaaatagggtgattcaaagctctatacccccactactagactgtgttccactaaagggtagaaagtgtgccttaaacttctctgtatctctgtgaagaaggtgacagtgcttgacatatgaaagacacccaaaaaatgccacttggatggccaaatgaatcaactctgccttttgtctcctgatatggacaatttttcattcccagaaactggccacctctaaaaataaaaaagtacaagttagtccttaagatgtgaaataaacataatataatgtatacatgctggtaaaaaattcaaatttcaacatgatcaagcctaaagatagctctctgttccgtccttgtagctgctggtaatgatggtttggttttgcttttaatattgaagttgcctatacttcttctttagaaataaataatactgggataaaaataaattgtcagacaagcaatgctcacatcatttaccgtatattattttttaactacacattatttcttaatcttactttttaagtcttgatgaaacattagtaatttgaaaaacacaaaattctgtaaatgaacatactcaaaggctttatagtcttaatagcgtgttatataacatacaaagaaaaatacgagtttaaggcatttagcgaaaaagccccttagtgaaagaaaacattaaacattagctgtgtgctattatctaggaccactcttaaaaggcaaataggaacaatcaatagattatgtctacgttgacataacaatttaaagccattaaccaaagaaagaaaaaatatagtttgaaaagagcatttgagggagactaaaaacagccacaatgtggttgtggtcaattccttttcatcagaacactcgccatattaattttagatatgttaatgcaatctgctggaaactaattgcaattgatccagaggccagcttcacagacatgtaacatatattgactgtttccacactgactcaaatgaaagccagcttgaagtctgttgctcttaaattgaaaaccaggacaatgagcacagttccaaatccactgatgacacccggctatcactccacaaaggaattcttttacagaataatcacctatttttgtcaatccaaaacttggaaaactagggccctgactggctctaaaacttcaagacaactccacttattaagaatttgtagctgggtgtgggcaggcgcagtggttcacacctgtaatcccaacatcttgagaggcggaggcaggaggattgcttgagcccagtagttcaagactagcctgggcaacatagtgagaccctgcctctacagaaagtgaaaacattagctggatgtggtagtgcatgcccacagtaccagctaattgggtggctgaggctggaggacaacttgagcctggaaggctgaggctgcagtgagctatgattgtgccactgcactccagcttgggtgccagagtgagactcagtctcaaaaaacaaaaaaaaatgtgatacatctacagaagtataatttatgtttacttctgcattctcagttgtaaaaaaagggtgagaagaaatctgctatgcaaatggatggtagaaagtacgctggaaatgtaatataaactgctgaataataataacaataatagttccatctactattaattgagcacttatgagctaggcattatattaaatattcatgtttcatggttaaaacaatcaggaaatgtcaagaattattatctctctctgtagctgtcattagtgcaaatcaagaaatatcctcggtcttcttccttctaggcacttccttacttcagctgaagttaggcgatgccgtatctactacctagagttagcaccagatcccccaggttagaggctcagtcccacaggactatacccacttgagatgccaggcacaagccccaggttattttacctgtgcttctgaccaaccagttatcaattgggagttcccaagacctcctcctcgggtttaactaattttataagatggctaacagagctcacaaaaaccactgctgacatttaccagttatttataaaggatatgacaaaagacactggtgaacagccagatggaagaggtgtacataacaaggtatgcccatggagcttccatgccctctctgggggtaccaccttgcagataccgccacatatttggcaatctggacactctccaaaccttgtcctcttaagattttattattttattacataggcatgattgttacctcattagccattggcgattaactcaacttttagtcccgctctcttccccagagactgggaggatggaaccgaaagtcccaaccctctaattatgctatgggctttctagtaaccagtcacaatcctgaagctacctagtggactccaaccactagtcatctcattagggtagaaaagacactcatcacttcagatatcccaagggtcttaggaactgtgtgccaggaaccaggggtaaagaccaaatatgtattttttttattatatcacagtatcatatcaattaactagttccagccagtaagttgtgagtacatatgttgtgtgacacattcaggccaacgtttaattgccatccctcctaccccatcgaagtttgccctctctagatatggggaatggcaacattcaagatggtagctgatctatcagccagggaccagaataaggatggacatataccaagtgactttacgtaaatgtgtagtaaaaaatacacctttgtggattcttagccactgaaattctgggggttatttgttactattgcacaacctttttgcccaattggctttactgaccaataaagccatgttacaaattaggaaacgggctgaacttgcccaagatcacaagttactctgaaacagtaaaacttctggatcaactgggtaacactattggttccctgtgtttgtattctggtcccagaggctctgtggtgatagagactgagataagagacaagtaaaatagtgtccctttcgtcaaaagtctaccaggaataggactttcacgaaatgctgacagagctcgtgtaaggtaaaatgtaactactccaggctttgggagggagggaggtggagatgtgaataggtgttgtcctaagatgctagaatggtagaagtttatttcaactcctaggaagagctacctgttatgaccctaaaaataacatctttgctgcaggagacatgaagaatctctcagataatccatgaattctagaatgcaaggaatggaatggagtataaagatcatctgccccagtgccttttgattgtttctgccagtcatttgccagcctgccctcaggaccattccacaggctcttctgcctaaatttgagactctgttcagagactgaacagtagggggaagacaccaggctttgttgtcctctttgtgggtgtaacagcatctcctctgaagctccaggtctctccagacagccctctcttccacattccagctcctgctatctcccctgctgtgacttctgcttgtaacagctagccctagactcggccaacaccatttccttcctctcctatggctcacggaagattcctgctgttgtccatccatctctgtgttgcctcccaagcctgtgtgccttacaatctttccggccctttgttaaattctattaaatgacctcacaaaatccctgtcttcctgactggcccttactgacacagtgcttcacaggctgaaggtgaaggggaatggcagtgatccacttttaaaaaggtctttgggaccctatactggagaagtttcccagttagtcacatgtttcaaatactggggtttcaagatataaagggaccactggggtccaatcacctcagtttacagtcaggaacctggaggcctgatgagggaaagtgtcttgcctagggatcatatagtaagccagaggcctgatgaaagctggactaattcccagcttttttccttccttcacatggattttggcaaagtgaccgtgataggaacagcatcacattcttaaactagctggggtaggtgggcacctaggttttgttccctttggacttgtacaatatccttgccatcattcccttccttcctgcgtttctttgatagagcaaacatttctaagcttggaggggaaggggaaaaatacaacttaaaagaaaagcaacacataaagatttaagggcctatgggaacaagggagcagaagcagaagaaaaagaatgaaaaatgaggcaggggacaaagagaaccagaagataacaagacaatggctaagtgggcaaaaactgacataaaaactccaagcacaaaaccagacagctacacagaaaaaaaaaaatgacatgcccaagaaatcatccttcgccccatggttttaaaattagaggtgtagaaacaactgaaatagcacctggggtggggaggtgggggaatcaacagagaatatcaaaagaaatgtccctgagctcgacacccctgaaagggaaaatcgtctacccactggctctgcacttgctccagccttcttcagctcgactttgcacactagtactgctcacttgggaaggcagcataaagcagtattagaaagagcccaggacttactagtaatcaagaaaatagaaactcaaacaaaacggaagaagccattttgccaaaaggaatgaagatgccactgaacacaaacacaaacacaaacacacacacacacacacacacacacacacgagatctgatgctattgttgttgaaggtcaggtgaaatgcactttctcagatactatccttacaacagaacactagtgcaaccaccttccaaaacaatttgacagtgtttatgaaaactaaagcacccccattctctgacctggaaagtctacttcctgggtatctatcctagcaaaacatgtaccagagatacatgcaaggatcttctctggagaattgtacataacaaaaggatacgattggaaatgatccaaatgcccatcaaatagaagactggcaaaacaaactataatatattctgactgtgtgaactatttaacattatctatggcaacacagtatcaccaagtaaccatgtgtacccctacatttctcagttctcttgtagctagtatgccaaaacttttaagagaccatgtgcaaccctccagagccctatttgttggctacaaggacctggaagccacatgtggagatggtggaatcacaggtgagattaggctggattataagagttacaacatgggggatgtcacctgacccacatgtgcatgactgagaaataaacgtttgacgtgttaaccactgagatcttaggaataactcatgataacagcattgactaatctagcctattaagtctgaacatggtagcactaattattctacaaggcacaagactaaaagaaaccagcaagctgcagaacaatacatacagcagaagaacatatattagacacacatgttcacacatgaagcaataatgtgtatcttctaaggacagatacatgcataagtaaatgtataggaaaaggtccagatgatgttcaccaagctattgccagtaaacttgggaagggcagaccaagaaatttcaacctaatctataatttaaaaaaatttttttaataatgaatttttaaataaattcatttattatttgtgccataaatatcaatctacttaaaagcaacattgagaaaaagaaataaaagccaggctttaacacaatggtgtagccttaagtctctattaacttttgtgcaaaacaaagggcttgccccttacttaaatgtagcagggttcttcaaatgtggtatgaaatcgaggtgggtgagcaaaagccgcattttctgttatacagaactaccacctctaatataaactcctgctgttagatatgaagaggctcttaaacctcacttcgagctctcaacagcagtgacgacagtggaatacaaacaaggaattagatttaaactcagaggaaaatatatttccctctcattacaggcatggcaatgaaggcagatgcttggtgggctgtggcaagtcaaaagttagtatgtgtttgttatattttagttttgccaatgttgttctgtatgcaaattagcaccgataaatctaccttagtcacgttacctaggaaatatgaggcctcaaataaatgtgttggtgcaaatgaaaagacagatataactcaatgtgtctcaatataagtgtcataaaataaaaggcctgcttgtttaaaacaggctctgatgaagaaggcactttaactgtgccatccggtaaaagagattaagtggaatcctgtttgtgagaggaaaaataataataccaataatgctgttctgcttaggccttaatacgatgacaacagcacgtcaacttctctttcagcatgaaaacatgctacagaaataggtaagaaaagtaatcatcgggattagaagcctaagcctatggaaaggaaaaaaataataatgtcagatgtagaaggaagaataggactgtgggtactgacactgttctttttccctccatgttcaggctaaagagtagtcttcattggaagtcacctttgaaaacagaacgtcacttttgtttagcactgcaatactcttcaccactctccacttgggttctccctgttttgcacactgtaagaaaatgaattaaccaattaattagccccctgtggctgagttcttaaactctagaaggggtacagagagatcctacctaccctatggatggcagaaatggcagctgacatgagtttcacttcctcatttataaaatagaggatactaacaggcccatcttcaaaggctgttgtaaagattaaatgagttaatatatgcaaataaactggaacagtgcccatgacaagtactcaaaaaaagttagctattattatttaatccagaaatataaaagaggaggaaaggtgtaacaagtagatacctggcaatcattaagataaaaatagtaggtgatcatataaataattttgttttaatagtgcccactgagccctgctcattgttttaaatacatttgtagagatatttttaaactctaatcatggaatttctatacttgaatcactcaacaatcacagaaaaagaacagtaatttgcaaaaggaagaactagaaaaatctcacattcagaaagcatcttaaaatgtgctacttagggccaggcgcagtggctcacacctgtaatacaagcattttgggaggccaaggtgggtagatcacaaggtcaagagattgagaccatcctggccaacatggtgaaagcccgtctctactaagaatacaaaaattagctgggtgtggtggtgcgtgcctgtagtcccagctacagggaggcggggacaggaaaattgcttgaaccccagaggcggaggttgcagtgagccgagatctcgccattgcactccagcctggcaacagaacaaaactctgtctcaaaaagaaaaaatgtgctacttactataagtaaatttacttttcatctcatttgaactaggttatccccatctcacagaagaagtctgaaggtgagacaggttggttaagtagcttgtctaaggccactcagctgattaagagagagtcacgatttgaatccaggtccccctgcctaaaaaaaacccatgagctttctattatcacatctgactttttctctttttagtcagtctgtaaatcctgtgtcaattaaaaactacttggaaccaccacagacaaaaactatactgccattcctgacctaaaattactgttttccattttaaagtatgaacaaataaagcagctgacaaattggtaataataataatgacgatatggtacctgaaaagccagcgttgaagggatgtaaaacttaattagagtggatagctagagaagaaaagtactttaaagttcccgcatcaagagaaacaacacttgagttattcttcacaggacatcagactaggatcagaccagcgtccgagaccatttttgttccattgacaacgcatctctgatagtgccacatgtcttatctaaggcctctagcagtaaagcaagcagcatcagtttaaaataataataataaaatcatctgtacttccaaaaaagaattgacagttgagctttcagattatccagaaactggatcacagcaggttgctattttagaattcattcttcttggggtgccttggcaaagtcttacgttgctgatccaaatcaaatactagtgaacatttctgagtcccatgaaattccagaaactgtgttattccacttggaaagcattacctcgtgagattctccaattaaaggaagataccagcagaagctcattttacagataagcaaaagaaggttcagagtaactaagtgcctgctcagggtgacacagctggttggaggcaaagccatatttcaaatacaggtatgtctgactgaggagcctgtgccctttaactaggcagtgctggtgtattatctcccagtgcacaaccatgggccctgagccttgaagtcaactggggcaaaagaagcaggaggctctggtttatagatttcactgcaggaaggtacagagctgtaccgaatatgaggttcactgggaaaatgggaaggtgtgaaagagaggttgctggatcggtttccctaactcgaaagaattaagattcgcaaagatactgccttgttctttttatcctaggttcagcagaaaagcagcatatattttaaggagcaaagaaatgtaaaacactttgtagtaatgacaaatgcccaaaggagagtttgctgcataactctataatgctgctctgccagcagcaagaaagaaaagggagggaaaaaaatacaaccttgataaacattagcatattagcacaacagcagaaacaaatgtataaaaggctctaaaaataccaaacatcctttcagaatgcctgtctgttccctcctggagagtatgctagctcaatcatgttgtagaagaaaatcaccttaattttaccctgcaaacagaagtaggcaagatttatttatagataaagaaaacaaattaaggtaatataaacatatactggcatttaactcctaccaaggaaactggcagacctatactttgttcattcatttaacaattttccactgcatccataatgtggtcactgtgtttgacatccaagatctagcagtaatcagcacagacaagttctttgtggtcagcaagcttttgccctaggaggagaggcagggaagaaagacatgaacacattaatgaagagtgtaattacagagcagcaaatgctatgagggaaaagaaagacacacatgatgaggccgggtgcagtggctcacacccgttaaccccagcactttcggaagccaaggcagatggatcacctgaggtcaggagttcaagaccagcatggcccacatggtgaaaccttgtctctactaaaaatacaaaaattagctgggcgtggtggcacgcacctttaatcccaggtactcaggaggctgagacaggagaacagcttgaacgcaggaggcagaggttgcagtgaaacgagaatgcaccattggactccagcctgggtgacacagtgagactccatctcaaaaaaaaaaaaaaaaaaagaaagaaaaaagaaaaagaaaagaaagacacatgatgagctgtgcaggccaattttagactgagtggtcacctttaaagaaatgacatctgtgcagaaatctggagacagaaaagaggtatacctgtgaaggaactgaggcaaagcacagcaggctgagaggccagcatgttccaaggctctggggtaggaaaggggttggcacgtgcacgaacaagggagtatggtgacagaggagcatgaaaatgccagcagggaccagataatgcaggtgctggtaaggcaaatacagagtttagacttcattcactcagttttaaacagggaagtgagaagatcaaattcacgttttagaaaagccactgttttctgtttggagaataaaaccaattgggagagagctgcattaaaccagattaaggttagcaaactttttctataaagagccagatagtaaatattataggctttgaggccaggtggactctgttgcaactactcaactctgcctttgtagtgcaaactagccatcaatcataaataaattaataggcatggctgtgttccaataaagctttatttggctagcaggccagtgtgctgatctctcaactagactatagagaagggcagtagaggtggggacagaaagaaatgaggggattctggataaagtttggtgatgaggtaaagcttacttgtggattagatgtgggtttaaggaaaaaaaaaagaaatctagtattagacacacacacactttacaatgttagttgatatgcatgtggtaaatctgatgtacctgctagtcataaaaaaggcacttctttaaaaacaatcttaacctcaaatcttttgcccaaactggccttatagtttgaatgtttcttccctccaaaagtcatatggcacttaatctccaatgtggcagtattgagaggtgggatctataacaggtaattgggttctgagagctttgccctcatgaatggaccaatccattcaaggatgaatggattaatgggttaatggattatcatgggagtgaaatcggtggctttctaagaaaaagaagagagatgagagctagtactctcagccccttcaccatgcatcccttggggactatgcagaagaggtctcatcagcaagaaggccctcaccagatacagccctttgaccttggactcctcaggctccataactataagaaataaattccttttctttataaatgacctagtttcaggctgtctcttataagcaacagaaaatgaactaagacatggcctatgtattacatttaattattgacatttctgcacatcattccaccacatcagagctgctgggcctttgatcttataactttcttccattatttaatatcaatctcagcgggcaacaggctacagtacctctatctgctacagtggcccatctgagattctctcctaggagagaacacaaggcctcccttgattacagagatgctacatagaaataacaaaaaccaaagacattaaagctaaggattaataagattggcctatccaatggaatactgtaaaatggttccaatgaatgaaccagctcttgaaatatgtcaatgcaaatatatttacaaagcaaaacacaggggaaaaactagcaagtggtagaacaagaggaacacataagagtatgcacacttaaatagaaaataataatagtaaacaatcttaggaagatacatacatagatatatcaaaaccatttggaaggtgacatgccaagtttaggacactgactatgttaaagggtcagaagggatcatggattttccgatgagacaacaacagacttcgatttcatcacttatactttacgtcttttattttaaagtgatctgagcaaatctgagaaaatagtagttggaacttcttcacattggacccacagatgactgtgatattaatctctatacgctgttttatcctgaataaaagttatctatttcatgtagttaatttaataactacatttaattccccaaagatgggtttattaataaaatgaaagaaggcaagctagaaaaagaaaaaaaatctaattacatttaataaaattaataattttctaactactttgaaaagattaataagatctgaaggaaacctgagattatgacaggccaaaagtccatgtgacacatgagtaactgaggcctgaagttacaagagtaacggacactccctcaacaggccagcattaagcacccatccctgtgcttaggcactgcccttgcagcctgccaagacaacatctctgcagaacaggtgagctcatggaagaaggcgaggatatttgtgccaagtagcttggtcttatgtcaggttcatgttcataaaaattgagtctctgctcacttgtggcacaaataactctagaagttgtttcctgaaaattaagtcactgctccatctcatttaaatatatatatatatacctatgtgtatgtatgtgtatatatatgtcattccccccacccactcaggtgagtctctgtggtggcaaaagagggtctgtgttccaagaatcatctccatgcaaagtgttcatttgaaaacaaattgcggctgggcgtggtggctcacgcctgtaatcccagcactttgggaggccaaagcgggtgaatcacgaggtcaggacatcgagaccatactggctaatacagtgaaaccccatctctactaaaaatacaaaaaaattagctgggcgtgatggcgggtgcctgtagtcccagctactcaggaggctgaggcaggagaatggcgcgaacccgagaggcggtgcttgcagtgagtggagatcgagccactgcactccagcctggatgacagagtgagactccatcttaagaaacaaaaaataagaaagaaaagaaaacattaaaaagagtacaatactaggccatgggatcattctttaaattttcaaaaaggggaaaaaatcttgttctggggctattcattattcattaaaacccgcccaactacaccatcagagcagatcctttacaatactcagagaagggaaagtactagatatttttattcaaccatgtggcccaaacacatcaccagtgtgagaggaacaacagcagtgtttttcaagatctctacctcaaatgagcttgcacactaagcgggtaaagcagagatattagcaaaacaccagcttccagggtggctgggataatgtacgtgaaggtgctttgtaaaccctaaagaacctacgtgcacattcaccatcaccattaccaggggtcaaacatgtcatctcaatgcatcagatttgactgtctcacagggccctgctaccatctccacaccctgcagttagcaatttgttagccctccttaaattactccccacagtcctttccaataaatccagatgaaagcttgcaagggacagactttattcaatcaacccactcctgctccttctaaggatctaatagtgcttaatagtttaggatacatttgagtttaatgggatttacctgatagcaagagacttctcatcacttctttatagcggcagttttgagtgacctagctaactcaatctcacaagtttgcctgtcacactggcttgccaaagaaatgacttgtagagtaggaaatgagcgaccttcgctggggaaattcctgagatcatctgacattttgaatgttctctgtgcagaatgataattggtgtctgtgaggtctgaagtccactatttgtgtttagaaagacatttcattcttgttgatgaataaaatactactgctatggaaaacttgatcttagatgcttttaaagaaaaatataacattgcagagagcaccctttctttcacaatttcattgtcaaaatctccatttaaggagaaataataattttgatgattaaattccatggccctccccaatattccacataaaatgccctagttataaaaaagaaaaacacatgccaaatttttccatctatgttagtcatctcttctcttatagtaatttgaatttctttagccagggagggggagagggtaaatcatccaaatattacttttatctataagaataatccatagaagttaaattcaaggtgagctttcagaaaactagatatcatgaaaaggaaactttaaaataatccctgaaaaaaaaatttatacccaagtgcagaatgcacggtagtcaaatgagcctgtcacactgtccaggaaatgtgtgaaatacatactgtcattcatttgaaaagtccactgtgatgacaaagacctcagaaaagtacacacaaaaagactcttacaaatagacaatctgacacagtatctaagcagcaaaggaaacaatatcctaaacatactataccctcttaaaatcagaggagccgaagaacctaagaaacatcaagaaagttttatactaatgactcttcttttaggaacccatagtgaaatgctagatgatattgctacaagctaacaactggcccaaactagaagtgaagagagaatgaggcagaaaggatcaaagtatgctgtaatgtcaagatgacagttctgggagttgataattgagaaataagcttaagtgagtggcatcgaaggctcggtgggtcatcttcaccctgccatttattcacaggtgacctctgtttgtttatgctaactgcaaatatcaaccaccatgaccttacaagtttgctggcaaagtaaaatgaaagatttctgtgaaatctcttttccacctcgtccaggatcaagaagcaacaccagggaggtgagaaatgcaccacagtggggatttggttctatgaccttccaccaggtagatccagccagcatctaattagctacccaatgcaggagaaagatctaaacaactctcccttattggccattactctcttctcttgaggacctttgcctctaaaggaggacagtcagctcaaaattaaaattgatctctgaagctcctgctgcctctgaaaacactagacatgaaagctactcaccttctcagggcagaagaaacaccccaaggaagtataccgatggccgggaaaatgaactgaggccttgagaacaagccccctcccaaaagcaatctgctgaacaccaagtatcacctacactacacggtaagatctagtgctaagcacagtggggacacagaaaggatgaatgtaagactggaccaagctgtctaaaccaagctgctatattcatagcagcactaggggaaaaaaattaatggagtgcccctggtagaggagaatggtaagcagataagaactagattgaagtaggatcccacagtcaaaagagcataggacagggttgtacccaaagtaggagtagctacatatatatatatttacattttttttttttttgagatgagtctcgctctgtcgcccaggctggagtgcagtggcgccatctcagctcactgcaagctccgcctcccgggttcacgccattctcctgcctcagcctcccgagtagctgggagtaatttttgtatttttactagagacggggtttcaccgtgttagccaggatggtcttgatctcctgacctcgtgatctgcccacttcagcctctcaaagtgctgggattacaggcgtgagccactgcacccggccactagggttatcttttgtctgaaggctgggcacccatggagcagagcgggggctcgggcaaccatcaaaatgatcagcaccaagcagcaaggggtatgctggacaaaaacagcaattgtagggtacacgggcccaagagatgaaatagtgcctcaggggactactaacaggaaaagaccagttactggcagtcactggtgacaggatggtctagggcacaagagcaagaatgatgaaacaacacagaccaacatcatgaaagagaaacaaatagaagaactaacgctgaaggagaaaaagttgaaggaggacatagcacaaaactgctttttaaaagtacatgccgggtgcagttgctcacgcctgtaatcccagcactttgggaggccaaagcgggtgaatcacgaggtcaggacatcgaggccatcctggctaacacggtgaaaccccatctctactaaaaatacaaaaaattagctgggcgtggtggcgggcacctgtagtcccagctacatgggaggctgaggcagaagaatggcgtgaaccccggaggcggagcttgcagtgagccgagatcgcaccactgcactccagcctgggcgacagagtgagactccgtctcaaaaaaaaaaaaaaaaaaaaaaagcataatacatcagacagacgtgagaggacagtatatgtatcaaaaaattttcaactagaagtttgaaatgtttttgtttttaaaaaaggactagagatgggttgaaagtagagagactataaccagaagacaaatcagtgagcttgaaattgaagatggggggatttcatggtcaaatatctgggaaatacagttttattttcttcacttagaggttctcgatatatgctttatttgaggttctgaggagcttgaccattaaaaaaaaaaatctacttaactatatttagttatcccccaaccaatttttacttggcatctgctttaaatcccatggaattagttactcctttgggaaatgccatagactgcaaaacaggacaaagtacacaactaaccatacaccatatagaagcaaattggagctgttgcacatctgtgtgaaaatacttttacttggatatttcacaattattttctcattagatctgaacagcatctttgggattcaatgtagtaaatcaaaagaaagatgaagaggacctagacttgggccattatcagtgacgtgccagttatgaagttattttgtctcagctccaaaatctcctttctaggtgttcattgctctgcggggctgataatcctgcaaattactttctctttcgccatctggcttcctattagggtctgcccatatggggcacactatagggagactaaagggctggcagatagagatgatatctgctcctttctaatgttttgtcaccatagcccctggccccacagctcctcatcctggcaaaaggagctggtttcaagactagctggttccagtttacaggtgctaccagcactccctgaccagccttggagccactgaaaccagccaagcagcagcctttccgaaaactctagatcccagctctgcaggacctatgttccaagttcccaagttcttagagagcttcaacctcttccttttatcttgggttgggggtgggggacactgcctcctgcaagttataatctctgttttagttagtggtggttttttttggagttttttgcccttctagtcctccaatacttctttactcaattctctatgttaaattttatctgttaaaataatgggcatagtctctatctttctaactggaccccaaatgataaaagcaggaataggaagacatatataaatacatagaaatttagtaaatacttccctgtttcatactttcttatgtgtactaattttatatatgtatatggctagagcagctccacagggcaatcacttgttttgttcactgatgagtgccccgtgcccagaacactgcatgagacattgtaggcattcgatttagttttttattgaatgaaggcgagtatgaatgtataagatggtcaaaggtagatttacccctatatgcaattgtaaggaatattttgatacactatttgggatgagtggatgagacacccagagggtatgtttaagtaaccacagatagaaagcaaacttccatcgaagagaagggtgtctagctgaccacaggactttttggtgagtggacatggaactgatatggtttggctctgtccccactcaaatctcacctagaactgtagcctccataattaccaatgggaggtaactgaatcatgggggtgggtttttcccatgctgttttcatgatagtaagtctcatgagatctgatggttttataaaggagagttccctgcacatgctgtcttgcctgccaccctgtaaaatgtgctttgcttctcctttgccttccaccatgattgtgaggcctccccagccatgtggaactgtgagtccactaaacctctttcctttataaattacccagtctcggatatctctttatttgcagtgtgaaaatgaactaatacagcaagttgggaattatatatagcaagaactgctccatgttaacacaggagaacgttatcagtgagcagcgggaaaaggcagacaggggaagagaacaaggaagaacagacacatgtgatgagaatgcgtgagaaaagatgttgtggattcagcatgccttcacatttcttctctgaaacctgcagcataatctgttcggtacgctttggtgtaagaacgttttctgctgaatatgaagagaggctgagcaccatattgagttaagcactggcaaagacagatgtcatgtgtggtgttttctgacaccaaatatgtgttatttcctcagaattctccaattatccaacaccaactggttgtccaaaaattccattcaattctcacactaactcccagagttagcacaaacaccacaggttaagggctcagtcccccagactgctcccactccagatgccagctgcaaacagggtggcaggccacctgcacacacaggggttcccactgctcaggttcaataagtcactagaacaactcacagaactctagagaatatttatgattactggtttattataaaggataaacctcagaaatggccaaatggaagagatgcaatagaacatgatatgggggaggggggggcgcccatatgtgttcaccaacctggaagctcccctaatgtcagtgtttcagagtttaatcaaggtttcattacttagccatgattaagaaattggccattcgtgactgaactcaatctccagcctctctcccctacttagaggtgttggggtaggggactgaaaactaaaagtcctatccacccttcttggcatggctaacccctcccttaaaactatttaaagggccaccagcagtcacctcattagcataaaaacccaggtatggctgaaaggagcttaaaaataacaaaagaacattttataagtaacaaaagaagctcctaccactcagggttttagatatgtgccaggaaccaggaaccatgaccaaatatatatatattcattataccacacattacatgctaggaaaatcagctttcattacagcattctctaatcctactctctgcccccttctcatcttgcaaccctaaaaacacaaaagataaattatgtggtacagccaggaaatgcatattgagcttataaaaggattcttatgctgtctctaaaaataaaaaaaaacttttcagagaaatgtattatgaggatacaaggtactgtacactctatttacgataaaggaatgaaacctactttataaagcaaatgtgaaaaaaaaaactccttaattacctatcttacatatttcaaaataaatgttaaacaaattctaattgcattatgttgtttaatattacctataagaaatgtaaaggccttaagcacaaacaaggacacaaggaaagaaaatcatttaaactgtagactttggtggttctattatatagaagattaaatactgatggtcaaggacattaaacatagaatgcaatgaatttcctttctttcgaaaacaactggaataaaaagatgttgccattaacgctataagcatttagtaagtacttatgtgtaggataaatgatttaaatatggttttgtgggaaggcatcaagataaatgtccattcatttgataaacccttttaaaactaacaattgtgccaagcaccttatgtataaagatagatggcaaaatccttgctcgcaaggcactcctagtcgcaaggattaaagatgcccagcacttgtaccaaccagtgctcccacaagctgaacctatgaccgacatcactagtcaatcgtctccttttcccaaaagaatgacctcagcctcacaatcctcattacacagtgttccacatggataccatcaacaggagttgaaatacaaggtgaacctacttgcctagaatactaaactttaatcaactgtcctgaactaacatacgatacaaagccctgcatcagcaagttttactgtaatgcagccatgcctgcccctttatgtactgtctattgctgcttttgcttttgagtagtctcatgcaaaacctaaagtatctactccccgatcctttaagaaaaagtttgcagaccaatgtcctatgaagaagaccaatgtcctataagaagatgcagataaacttcttgagagtccagatgaggaaattgcaggctgatgctctcttacaacagcactgagagtcccacaggagatcctcactagctacttgacagcattcagcagcctcccagtgcaggtatgtgaagacatttgctttactaagcaaatgataaggctctctgactctcatcagaatctccctgctagtcgtcctcactggcctagaccacaggaaaagatgaccctcttgttacctgcagtgatagaggtgaatggttgcagcagggaatgtaaggcccaggagtataaagtatttactatggccgggtgtgagggctcatacctgtactctcagcactttaggaggccgaggtgggtggattccttgaggccaggagtttgagaccagccttgccaacatggtgaaaccccgtctctaccaaaaatacaaaaagtagccgggcgtggtggatacgcctgtaatcccagctactcgggaggctgaggcataggaatcgtttgaacctgggaggcagaggctgcagtgagctgagatcacaccactacactccagcctaggcaacagagtgagactccgtttcaaaaaaaataaaaaaataaagtatttactacgtggtcatctacagaaaaagtttactgacctctcattttacctcataacacctctcaatgtgtaattatacatgtgggtgatttgtcagtgtctgccacgtcccatgagactatgatggtctcaaaggcacaaaccatgtctcatgcattcaccaatgcatttcccatgcctgggacagacctggtgcttctttagtatttgttgaatgataattaattaattagatacaaagcccaaggacacaatgaccctcgatctaaaactggggccactgacttgccttcatagcagacaaataataatggttcctgtgacaacaaattattagacaaggtcaggcacttcccagggctaacagttcagtaatcgtgtttccagaataatacagatttcagcccatatgcccatcatcatttatctctaagacttcaaagctaaaaagtttctctctgcattgagccatatattatgtacaaataaatagacaaataagccagttcaagcacaaattctacagggaaaatccagagttcatttttttttagacacagtttcactctgtcgcctagactggagtgcactggtgcgatctctgctcactgtagcctccccttcttgggttcaagcaattctcgtgtctcagtctcccaagtagctgggactacaggcacgcaccaccacacccagctaatttttgtatttttagtagaagcggggtttcatcatgttggccagactggtcttgaatgggtgacctcgagtgatctgcccgccttgccctcccaaagtactgagattaaagatgtgagccacagtgcctggcccaaagctcattttttaatgagcatctactatgtgtcaggtggcatgcttgagcaccagtgatgctcaagcatacagtgatgtggttaagatcatggacactggatcacggacttgtttgagccctggccccactatgataatgaccacaaccacttattaataatacaagctgaccagggaatggggcactgtttcagcgtattgcttttgaaatcataaggtaggtaaagggtgatctccaattgcagatggaaaacggaggcacagaaagattaacacatgtttccaaggtcacaaggatacaaacctaacttctagagtctatgaccttaatcactttgctgccaggttatcatgtgtaatcaatgagatcctgcttttgaggatacattacagtacctaacacaaagtacacactcaacaaatgctttcattataactatcacatcaccataatcatctacactgtcaagcaaagaactcatttgatctttcacagatttagctaacatgtacaaagatattttataatccttcatattgagatataaatctgagcttgtccaacggtgcttttcaccattctcatcgctagaatccacaagtgtaggaggatgaaggtacaggtagtgcattttttaattaatgtgcttaagccagaaaacaaaatcaagaacaaattaataacgaaaagtaaaatgtttttaaggttattcaaaaggacatgattatttttttgggctgttttgcagactgtctcaagtaaaatttctctaattttatgctagatgaagtacttactagcaaaatgtatccattaaatatttattatatcaatattcataaacaatgtagtacactgcaatcagtttctgtagtaaagtcatttacacagaggtcaaacctttcaaatacagaaaaagcaaaccaaggtctgcatgttttcaaacaccaagttctaaaccaaaagtcagagttattataccctgactccttcattctgtatttgatttcttcatgttctatagcctataaaataatgtaacaggcataattacagtgatttgctccccaggtttggatgaaattaaataaaaattccataatgaaatgccaggaaaatacctagttgtagtaaatgccagttaaagaacaatgcttcctgtcaatgtctatgttcaataagtttacctggcaataataaaacaaaactttgttaggcagaaacattttaatggacagttatttaatgcacgctgtgggctatgaagggccctcagaggaaaagccatgtcaatgtgggtctcgctcagtgtggttcctttccttcaaggatggaatcctctccgctttctgcctacttttagttacactccaagactttaaaatattttaatatttttaaaatatttcttatattttatatattttgtccacaagttatcactgttttatctgttatctgttaatccagtataagactactccattcctggaataaagtattcattttataaccatggtgttcagaaaactaaaattttcagatgtggttgaatacagaacagagctgaaacatcatgtccccactgtagacaccctccatatattatctaagcctaatgctacaacttcctttcgtatccacatgatcctgcatcgtctagcttcttcatagccagtatattgcagtgctcagtgtcttgtaaaaagctctttggtgccacaacaggcagggaattctctttcctttgctaactcttcaccaggaccactaccatcaccaaggttactatcaagagtctgtaggactcttcagctgggcacagtggctcacacctataatcccagcactttgggaggccgaggcaggaggattgcttgagcaagacccactctcaatttgtaaaattatattaaaatttaaaaaaaatttttttaagagtatatgcttcttttggagcagatttcaagaattctggtgcaaacaaagtcaactattagttatcttataaagtttattttcatcatttcattctaattaactatacttaataatttgctcctcaatatgaatgaaaatttcagcagtattctagctacaagagtcagtaaaccattgcctacagaatctaactcatctggataagcaaactactcagtcactatttatctctttaactaaaggttcattcaatctttgggctctcattagtatttcttagtcttttccctgccaagttcatgccagtaaacttgacagggcacagtatcatgaaaatggtatttttcatatttatcttcctcaggaatctgctgaaactcagtgcagacaatacctgtcttccaattctaaccacatgtttgagaatgtgcacgtgtgtatatgtcatactaaccaatcttccttttcctattagttcctggctttactacttaatagctgtgcattcaaccactctgtgcctttaatcctcaactgtaaaacaagaataataaacaggattgctaggagaataggatgagtaaagtgcttagggcatctgtcacgtaaggagagctcagaaaatatcagctattctcatctattatactatgatttttgcgatattcaacactgcttccaacatcatcatgaagagccagcaaaacaacatgaagtgacctaggacattcaaatacatgacgaaaatcttcatgacacaccagtaattgtgcaaaagaggtaggaactgtggcagaaccatcacccttaaaaattcatatcaaattcctgccttggctgaggctttgcactggttatcagtttttcagacctcttgcctgcctttcaaagcccaacaactgtgaactaagcatatgaaactgagacaggcaactgaacagtgggaaaagagaatatttacattgtgtgtatcagacataagtgaaaaaagctgagatcccagtgaagagtgattcatgggtgacacatattcagactcaaactgcaaactctgtctcttgggcagcagctcaagtcttactttagttcttttttactttagctgggccacttacagtcagccttatgcatgtgttgttcatgaaataccttctgatttggtcagtttatacacagaatccaggactcctcctctctgactctctcctttctgagacaccctcccacccccagtttcccgctgcttagggatcctgaactctgtccttcagttctccagtgcaaaaagactacaggttttctaccggagtttagccaccattgcaccctgtcatcaagaccaaaaagctggaagtaaaagctggaagtaaaaactggaaactcaaagcaggccttttgtttcccatttcaactcccctccttccagtttcgactcccctccagggtctcccagcctttggcactttccaaaaccttcaagtacttgttttatattttctccaaagcagatagttactagctatgcaaagcccagtctgttaagagcttacatggtcacacaggaaataggatctgtcaatgacacatattccagagggattcaagctcaagcggagatgttcttttctattccacatagccagggaacactaactcatgaacagggacaatactttgaaagttcatcctattaaatgacaaagagtcttcaccttaggagaggaagtcacttccaagcagaaactccaaagaaatgggtaaagactggccaaagaataagtccaggagcttgtttgggatgaacaaactatgcagacagcctgagagctatgaaaacacacacaaagtatggtaatagaaagggtctagaaaaggagaagattctcattcaaagaggtaggaaaatggacaccaaggcagaatcctttttttttttttttttgagacagagtcttgctctgtcacccagactggagtgcagtggcaggatctcggctcactgcaagctctgcctcccgggttcattccattctcctgcctcagcctcccgagtagctgggactacaggcgcccgccactgcacccggctaattttttgtgtttttagtagagacggggtttcaccgtgttagccaggatggtctcgatctcctgacctcgtgatccacctgcctcggcctcccaaagtgctgggattacaggcgtgagccactgcacccagccacctggctaattttttttctatttttagtagagacggggtttcaccgtgttagccaagatggtcttaatctcctgacctcgtgatctgcccacctcggcctcccaaagttctgagattacaggtgtgagccaccatgcctggctggcagtatcttttttttttttttagaatcagctgataatgtaacttactcagagatcctggtggaggatataaacgttcagacccaaaacagacaacatccagaccagggatggcagagcctcttaactctgaccagctggaaatggctgcccagggagctgtagaaagtaagacctcaaggctttgtcatggtagacatcaataatcactcagaacagcatcatgagtgattattgatgtctacgacaggaagagagaggggcagctcagtctcaggtattcacaagccagaatcaagtataaggttataggacttgagaagaataaggacagatttgtcaacatcatcattattaagattactgagtttcttcaatatgcccagatgatgtttagagtaattcaaatttaagtgaaattaaaaagggatatcagacaggctaaaataaaaaagtgccttgaatcttaataagcccacagtatatgaactgcctctaattagattcaggaatatgactccttttgaaaccaaccaggagaaaacacttattcagaagatttcaataaaaaattaataaccacttgcttccactttatcatgcacagtcctcaacggtggattttaaaaaacgaaagtacagtctgtctcaggaaaattgtacttgtgagtccttcaaaagctaggacattttaatcaataaagtgtgagggcaatttactgacttacataattcaacaaaatacttgctattcaaaatgagtgaagtctgtcactgaaattgttaagggtttatataaatacactactaaattaacaaagaaaaaagcaagcaaaggctgccctccaacctgatcttcatgctccagggaaccagttctttatcaggataatggtggttgacgtttccgtaagttatctggtactctgcctttcttttttggagagagatgacttgcccaaggtaaatccagttcagaaagggagcatccatgccagtaacttttgatccatgtagctttctcctataccacattatgacttgctataagaggacagttaaacaggataattacagagggcaagtttcccaactaaatgacaaccattaaaattagacatgaagttacaaaaaaagagtgaacagagggagattttcttaagtactagtaaatttctacttaggtcctaggaagtgctgtttactttataattacatgttaaactacatatatgataagtattttttcagtattttatgctacattgcacaattttaaaaagctttaaagaagagtgtaagcttctaagtctcacagctgtgaattcaaattcagactctattatttacaagttggatgagtttagacaaacttctcaacctctctaagcttcagtttcctcttgtgtaaaatgaagataaatgatagataatgataatgatagtacctatgttacagattgctgctgagtgtcaaagagaaaatgccattggaatgcctagcacttagtggccctctctggactggtctctccactgcaaaggcccaaaacctgccccctgcattgtttccaagctgatatacatcaacacatttccagattgtagctacacttggcatttcacctcctagttgacagtgtgaagctgttcatactgctatagggcagcacacagctgaatgcaaacacagttcttttgccttacctaggagctccatggatcaggagatgccctacagctgagagacaggcaagtttggtggataaagaaagccagcaagtggacaatcgaacataatttggaattactggtcatcaaagtctaattccagaaataaatcaattcaatggaaagcctttatagcaagcagacagatttagaaaggctgtaaggcacagaagaaatcacgtagacttgggagtctgacaggtgggtgttcaaatcctatcttggtcactaagcagtaacccaattgtagcggatgttgtaagtgactcgccagtatctttttctaaactattcagcagcttagccaataatggagatttccaatttttgccaataactggctcagcaatgagcatatgacctaatccccagcagtgataacctagaggaagtctaatgggaaggttataggaagaacttcctccctcatagaagtttaagaaaataagaaaaaaaaattatctagattaactatctagagctattccgtggccttgtccagctgcaaggcaagctgggagatccagtacagccatgtgtccagagaaaagaagagctggcttcagttaacggataatagttcctggcatgtttttaaagaaagctctgtcaaggctttcttctgtgtaatttattgtaatgtacattcgaaaaaaatgtatatgtatcagtaatttaccaagcccatactttcatggacactattacttatggaggggctcaaatgtggatttaaatatttttaatagtgaatagatttagaagaaaaatgtgaagtcaatgatattgatacttaaacatcacaaaaagccctgaagaggtattaccctagatgaggcaccgaagtgttaaaccagttgtccgaggcacaaagctagtaagtggcttacatgtcacattagccatggaagagccttgcagcagatgctctcagtgctccatccgcatggcctcagatcgcgccaccatttttatacagactcactgtgcactcttactcccaagagcagccccggcaggtctttgtcttaagatgctgaagacaacatgcccttaaagaaccttgaagagggtatataaatacttcaactctcttgcccctaactacaactctgaggtgtaacctacacagtttccatagctgtcctgtggaattaagcaaagtcaccctctttgggattcagtttaataacacacccttctcagcctccttcccttcaacttctctaaacccctttgagtttttcctgagaatgcctccccgaaaagccactttcacatgaatccttttctcaggatgtgtgaccagggaacaataagaaaagtcttggggttactatggtccaaggttccccaaacaagaatcactcatacacaattcttgctacatctagagaacactaataccagtatcagtttatttatgatgtttattttaacttaaagatagagaaaactttagagcactacctatactgtttgtttaagtagaaggagatagcataattaaaaaataaaagggattcaattctgattatttgaggtatgaagtcctaagctgaagatcttaaaagcacacaagcacaaaactgaaaatttctccgtgacaaaatcctaaggttccaaagacagtaacaatgaattcagcactatgtgactcactggtattggatgctgcatccctgcgttacctaaactcatctcgtgtactgccaatggatgtgtcccgtgctctgggcagcactgtttcaacagccattttgcaaagttaagcatgtatctggcacacagcataatccctgatacatgatagatgtacaatgaatgttaaacagagtttagtaaggaaactgagtctcttccctaaagccatgctgttgatcagtgggccagaaacaggcacaactgaaccttttctctgcataccatctgcctgcatctagaacagagatgtgattcactcctaaaaatccactacgattcttcctagatgacttcatctacagcagtaaatctacacatttatatagattttttactctcttataacatttgttttccccattctccccaaaactcgttgagcattccatggaatattattgctggctaattttcaccactatttgcctattggcataaccgcacccactttttatcatgctcctttttcaactactgctattactcctttttttctttcattagaaccctcagaagtgatttcacttttatgttcattattgttcatttacaatcagcttttgattgcatgctgattgttcttaaatttcaactttagactgctgaagaaaaacagtgcttggtgttagcttctgattaccaaagatcagctgaattaagttacaaaactgtttttcaaaaggcctggaacataggtagtaaaatgttagtgtttttgtttaaccttgggtgagctgtctggataaagagaatggttaaaaactaagtgagattaaaaataataatgaggtttgctggatttacttaaaatcaaaataaaaaaataccaaaattgatacatctgaacaaggctctgcatttattccaatctcttgctattgtttaaaatatttctagagctcctatttgggaaatgacaataaacctgtgcccctttccttgggatattcttctcaattgcaactcgtctgtctttaagttgatttcactcatagaaatggtcagagcttctcaaatccaacaccagcaaataaggtgtaggaaacaatgttttagttggaaaacaagtgctggaagcataaagcaaaagaactcatggcagtggtccatgggctagctctccaagcagccagaaaagcatgcatctccagcaaaagttcagagactccagaagtgccaaggtgaaaaaacaaaggctcatctggtcacatattaggttggtgcaaagttacaaatttcaaaaaccgcaattacttttgcaccaacctacaatttcagatgtgtttgatcaaaaaaatcaaccacacccacgttgtctcaatgcagggtggttctggaggtctgtgaggtcaaaactattttcataataatactaggatgactttgtcactctcattcttcacaaatgtacagaccacaaaaagttcattgatgtgtgtattagtatcctaggactggcgtacaaagtaccacatactgggtatcctaggactggcatacaaagtaccacatactgggtggctgaaactacagaaaggtattctcttgcagtttaggaggcttaaagtctgagatcaaggtatcagaagggttggtttcttctgagggctgtgagggagaatctggtccatgcctctctcctagcttccagtggttcacaggcaatctttggtgttcttggcttgcaaaagcatcactactttcatcttcacatggctttctccctgggcgtgtgtgcccgagtataaattttctctttttataaagacaccaatcatattgaattagggccctccctaacgacctcattttaacttgatttcctctatctatctcttaccttctatctcctttaaagatagagtctttacagagaaaatcaaattacattaggtcacattctgagatactgaaggttagatttcaacataggaattttgtgggggacacaattccacccattatcaggcataattcagtggacccacgtgagtggcatcctgaggagatgtgcagggcaacagctgtgacaacaaggaagttgtttaagatctctgagccgcagtttgttactctttaaaatgggcttagtagctaggcatggtggctcacacccgtaatctcagcactttaggaggctgaggtgggaggatcacttgaggccacaagttggagaccaacctgggcaacaaagcaagaccttgtctctacaaaatttaaaaaaaaaaaattggccaggcatagtggcatgcacctgtagtcccagctaatctggaggctgagaacagaggattcattgtgcccagaagttcaaggatgcagtgagctgttatacgatcttgccactgcactccagcctggatgacacaacaagaccccatctctacataaataagtaaagaaaataaaatgagcttagcaatggctataataatgccttcctcctagggctgccatgaatactcaacatgataatcctcctcaagtgcacagcaccaaacctggcccacagaatgtgcttgataaacatcaggtgtctatttgtacatgtgcttcatttcaggttatccagacaccattaatagccattgtacaggcaagtccagcagaaaaggactctgtgtgtgtgtgtgttatccagacaccattaatagccattgtacaggcaagtccaacagaaaaggactctgtgtgtgtgtgtgtgtgtgtgtgtgtgtgtgtgagagagatggcaccctgcaagggaatggcatcctggttcctggcaaacaggttcctgccttgctccctgagctactgggatgggcatctgccacctgtgacacggaactggaataaaatgaatgaatgtaaatgattgtcaaataaacattcatcaagtctacaataatcataaaaacacactaaacaacgtggtccaaaagtactcagtgtttgtgtttgtttctgaactttgtggtgaaaggaggtgctccctaccattttcactttgcaaacatttattctgtgacttaaactacaacgactacgaccgccatcactcacttatcaccagaaactgggtaaatcattatcttacttgtttttattaatctttttgaaatgtaagtagagcttacatttaattcactgtttaatattagcggtgtttttggtctttggaagtttgatgatgtttctgtaacctgaagtatgctgaacttaaaactcttgtttacatcaattagcctatagaaaactggtttgctttatggtgaaaccatttctgtcctccaaggctgtataattaacttcttatcctcttcctacattcagtgctggaatgggtatggaagcagagaacaaattggaatgtctttagtgaggacttacagtatccccagagggctggggtgctctcacaacaccaaacacatctcactgtaattgcccatttctcatcagtctccaacaaatgagactgtaggttccttaaaggcagcaactgtctcatatccccaagcttcctacaaacccaccatctgcaacctccgcctcccaggttcaactgattctcctgactcagcctcccaagtagctggaattacaggtgtacaccatcatacctggctaatttttgtatttttagtagagatggagtttcaccatgttggccaggcttgtcttcaactcctgacctcaggtgatccacccacctgggcctcacaaagtgctgggattacaggcgtgagccaccgcctaatagtgggcctaatagtggacctgtgctgcatttgacccactgaaagaatcaatgaatatgaatatacaacagaaacattatcaggaaagatatttcttaatagacattttagttggacatgggaaactgaaaatgtagcccaagctacatatgatacaacatttctactcaggtgaatgttaacataaggtatacctccacggaacactcatgttcatagcagcattattcacatagccaaaaagggaaagcaacccaagtgtccaccgacaaattaatggattaaaaaaaagatatatacacatatcatggaatattattcagcctaataaggaaggaaatttttgcacatgctgcaacacagatgaactttgaagacattatgctaaatgaaataagccagtcataaaagaatagctatagtatgaatctttttagataaggttcctagagtaggcaaattcacagagatcaaaagtagaacagtggttggcagggactaggggaaggggagatgggggagttagcattgaataggtacagagttttagtaggggaggatgaataagttcaggaaatggatgatggtgatggctgcataacaatatgaatatataacaatgtccgagtatggttaaaatggcaaaatgataaaaatggcaaaaatggttaaaatggtcaattttatgtcatgtatattttactacaataataaatatataataaaaattttaaattaaagaatatacacattcatattttttagtatctttagaagctttggaaatcaaaaacaaggtttcagagacaaaaaaggaacttaatgatccaaatttttaatcaaaaaagcaattcttttgccacctccctcaacaccctaaaagtcaatcagaaaacactgctttgtgtcaataattaattttacctaaattatgacaatgttgcttaacatcaaaattccaggaaaaatattccactgacctgaaaagaaggactctgaagtatgcaggaggaaatagattcatcctgtagcacatgacaacacatcttcaagaaaggaacactatgactcttggcttaccataagcgtaacattactgatatactgccaatattaagcaaaatgaaataccactactaaatattctcacttggggccctttaacataaagaaaatttagtatttttctctcatcttcctataaagtttaactctgtaagtctccccacatattaaaattatattttatacaaaatatagtcataaaagctattttatactggtcataaaagcctcatcatatactcatatcaaacaaaaaagaaaggatccattagacactcacaacatgctatgctgtgagttttggacgtgggactccaatcctaaaagcgtcctcaggcccaccctcgcttaggacaagtcacaagccttctgcctccatttccaaccatcctattcaacactcagccattcagtccttctgcatcattttaaaattcatgaggataatctgtttacaacttcaccatctcaaaatttacttagtttttctaatgtgccaaatagcacgtatatttttttccatggtaattataaaaaagttaaaagctgaaaaattccttttttccctgtattgttggctttcaattttaatgatacatcactttaaaagagccctgaatcttaacaaagaaacactcatcattaatagtttattcccttaatcaaaaataattcataactctccactttctattacttattaaaggcccacgtaagccctcaggctggaatgagaatgcctatgagaactggttttccccctttctttcaaaggtaggaaaggacttactaactcaaataagtccttcaagtccagatggtatagcatagcatctcaacaacaggtaagagagtacaagcagaagctggggacaaaaagcaaaggataaaaaatagttccttataaaaatgtgaagagatctccattgataaggagaaaaccttaatattttctggtaaagctataatgctgatccctacttctattcaatgctgtgggcaagccaatcaatgctgtgggcacggggaagggaggggaatggaggggagggcaggggaggggaggggaggagaggggaggggaggggagaatatggtgccctaaatggatcaggccactccccagacactgtacccagagccctgagccctgcttcaggcagggaggaaagcatggtgctgttcctctccacaggcctcccgacttcagccacagacaataagatgggggtggatcccttacttaaaaccagacaatatcgaaacaataaagtttggccgggcacggtggctcacgccttaatcccagcactttgtgaggccaggtgggtggaccacctgaggtcaggagttgaagacaagcctggccaacatggtgaaactccatctctactaaaaatacaaaaattagctaggtgtggtggtgtacacctgtaattccagctacttgggaggctgagtcaggagaatcacttgaacctggaagatggagggtgcagtgagccaagatctcaccactgcactcaagcctgggcaagagagtgagactctgtctgaaaaaatataaataaaaataaataaattcagctttcagagacactgaaatgtgaaaaagaaaaaaaaaaggtatcttacaaagaaatataagtaattgtcacaagatcacaaagctatggagtgctgaaggcaagagttaaacccgggcagtctgattccactcacggtgtacgtctagtatcctggcataatgactcacagcattgaatcgatgccaaagtcgcccaaatgatctccattcttgcatttctccaaccctctccacactatatccagaaagagtactctacgcattaaactgcccttgccacttcactgtctaaaacccttcaatggctccctattgccctcctcaagaacaagcttagcttcattaccaggcctaccaggatcagcgatcttgtccttgctcttgtctctggcctcatttctcaccgtaaactctacaaggcagccctcctgaacctccttagggctctcaagtcacaactctgggactaagacagcccacaaatggaaatacagcaagcacagggagaaatggatgggagcagaaaaaagatgctagtccccccactccaacccacaggacccaaacttacacaaaccatgccttgtgctttgccatgtctccattaacaattcatatattatgtcaaatccctcgaattttaaaataaaaataaaattcaaaggtaaatgttagaaatctatgcatttatggctactgcctaagtcctattcttttggaatcatttctagaaagggtaaaagctgaccatactcagtacactggtcaaagtctgaacccagaataccaggaaactccatcctccaacaccatcccccaaagcccactctgcaaaggcaatgacatttcacaatttctccagcattcttgaaacgctgagggcagtagtttgtgctaagcacacagtgaaagtcatgtccagttggccgttggttcatgctgtggctactgccaattctttaagtgttccctcacctcaaatctttgatgcacgaggtccagcagtcgtcactactaagtcaacactgagacatgtaaatgtttgtgaaatgagtaataaccaggatggtacaattaagctccccatgagctcctccccactgccacctcaggcctcaccagacattcatcccaactgtggaatcctgaagataatcagagcccgggaggcagatcttcacccctctgagcctcagattccccagaagtaagctgggaacaataactcctatttcacatggctactgcaaggatgaagtgaaataaaatgtatggaagcaccaagccagtgactaatcctgagatggcagcacatgataaatgcttactgaatctgggaaagcaaaattattctagctcaataaagccttttaaaaagaccagcgaatttagcttcaaattcagtgcaagagaaataatcatcctgggcccaccatcgggtcatatgccaaatgtcttaaatatcatcttatttaatctttgtaactatctgtgcaaatgatccccttttcaagtaacagtaaattgaggctcagtcaggttcaataatttgctccaggttgcagagaaagaacatgggagatcccataagaatttgaactccgttgaatttgaacccagacttcgtgtctttaatctccctactactctgttgacaagaccctgaagccagagagagaggaaggtggataagagtccagaaagggcaaccatgccaagttgatcagcacaccttcatcagcacaagtccaaatgaccaaaggcgagtgtcactcaagggcaaaaagatggggaaaggtaagcaatcagtttaactgcctagttcagcccaactaggatctttcagtgacagagcttaataatttaacagcataagtcctttatcagcatgaggcgggtgactccctggcactgtgattttaagcaaatgactatagggcctctctatgcctctgactgcttctataaaacatggagactgtgaaatctcccctgcagtgatgttgtaagggttaaagaaataatgtgtggagattacttcacgcagccttgttatatactacatgcccaaggaacagttctatgattatgaggaccctttcacaactaggatttctatagccccttccttcttcctcatttgctgaaatgagccacatcatccctcaacttctcctgttccttacctccctctcccttctctgtgcaccctactcattgactgagaccacaaatgcttactgaataccaactccggccagctggggaatcactcacgctgttacattaagctgtatcactttgcctttgtggagcttacattcttaaacttgtaggagagcggggaagacggccaatgaacaaataacactaccaggtacagtcaagtgttataaagaacaaagcagataagggtacagagaataatccctggaaaggcagggctgggtaaggtaattaggaaaaagcctatctgaagaatcaacgttgaatcagaaagctgatgaagacagagatcaggcaatgaatgatcagagggaatagttctgcagacacagggtaagtggttgacagaggccaacagtatcttagaaggctaagaacacagctcaattgcagtacccactatgttttagtataactacaggtttataggccagttgtacctctgtgccctctgaaggtaggagctgtgtttcttattcctgtctgcattcactcagtcatatttatctgcccaacattctataaagaatgagctgtaataagcattcagaaaatatttgctacataaatgatatttgtttgatttttcagttgtgggggttaattttattccctgctgaattctgggctttctgaagccccatttagacttctttgtatacccaaaagtgccattgtccctcaacttctgctatccacctctcccttctccatactaaactgctcactacaactactctccccctgttctctcacctctgcctctgcatgaattcacctggactgccttcttcatcacctccaccttcctcacaaactctcaagattaatctccaaatttcattagtgtactgatattatcatttgttcaaatatttccaaatctctcaagttcttcagtaaaacttttccatcaagtaacagaaagtgatgcatcaagtgacaattgcagattgagtggtaaagacagctgaaggacaaatgatctgaggttacttatgtaatttcttttcctcccccaaatatgccatatttcagtgactttctgggctttgcgcctgcagaactagaccagggtacgagggcaggaatgttctcactactgtgggtctgtgcactcaatcactcacccataaaagaaatgccttatttacagcaaacaaaaccaatttaggacaaagctatcacttaacggtcttccccacaaggaaggtcaatagtttagcatctaaattatttgagatggattcccttttctaaaagcagaaattgcagctgtacttcattttaaaaaaagaaaaaagtcaaatatttattctcctaggcaagagggagatacaggtaagtcacaacttccaatgcagccgccacagcctcatttagctgataagaacttgcccataacctttagtccttcacttacaaaagtcatgcattcatctttctcctcccacttccgtaaaggcagaaaattaggctggagccattctttctgagtatacaacagcaggggcatgggtttaagcagtttctttgacaacatacattcctctgtaagtccctggacagaagctctgggctgcacagaaaacatacaacaaggattctaaaataggaggcctggccaggcacagtggcccacatctgtaatcccaacactttgggaggctgaagggggcagatcacttgaggtcaggagtttgagacaaacctgaccaacatggcgaaaccccatctctactaaaaatacaaaaatcagccaggcatggtggcgtgcatctgtggtaccagctactcaggaagccgaggcaggagaatcgcttgtacccaggaggaggaggttgtagtgagccaagatcaggccaccgcactccagcctgggtgagagtgagactctctttcaaaaaaaaagtaaaataaaattggagacctgaaaggcagtgcttctcctacaagagagctccatgaacttccactagccaaagagaggggaaataccctaagagacaacaaaactgtgcttagacttaagaaccatttcaaactcagtgccctcagccaacatttcccctaagacttgactggcagtatgtactcatatcttgcccaccatggcagtgcctggctatattacaccaccaagtactgcacacacttttcacttggctatatggacacagcaacatggcccctgtctaccaggatttaggtctttggaaagacttctaaccatggttagacccttactgctaaattcactgaacaccactctgctaaaagtttcaaagccagcctaacttagatttataacagggggcgtgtacagtacattaattacatgcctgtgctttggctgccaggactgggattcagcctctgtatggtttaaacccctgaaacctccttagcagaccctgcaggtctccacatgatttggcccttgtcttcctctcagacctagtctactaccactttccccctctaattacctagacatgcccagctcattctcatctcagtctttgcacttgctgtctgctctgcctaacacactcttccccttagtctcacctagctggctacctttcatcgctcaggtctcagctcatatgtcaaaaaggccatctccaggatcacttacatataatgctgagcaatgtgaagtatgtgtatgcctacatataatttcacctaaagtacaaaactgaacaaaaccagcgttataagtcaggggactggtgaccctttgtagggtggaggtagtgacaggcaggagcaccagggggcctctgggttgttgttaaatgatcgttttcttcatctgtacctagttagctgggtttgcattcagtttatgaaaattcatcaagttgttcatttgtaattgttcatttttcagtatgtcttatatttcagtttaaaaaattatgccaatcaaaaacacaccatatcaaataggtctcctctgatcatccagtctaaactaccctgctgtgaagcaatccattctccatcccatgaccctgactgattttcttcacagaatctgtcattggctgaaatcattttcattattggttatatgtgtactggctcactctctcccacctccattaaaataaagtatcacgtggccaaagactctgcctgcctcattcaccatccccaaaccccagggcctacaacagtcctgccaaatggtatgggctgaataaaaactatatgaaaaataagaaatgactaaagtggaccctttaaggacgtactatcaatcaaaagtcaaaacagtaaagctaacagcaaaggtgaaaaaaaaaaaaaaacttcaatgacactaagcatcaggaatatgtgtcaaatgttaaatttaaccatagggaggaggtagacaaaatgtcattctatgggtatctttgagagaccagttaaagttatttctctaagcagaaactgggtcttttatttctgtacagacaacagtttttcacaaggcctggtggtataaaataggtctgggccaagagtggcaacagatttctgagacacttggtgaggattcttaagtatgatgagagaagtgggccatgtttaactgcaatgtctgccacgggcaagggactatggaaacgtaatatcaaatcagtgtacatgaaacagatcataggaagcacccaagaatttgaaaatagcaatactcaccatttttatggacaattctaagatggtcataaagaaaaaaataaaaatgtgtcagtggtgctaatgacttggatgttatatagttactactggcatgcagattaatttgcatgttgatataatatattttcatgaggaagtatatactcaccaggaaacagcatggtgtaacggaaacgtaaaggtaagcctttactctggaatgccacaaactctcactgtatcgttgaatatgtcattgaacttctttaggcctcaatttctctacccatgaaatgagctggctggactaaatgattgctaatgtccatttccagttcttggacactgtgtacctttctatctttaaaaaaacctacttttaccttctaagaatttacagaaaaacacatcatccacaaatatgtaaatcacagtaaccagatggggcgtgctaacagatctttttacccagttttcttgacaaaccaagagtatctctccccaaccagattttctcctgtgttgcgttcagcctcttatttcttggttagggaagtaggcttcacatatttcagctaaacactctgcattttcagtttctctgtacaattcatgagttttcactgccctgggccccatgtttctcatcaattcaagtctacactcatggtaagcaccctagttcttgttttttctaacacttaaataatgaataggacttcatctcctagagctattctccttactctattacaacagttattagtgagttttaattagacaaaactgccattccttttgctacctcactatactgtcaagcacctattaagaatattacagtagtaagtattagcaccttttaaatttacattaacaataacagagaaatggggaggcaggaaatgaaaggagaggggtaaaaatagctcacagatgtcataaccaaagtttagaggaactcaaaaaatcattaatcactattttttaaattttctaaaaaactatactatgcacatcctggttaaaattgtatgagtgataatttgcctctcatcaattaaaaatggggaaataggcaaggtcattaactctgctgtggctgaatcccagactgtgctttctttaaaagggaagagagatagtctacggagactaaccagttcagtggttgagtgatttctacaagagtcatcaccaactcaaaactttcctgaagtccttctgactattttaacgcttgccatctgcagaaggtaaaaatctgctagaggccaagttccaatcgctatccagcccaccactgaccctctttgatttcattctccatcaacaaggaggacatggacagggtcaatggtctaatgcgttttagtgacagccctgatttttcattggaaagaggagaaagatcgtttcccatttttctccttgacccacggatttgaccaactcaggcacattaaaagtctgcaaaagcaggtagcctgcaggaagttcaccctagggggtgagttcctagttgggctgaaacgggtttccaggcatgtttatcacgtggtctaaacgtgctcagggttagtgccagaagtttgaaaagcagaattagtagagctgacaataaaacctcagggctccaaaacccggtccaagaaacttttcttaaacttgcgtccagcgcctgcttcagcgccttcgccatgagtctgcgcgggcagacagcggagactctagtgcgttgggtcgctcataccccgaggcacccggggctgccgccgcgccgcccctgccccacactggagcggggttccctgctgcgcctggacccggcgccgcgtcacctcccgaagtggggcgcccgaggggccgcgcagggggtcaggcggagaccaagagtagcagggggcgagggaagcccgggcaggccggcgccgctgctggcgcccgcagctcctgcccccacgctcacctgggacccggccgccaggaagcggggccgcagcgctagggctcgcagaagcttcccggcctgcgctgctacgggggacgccatcttaaacaggaaactcggcacggggcag

SEQ ID NO: 1374 - DNA, 196435 bp, Homo sapiens
gtttaaaaatgtgttttaattatattttcatgaattccaggaagaacatcattgcagttaatgttacaaaaaaaaaaaacaaagagggacatctgaacatgcaataaaaaagtgaattcacagtgaaaataatgcatgtcagtactaaaatagagttgcttggttccctgaaggaaaagggtttcttctaattatctgttcacttggattttattatgagaaaatattctgtgaaagctttggggaagttttcaatttgtgctactattatcattagagtctgatggaagtccctcattctgaaagccgttgttcgcagtctgtaattcaatcagaaaattcaaaagtacaacaggtagtttggcaactcgcttcttgttacatacaaagccattagcaaaaatatgtaacaaaatttatgtaaaacaaacaattttgtccttatgtacaaaagacagccttcttcctcacaccctcacggcctattccaaaaagtgggaagggcatggggagcagctatccatcccctttcaactctcattatgggtgggataagaacatcctaaaaggcaaggtaactattttaaagtttttaaaactgagttataaaaatgcatctgggcttctgaacaaagagggaaacataggaaaaatgataacagattaaagtaaggaattcatccctttgtcgtttgcaaagtctcttaatcaactcaacagttagagagtaaaaatgactacatttgtgactgcaatctgaggacacagtaaaggacatcttggtgaaacacacacacattataacccgagctgctgaggagtttcacatctagggcatgcacatatttcatactgatacagtttacaacaactcaagggagaaagatcataataggtacatgggaaatgtcaccaaatctatatacaaacgcattaacagggagaacacatgaagtcaaagggagacccaaatacaagtttaaaaatacatttgaaaatcattccaaagccaaggaacttatttactgaaaactctgacattctacagaataccttgaaaaccttaagaatgcagttttaaataattcacagtctcaaaagaaaataaatttctggtttatcatcactgcttggctcagtctgcaaaacagaattatctgaacaaaactggtcaacgtggccatagtgaagagccgtgcatgccccctctgggatgccccggccttcaaggccaccccctttcgtgttcttcaggtagcctgcgatgtaggagccggtggagtggcgattcactgcaggggtgggtgctgagggtttgtttctaagaaccactcctgccccattgctggggtttggaactttctgcttgttggcttcctgtttctccttggcacgactagcaatattgcgcactctgctctgacttctggatgacaacttcctgaccagtgcccgggggagctgattggcatcctgctttgaatatagcacttggcagttgtcttcctggtcaaaggacacaagcttccgaagctgctcggtcagggcatctataggctctaacgactttgtcttcacagtcacgcccttcttgtctctaatgccagttgtaacaaaactcttactaatacactggtacttgctctcaaaattgcaggcaatgtcctctgatgttaagtcccccagacttttggatttgcaaggactaggcagtttcagagcaggcaaaggaagatgtgccaactgcttgggtacagggacatgcatatcttgagcactagattgctggggcacacaggtctggaacatttttgcatctgaatctgagaaatgattatgcacaaagccagcaccctgataggctagataagaaatactttgagttttgacatcttgaatattgttgaatatttcagggacagaagggcggagggtctctttacagtagccgtttctcaaacctctttgaaagtgttctaccacaccctgattgtacttgagttttaaaggagaagcaagttgacttgtgccctctctcctatattcacaggttgttagagaaagattttctgattctccatcaatttccacaaggctgctctccccagaattgaaacagagagtgggatcagctattacatcctccagggtcaaatcaggggaagaggcagggctgcagctcttcagtgtttcccagtcttctcccttggtaggactttttggtaaccagccacgagaagtattaggggatccaggcaggttgctttctaaggccgctgtcttggccttactagaaaggtcatcatctggtttggttttagagatgggagtgcaggtagtttcataaactgtgttcgttgcatgtttggtggtctcagaactcgagagtgctatcagctccggagatgagcacaggaaggaagacttggattttcccttgcaaaaaccatgcttgatgggcatttttaggcccaggctaggcaagggacaatggcctgacatcacactggtattatgaagatgagaaacaactgtgagagcctgattgttggtctcatcaaactggccaatcagggctgagatggaactgcccggctcattctcatttgttaaagtgacattgtcaataagatgggaaattacactctcctgcagaattgcagttgaatgtaggtcaggtatgtcagaacagagcatggagacgtctgacaaagaaaaggatgttgcagctcggcccttacccctattaccttccaggttcttaatttctaggttgctatgagaaaggacgcttcctgacaagatgcttttcccttccacaaagtcctcaggattacccttttccttgattttcacaccatgcagatcttgtgtggggttaactacaggatcgggagccaaatgctgctttggggagagagacttgctgggacaggggttttcctggcaattgcttgtggcatttgatgtggttctcccacccctaggacttgacatgcccagctgttctcctgtgactgacatgtgggcagtagatacaatggtgtccccttggctggtatctttgtggagcagagcactggaggaggatgataactttttgttgaaatttagaaaatgtggatcttttatacttgctttcccttttcttctgccatctttatcttctgctgaaggagacaaacaatattttaggtgacatctatcactttatgtaggacctgcaaacactcatgttgtcttcggacagacaaatggagaatgtaaatctgttacactgtgacagaatataattatggattgcataggtttgcaacaaagtgtctgtgtgatgaataaatggtaaaatatatttataggaatttcactggagcttccctttgaatatctattacatctgctaaggatgtaatattcattgtcaaaaaaatgtcaatgagttaccatacttttacagtgaggattaccttaagttgtttcctattcagatttgtactacacagaagcatggcaatagaaacagaacaagacagctctgttaaacaaagcattgtggtacctgtaagcaagatactataagctttcaaagttatacatgtattagttaaaacaaaaaaagaagaaaagaagaaaaacataataatatcattttcaaaacattttgggagcatatttaatttagtcaattaatttctaaaataattggaaggtgcaataaatgcattaaaatatcaatatctgttgagttaaaatgtaaagataaaaattggtcatcaattccatgtcattgctaatatctaattttttgttaatcatatatttctttttaatacacaaatttcatattgcatccttccctaaaagtggcagtaagttgtcaggcacagtaaaggaaaaccataaaaacacaattcacagtaatttgggatagcccatcatggttagtatactgctaggagagtatgaggtattcaattcttcatcagattattttaataatttaatgctttcagagtcatgatatataagaaaaagaacttgttcaacttgttattaaatagtttccaaactaaaaatattcatcataaaaattttgaaaacctcaaaaaattataaagaaaaaattaaataccatatgatgttaccactgagacagccactgtaagattttgcagaggaacagaataatatatagaattttgtagtctgctttttctgtacttaatgcaacataactatgtattgttttatatttaccgaaactttaatacacatgactaatttatataactgttttttaaaagtagacaagaaacattacctcaaaattgctttctaactcaccttaatggtattaacatcttaactgtggcattaacagatagaaccaatttctactgaatatagctttatttttcccaaagatggggttttaaaatacattttaaggcacatgttttatctcttctctgacactgctcttagcaaaatttcaagcttttaaatgttctttttctccttcaaataaaccactgaagaatatcttgtaacaaaaatcaatacaagtaaaatggtgtttgtgggaaaagagagcactgaaattagaccatttgataaaagttaaaagaataattttgctaaaggaaatcagtaccacattttacttgtctgagatgattctgatttaattaaaacatatttgttgcagagatatcaaatgcacacagttttggcgcttaaatttacccccagataggatgggttgggagtcaccaacatcagtcaaaaattctctggcacactgcaaggcggtcttcactctttattgagctcctgatatgagtcaatgatacactcaaattaaggaaaaagacaggcagcacctggtccctatgcttgtggagcccacaaccgtgctgaagctgcaggcacacctctatctctgtcagcatccaaggatcagggaagtgaggccacaggaaaacactgcctgagccacatcttgagaaaaaagatttgcctgtttttgaaaaaggtggctcgtttttaacatctggctttctttctccataaacatttccaatcatggaaatgtgttatatggtaagaaaagtaatacaactatattcaccctcaaaacaaatcagtaaatatggcactcatttggaaaatcaatatttcaaatcctattttgcaggtttcatcttcctctctgtgccatcacacctaatggctcccctatccctcactgtcaatttcagatgttgatattatgaagctcttggtgaggaggaaatggatctacctggcccccaaagtttaaaatcttctggtctggaagatcacattacaaagtatttatttttcagtatattttactttgactacagaatgtcagccacttcataatggtaaacagggactgacatgcagcctagaagggtttattctcagagaaacttaaagcatcttacctagagagttttcttttccttcaatgtcttttgctgtttcagatacaggcagcgacaaagctcccagaaggtttctgtcaacaggcatagagacagggcgtgcttgcaaactgcgtgtggtcctcctcagcacgccatcttgatctcttgtggcctcggacacagaatcctttatctccaccatttcttggaagcccattttgctctttttcctgcctttggctggggcgctagctgtgcgtcgcagaattctatctccaatggatcgcttccgtacataatgggaattgttttctgaagaactgtgcctaggattcttattgaacagtcccttcagaccctggagttgtctgttctgaagacacaaaagaaccaaccacaagttaagcaaatgccatcacatcaacaacttgccttgaaaatgacagctccatgaaaaatgaatataaaccaaaatcgtacagccattgaaatatattcaaaccaagaaagcagcagctcacagcatgtttgcacaacttcatgcacatcttatcaaccttactttgcaaggacttcagccttccattcttacatcaagctttcccagaagtttcctacccagagatgacaaagtggtaggaaaagtctccacagctcatagactgctatgaacttcaggcgccttaaagcaacagatgcatgtttcaaagtggtaagcaggaagatggagtgatatgaaaaagcatgctgccataaccacttaaaaagaaatatgccagccagaacaaagcaccatgctgagaaactacctttgtagctcctagaaagtgcaatatagtataactggggttgagtattaaagggctccactgtaaaggaaaaaaacaaaacacaacaaaacacaattggggctcattgaagagggtgtcacaagtaaacacaaaagaaaaaatgcatacatgtctataaaccctttctcttagttttggggatttttagtcttatgctcattcattgttcaaccaatatccactacactgtgatgtgtggatcccaacccgaacacatcttgaaaggaataaagagtatgactcataaatggacatttatttagcagagaagatggaggtgatatagaacactttcagattttaatttatttctggctcaagtttgttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgccggccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggccctggctcaagttttaaacaaattcagaatgtaattgtttccctcaatgtgataaatgctagagataatctgtagttaacctgggattcctagaattcaagaatcatttttgaattatttacatttgtgtctacttagatgagaggcaagaccccaacaagcagcacaaacagaaatccaggactaaacacaggaagttatggtataaaacttcacgagtcttagaaattaggatccttacccccacctccacgcccttgctgacagatatgaaaataaactttacactccctaattcatgctgaaatggtccattccttattagttaggttgtagtcataataacattaatattagccaacatttctgagcatttactgcgtaccaggcagctttctaaggataagatatatatttatttatgagataggtattatttttatcccacattcacagatgaggaagcttccagctatacagattttctggcaaagagcacgggacatttctaggccccattcaatgctttaacagtccctccaaatcccgtgtggtcctgaaaattcatactggtaaccaagtccccaattacttgacatgaccagaggacaacctattgatttgtaaacctcaaatgagttctataaccaagacaacagcatcaggaaagaactagaatgcatttacatggtcgccttttcagtcctataggtagctttaaaatccattcacaatttttagattttcagttaaaaacattggtaccaaatgaatgtagcctgcctagaagtcgctgggatcacagcccagttagtacaggtaactcatcaaccatctgagacactgcatttcccactgaggccagttgagtctttttaaggattaaaataaaactcaacatttaactatatcttcattgttttagcccaacagattactgcctgagagaataatagttttctcaattctattaagcccagagagggcccctgtatagaagaaatgagtacacaccttaaatagtgaaaagagtacaggtggatcaggacatgactggaatagcagactgggcttgctgggcctccttagagtttttggttcaagaacagtttgtcaaaatttacattcctattatgcaattaatcagtagcattgttaaggaccatattaatgtatatgactttaaatcctatgatctttctcacctttccatagatttcattgatggttatgtgtacaaatatggatgcttctgtcagtccttccaaatagacatgccggtagcctgataaaaggaaagagagtcgtttctttttagttgaacttgcatttggctttctcatgggtgcaacaaaattaagtatctgacttgactgtagttctttttttttttgagacagagtgttgctctgttgcccaggctggaatgcagtggcatgatcttggctcactgcaaaccccgcctcctgggttcaagcaattctcctgcctcggcttcccgaatagctgggattacaggcatgcaccaccacacccggctaattttttatttttagtagggacggggtttctccatgttggtcaggctggtctcgaactcctgaccttaggtgatcctcccacctcggcctcccagagtgctgggattacaggtgtgagccactgcacccagcccaactatactcctttacattttacaaagtttgttaaaagtcacatttattacatgacacatattttatcacgtatgctattatgtaagtaacatatcatatattacgtcttccaaataaaaaggaatggtcagtctagagagaaaaggccagctcatacctaccaggcactaagctgctgaaggtcacagttctttgtccaacaaagtctcgtccaatgggatcgtgatcccacacaaggaaccgaaccaaagctatttctggcatgtgtactgtaaatgtcagtgtttcttcccacacagggttaaatcctcagagaaataggaaaagaaaaatcagaaaagcaaaggacttggctgaaaatgagttggcagcaacatctgcaaagcagacggtgaaaattgcttgcaatggttattaaactcatgaagacaactaagccacactcaaggatgccttactggaataaagcctcgaaatttacccccttgctagaaaataattggtaagaaaattgcctgtaaattatcacatcaaatctattaatctttgatgcctaactgtattgtagagaagctctttagtattcagaatgcttcaataagttaaaaaattatctatagtagtgatctaagaataatgttttagacaaaacaataaagaatgatatcctctcccaacagaattatgcttctcatgcaccaaagatcctgctgctgtaataaccaccaacaaccattttataaggtgcatttgcaggtttcaactcctattgtacatacatcctcttatttcttatagcaattctctaagttttttttagaggatgtttagagtttttagagtagagcagggttttggtttttgtttctttctaattaaaaaatatatattactgactttcaaaaatatattactttcaaaaactgtacaagtaacactcatcttttaaagtagggaatatcagtatttataagacattttgtagttgagaaaattgatgttcatagacaataatgtgcccaaggccacacaaggccttatagttagtgacagggtcaaattagaccatgcactattgattcccagtagcttctcacgaagcaagaccttactgcatgaatgatggcatattttcacagctactgaaaaataagttaataaggtatataattcacctcaaatactaaaatgcaaaaatacatttacttggtaaaattctctccaataaaataactataaaagttgttaaaaattcaagtactccataagtttctgtttttcttcctttctaaaaatgaaaataagtgtttaaaaatgtatgcatttcggaggtatcaaccacttaaccctatcaaaaagcctcgagctaatgaaataattatgagctgaaaaatcactgagatacctctcttgaatcagagaagatctttttgttgacttagtgatgacctctcaattatttctgagactaaaaaaagaaagaagaatctattgaacatcggtgggaaaatgcaatttgagaaggtttctttctgtgtacatgtttttcctaagttataggtttgccctactctgaaactgtagtgttccttcagggactccttgtgaacccttaatttctcaaattaatgattgtgcttcaaatgtattttacagtattaatcacaagagattgaggaaaaataggtatacaataatgtttgtgaaatgtatgaacaaacaaattttaaaagattacaaataaaaagacatgaggcttgggtaaagaaaaatttctttatattatggcgaaaatataagaagaatgctgcccctccaatcgtatgtaaatattcaagaagtaaactcgccagactatattgtgcttgcctttagagttttacatgctccagaaaaagtgagaaattatcaagacacataggcttcacaaatgagagctttgagaaaacgcatgtcataaaaatacaatataaacatataatggaggcatttcctcagtgaatttttaacccaattctttaaaatatcatttactctttttactagaaaaaaaatttcctttaaaagcaaaagtctagagagcctagattacaataccataaaaataagccacgcatcaattccacagttacttagttttatgtgttgaaaagcttttaacataaactcagatgggagttacggattttagagatttcttgctcttctacatagacactttttttagtgtaaattctatttctagaccatcttcattaaaaagtgaacacagattaccatcttaccattgtcatctaccacacgggtttgatctttacaacaatctactggcaatccaataatttcaacttcaacaaaagggtcaatgatctattaagtaaagagaaagtactattacaaataacatatttctatacatatgttaattaatctgagaatattggccaaaatgtctacatttcgacagcaactgattttacaaggtgcttagtaagaaaaagaaatggtactaggtgtggtggattcagatatatgagacaagtataaaaaatattaaattactgtttgctagtatttattaacgccaacaactttacccactgaacctacaactttagttcagggcaaataccaaacagaactgagatgttttgcccatgcacaaatgctgagagcagctgtatctataatagtcaaacactggaaacaacctaaatttctatcatgagtaggatggataattgtggaatatacgttttttgttttttgttattttgttttttgagatagggtcttactctgtagctcaggtcggagtgcagtggcatgatcttagctcatggcagcctccacctcccaggtttaagccatcctcccacctcagcctcccgagtagctgggactataggattgtgcaccacacctggctaattttggtaatttttgtagagatggggttttgccatgttgtccaggctggtctcaaactcctgagctcaggcaatctgcccacctcagcctctcaaagtgctgggattataaatgtgagccaccgtgcctggtcagaagtatgtgttcaatgaatactctcaacaatgagaaaagaataaagttctcctatataacataacgttgagcaagccagacataaaagagtacctactctaagagtccatttatataaagtttaggaatagacaaaatttgtctgctgtgataggggttggtgtttgctatgagaggcagtggggagggtagatattgactgggaaggtggacaggagccttctagggattctggatatactctgccttgatctgggtggcataataattaatcaagctatgcatgtttgattcttatactttaattcccatcctctcctctagggggaaatatcttgtattgttggtcatctgtagactctcctttctggtaccagttctgggcgacgaacaatgaaggaataaaacccaaagaatctagaaagagctgacctaagaaagtctaaagcagagaaagtagacttcttaaagcatttatggcggtaccaaattgtagagctctgtgatttccttccttaagatccaaaaatgatggtttaataggcgggagtgacaaagaacctgaagtaatggatcagctctgagaggaagggcatgagcataggagaagctgctatatagcgagaaaacagaagccaagaaggtataatggaaacaatgggctaagagctctggaaagaaaaaagactgtggccgcagatgaagacattttaaaatcacgcgacacaggtacagcagatgataataagaatcagcacatggccaaggagcaggtggctgatgtgcagcagggaggagcattgcaggaggacaggaatgtgaggttatattattaacggaacattgcctttctaggttaagatatactcttaggtgttgttctgttaataatataattgtctttgcactccaattttagcaatgctagtgtcaaccttaaattgtgaattcaattgtgtgctcttatgccttcaaaatagatgatggacagcagtacagcaagaactgtgtgacttaccaataaatcagttaatgtctgataagctgaggtcagtgctcagttatgaacacacatacatctctgaagacatttcggataaaatgtaaatgcactaagataatcacataattaaccacttagacacgtagtcataggcaacttacctcgcctcgatctccaaacatggagtctggaggtttggggagttgctgtccactgataactttcaggatgagctgctttttggggttggcaggaagagggtcaccagagaaagggttgaaagtacctaggccaagtaaagtataagttggtaacataagaagaaacacacacgcatgcacagcttaagcttgtaaacaaagaaacaaacaaacaaaaacaaatgctgaattacatgatcacataactatcagtgtggcatagctgtggttttcattagaaaccatgttgccaaaggccagtggagtgggccaacttaaagcaagtgtttgcaatgcaatgatcaactgtggaatgaaggaagagaagcattttatttgaacaccaacagtgtaaaaagaagaacaattatgtcagattcaaataattttctaacctaaactatctcaggcatgagtgaatataacaaacagaaagaagacttgaaattaagtaaacagcagagcaagaaaatgtgcaaagtgtaaaatcttgaagataatcctgtcaacaacttttttatctgaattgttatatatgtaatttggaaattttaaaaataattttaatgagcagaaccaaaagaaagtgttgtttgatctaacacattatcctttttttgctttgttttgtttcttttgagatggagtctcactctgtcacccaggctggagtgcagtggtgtgatcttggctcactgcaacctctgcctcctgggttccagcgattctcctacctcaacttcccaagtagctgggactacaggcacgcaccactatgcccagctaattctgattttcagtagagacggcgttttaccatgttggccaggctggtctcaaactcctgacctcaggtgatccgcccaccttgacctcacaaagtgctggaattacaggcgtcagcccccatgcccagcctatcctttctcttttgttagcactgttttgtaattggactacactgagtaaaagggcttgataaaattgtttcaggtggaattgaagcttcccagcaggtcacagactcacattacttaagatagtttctgaaagattgggctcagaccttaaaaagcagtccagcttatatggggcactggatttcaagtgataacccaatgctatccatgtccctctttcacacacgacctctcaagataacattctaaacatcacggctaaccaaatattaagtagtggtgacaagaattctaattcacattcaaacaccttaacctatctttttgaaaaaaaaaagttgaaaaactctggggtatcacactttctaaacagcttccttaataaaggttgcctgcatttagactatgaaattaacacacacctgcatttatgactatgaaattaatacacacctttgcacatttgctggggtttgaggacatagccacaattgccatttgccttgaatttggctcggtttaactgcatcattcgtccttcagattgataattcagtgccactgtgcaagttgaaagtgggagagaattaggcaagatggtggcatagtgagaatatacagagaaccactccttcccaaggaatacacacctagctggcagcctgcgttccagtaggggagagggttgaagttactggaatcaatgcggtaggcagaggggtaaatcctcgtgagttgcttttgattataaatcatgaactgctctgatttttgctgaacaacctgatgtgctcttgtttcactgaatgataacacatttcctgtggttcctggcagtttttaatcgagaaaaaaggaagtgagaactacagcaaagaaaacaccacgcacagaagactttataataatgtcagattataccaatagcaaaaagcagagcactagagagtggattcaaccagagtagaggcagctcctcaacagaaaagacccataacattccattcatagggttcttttgccattttgaggccaaatcagagctgtgtgtcttgctcaagtagctgtctatttctgggtcccctgttctccctaagaattcaatcataccgctaatttatgcctatctggctagcatgaaaagaacaggtagaaaaaataacttaaacagaatatatttgccaaatatatagacaaccatggataaataaaactagatagcttcttcctgataacaggaagacattcattgaaggcactcatctaaaaggcacacaagtaaaacatgtattactagtaacatccaggatccaagaaaataaaggaaaatgaacaattataaaaataaaaagttgagttttaaagttgctttgaatagaactatggaacaagtcaaaacctatttgggagaaaggaataataatggagaaaaagaggtcaaaagcattataaaggaataaaagttttaagaacaaagacagacattcacctagccacgcatataaactatggaacaaagtaaaggaaggtaaaagtacatgaagcctgtactaaagtttctgccagcacaatcatcaggaggggtcaatctagactcacagaagctgcaaatttgggggtcataatggagtaaagctccaaacatttaatattccactcttgtctccaatcccaccttttgtaccatatctacaaagcccccgctatttccactccttcaccaagaacccataccctatccccaaaatggccgcccatatgtcatttgaacatgctggaaaagaccagcccagataaaaagacccaaagttacccagaatctcattcttattcagccctaataagctgagtgtgtctgagcccagacagagagatgtggtccatgaaaccaaagagttgaactgtatatggtctcgctttgccagctgggcctgagtcatatctagactctgcatgtttattaacacacagtttcccagggcccctgtggtcctcagggttgtacacccttagatgttagatgctgcccaactgacaatgatactcccgagttagaagagtcaggaatacaaactgtggcaaagaaatgagaggattacagtttttaatgtgatgatgtttctagtttagaccctttccttaaagatacatgttcatatattttttattggcataacctattaacacagtttacatatctcaagcatactaatattgaacttaattgcagattttgatgagggatgttttaaacattataggagaaaatatctttttgacaagcctaattcagatagaataggactataatcactactactgttttgtctgtctctctacataaatatgcacatcacaatatcattgatacgaccttgctaattaggcacatatcaattagtatattaatagagttgagttgtatcacattaggataagccatgcattcattatctagttttcattttgtggctggcaaaaaaattaaaaagacaaaaacagctgaagttccagagctaaatagtactcaagattaatttccattaagttaataggattatgttttccaagccatttattggaaatttttattccctaaaccaaatatacctttaacttaatgcaatcattccctgagtttatttttgagctaagggcaattgttgtaagagtgtgttgctcagttgctgagaatcctacaggttctcatgctctcacatgtgaaattcatttaaatcttgtataattgttaccatttgaagaaggaatcaaggccaaagggaagaaatctttctgcaaatagaaaaagatacatttgtggagtgggggctgggcagggggagatgggagggaagaatcctggaggtttgtgaggacacaatgttgttttcccttcactaaaacttgttgagaaatttggaggtcctgatttacatttcggttccactaaaattaaaattagatgaaaagccacatgacagtaggttttttttctgtaagcattcagtaactaaatgaaatagaagataaaggagacaagagtaactagcaggaaagccaaggatatgaatagatgtgactagaatttctcagctccgtgtggcaactgataggtaaaaaacagtgacggagagaatgctactgagatttctgctctttttgttaaaacttcaatctggattaagctattttcacccaagtcaaaactttcattgagaaaatatagggcttttcaaggtgtgattttagccaattaatttcttcttttggtcattcgcatttggaatggccatctgtgacctggtcctcaagccgggcctggacttcacagttcaagtgttgcaggaagatcttgccctgaggcacttgtctttgtatagtaataaagtcctctttggccctgtgggaactttctctggcctctggtcaatcaggcaaccacagtaatcagtagaaccctccatgtgaactcaacactatagcagcagtgagtttcctgacactcaaattggtttctacatagtcccaaaaatgtgtgttgataatgggattaacaaaaattcattaacaattgaaaaagaaaggtcaagaatgtttattcagagcagaatgagaaaactctccatccttaccgtcatccacaatgtcctgagcggccacggagtttgtgtacacaaccaaatcagagagttctcggcagagcttcatggttttccttcggcgacccaatctgtgaagtacccacagaggatgcatgacattttggagttgaaagaggtttgggttcttggttatcccactttccttatttaagacaatgatttaatagggaatacctgccccaggtcctaagggagccaggattggcacccaagtgtgcttcctagttcagtgctctttccaccacaaaatcctactacagtagtccccccttatcctcactttccctttccagagtttcatttgcccatagttaaccatggtctaaaaatattaagtggaaatttcagaaataaacaattcatgagattttttttctttttttgagacagagtctctctctgttgcccaagctgcagtgcagtggcgcattcttggttcactgcaacctctgcctcccaggttcaagtgattctcctgcctcagcctcccgagtagctgggactacaggtgcacaccaccacgccagctaattttttgtaattttagcagtgaaagggtttcaccatgttggccaggctggtctcaaactcctgacctcaagtgatccacctgcattggcctcccaaaatgctaggattacagacgcaagccacagcacctggccatgagttttaaattgtatgccattcttagtagcatgatgaaatcttgtgaggtcctgctccgtcccactctggacatgagtcatccctttgtccagcatatccatgatgtatgtgtcatctggtagacatcttcttatgtgactgactgtggagtggaggttttgcagtgcttatgttcaagtaactcttattttacttaataatggccctaaagtgcgggagtagtaatgctggcaattcagatatgccaaagagatgctgcaaagcacttccttgaagtgaaaaggtgaaaatgtttgacttaataaggaaagagaaaaacaacatatatatagggttcactaccatctgtggtttcaggcatccactgcagtcatttctcatgatgacgtggggactattgtaatgtggttttattcactgctctgccaggaatcacagcctcttctcatgcatttgtgagttctgctgtggaaggctggattcccactgtgacccagttagggagtaacaccagagttcatcagggaactacatggcctttgcagggaggagaccagggctaaaatggaacagaaacactgcatagtgggtagcgggccacaagaattatacacctaaagggaaatatgccaaatttccatagtgattattggagagatgtaattacaaaggatgtttactttcttctttatactttttctatattctctagctttcttaaaacaaacattcattactttatctagtgctgtttttatcttagatattttaatagttttctctctcctacaaaccactcataggatctcctctgcaaccttacaaattgtaccaccactctcttctgcagtcaagtcctccacagaccatcacattcccctcacacacacactttttcttatgggaaacaactaccaaaaacaaacctaaactttagtgttcaattaaactttatacttaagctccaacagaatatctatacataaaatagtaactaattaggaagggcagaggagatgtatgtggtccgtactctaggcaacagaaataacatgtgttattgtctgccttttcggttataagtatcatagtgggtgtgaagaggtattccattgtagttttgatttatatctccctaatgtccaacaatgttgagcacattttcatgtgtttattggccatttgtatatcttctttttgtgaggtttcttttcgatagttagatgttcccctataggagaaaagtgggtaagtgaggggaatgtgatggtctgctgagaactttactgtggtaaaaatcaatagaaaaaagaacgcatgttccttctttaccatataattaggaaattctatagccactggtgaaaatctgattttgtgaaggctaatgattataaatcggtgtgaagtcatgcctagaaattataagtaaaactctaagacattccgtgatatggagaaattctacagaaaattaactctttttattcctcatcctagaggtgcattaggttactaaagtcccaaaaggacatcatcatagatgctcaggccctgatatctattatgggaaaatctatagttgacactaagcagcatgcaaaatgatttcatgtgataactgtattgatgtctcctttgcacacattaagattattgtagctttcctcaaacactgccttttccctggctatatgtgtcagagttaagcctttctcaaacttacatatgacaacagtcacagcagaagtctcccagcaggtgatcctattattttctctttatcctttactgtaactatatattcaattttctgttccctagagtagggaccacacacatctcctctgcccttctaattagttactattttatgtatacatattctgttggagctcaaatataaagtttaattgaacactaaagttttattcctacagggcttctatgcttctaatttcaaataatttcatttttcaataaaggcaaaagtgtgtatatgtatccatatctatctaatatatataatttatatttctttgtgaaagttatggtataaataaactgccaggaactcctgtaatgaatcatgtgtcacgatttggattctgaaaatatggtcatgttacttatcataaatactactggcaataaagcaaacaaacaaacaaaaaagaactttttttgaatacttatttaatcaggccagggcttacagggctaattagtttaattcctttaatccttacaatgactctaagagacagatacaatgaggagccaaacttgtcgcatgttaaagttggtaactggaggaacaagaatttgaaatctggctgatttcagattcctggctcctaacatgggcttagcatccatcttctttagtctcttgtgacggtctttgtattagttcatgtgctccctccctcttctctgaagataccttttacttgacaactgctgcagctaacatttataaagagctcattatgtgccaggcacagagctgagttccctacataaattatcatttcatatccagctgttcttcacatgttcgacagcacagaatactttccttgtgatccaattctctagacatgtacaagaaaaatgactaagctgacaaggatggaggggcctcaggagtgtgagtaggaaacatggagatgctttcttacctgtacagctggccaccctccttgccagtactctgctgtgtgtcttcctcatcatcagtactgtaagatttagaccgtgattttgtagttttctgccagaaaaatcaaaacaaacttaacaaactcattgtatcaagtatatttacaacatgcagagaatgagctgggctttaaaatgcacatgtgcacaaacataacttggagggagaaaatgaccaaatattgcagcttgcttcagcattaataacaagcctatctaaggccataattatattaaaatattaatacaaaactgagagtttcatgctcagaaactgacttcggagacacataaagttgatgtatcagaaagactttattagtcatgcattttgaaggtttctactaggggtagagtcaaagttgcagtatctatgtaaatgattataagggacaaaatgcccttttgtataggaagctcactattaataaactgtaaaaggcacatttggttttttaagaaaggacatgtagtaacttttaaaaaaataaataactaccatttctgcttttgatcagtatgcactcaaatgatcatctaaatcaaatttcccttttgagattttgacccattttcatttctagcagcaggaaaaaaaattgctacccacagaatacaggctgaaaggctccaggtctaatctggtgtcttttggacagatcagctgtttcacaataaaacttttttgggatggtatgatttcatccccaccaatttggagatagtcccagtatttaggcaacacagacctcaacaatacaaatgatgggccgggcgtggtggctcgcgcctgtaatcccagcactttggggggctgaggtgggtggatcacctgaggtcacaagttcaagaccagcctggccaaaaaatggtgaaacctcatctctactaaaaatacaaaaattagctgggcgtggtggcaggtgcctataatcccagctacttgggaggtggaggcagaagaatcgcttgaacccaggaggtggaggttgcagcgagccgagatcccaccattgtactccagcctggacaacaagagcaaaactccatctctaaataaataaataaacaatacaaatgatggggaaggaccaccccaataattgccgaaaaccttgccatcgaaaatgcagtgtctacaaacaaaggtaagatgtttagacagagaaccctggacatcaggaatgtggcttagaaagggaaagggtctccatccccaaattaccataggaccatgccaccttctagattttctcatgcttctcctaaacccccccaaaaatcaaacaagctacactgttggcataaacacactcaacttctctctatttcagtgacagtaagatgccagtttggtttggaaacttctccggcattatttatgccttgagtacctcagcttgcaggtatggaagccctaccatttgatgatctcatgttccgtctttcaccaggctggtaaactggctaacctcactagcttcctattggatctttagaaagagtgtggcaagaacatctatttcaaaggattattgttgtgatggttaaataaatggcacagaaagtcattctgtaatctatataacattacctttccatttaaaatactgtcaatatttattaaaataatctataaatagtctaatggacaacaatttattcttataacttgaggtatgataaattttagttaggtgaagtactccctaaaacatctactttgaaagactattttaattgtaatgacaagttgcaatccagaaatgaaatattctctaattccacatagttagtaatttgagttatacagtaataaatgtctttttaagaatcatttttactataaaatgcaaaaattagaaataagaaatgaatcaccaatgacagataacattcagagaatgatatattttctggacatacagttttgacacatcttttcatggttatcataccatagaatctacttctcatcttactttttcatttaatgtttcacaggtcgagctcttccgagggatcatcttttaatggctgcatcattgtccattatgtgaatgattcacggattacttacacagtctttggaggtgaacattttggttgttttcaatattttgtgataatgactaatctgactagcctactaacaaattatctcactgacgggcaggaaattctaaatatgacattccttaaagtagaagaaatggccttacagaaacctcacgtataatgtaaagttctccatctaataattgaattcttatgtaagttttactgacaaacagctaatctgtccagaagacaccagattagtgtaacatcttttttcactattttattgaagtgtaacatacagttgggacagtacactggtcataagtgtgcaggttgatgtctttcacaaatcaaaaccacacatacgacgaaatagaatattatctgtcccccaaaagccttctgatcctccaattctgtcattcctttctctgtgaaggtaataactattctgatgtctactctatagggtttcttttgcctggttttgaatttaatattgatggaataaaactgtatgtactctcttgggtctggtttattttgctcaacatcatgtttataaagatcatattattgcatatagttgtaattttgtcattttcttagttgttaactattctcttatatgaatacaccacaatttttactcattctattatcaatggacatttgtactttttcctctttgtactattaccaatctcaatataagtattgttacttctgtcttttttttttttttctgtagatggagtttcactcttgttgcccaggctggagtgcagtggtgcaatctcgcctcactgcaacctctgcctcctgggttcaagcagttctcatgccttagcctcctgagtagctgggattacaggcacacaccaccacacctggctaatttttgtatttttagtagagacagtgtttggccatgttggccaggctggttttgaacacctgacctcaggtgatccacccaccaaggcctcccaaagtgctgggattacaggtgtgagccaccacgcctggcctatttctgtcttttgacatatacctaacaatagaactgctaagtcatagtacatagtgcagctttagcagatactgtgaaatagtgggccaaagtacttgcacaaatgtgcacaaccataagtagtgtttgagaattcaactgcttcatcctcactaacatttggttcttgccatcttttaatgttacctgttgtggcgggcatatatggaatcacatagtcattttaaattgtgtttcccagatgactgacgggtgaattccttttctttattagcaatttggatatcttcttttgtgaactgcctgtttaagtgttttgcccatcttttagaaattaagttgcctatctttttattgatttatagaagctatttatatattcaggatagaatatataatacacataccagttttaataacacatacccattatgtattggatatgtatatttaagatgttaaatacagttttttggatatattattggatatatgtattcaaaatattctttcccagtatgcaacttgctttttgatactgttgatgcgtagaagttcttaacttttaaagtagtttaaatatcaatcttttcctttgctgacgtgctggttaagaaatcttcagttattccaaggtcatgatgatattctcctgttatcttccagaatctttaaattaactgaagtatgcatagttattactcttaattcataccttatgttttccaaagttggtcatgagggatcgtccatgtgatttctttccactttcctttacatctggactctgaataaataaaggcataatataactatttatcttctttgcttttgtctttttccttagttctggtggaatagcaagggggccctcttttctcttctgtttgcctctaggtgagaaacaagcagactccactcatttcctcctgctccacactccactaccacaaaggtggctctgcctgccttggaaagggaaatattggcatggagagatggatgccagccaggacgcagcagctgcctgcaccttcccaaagctgaggtcaagggctctcagcagtgtgcaggtgtgctggccctcatggtgcctgttcaccaggctctccacagcacaggatgtgttcttttaaatgttctgagtggggttaagtcattttcagttaagtagggattcagttttggaaaatgaccaaaagtcattagcagccaattctattgaataaagaaagtggatcacattgactaaacagtgctatgtgggattttaaaacattataaataaataaaatccaaggatatctatgagataatagattgtttttgtttaaagtaaaccaagcaaagtttatgtgttcgttgaaataattccctctgtgatgagcactggaaagaggtattgtagcctctgaatttttcctcacataggttaattttccagttagagatactgggccaactctctttcctggagcctatgtctcattaggtaacagaaagtccacctgctaagagagtttaaactcttattcatttgtcatccttaaaaatatgttaggtggttcattactaataacatggtataaggagagaccagtaggccctacctgaccaagactccagctaaacagagaagaagcaggtaaccacataaatggaataaatgtgggtgagaaaaaacagttaaagccaaaaggttgggaaggggatctgtatatgcccatagatgctaatcaaagatgcaagtaggggtaggaagagattgggtggagtccaagaactggttggggaaagagcagttcaaaaaatgctggaggagtaatggtgaggggtttacaaggtgattgatgttaggtaactgttaactgattcatacatgtttattgcttttggagatctattaatgcggatcattaactgttcaaaaactgtggaattaagaaggcagctggatgtgatcatagacatagcactgctctccaagtcagaagacccagttctgccaacaagtagctacatttcctttagcaagcctcttctcttggtccgctttttttttttttttaatctgtgaaatggaccaattaatctgtgagttcctctctatttctagtagggactatgccatttattatccaaaacaggaccttttaagaataaaatgggatacttttaataattatgctgggacaacaggtataaagcacggctgtcacaggcaaattgaggtatatggtcaccctatttagtaggaacctattataccctaaggataatgctaattgcattacatatattctcatttactatgcataaccaaccctgggaataagtataattaaattccaattttacagaaaaggaaagcagaaatacagaaagttagattatatgcccaaagttacaaagcttgttggtgataaaacaggattctgtctagctacaagtcctctctctggcttccttccacttctccaacattttctatcccattctcactctctttttttttttttttttttattatactttaagttttagggtacatgtgcacattgtgcaggttagttacatatgtatacatgtgccatgctggtgcgctgcacccactaacgtgtcaactagcattaagtatatctcccaatgttatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcgtcattttttatggctgcatagtattccatggtgtatatgtgccacattttcttaatccagtctatcattgttggatatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctcttattggtctattcagagattcaacttcttcctgttttagtcttgggagagtgtatgtgtcgaggaatgtatccatttcttctagattttctagtttatttgcgtagaggtgtttgtagtattctcttatggtagtttgcatttctgtgcgatcagtggtgatatcccctttatcattttttattgtgtctatttgattcttctctctttttttctttattagtcttgctagcggtctatcaattttgttgatcctttcaaaaaaccagctcctggattctttgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttagcattatgtaatggccttctttgtctcttttgatctttgttggtttaaagtctgttttatcagagactagaattgcaacccctgcctttttttgttttccattggcttggtggatcttcctccatccttttattttgagcctatgtgtgtctctgcacgtgagatgggtttcctgaatacagcacactgatgggtcttgactgtttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcgtttgagggtaacccgacctttccctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccacatcactttcaggtacaccaatcatacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttgcttttcagctccatcagctcctttaagcacttctctgtattggttattctagttatacattcttctaaattttttcaaagttttcaacttctttgcctttggtttgaatgtcttcccgtagctcagagtaatttgatcgtctgaagccttcttctctcagctcgtcaaaatcattctccatccagctttgttccgttgctggtgaggaactgtgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctgtttgtttgtctgtgccctgcccccagaggtggagcctacagaggcaggcaggcctccttgagttgtggtgggctccacccagttcgagcttccaggctgctttgtttacctaagcaagcctgggcaatggcgggcgcccctcccccagcctcattgccgccttgcagtttgatctcagactgctgtgttagcaatcagcgagattccgtgggcgtaggaccctctgagccaggtgtgggatatagtctcgtggtgcgccgtttcttaagccggtctgaaaagcgcaatattcaggtgggagtgacccgattttccaggtgcgtccgtcacccctttctttgactcggaaagggaactccctgaccccttgcgcttcccaggtgaggcaatgcctcgccctcccattctcactctctttatgtaggaaacagatatctacaaatacctatcaccaactttgacctctccctgagcaccggcacatctttcactgaattattgagtaagacattgtcctaggaacttggcatatacataacgacaagagcaaacaagagagatgcagactctctccctactgggcttgcagtctaatcgtagacacaaaagattacaacacactgtcataagactataatggggaaagcttagggcactgtgggatggcacagggagaccatctacctggatttgaggattaagaacttccaaggggacatgacacaaaagctgaagcctaaaggtgagtacaagttatctatgtgaaatggggaagacgaagtgtactatggccaagaaaacagccaatatgaaagccatgtggtaagagcacggtaccaggaaatgaagaaagtggaggtgtgcacgtgtggactcctacacatgcacactctgtgggtgtcaccgctaggagccagaacagaaaggaaggatcttatgggctattatctctgaatttgagctttatcctccaaactatgaggagccctgagatggttgaagacaggagagtgacatgaccagatgcacatttctgaactatcactatggcagtggtgtgaatgagacattaagcagggcagctgagagcttaggaacttgttaaggttattcaggcagcagcagttcagatataaagaaagcagcagattccagaactcttaagaaccatttcctgtgactactaagttcttccagcctgaaggcaaatttcatttttacttttcttcagagctccgcaggaaaaagacaggacaagtagaaaccagtcctgcactgttaattgacggtccagaaaagtagaagctggagtgacgtgctgcccagagccatactcagcacattctcagctttggatttaaaccgacatatgtatctggcacagagggcctcgtctcaacagtaacttgcctttgcttgcccagtgaaccaaaaccatatttttaaaacatagcagtgttaaaaacctcaaaaataagtaaaaaggagatgagttttgctacactacctctcaaaaatttttggttctcttaccactttacctgatggagaaattgtcattaggatctcttcagtgaaagcaaaagatagaagggcttaatttgtttcttccaaaatatccaagccttatggttgcatttccaatgagaataatctaggatggggcaaagacttctccaaacgcataagggaagtaactggcccagataagccaatgagagttcaccaaggacaagaagcagaatcaagatgggctaaacaagtctgatcttacaggcacttgtggtgttgaaaataaatggctggaggcgaggagggtggaaagattgttactattcatagaaattattaagaaaatccagaattacatggtaaactataagggcagtaatgctgtcattgaccttttggttgtctccccagtattccatctgcccctctaacatgcagtttgagaggagctaaccttgacaagagcttcagaggtaagttctcactggcattagcaagccaatattatcctatactctggccaagtactgtttcaggaaggacacttacccatggccactatgattagcttgggggtaggcacatgaactaggttaacaaaactctcgtttgttagttggggcaaatatgctgtctcaatctctctggatatggaccaagaaacatgtaactcatggggctattggcagttatctcgcaaccatcatagacaggagaaccagacttgagatgacactgatggcatgataggtagagcaaaaaaatagagctacaatgacaccactgagccttgggattaaatccaccccataggccattctacaaataaatttgccgcttaccaacatcttcttcatcattgaagccattttgtattaggatttctaagtttagaaactaaatgggcctgaggaacagcctggcagttggatggctagacttgtatagggtccagagggcaaccatcaatgcagagtgatcacttaggatccaagggcggtcacccccatatgatcttccttctgcctgaagagccctcagccctgaaaaacaggtggtaagtagcagggaaggcagacatctaatgaatgtggagaggtgggagtgtaagggacacagtgggctgaaacttcttccctcacctgagcatgcattaggaagatgagtctggaaacactgggctttgtcctgagggtccaagtggagcagtatttgagtcatttctacctccacccaatccacttttaactatttctcatatcattttgcaataagagattttcatttctcaagcaaaatgaggacagaaatagaagaagttggaggagcatttcacaaatgattagaaacaaagtatgagatgctttttttttcctgttgaaggataagtacaagagggaatcagatacctgcttcaggtgtgcatttaagccttcatgcgtggccttcagtagtgcccgcactgtgaaactatcaggatcttctttatctcgaatttgagattcttttaacagtgactccagttttttccttatgaaagattccacctgatgctcagtggtcccattactctgcaaagaattaagtaacacaaatgatttccttaagaaacacaccgaattagaatataccctttgatcaagccacaattgcttctataatttcacttctctcaattacttgtaagaaattaagctcaagttcattgtaccatctcagtcttccctcctccacaaatcctttaataataaggattactatttattaagaactaattctctgccagctactcttcatgtgactgcattcagtcctcaggaaccttataagtattattatcatttccatttcagtgatatagaatctgatgcttagagagaaatcaagtaagttgttcctggttacatagctagcaaataactgaagcaggattcaaactcaggactccaaagcccttccccctatgcttatgctatttgatgcttttaacagataaaaggccagggaaagtttttggaaactaagttttctaaacctacataaataaattagaacaaaaatatgctattaaaataaaactacttttttcactgaggagaaaagaatgctatggaaatttcaggagttgaggattattgtgagatatatttccttactatttccaatcccattgtatagttagggggaaccccaattattacctcagccatgatttgtcattacaattactttaagatcacaacaaatttcaaggggtttggatatcagagctatgacctgtccagatgatgactcacagaattttgaggtgatcatgggatatagattctctcaaagtcctgcttagcacagcttttcggccatttgttctgcttgaaaccaatggccccagcctccgttcatagctcttctgctcttccagtgcacctacctctccctgtttccaatacctttccataaattcttcaaccacttgctaaagaccaaccccccaaagggaggaaagggatactccttcacaagagcaattcccacattcttcacgaaaagtttaaggctgttcttccatttgcaaatctatttctaagaggtcattatatgtggactctgcataatgggtagctttccaataatgcattcattttcacaaaatcctgtaagagcaaagcaattataaatgccctaaggaaaaatttcaaaaatctataccaggataggttattgaatttccctgtatcactatcacatgcattaatatctttaacatgcccaattaatgaggcactccacttccctggagacctccaggtccagaaggagatgcaaggatgaaaaaagagttggctcttaacatcagaagggaacaccctcctgtcatgctagaaaaggcatgtccccaaatattctaccctggtcatcagagatgcccacaaaagcacagacaaccaatacaacagagtttctgataaggaacacggcattactacctgagtgactgagaaggccccacaaaagaggtgggaagtgattgtaactcattgtaactgagatttcaacagtgatggaaagaagggctttcctgccaaccacagttctagcaaaggatttacatgaattaagaatgttctgtaaatgcaaagaacacatgagttttcctagagttcatggagtagggtagtggcagataaagaactttggagagcggagggacttgaaagcaagaggtatggagctgctaagagagtctttgagtgaacaagtccttgggtagcaactctagaaacagtattaatctggcagcgtatgccaaaagaggaagtgtgtctgcagatgaaacatcaggcacactgggccccagtgcaggtactaagtgcctaggccaatgtgctgggggtagttaataaagttgagagatagtttgggaacaaaactcattttgtattaaaaaaaaaaccatgtattgtgtttctgctgtgccaggtgagaagtattaaagaggaataccccccactgtcacagagccctcagtgtcattgagaaggccaacacatccctggataattacacaagcaggaacaagtagagaggggtagcatatgcacacagaggaggcgcaacttgtccagccttggggaatcgggggacaattccaggagcataagaaacctgagtcaagccttaaaagataagtatattagtttcctgtgacttggccaggtgccatggctcatgtctgtaatcccagcactttgggaggccaaactgggaggatcgcttgagtccaggagtttgatatcagcctgggcaacataatgagaccctgtctctacaaaaatttacaaaattagctgggcatggtggcatgcacctgtagccctagctacttgggaggctgaggtggaaggatcccatgagcccaagagtttgaggctgcagtgagctatgatcatgccacatcactccagcctgagccacagagcgaagccctgtctctaaaaaataataataaaataaagtttcctgtgaccaatttaacaaattgctacaaacctgatatcttaaaacaatagaaatgtacttattttctcacacgtctggaggccaaaagtatgaagtctaggtgttggcagggctacactccctctgaaagctctaggggaggatccttccttgcctcttccagcttatggtggccctatgtattccttggcttgtggcagcatcactccaatttctgtctctgtctttatatggtcttctcatgcatgtctcacccatctgtttgtgtcttctcttcttatgaggacattgtcattggatttagggcccacgtggttaacccaggattatattatcttgaagtccttaacttaattacatccgcaaagaccctttttccaaataagctcacatacataagtaccacggattaagacttgaacctatctttcagtggccacaaatgaacccactgtaatgactaacagctgatcatctggcaaagagtagggggacagcatttcaatgtgaggaaaagcatggagaaaacaaaaagtatcaaaagaaccagtaatcatatgagcaaggagaaatgagccacagggaaatacagaaaaagcaactaagattgtacacagtagtccccctttatgcatgggagatacatcaaaaaatcctcattggatgctgaaaaccatggatagtcctgacccctatgtatgctgtgttttttcccatatagtaatgggtggatacactggacaaagggatgattcacatcccacgtggggtggagtagacagtgcaagatttcatcacacttctcagaatggtgcacaattcacaacttacaaattgtttattatagaatttttcaatcaatattttgggccatgattgactgcaggaagcaaacccacaaataagggggagactgtattgtactaaggctcccaaagcactgtcatgtaaagatacttcatttgagctgctgaaccctgtttaaggcaaacactagggctagccaattttttctcataatgacacaggcagaaaggttcagccactcaaccaaacacacaggcctatgaaaatggctgaattgcagcttgaacctcctaagacttcccattcaagactgtggctatttttccatacaatgcagcagccatccctcttatattgttacagaaaaagagaaaagagaaattcttgagtcaaagtaaccatgcacaggttcatattttaaaaagccattatttctatcatggaaccagggaaatacatcatcacaatccctctgggaaaaacaatttcacttaaggtcagaagcaaatccaagaaaagaactccacgtctctaacccccaacgcatttgatcaagacccagggcccaaaggagtgtgcatttgctgcgaggacaaaaaaaaagaaagcatttaagagcacctagggtatccagtatcacacagaatgctccaaatgagcatccatttccttctctcactcagggcctcacaaagaggcagagacttcaagtaaggagaagatctgtggccataacaccaagtcactttcactgtcagcaaggaaaggctcaaaatacaaagccagagccgatccagagctggtaaaataaagaatgcttaacacaaaagctataattattcacttcacatcctccaaatactgggagctgctaaaggaatgatatctctgcctgttgatctttttctgctctgtgatttactgcacaagaaaattggcagctgtgaagaacaaataaatgtgtggctgaggtttcattaatatattatcattcagccctggaatccaatagcactactgaaaggaagctaagacagacacttgacctcgagacctatcaggcaccatgcacctgcagcagggaccacagctgaaagccatatgtatcttgctcttttgttctctgggccaatgggtgagaaaggacgctgcagctgggggctgggggagagcagtcatttcatatggtgggtagtttccaccagagaagtaatcagggttctcaattcccttttttgagagataaatctgatctaggaatccctctaccacaagtaaataaattaaacatattctcattttgtctccagcatgaagctaaatcatcgctgaatatgcagaaggatgccccaaaccacaaccatcattccagactgggaagatccaggaaaggggagaaattgggtgctgctccttgaaaggaaccttccaaacagtgggctctacctgcactacacattgcaatcaccagcagagtgctcagaaatcccaggccatgccccagacccatgtatcagaatctctgggccaagacccagacactgcggtttttgaaagctacccatcattccaatatgtggccagagttgaggaactttgcattaaaaaaaaaaaggcaaaaaagttgaggacctttgctttaaaaaaaaaaaaaaaaaaggcaaaaaactaaaaactgaagtatttcaacatccccccaatttttttttcctttggctaaagtccaaagatgggaagaataatatattgctgccctttctgagtgccttactgctttccaagctgtaagacctgaaggtcttggctgaagaacagctgcttctcagccattcaagcctgtgtgtttactcctgtcctctaccatctcctgcctgctcctttagctcacttaacaacatattcttctgttcaaggaccagtcatatccatgtattagaaacaactagaatcttccagggagattccaagtcacctttatcattctctaccccttgtcgccaggatgtactagcatgcccagcacctgggctttttgactcaatgaatgctttcaacagcaagaccttgtaacctcaagaggtaactcatgctgtctttgagtgctggtatgttttaaacgaacaagattcataatcctttttaggatagctcaaagcataaaaggaatgataggaaaaaagatgagggaggaaaattattaaagtgtttagtgagagatatacacatgcagactggataatggttttagaatataagacaaaaattgctacatgtcactgcaccaggactcctttagaacttgctggaaggcttggtgtttatgggatcagctttacgtaggagatacagagctaatgtttatgcccaagaagctggcaaaacagatttagagagcacaagataaaagacactgcataactcagcagaagcagaaaaaaattaatgaagttaaaatacagaggtggaaagtgtgtagagcacactgacattagaagacccataaagatgaataatggtgacttcgcctcacagaatcaaatctgttagattactactctgtggttgaaaggaacttgtcctctgtgtctctgagttgtatgattcttgggtcactgaacacactggctttaccttgtggcttacccattgtgagccagattttctctatggctggagccacaaaataatatgtggtagaagcttaaaagattcagttaattcaacaacagaagcatttattacataagaaaaaaacttaacagtatggcttaaaccgctagcttaaaagtaacaggagtcttgtcctcctgctctgcatctaactccagggtggtgccgggagagcctcaaatcccgcttctggcctttgcgcttggggttctttctgcctggaacattcctcctcaggtatcagcatggctaactcttcacttctttcaggcctttgttcaaatgcatcttccctgtgaggcctttcgttgacatcccatctaaaatttcaatagatcccttacatatacacatgcataagtgtgcacacatgcacacagacacacacacacttttttcctttagcactgatcactgtctagtacactatatattttacttatttgtcttatttcttgtctatcctcctcttctcccattgatgtgtaaacttcacaaaggcaatgatttttgtctattttgttactgatatatcctccaatacctacaacaatgatgagcacatgtccaacaggagatgtttaataaaagtttattgaatgtacaaatgaatcttacatgacctcatgagagttggtgttccagtgtaaatgaatgcaaagttaaaatgtgtatttattgcaataattcagatataaatctaaccacattctctcaacttaaaactgaggttaagagcttcctctaagataattattggttcatataaactatccaaagtacaccctcttttgcagaaatatgatcagatattcagtttctcagggaatttattataaattcaccagtcagggcatttgagccctctgccaacaataggactataaatggtctgattacaagataatactttgcctttctaaacacggcattgccttttctcagaaaagctcaaaaatagcaaaaaacaatttgaaatatttctccaatgttgatttacttcttttctcttccaaaatataacaaagagatgcctataaacatttacagttaaggtgctctactttcacttagggccaaaccaaagaatccaaatgaaagatcatatctaactccatggaatcatgttccaaaccatctcctgatgtgggtttccagaaatcaactactcttagtaaagaaaagaggaatccagttggatactccaatttgttcccataagactacagcttactattttttgcataactacatatatttaacttaggaagttggagagctcactggcatcagaagaaaaatgaaatagctgagtgaataatgatagatctacactatggctggcaaccaagagatctagaaaacaagatgcaaaatgataaaaaatcagagacaaaaatctggtttataaagtaatgctaaaaaaaaagctaaattatccataatcataattaattataaaaaataaatacctagaggagaaaaaagcaactatttaaaatattaactgtataatgacacctcaagcatagttttcaatcatgtaactctatttagattttctgtaaccatagccctattaattaatggtatttaattttgctaacataaactattaaaaggcaagagaagaatacagatagtaacttttccttttcacttcaagctgaatcttctccatttggcccatttaaagggcattaaagccaagaaagaagtgtctactgagacatcagctctcattaagctcttgtcccctttgaaaataatgccagctcattttcacaactacaggaaagccaacacagaattatctgagagtggactgttgttaacaatgtaataactgaattcagggcaatggtgtaaattacaagaatttatacaaaatttctctctcttttttttttttttttttagagggtagaatcatagtcctgatgtctagaggactaaccttttctgtagaaataaaattctataccaaactatcatccctgtgtgctcctctcaggttgctgtgttactctagcaatcacatgagttatagagttacagaaagaagcgatgaggcatctttttaagtcttatatttccctcaggtttgtatttcccttggatcacctggctaaatgatgcttttctttttttgcggggggggtggggtgtggggttggaggtggggacggagtctcgctctgtcgcccaggctggagttcagtggcgcgatctcggctcactgcaagctccgcctcccaggttcacgccattttcccgcctcagcctccggagtagctaggactacaggcgcccaccaccacgcccggctaattttttttgtatttttagtagagacggggtttcaccatgttagccaggatggtctcgatctcctgacctcgtgatctgcccgcctcggcctcccaaagtgctgggattacaggcgtgagccaccgcgccaggcctaaatgatgcttttctacaaaggaggctccttcatctagaaaagggggctgacacaccaagtgagtaacaaactattccatgccactttattgaagacttgacaaattaaagatttagccaagaggtccatgtctggaagggcttggaaatccctctggtccaaggtacattttcttaaagagggcatgggcatcccagagaagcaggtccacgtgcaggtggggttcctccagccagccttgacagggagcatggggggctgctagcacgaggtagggaaggcaatgctaaaagtaaagccagcttttattatcaaagacagtaacatttccaactacaatttgatttttgaatttgtaataggaaatttatccctggagagagggttgaatgaattaatcactaaaattccttccaacactcagacacaagaatccttgactcattcattcaacaaacatttgaatgtctatgtgccagcaaataaagtaattttcaatgaatatcctttctacaccacagccaccataattgtgaggcctccaacacagtagcaacttggaactccattttaatacagcatatcaaggataaaaaatatggtcatgcctgcaacttacataatggagcttgaatttgcactcgtcttcaatttcatctgcactgtcctcatcagaaacttccccttcctctgcatcatccccaaggtgataaggcaacttcttaccctgaaatggaacaaaacatcccatttaaaaatgagaataaattcacaatagccaaaaggtggaagtaacccaagcatccattgatggatgagaggataaacaaaacgtgtatgtacatacaatggaatcttagcctttaagaagaaggaaattctgatacatattacaaaatgaaggaaccttgaaggtattatgctgattgaaataagctagacataaaagaaagtgtattgtatgattccatttatatcaaattcatagagacagaaagtaaaatggtgatggcaaagggctgaaggtaggagggtatcgggagttgttgctgaatgggtatagagtttcagttttacaagatgaagagttttggagattggctgcacacaatgggaatgtatttaatactactgaacacactttaaaaagggtttattgtatacatttaaaaatagttaagatgttaggtagattttaggtcacatgtattttactacaattaaaaatcatttttgaaaagtaaaaactgaaaataaaatgttgtatcattaagctaatcattacttcagactgactagaaagcagacagtctgaattaggggcaaaataagggggagtggagactttcaaaaaagggaagtcttattactttcaattaagtagaattaattagagatactatagtttgaaaaatcaaaccaggcttctattcaaaaatagatgacttggaacctggagccaggcccagtggctcacacctgtaatcccagcactttgggaggctgagatgggaagatcacttgaccctaggatttcaagaccagcctaggcaaaaaaataagcctctgtctctacaaaaaataaaaaaatttgctaggcatggtagcatgtgcctatgatcccagctacacaggaggttgaggcaggaggatgacttgagtccaggaggttgaggctgcagtgaatcatgtttgtaccactgcactccagcctgggtgacaaagtgagaatccccctccaccaaaaaacaagatgacttggctgggcacaaaagctcatccctgtaatcccaacactccaggaggccaaggcaggaggattgcttgaggctaagagtttgagaacagcctgggcaacatagtaagaccccatttctatttttattaaaaagtgaaagaatagatgactcttcacaacaaactaccattccatcccattatgtacaactgctatggtgtgaatgctggtgtcccccaaaatccatgtattagaacctaatacctcacccatatgatagtattaagaggtgaggcatttgggaagtgattaagtcatgagggctccaacgagctcccttgccccttctgtcacgtgaggacaaatagtaggtactatctatgagaaacaggccctcaccagacgccaaatctgccatcaccttaatcttggacttcccagcatctagatccacgagcaatgaattctgttgtttacaagttgcccagtccaaggtggttttgttatagcagctcaaaggaactaagacaacaacaagcatgctaatatccctcagagcagcttattcacctaagcaggttacatgtgtccttaacacttatgcctcactttgcatttcacaagcccctctttcacagacaatgcagcgagactcctgcccagcttgagcacctcccccaggaccaggccactcttgacttacctaacaacacactttaaaaatgaggggctttttgacagggaacattcttataagatattaagacagttaagttatagaattatatatataatattatctcagtgattaaaaaacagcaaaaaagtctaaaaataaatatggtcaattgttaagggtaattatctctttataacagtactatgagggaaatttacattctcctttcctgcatttcccaaattatattcaaaaacagtaaatgtaaactaaaaaggacagcagggggtaaggcccaggggtctgagaaaggcttcgagggcagctatctgtattagcaaggctttttactacaggcagaaaggaatatttattaccaaaatattgaattgcttccagaatcagagggtgggaggtggaacaaaaccaggctctgaggctaagaggccaaggcgactgcagtaggcagcctctaaataatagtaccaatgtctcctgtctcagtattcacacccttctgcaatcccctccctttgagcgtggcctggacctagtgcccgacatctaatgaactgagtacagcaaaagtgatgggaggttacttatcagatcaggttatagaaacactataccttcttgcttgcttgcttctccaaacttctctcctttcctggagctctctctctctctctctcttctttctctctctctctttctctctctctcttctgtctctctctctctctctttttctctctctcttctctctttctctcttctttctctctctctcatacacacacacacacacacacacacacacacacacacacacactggtgtcgtgagctgtgctatggagagacccacatggcagggaggtgagagaggcctcagtagccaacagcctgaaaggaactgaaatgtgccaacaacaaccactaaaggaatctcggaagcagagcttccctcagttcagctgtgagatgactgcagccccagaggacaccttaattacagcctcaagagagaccctgagcagaggacccagctaagccacacccaggttcctgacctacagggactgtggaatattcaatgtttgttttaagctgtcaaatgttggggtaatttgctatgcagcaatagatacctaacgtaagcaccaaccaaaatcatggggcagaacaaatccactgaagataccatttccaacacaactaagcacagagatagtggctttcactccatcatccacgcaatggacatcaggaactactgccagaagtgctgtcatgggccctaaaggtagctgccagcatgtccaccctactccctccacccaccaggatgggttcaacttggtcccactttcctactgtagtttctgcttcaatgtctgggacaggttcacttgattggtggcttctagatggggggcccatatcccagttctaagaaaggctgcaaaagcaaactttgagctcctctaaggggatctcttaaaacatagggatggagacttccttaaacatggaaggatgttcacatgcctgacagccaaaataatgataaatttctaaatatcatcccaggctgatctctaaactcaagcttcaatgactttaagtattcctgctctgcacagcactattacccctttcagaattctggatccccccttacccgcttcctccctccatagggctaccagcttagtcatattttcggagaaatgtctttctcagttttcctacaccttccttgatacccaaagctcttgaccttgagtccttatcactagtgacaatttcaaagctgggtaaatcatttatataatgaaagcataatctacattaagaatctaaacaattgggatttaggcaaatattttcttcaacttacagaagggaatttgtaagattaaaaagttggggccagctgggcatggtggctcacacctgtaaccccagccctttgggaggccgagggagattggtggatcacctgaggtcacgagttcaaggccagcctgggcaacatggtgaaaccccgtctctactaaaaatacaaaaattagccaggcgtggtggtaagcacttgtaatcccagctactcgggaggctgaggcaggagaatcgcttgaacctgggaggcagaagttgcagtgagccaagatcgtcccactgcactccagcctgggtgacagagtgacactccgtttcaaaaaaaaaaaaaaaatgttggggccaggcacagtggctcctgcctgtaatcccagaactttgggaggccaaggaggacagatcacctgacatcaggagttcaagaccagtctgggcaacatggtgaaacctcatctgtactaaaaatacaaaaattagccaggcatggtggcaggcacctgtaatcccagctattcaggaggctgaggcaggagaattgcttgaacccaggaggcggaggttgcagtgagttgaggttgcaccattgtactccagcctgggcgacagagcgagactccgtctccccaccaaaaaaaaaaaaaaaaaaaagttgggatctaatttgtgtatcattaataacaaggcagctcagaatcaaagcatttatttctgtatattattttaggtcctattgatatagaaagctcctaaaaatcagtttttctatttttctttattttaggaacatttgtagagtagttataatatggcagcaccagaaataaggtactcaattaagaggtgatcagacatactcagaaacaagctatcaagatatcaactttcttcacttattcagaatctgctttgttttaggtaccatggcagacagcaagatgaaactgtacacaagacatttaaaatgtagtgatagcaattccctcttttgaaacagcataaaatagaataaaaaccaacatatgtttttaaatgttctacagaatagaaataaatatgaaaaataacatcaccaagaaaagaataataataatcctcaactgatatgcatcactgataccactgactagaaaggaaagtgtaactgtgatgagcaggtggtgctgagcaggtaaggacacagaactaagcttcaattccccttcatctgagggtggcatgaggtgagggaacaaaaagaagaagctgcctctcagagtattcataagacaggttaattttcagtcctttaaaaatctaattaaaagacctggcattatcagagccctatttttggtcagctttttccaggctggcaaatattttatacaggcagatagggagaaaaacaatgcaaatgaacactgtttttcaaggcctcttttcaatggtgttactccaaaggaaaattataaaataaatttagatagcactttatatggctaactaatttaactgtggtccaatgttgatgtaaatgaagaatgatccaggtgtcttccagaggtccctttctgatctacatatatttcatgcagaagttacactctagaattaatttgtctatggtatatggaaatattgctagagactggactggaagcatggtcacttctcagcttcaagatatctggctgcacagccccaggagaatgcaaacaactccgcgattcacatctgtaaaagcaggaaccttgaaccacacagctaaagttatttcagcaaaaagagtctatcgaaaattactatttgtttttttttttcataagcaacgttttatttacaggcataccttagaattattatgagtgtggtttcagatcactgcaataaaatgaatatcacaataaagagaggcacacggattttttggtctcccagtgaatataaaagttacaattgtgctatactgtagcctattaagtgtgcaatagtattacgtctaaaaaaagtacatacgttaatttaaaatatttaatgctataaaaagctaatgatcatctgaacctttggcaaattgtaatcattttgctggcggagggtcttgtttcgatgtggatagctgctgactgatcagggtggtggttgctgaaggttaggtgactgtggcaatttgcttcttttttgttttgttttgttttgttttgagatgcagttttgctcttgttgcccaggctggagtgcaatggcacgacctcggctcactgcaacctccgccccccgggttcaagcgattctcctgcctcagcctcccaagtagctgggattacaggcatgcaccaccatgcccagctaattttgtattttttagtagagatggggttttaccatgttggtcaggctggtcttgaactcctgacctcaagtgatccacccgccttggcctcccaaggcattagccaccacacctggccagcaatttcttaaataggacaaaaactaagtttgctccattgattgactcttcctttcacaaaagatttctctgcagcatgtgatgctgtttaacagcattttacctacagtagaacttctggcaaaattggagtaaatgctctcaatccttcctaatgctttatcaactaaggttttgtacacctcaagaacccacttgctttgcttattcatataagtaattcctcatctatttaagtttaatcatgagattgcagcaatcttcaggctccacttcttttttttttttttgagatggagtctcgctctgtcgcccaggctggagtgcagtggtgcgatctgcaagctccgcctcccgggttcacaccattctcctgcctcagcctcctgagtagctgggactacaggtgcctgccaccacacctggctaatttttttgtatttttagtagagacggggtttcactgtgttagccaggctggtctccatctcctgacctcatgatctgcccacctcggtctcccacaggctccacttctagttctcttgttatttctaacacatctacagtgactttctccactgaagtcttgaacccctcaacgtcatccatcaggattggaatcatcttcttctaaactcctgctaataatctgttgacctcctcaaaaaaaatcgcaaatgttcttaatggcatttagaatggtgaatcctttctagaaggttttcaatttagtttacccagacttatcaaaggaatcactatttatggcagttataggcttacaaagtatatttcttaaataataagacttgaaagtcaaaattatacatagaacaacgagctacagaatagatgttgtgtagcaggcatgaaaacaacattaatctacttatacatctcattagagttcttgggtgaccaggtgcattgtcaatgagcagtaatattttgaaaggaatcttttttcctgagcagtaggtctcaatagtgggcttaaaatattcagtaaaccatgctgtaaaaatatgtgctgtcatcaggctttgttattccatttacacagtgcaggcagagtagatttagcataattcttaagagcctaggggatgaaaaatgagcactggcttcaacttaaagtcattagctgcattagtctctaacaagagactcagcctgttcttgacgctttgaaggcaggcaatgactcctctgcagctattaaagtcccagatggcatcatctcccaatataaggctgttttgtttacattgaaaatctgttgtttaggctgggcacagtggctcacgcctgtaatcccagcactttgggaggccaaggcaggcaaatcacctgaggccaggagttcgagaccagcctggccaacatgatgaaaccccatgtctactaaaaatacaaaaattagctgggcgtggtggcacgtgcctgtaatcccagctacttgggaagctgaggcaggagaatcacttgaacccaggaggtagaagttgtagtgacccaagatggcgccactgcactccaacctgggtgacagagtgatactccatctccaaaaccaaaaagaaatctgttgtttagtgtagccaccttcatcaattatcttagctaaaccttctagatcccttgctgcagcttctccaccaacacttgctgcttcaccttgcacttttatgttatggagatggattcttgccttaaacttcatataccaaactctgctagctccagacttttcttctgcagcttcctcacctctctcagccttcacaaaatttaagagagttgctctggattgggctttggcttaacggaatgttgtagctggtttgatcatttatccagaccactcaaactttctctctatcagcaataagttaaggctattttgctttcctatcattgtgtgtttactgaagtagcacttttaattttcttcaagaatttttcttttgcattcacaaaatggctaactcttgggcacaagaggcccagctttcagcctgtcttgtcttttaacacatcttcctcactaagcttaatcatttgtagtttttgattgaaagtgagagaaatgtggagatgccagaggaaaatggcatccaggaggcaggactaacttgcagctcccactcggacaatggaagagcatgtgaagactcgcatcgtgaacttgtgctacaagaactactgcaggaacataccaggaaaaccaaaagaattcacagaccctttgaaggaagcagactgctgttccaagctctgtgagacagctgaaaaactgtgagtggccaaagtgtgaggagggaagatccaccctcgaaaacacatcctcactggggaatctgaaattctagatcacaggtgatatggtttggctgtgtccccacccaaatctcatcttgaactgtaatccccataatacccacgtgactagggagaaatctggggggaggtgattggactatgggggcagataccccatgctgtttttgtgatagtgaatgagttctcacaggatctgatgactttataaagggctcttcccacttcacactcactcttctctctcctgccatcttctgaagaaggtgactgtttcctcttcaccttctgccatgattgtaagtttcatgaagcctcctagccatgcttcctgctaagcctgagaaactgtgagtcaattaaacctctttcctctataattacccagtctcaggtatttctttatagcagtgtgaaaactgactaatacagtagattggtactgcagagagtcgggtactgctatacagatacttgaaactgtggaattgactttggaactaggtaacagacagaggttggaacagtttggagggctcagaagaagataggaagatatgggaaggtttggggcttcctagaacttgttgaatggttttgaccaaaatgctgatggtgatgtgaacaaagaagtccaggttgaggtggtctcagatggagatgaggaactttttgggaactggagcaaagatcagtcttgctatgctttagcaaagagactggtggcattttgcccctgccctagagatctgtgcaactttcaacttgagagagatgatctgaaattggaacttatgtttaaaagggaagcagagcataaaagtttggaaaatttgcagcctgatgatgtgatagaaaagaaaaatccagctgggcatggtggctcatgcctgtaatcccagcactttgggaggccaaggcaggtgggtcacctggggtcaggagtttgagaccagcctgaccaacatggtgaaaccccgtttctactaaaagtacaaaattagccaggcatggtggcacatgcctgtaatcccagctacttgggaggctgaggcaggagaattgcttgaactcaggaggcggaggttgcagtaagctgagatcatgccactgcattccagcctgggcaacaagagtgaaactccatctcaaaataaaaaagaaagaaaagaaaaacccattttctggggagaaattcaagctagctgcagaaatttgcataagtaaaatggagctgaatgttagtcaccaagacaatggggaaaatgtctacaggacatgtcagtaaccttcatggcagcccctcccatcacagacccagaggcctaggtagaaaaaatgctttcatgggccaagcccagggccctgctactgctctgtgcagccttgggacttggtactctacaacctagccatggctaaaaggggccaacattcagctcaggccattgcttcagagggtgtaagctccaagccttggaagtttccacatggtgttgagcctgcaggtgcacagaagtcaagaactgaggtttgggaacctctgcctagatttcaaaggatgtatggaaacacctggatgcctaggcagaagtatgctacaggggtggagccctcaaggcagtatggaagagaaatgtggagttggaggccccatacaaaatccccactggaccactgtgtagtaaagctgtgaaaagagggccaccgtcctccagaccccagaatgatagatccactgacagcttgcactgtgtgcctggaaaggatgaagacactcaatgccagcctgtgaaagcagctgggaggggtgttgtaccctgcaaagccacaggagtggagccacccaagaccataggagctcacctcttgcatcagcatgacctggatctgagacatagaatcaaaggagattatattggagctttaagatttaatgagtgccctgttggattttggacttgcatggagcctgtatctcctttgttttggccgatgtctcctttttggaatgggagcatttatccaatgcctgtacccccattggatctttgaagtaacgaacttgcttttgattttacaggctcctaggcagaagggacttccctcgtctcagatgagactttggacttggacttttgggttaagcctggaaagagttaagactttgggggactgttggaaagacatgactgtgttttgaaatgtgaggacatgagatgtgggagcagccaggagcagaatgatatggtttggctgtgttcccacccaaatatcatcttgaatcataatcctcataatacccacatttcttgggagagacctggtgggaggtaattggatcatgggggcagtttccccatgctgttctcatgatagtgagttcttatgagatctgatggttttataacaggctcttctcccttcactgttcacccttctctctcctgccaccttgtgaagaaggtgcctgcttcctttttgccctctgccatgattgtaagtttcatgaggcttcctagacatgcttcctgttaagcctgtgaaactgtgagtcaattaaacctctttttataatttctctgtgtcaggtatttctttatagcagtatgacaacagactaataaaatgagagaaggatttggccttaccaagagctgaaacaaatttagagagctgagcaaaatataaaggtagaagaaacagcaggaagagccctgtgggcacacccagtacccagggaaaccacttctgactgtctcacaggggcctttggggaggctaccagtagaactggggaaagaatacagggagaaggaaactttgagatgaactttgtaataattacaaccaagcgtaaacatttatgggcagaatctgggggcagtgacgggagcaaacaggaagtgcagataggagcacagaggccatggcaggtggggagaggtggggcctgaaaggccagcttgctttctcagtggggaggcttgtagcctggggcaagatctcagccctactcatgagctgcctggatataaactcggtgctggtggtgggaatgagactggccttgctggctgagtgggaactaggtgaggcctgtcactgccagctttccccacttccctggtgacctgtatgatgcagcagaggcagccataatccccctgggaacataactccattggactgagaaccacactcccagcccctacagcagcgacagcaaaccctgctcaagaagagtctgagcttagacacgcctgaccctgcatccaactgatggtctttctctacccaccgtggtagctgaagacaaaagacataatctcttgggagctctatggccctgcccattggctgagaaacccaaatatgtatccaggtgaccttagggcaagcttgtatcagctgatgatctcttaaaagtgctaccttctggctggaggataaccaacaactagcacaaccagcattcgagaaaaccagcacactaaacaaaacaaccaaggaccctcacagagtctacttcactcccctgctacctccaccagaacaggtctccatggctgagagacctgaagacagatcacttaacaggactctttgcagatattcctgagtaccaggctggagcctggtagccccactgggtggctagacccagacaagcaataacaatcactacagtccagctatcaggaagtcccatgcctagaggaagtgggagggcaccacataagaagaccaccctgtgggacaaaagaatctgaacagcagcctttgaataccagatcttccctctgacgtagtctacccaaatgaaaaggaaccagaaaaacaattctggcaatatgaaaaagcaagtttctttaacaccctcaaaagatcacaatatctcaccaagaaaggatccaaaccaagaagaaatccctgacttgccagcaaaagcattcagaaggttgataattaagctactcaaggatgcaccagagacaggtggaaaacaatttaaagaaattcaaaagtaatgcagactatggatgaaaaaatatccagagaaatagacggcatcaatacaaaacaatcacaacttctaaaaataaaagatactcttagagaaatgcaaaatacactggaaagtttcaacaaaagaatcaaacaagtagaagaaagaacttcagagcttgaagacaaggcttttgaattaacccaatctgacaaagacaaagaaaaaagaattaaaaaaagaacaaagcctggaagaagtttgggattatgttaaatgaacaaacctaagaatacttggtgttccccaggaagaagagaaatctcacagtgtggaaaacctatttgagggaataattgaggaaaatttccctggctttgctggagatctatacatccaaatacaagaagctcaaagaacacctagaaaattcatcacaaaaagatcatcacctagacacatagtcatcaggttatctaaagtcaagatgaaggaaagaatcttaacagctgtgaggcaaaagcattaggtagtctataaagaaaaacctataagattaaaagcagatttctcagccaaaatcctacaagctagaaaggaatggggtcctatcttcagcctccttaaaataattatcagccaagaaatcttgtgtccagcaaaactaggcttgataaataagggaaagataaagtccttttcagacacacgcaataatccaatttcagatcataggcaacaaaaatgctgagagaattcgccactaccaagctagcactacaaaaaaaaaaaaaaccaaaaaaaaaaaaaaaaaaaaaaaaaaaaaaacctaaaaggagtgctaaatcttgaaagaaaacctcaaaatacaccgaaataaaacctccataaagcataagtcccacagggcctataaaacaatacaatgaagaaaaaaaaaagtattcaggcaaaaaaaactagcaaaatgaatctaatagtaccttatctctcaaaacaaattttgaatgtagatggtctaaatgctccacttaaaaggcacagaatggcagaatgaataagaattcaccaaccaaatatctgctgtcttcaaaaaactcacataagatataaggactcataaacttaaagtaaaggggtagaagaagatatttcatgcaaatggacaaaaaaagtgggcaggagcagctatccttatatcagacaaaacaaactttaaagcaacagcagttaaaaaaaacaaagagggacactataccatgataaaagaactagtccagcaggaaaatatcacaatcctaaatatatattcacctaacactggagctcccaaatttataaaacagttactactagacctaagaaataatgtagacagcaacacaataatagtgagagaattcaatactccactaacagcactagacaggtcatcaagacagaaagtcaacaaagaaacaatggacttaaactataccctagaacaaatagacttagcagatatttacagaatattctacccaacaactgcagaatatatattctattaattaggacaggaaacattctccaagacagaccatatgacaggccacaaaacaagtctcaacgaatttaagaaaatcataattatagcaagtactctctaggatcacggtggaataaaattggaaatggactccaaaaggaaccccacaaaacgtgcaaatacatataaattaaataatctgctcctgaataattgttgcgtcaacaatgaaatcaagacggaaacttaaaaattccttgaactgaacgataatagtgacacaacctttcaaaatctctgggatacagcaaagtgatgctaagaggaaagttcatagcattaaatgcctatgtcaaaagtctgaaagaggacaaacagataatcttaggtcacacctcaaggaactagagaaacaaaaacaagccaaccccaaattcagcagaagaaaagaaataacaaagatcagagcagaactaaatgaaattgaaacaacaacaaaaaatacaaaagataaatgaaacaaaaacctggttctttgaaaagataaacaaaattgatagaccatttgcaagattaaccaacaaaagaagagagaagatccaaataagctcaattagaaacaaaatgagagatattacaaccgatatcacagaaatacaaaagttcattcaaggatactatgaacacctttacatgcacaaactagaaaacctagaggagatgggtaagttcctggaaatatacaatcctcggaggttaaaccaggaagaaacagaaactctgaacaaaccaacaacaagcagtccgactgaaatgctaataaaaaaaattgccaacaacaacaaaaaatgtccaggaccagatggattcacggcttaattctatcagacatgcaaagaactggtaccaaatctattgaaactattccaaaagatgagaaagaaagaatcccccctaaatcatgctatgaagccagtatcaccctaacaccaaaaccagaaaaggacataacaaaaaaaaaagaaaattacagaccaatatcgctaatgaacatagacgcaaaaatcctcaaccaaatactagctaattgaatccaacagcatatcaaaaagataatccaccgtgatcgagtgggtttcataccaaggatgcagggatggtttcacatgtacaagtcaataaatgtgatataccacataaacagaatcaaaaacaaaaatcacatgatcatctcaatagatgcagaaaaagcatttaacaaaatccagcatctctttatgattaaaaccctcagcaaaatcggcatagaagggacataccttaaggtaataaaagccatctatgacaaacccacagccaacattatactgaacagggaaaagctgaaagcattccccctgagaactagaacaagacaaggatgcccactttcaccacttctgttcaacatagtactggaaatcctagccaaggcaatcagacaagcgaaagaaataaagggcttccaaatgtgtaaagaggaagtcaaattgttgctgttcgctgatgatatggttgtatacctagaaaaccctaaaggctcatccaaaaagctcctagatctgataaatgaattcagtaaagtttcaggatacaagatcaacatacacaaatcaatagcactgctatataccaacaacaaccaagctcaaccccttttacaatagctgcaaaaaataaaacaaaatacttaggaagatacctaaacaaagaggtgaaagatatctacaaggaaaactacaaaacactgctgaaagaaatcatagatgacacaaacaaatggaaacacattccatgctcaaggatgggtagaatcaatattgtgaaaataaccatactgccaaaagcaatctataaattctatgtaatccctatcaaaataccatcatcattcctcacaaaactggaaaaaaaatcctaaaattcatatggaactaaaagagggcccgcatacccaaggcaagactaagcaaaaagaacaaatttggacgcataacattacctgacttcaaagtataatataagaccatagtcaccaaaacagcatggtactggtatataaaaataggcacatagaccaatggaacagaatagagaacccagaaagaaagccaaatacttacagtgaactgatctttgacaaagcaaacaaaaacataaagtggagaaaggacaccatattcaacaaatagtactggaatattggcaaagcacatgtagaagaatgaaactggatcctcatctctcaccttctacaaaaatcaactcaagatggatctgagacttaaatataacacctgaaaccatatacattctaaaagttaacactggaaaaaccccttctagacattggctgaggcaaagacttcatgactaagaacccaagagtgaatgtaacaaaaacaaagataaagagatgggacttaattaaactaaaaagcttctgcatagcaaaagaaataatcagtggagtaaacagacaactcacagagtgggagagaatcttcacaaactatgtatctgacaaaggactaatatctacaatctacaaggaactcaaacaaatcaggaagaaaaagacaaataataccatcaaaaagtaggctaaggacatgaatagacaattctcaaaaaaagatatacaaatggtcaacaaacatatgaaaaaatgctcaacatcactaataatcagggaaatgcaaatcaaaaccacaatgcaataccaacttactcctgcaagaatggccataatcaaaaaatcaaaaaataacagatgttggcatagatgtggtgaaaacagaacacttttacactgctggagggaatggaaactagtacaaccattatggaaaacagtggagattccttaaagaactaaaagtaaatattttcctcttggtagataccactcctgcatctctaccaagaggcaaagaagtcattatatgagaaagacacttgtacacatatttttagcagcacaagtcacaattgcaaagatatggaaacagcccaaatgcccatcaatcaacgagtggataaagaaaatgtggtatacatatatacaccgtggaatactactcagccataaaaagaatgaaatatggcatttgcagcaacctagatggaactggagaccattattctaagtgaagtaactcaggaatggaaaacaaaacatatgttctcacttataagtgggagctaagctatgagggcacaaaggcacaagaatgatataatagactttggggactcgggtgaaagagtgggagggggcaagggataaaagactgctcactgggtacagtgtacattgctgaggtgacaggtgcaccaaaatctcagaaatcaccactaaaaaacttatccatgtaaccaaacactacctgttcccacaaaacctactgaaattaataaatattttttaaaaagtaagagacatgtgagttgcctttcacttggacacttggaggccattgtagggttatcaactggcttaatttccatactgttatgtcttaggaaacagggagaactgaggagtgggagagagatggggaatcaggtggttcatggagcagttagtacacacacaacacttatcaattaagtttgccatcttatataggcagggattatgcctcccaagaacaattgcaatagtagcattaaagatcaccgatcacagatcaccacaacagatacaataataatgaaaaagttttaaatagagcaagaattaccaaaatgtgacacagagacacaaagtgagcccatacttttggaaaaacagtgccgaaagacttgcttgacatagagttgccacaaaccttcaatttgttacacacacacacactcacacaaaatgcagtgtctgtgaaatgcaataaagtaaaatacaataaaatgaactttgctggtgggggagccaagatggccgaataggaacagctccgggtctacagctcccagcatgagcaacgcagaagaccggtgatttctgcacttccatctgaggtaccgggttcatctcactagggagtgccagacagtgggcgcaggacagtgggtgcagtgcaccatgcgcgagccgaagcagggcaaggcattgcctcaatcgggaagcgcaaggggtcagggagttccctttcccagtcaaagaaaggggtgacagacggcacctggaaaatcgggtcactcccaccccaatactgcgcttttccgacgggcttaaaaaacggcgcaccaggagattatatcccgcacctggctcggagggtcctacgcccatggagtctcgccgattgctagcacagcagtctgagatcaaactgcaaggcagcagcgaggctgggggaggggagcccgccattgcccaggcttgcttaggtaaacaaagcagcctggaagctcgaactgggtggagcccaccacagcttaagaaggcctgcctgcctctgtaggctccacctctgggggcagggcacagacaaacaaaaagacagcagtaacttctgcagacttaaatgtccccgtctgacagctttgaagagagcagtggttctcccagcacgcagctggagatctgagaacaggcagactgtctcctcaagtgggtccctgacccctgacccccaagcagcctaactgggaggcaccccccagtaggggcagactgacacctcacacagccgggtactcctctgagacaaaacttccagagaaacaaccagacagcagcatttgcggttcacgaaaatctgctgttctgcagccactgctgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctttcctcctccaaaggaacgcagctcctcaccagcaacggaacaaagctggatggacaatgactttgccgagttgagagaacaaggcttcagatgatcaaactactccaagctacaggaggaaattcaaaccaaaggcaaagaagttgaaaactttgaaaaaaatttagacgaatgtataactagaagaaccaatacagagaagtacttaaaggagccgatggagctgaaagccaaggctcaagaactacatgaagaatgcagaagcctcaggagccgatgcaatcaatttgaagaaagggtatcagtgacagaagatgaaatgaatgaaatgaagcgagaagggaagtttagaggaaaaagaataaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccccagtctagcaaggcaggccaacattcagattcaggaaatacagagaacgccataaagatactcctcgagaaaagcaactacaagacacataattgtcagattcaccaaagttgaaatgacggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccagtaccagccactgcaaaatcatgccaaattgtaaagaccatcgaggctaggaagaaactgcatcaactaacgagcaaataaccagctaacatcataatgacaggatcaaattcacacataacaatattaactttaaattaaatggactaaatgctccaattaaaagacacagactggcaaattggataaacagtcaagacccatcagtgtgctgtattcaggaaacccatctcacgtgcagacacacacataggctcaaaataaaaggttggaggaagatctaccaagcaaatggaaaacaaaaaaaggcagaggttgcaatcctagtctctgataaaacagattttaaaccaacaaagatcaaaagagacaaagaaggccattacataatggtaaagggaccaattcaacaagaagagctaactatcctaaatatatatgcacccaatacaggagcacccagattcataaagcaagtcctgagtgacctacaaagagacttagactcccacacattaacattgggagactttaacaccccactgtcaacattagacagatcaacgagacagaaagttaacaaggatatccaggaattgaagtcagctctgcaccaagcggacctaatagacatctacagaactctccacctcaaatcaacagaatataaatttttttcagcaccacaccacacctattccaaaattgaccacatacttggaagtaaagctctcctcagcaaatgtaaaagatcagaaattataacaaactgtctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaataaagacacaacataccagaatctctgggacacattcaaagcagtgtgtagagggaaatttatagcactaaatgcccataagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaattgatagaccgctagcaagactaataaagaagaaaagagagaagaatcaaatagacgcaataaaaaatgataaaggggatatcaccactgatcccacagaaatacaaactaccatcagagaatactacaaacacctctacgcaaataaactagaaaatctagaagaaatggataaattcctcgacacatacaccctcccaagactaaaccaggaagaagttgactctctgaatagaccaataacaggctctgaaattgtgtcaataatcaatagcttaccaaccaaaaagagtccaggaccagatggattcaaagccgaattctaccagaggtacaaggaggaactggtaccattccttctgaaactattccaatcaatagaaaaagagggaatcctccctaactcattttatgaggccagcatcatcctgataccaaagccgggcagagacaaaaccaaaaaagagaattttagaccaatatccttgatgaacatcaatgcaaaaattctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaagcttcatgctaaaaactctcaataaagtaggtattgatgggacatatctcaaaataataacagctatctatgacaaacccacagccaatatcatactgaatgggcaaaaactggaagcattccctttgaaaactggcacaagacagggatgccctctctcaccactcctattcaacatagtgttggaagttctggccagggcaattaggcagaagaaggaaataaagggtattcaattaggaaaagaggaagtcaaatggtccctgtttgcagatgacatgtttgtatatctagaaaaccccattgtctcagcccaaaatctccttaagctgataagcaacttcagcaaagtctcaggatacaaaatcaatgtacaaaaatcacaagcattcctatacaccaataacagacaaacagagagccaaatcatgagtgacctcccattcacaattgcttcaaagagaataaaatacctaggaatccaacttacaagggacatgaaagacctcttcaagaagaactacaaaccactgctcaaggaaattaaagaggatacaaacaaatggaagaacattccatgctcatgggtaggaagaatcaatatcataaaaatggccatactgcccaaggtaatttatagattcaatgccatccccatcaagctaccaatgactttcttcacagaattggaaaaaactactttaaagttcatatggaaccaaaaaagagcctgcaacgccaagtcaatcctaagccaaaagaacaaggctggaggcatcacgctgcctgacttcaaactatactacaaggctacagtaaccaaaacagcatggtactggtaccaaaacagagatatagatcaatggaacagaacagagccctcagaaataacgccccatgtctacaactatctgatctttgacaaacctgagaaaaacaagcaatggggaaaggattccctatttaataaatggtgctgggaaaactggctagccatatgaagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcagtggcaacaaaagccaaaattgacaaatgggatctaattaaactaaagagcttctgcacagcaaaagaaactaccatcagagtgaacaggcaacctacaaaatgggagaaaagttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactagccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctataactagaaataccatttgacccaccaatcccattactgggtatatacccaaacgactataaatcatgctgctataaagacacatgcacatgtatgtttactgtggcattattcacaatagcaaaggcttggaaccaactcaaatgtccaagaatgatagactggattaagaaaatgtggcacatatacaacatagaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaacgagaacacatggacacaggaaggggacatcacactctggggactgttgtggggtggggggaggggggagggatagctttaggagatatacctaatgctaaatgacgagttaatgggtgcagcacaccagcatggcacatgtatacatatgtaactaacctgcacattgtggacatataccctaaaacttaaagtataataataataaaataaaaataaatttaaaaaatgaactttgcctgtattttatcagaaaatttacacatatataaatgtgtatgcatgcatgattggaacatatgtgtgtaacagttgtaataataaacaacttgtcaatctccaaagtggtaagtagtcatagacatcctgccttttcaatcagagattgctctgatagtaaaggaacacaataaatcagttgccttgtttttgctttaaatggggttgcgctggtccgcagatccaggcagctccttaatgtctaaacaacattactactagcaaatggatctcagatgctcttgaaatacttgcagttcacattgttgccaccctttcccatgagtgcctcagactttctgcctctgattcatcctgatgccataagccctgggatattctgtgtcaaataactcaaagcccagttatgcaaaggagactcaattagtccacattaaatatccactgtgagttccactgtccaaaggagaaagatttcaatcaaatgaatttattctgcatttaacatcctgactgctgactaaagaatatttaggaagtagaaacatttacaaggttataaagatgacatttcattttctaacccacaaatcaatttttactataaaagtttgctttagcaagacttgggcaaattggccttcatgttatctcttgcattatgtggagcttttattcaaaatacctttatgcatataaatgcctagcaacacctttttgatgtattcagaatctataattttatttaattggtagaaaacaggttttgaccaattctaagaatgaatatgttccatcttttccatgtgctgctctcccttaaagccccagttgaagtcctgccatgaaattacattgcctccttgactttcctgctcctcctatatatttgttttttcatacacacctcttttaagtaaaatataacccagtttgaattttaataccctattgctttcctttacatttttaatcacaaaatgatgtggccacccaaggtggttttagtacaaacacacaaaattcactggaaataagtaaaaccacaaagtcagtgatctgaaaactgaaagaactgtctttctggctattctttgcatgaataatatttattgtagtaagcttcctctctcagaaaatctgtttatgaaatgtcattctgttcacctactgctctttcacacgtacatgagtcctgtggggcattattatgtctgtgcctgtgttcctctttgaagtgagctcttctcacttgcataaccaagactgatcaaccatgaagctttttgttttttttggtttttttgacagacagttattggagcttgaaatgggagaaaaagtctgaaagaactgctttcagatatggatacaaggagccttctcctttcctgaacctcacgctcctacacacacatttctctctagtgtgaactattacagactaaaatatcaaacatttggcttacagtattgatgtttccacttcataagtacaaatctcagaatatgtgctcactcaacaataagcttcttctgaagacacgactataaaaaaattggaataaggcgcatacatagatctagacaatccttcatatattgattctaattattattctcccttgaaacccatttttattctttaagggagggcaggcttagctgataatgaatgtcttttattgcattacttgaagtaattaccttcactagaattttgcctttcaaactttgagggcttggaagctgcttgcactcccctgtatcaacagatgacaggtccagtttgtctccgaatattcctttcaggtactgagcaatcttcctttgctgctggatactgcagtgattctcgatagacaatataacaggaaacctgagaaaagagcaacacagtccagaggcgtcaggtgcaggcaactcacagggacttttgaaaatgattcagtattcactgtgttgttacaatcctagtgacagtatttgcgatactgatgatggttaaaatgcttctaaaatgagaaagattagaaatgcatttaaaaaattcctctgagcaaatatactttgctaagcataatggatgaacaaaataccaatccacatgggatggcttttctaatattttgcatcaggaaacaatggtagatatattatgtttcttttaaaagaagagaaaattttaaaagagatgagaagtctaaagaaagtaaactcatataatgtaattttgtcttatttattcaaaagtctaacagcttctaagagaccactgaatgtcattaaatgaagctattgactctaaaatatataattaacccccaccttgaaaattatgattgaggataaaataacataagggaattctgtgttttatagcatcctacgtcgcacatttcaaaatcactttgatagaattatatactagtctttgtcaaaaaataaaaataaaaaccagccaagcattcattctacaccagcactcaggtttctgcacagaaaacatgagatccatgtaaataattacctaaaggagttggtggctaaggcagaaaggagatcagggctgattacatgattttactcctctctcaaccttattttttcctcagaataagaaattatttcaaattcaggttcattgacttttttctagttttccgttacatgtcttcagacataataggcaatatatttaaatcacctaatatatcaacatataccaatatttaaatcacctaatatatcaatgtgcagaaaaactttttccaggctttcatgacaagcacaagttccacaatacgggctatgaccgccagacctaccttctctcctcattagtaaaacctgatgctgtgggccatcttacagatgagcctttgtggctgaggtaggtttccttactcgactacaatctgtttgctattcatttcttcacataggttttaccctaaagtgctagaagagggaaaagcaacagcaacaacaaactgacaaccctgagttgtcctgcagtcacatcagggagttttaacaaggaattttcacattgtcaattcatttacaaaaaatctattagtggcagggagtggtggctcatgcctgtaatcccagcactttgggaggccgaagcaggcagatcacttgaggccaggagttcgagaccagcctgggcaatatagtgaaacactgtctctactaaaaatacaaaaattagccaggcattgtggcacgtgccggtaatcccagatactcaggaggctgaggcaagagaatcgcttgaacccaggaggcggaggttgcagtgagctgagatcatgccactgcactccagcatgggcgacagagcaaggctgcctcagaaaaaaaaaaaaaaaaaaaaaaaaaaaaaaaaaaaagcctaattagtgcttgatgatgtttagtgtaaagctgtgcttctcaacagggaacgaggcaattattccccccagtacaggagacgcttgtcaatatctgaagacatttttggtggtcacacttcaggggtgctattggcacataatgaatagaagctgaggatgttgctttccaccctacgctgcacaggacagctctctaccaaaaaaaaaaaaaaaaaaaaaaaattatcagtacacaatgtcattagtgccaaggttgagaaaccctgatataaagatgcaaccaaagttaagaaaggagaggaaaaggctgaacttttaaaatgtactaaacaagtttattaactcttttaatttgaagtgcttttcttctaagagttcccaaacttgaagtaaattgtcaaatcaccagaggatcttccaagatacataggtggcaggccttctcaacaccctacttcatacattgggaaataaaggcaaaattacttcacccatttggctaggacctgtagaaatcagggttgtaaagacccattagaatgcagtgttcaagattcttccacgtgggaggcatcataaactaaatctgctatacagcaagtgtgtcttattagaaaagcatttttaacctcatgtttaattaatgagaagaccaaatattggaaattttaaaggctactaacttctaaaaaattaattttacacaattgtaattttaatttgtttcctttaattcaaaaatcctttcttgaatagctggtatactgaaggtacctgctaggcaacaaaaatgaatacaaaataataagagattgctcatattttcagtgagttcacagtcttacagatgtaaaagaaggcaagtaaccaaccaattgcaagagggtgctatatgatatgacagaaatatgtgcagggtgctaaatacagagaaaatatggagaaaaagaagatttaaatcagctggtggtattagtaacttgttggagggacaatacttaaacggccttgtagaataagcaacaattaatcagatagactaacggggaaggttgttccaggcagagagaacagcatacgtaagagtggggagttgagaaagagccaggctcaatagggaagctgaaagacagtcattgaaggcagaatcctaaatctctgtggaataatggtggaagatgatagtggaagacaagggagatgccagaccttaagggatatgaagacatgcctgtgtattgagagagcttctgacaggctttaagacaagaattgaatcaccatgctcatatttcagaaagaaaattatagcaccagtgttgaggatgaaccaaaggggaaataaaaatgaacaggaggcaatggagtcaaaagataacttgggaagtagaattgccaagaattggttgagtctagaatgactcccagtttctggctgaggccagtgctgcccctaactattaataagaggaaatggagcgagaatcaagaggaagtttggcagaatgagatgctgagttccccttggggagtaagctccttaatggcaggagtcttatcttctgctcactgttgtggctccccacacctatgggatactcagatgaatattcactgaggatttttatttttatttttatttttctgagatggagtctcactctgtcacccaggctggagtgcagtggtgcaatctcagctcactacaacctccaccttctgggttcaagcaaatctcatgcctcagcctcccaagtagctgggattacagatgtgtaccactacatccacctaatacttgtatttttttagtagagacagggcttcgccatgttgaccaggctggtctcaaactcctggcctcacgtgatccaccctcctcagcctcccaaagtgctacaggagccaccgtgcccggcctcactgagtatgtttcaacatgggcctagaacttgaggggaaagttctggacatagaatttgataaatatccagaaagtgatctagggcaaaaccttagaaaacagttaaccattagaggaatgaggaaatagattaacagaagactgcagtacaaaaaaaagagattgagaagcaacgagagcaatggaggggagaatgatataatggaaaccaaaaaaggcaagtagtggggaggaaatattcaacactgtcaaatgacaaggagagggtcaagtaacataaggactccagacacctcagtgtatagataagacatccatcatgatcagaacccactaattatgtacacagtaacctatgtttccagattttatggacactctacaccctggatttagaaatttagaggtcactatttgcaagaatgtctttaaggaggcatattgagaaagaatgggacaaggaataaatgcagcatgagaaagtacaaacgggaaggccacattatttgttcacaatgttttgctgagaaggagggagaaaactagtctagcaaagagggcagtgtagagtccaaggaagaggatgtggttttgtagctacgttacatcaggcaatgctccatgcgggaggctaccgcttagctcacaggtgctgctttacttactcattcttcacaaaggcatgcttgttgatggtctccacaacatctctgaagagaatttttgaagtgagagtgtaaccatgatgtactactggctctccatctgggccatcccaacagtcaactgccaaaaacagaactttatatcaacaacccaaagtctctggtgtttattaatatttctggaaataccagacacatattaagtccattatctgaaattatacccatttcaatcctgacaaagacgtgacacagacacagaaatcggtgttctggcatatttatcagaacaaggaattaaagaattgcttttcctcaagacacaatgatttggttttgagtgtggttaaaaagatgtcatattcttaaacagctcagaattcaccaaaaactcattagaacttatctaaatccagtcaagtgtgcccaaggatagggagatttcttgaaaggtcatttacccaatttcacttcttcttcttcttcttcttcaggttatgaaggtcttttagaaagtcacagtgtccttcccaaatcaataatatagttttcattattgttcacttaggctcacaatgttttcattagattgattttcatttcattaatactacagtagttataaaataacatcaacttcctaagttcaaatcctcgagcgctgccaagatttatgtgaatttgggcaaataacttaatcatttgaagacttgttttccccatctagaaaaggagagtaatagcacttacatcataaatttgagtgacagttaaatatatgtaaagtagcttgtaacactgcatggcatatagtaactatgattgttattgatactattaatattgctctctacccacacaatctcattagctctcagctggagaaagacagtaggtttttcaccatgcccctctgactaagaatttgctttctcttgtttttatattttgcccccaggctaattcctcaaaacactactttcacctcattgctcctttgctcaaaagcctacttggtgcatagcacagcatccaacacagagaagtaagtagtctgtaaatatatgctaaatggattaataaatatcttacctcatacaatagctcttgcgtgcttacctccaacgcccctgtctcttgtgctagagcctggctaatcattcactaaccctgtttcttcttttatcgagggaacacagctggactctatttcctagccttcctttgcaggaggatgtggccagtgaaatgtgggcagaaagtatgtgcaccacttccaggtatggttgacagaaacctgctgccttacataatcattcgtcttctttcctcttctgctgtgactttagaagtggtgaagatggcacagccacaagatggaaaaagacaaaactgcttgagagattcacccactaggaacacctattttgaacttgacataatcaagaaataaacttcagttgttttaaggcacaggaaatttgaagttttattgttaaaaggacaatgttgccttaattaccatgctagctcctgtctgacaattcaatcttactttctcctacacccaagctcacaggcttgttcttctggttaggcaaattttctcacacacattcccacctccatgtgtcttttcttctttctttaaagtcaactgacatatccccttctcattttgcttacctaaatcctaatcaaggcaaaactaggatcccccacagaacctcgctagcccacaggatctctcttttccttatggcaagaggtcatcatctcaaacaccaccaaaagcctagcagttaatataaataagtgcagcggctcaatgggaaatgtgtgcctgaatgagataactacttactgttaatcattactaagtaggaatgagaaccttggttgccagaacttctgaggaaactaaaatgtctagattttattgctgtgaattttcccaatttttaaatactggcaattaatccatttttaaaactacaatatgggtcaaacataaacatttctgcaagctgaatttgcataatggaatgctgattgaaagtctgcctttagagttcgagaccggcctggccaacatggtgaaaccccttctccgctaaaaatacaaaaattagctgtgtgtggtggcggatgcctgtaatcccagctactcaggaggctgaggcaggagaatcgcttgaacccgggaggtggaggatgcagtgagtcgagctcgtgacattgcaactccagcctgggcaacaagagtgaaactccgtctcaaaataaaagaaactctgcctttaattaggaccacacagttgtgaaccacatatgttctctattttagtagcaccttcccctatatgtgtgttttgtgtattaccccaggagatatctctgtttttcttttaaaatattcaaaatgctcaccataattacaatgtgattgtaatggttaatttttcatgtcaatgaggcttggctatgatgttcagttatttggtcaaacaccagtctatatgttctgtgaagatattttaaaaataggattaacatttaaatcagtaggctttgggtaaagccgattatgctccacaatgtgagtgggcctcgcccagtcagctgagagccttaagagcaaagactgaggttacccttcaaggataaattctcaacactgcaacacagaaactgcctgaattccagcctgctggccagctctacagatttcagatttgccaacacccacaagcatgagagtcaattccttaaaaatcagacaacgaatctcaatctcttgctttctctacatatcttattggttctgtttctctgcagaaccccgactaatacagctatctatattaatccactaaacactggctgttcaaatatccctatgggaaaaaaatagaaaaaataaaagaagaaaaaacattcacagttgataccacaggaatgctaaaaacaatgtttaaggataaaatgctgttaagaaaaccaaaggttctgagatactatcagagagtgtctactattccttggggcctgcaaatgaggtcatatgtatcaacaacatcttctcacaagagaagcgtcatccatatttttccatgtacttgacagtctttaatttgtctctggaaataattatggaaaaaacttaacaggtgtttcaaataatatataattttaacaatttttaccctgttttgtggtcccttcttggagaagaaagagcataacaggattcttcataaaggaactaatagcttttccaaaagaatgcaaaggcgacaaagcaataccttgcccgacttgcttatggtgtctacatcaaaaattaaaactacacgagtcatgaaagaaggcactctttggctagtatttacaacataggcagaatattcataactgaggataggaggttctcctaatgttcaatttttatatctaattccatcacttgtctgtgagatgaagataacaacattcccaaatggtactggcatcttaatatgtggcattcgtggccaggttcaaatggcagtgaagtttcctgtaagtgctaatgctgtaaatgggaatgttggcaaggtagaaatcctctgtccaattcccctgctcataaaagagccggggcccatttttcaatcaggttacacactatggaaccccaaaagcaaagcaactccaacaaagatttagccattctgaaggccaaatagctaacatgacagcttttcataatggagcttaaagacgttccaccctgatagcactcccagagataactggagaagtcataaaccgattacaacagcaatgcaacatcagtcccataatgagaatgaaaatcccctggacagaacatccatatttattaagcaactcaggctgaaaatcaagcgaataaaaggccatgtaaaaatgttatccatttgatttgctgacaagcccacctcaccaaaaagacttattgctcttcctcaagacactgtgtacatatcctgactaaggacattattgcagctgaactaatggagatggaaaacataacattaccaaaatagaagcttgaaagtagagagaacctccaggtcacaatagtgtgaaaatactgtagaatcattcttctccatctctcaagtgctacacttagcaaaagctgcttcagaaaacagctgtgggacctgaaattttcaacccatgaccggctacattctataaattgtgttctttaaattctaactgcagctgtttaagaataaaaataccttcatctggccacatggcagataaaatgccactaggtatacagcagtacccctttatcctcgggagataaattctaaggctcccggtagatgcctgaaactgcaaagtactgaaccttatacatacacccttgtttttttcctacatatacatacctataataaagtttagtttatagattaggtcagtaagatattcacaataactaatagtaaaacagaacaattatactgcaataaaagttatgtgaatgtggtttctctctcaagatattttactgtatcacctttcctcttgtggtgaagaagggacagagtaggacggtgtgagatttcatcacactacttagaatggtacacaacttaaaacttatatgttgtttctctctggaatttctatttaatattttcggggtgcagctgaccatggctaactgaaaccatggaaaatgaaaccgcagataagaggagactactatacacacactggtgtctctgtgcccaagcttcaaatgtggactaaggtcttcaaatcacaggactgacagatattgttaggaggaccacagagatcatgtcaccaaatgctaagccttcaggaacatctaaatatttaggtggtaggcctaatcacaaatgaagcaaattcctccttttaatgccaacctctcctctatgttgtgctcctcactttctctggccatccttatatgacatgacagcctcattcaattccttagggctggtcatgtcattcaatgcttgctcctccaaaaacacacagactttctggagaacagtgcaattcaagagtcagaccaacctgagttcaaatcccagcttccaagcttcctaacctcgggaacttaagccatttatttaactatgagttgaatctcttaagaagagattattccctctttcttggtggtgttataagaattaaatgagaatgcacggaaaacacttagccaggacctggtccactaaagttgctaaaatcatagtaggtcctcttttccttcctacaatacattcaaatccaaggtgacaaccactatttccaataagaaataggtcaaacacacaaaaacaaaatgaacaaacaaatacaaagaaataggtcaaatgcaaagctggccaagtctctgagataaatataattattctcctcaagaaaaacattccagaaatagtagttcaacttctattgtccagttatagattattctaataataagaactttaagccaaatactagggaaagaatttactgatgcaagctggtgaggaagatatttgggagcatataaaaaattacatatccttcaaaattataccatagctgtgcatagcctcgtttgtacaagtatctggagaaggtaaccttttggacatacagagccaagtagcttctttatattacagcagcgactggaaaacaggaagtaagaaggtacaagagaaggctcttgttcaatgtcatctactgcacacaatttccaaaagctcccattttagaattaaaagactactggaaaagcaacaactaaaaatcatgtgtactttatcatgaattatcttaatcagataactttccttcttaataccccaaacaaagctggaggtttagaagttttgagtcggtataaggaattaatgacagaaacatggttaggcttgggtaggatactgattttggacaggtaaaccaaaaagagaagcctaggtatctgaaagaactgaaaagcaaaagaaatagagcagaagagacagaattaacaaagttgtaaaattgtctagagttgactgtcacttcatggagtcactaaaagtcattttctgtacttgaacctccaagaaaatgtcactatttacaatgataggcaaccatcagtgtgaatccaatgaggctgtgtgctcagggcatctctatgcatgccagacatgaaaacttgttgagtgctaagcaaacaaagggctgaataatggctgagagcagaatgtcaccttgagacatcttactgcttgaaaggattttcttcctcttaatattttatagcatcttcattattcagttgtttaagctactcaattgttaatcactattgctggtatgtactctctgcaactattgcaaaaatactattgaacgactaaatttacagagcattcaatttgtagtcatcctaatgtttctgtatgcaggtagtttttaatacctgcccattttttaagcatgttgatttaccttaataacattactgtcacttttgtagcagaaaattcaagctagaaactatctgacaaagaaaggcccttccagttaagcagtcttatctcattgtcctactgctttattcattgccctgcactttccaccatgcctaggaaaaccagtcatcccactgctgactcccagcacattccccaccaaaatcaaaagacaattccctgtgactcatggcatctccattcaatcataaaccaactcccttttatcttcagactccctttggaattctcctcaacctccttaccctggctaagcaccagcttaccttcgagggcactacttcctttctccaaggatgctcttttgtataaatcacagaagatttagatataaaccaaaaggcattatctatgcctttactgctacttttaaatgattgttcttctacactcattaaaaaatctctcctcttttgaagcttattctatccagctatacctttctggcatcttctaatcaccttttcttttttttttaattattatttcttattattattatactttaagttttagggtacatgtgcacattgtgcaggttagttacatatgtatacatgtgccatgctggtgcgctgcacccactaactcatcatctagcattaggtatatctcccagtgctatccctccccccctccccccaccccacaacagtccccagagtgtgatgttccccttcctgtgtccatgtgctctcattgttcaattcccacctatgagtgagaatatgcggagtttggttttttgttcttgcgatagtttcctgagaatgatgatttccaatttcatccatgtccctacaaaggacatgaactcatcattttttatggctgcatagtattccatggtgtatatgtgccacattttcttaatccagtctatcattgttggacatttgggttggttccaagcctttgctattgtgaataatgccgcaataaacatacgtgtgcatgtgtctttatagcagcatgatttatagtcctttgggcatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagtactttttttttgatggaatctcattctgttgcccaggctggagtgcaaaggcatgatctcggctcactgcaacctctgcctcctgggttcaagtgattctcctgcctcagcctcctgagcagctgggactacaggtgcatgccaccatgcccggataattcttgcagttttagtagagatgcggtttcaccatgttggccaggctggtctcaaactcctgacctcaagcctcagcctgtctcagcctcctaaagtgctgggattacaggcatgagccactgcgcctggccacattgtttttatacttaagtgtctggtttatagttttaatctccaatctgctcctgtctgcatactttgtaaattaaaacaccatgtagccatctatttaatcccttagcactgacctcctccaggccaataatcccttgcttcactctgtttccatgatgctcacccatgacacaatctggaaattgtcacctgtgactaaatcccattgcaatgacagctctgttctcattttcttaaagtgtgatgacaactttccacatttttctatttatttgagtcttctagtctcttaatcttattttatggccccctatccacttcgcttcctttcctagaaccatggagcccctgtcagttacttataagagctctcaccaataccttgaagatatttaatatgatctagaaatcccgagacttggatcaattccataatctgtcttcactacttctctaagcagatgagtactgctggggatgggatcaaagggagtctaagcatccagattttgaatcagtaaagactgtttttgaaatcagcttgggcttccctgacttaccttgtcaattcctttcccattctctgatgacttctttaacaatttgctgattttaagccctgtggccaatctccactcactttatactgagtggatgatgttctctcctacttctctgagaaaacaggcatgcgccctttcaaaaatctcttgtcccctttattccacctgaaaacaaacctatattatttcccccacttccaagtctcaaagttgccccccagcctatatcatcaaacatttggatgcagaaaaatgcccagtcaccaatcgacagcaggtaaccaactgcccactaacatatcaccaacctacatagcaaaggccaccaacaattccctgctgtcaaatacaactaaattggatacttagttttattttatttttctgttccctgtggcatttctggctattcctttctaaccctttcatcctttagatccaagtactcctgttctctgcactggccttgctggctccccttgtgctccctactcctaatcgttgtattgctgaagtcctcaggcctcttcctcttttccccttctctctgtaagtgatcttgtacacttccatgattttaactaccacataccaagttcagcattttggaatccttatcttgcccagactcttcattaagttcagacattgttatccaaatgactgataaagatgtccacatacatgttacaaaatcaatctaaattcagcagatggaaaactggactcatttagactcttgttctcagattccctatagtatggagtggcaccatccaccttctagctctccccttcgttccttttattcttttctctcaccagtttccactaagtttacctcttcaatactgcatccttaacatcatctctttctcacttagtccaagattttggaatcctcccttggattcactgtgatagccttcccaccaacttcctgcttccagtttcacctcccttctccctccacaaacacacatgtcaaaaaaaaaaaaaaacttttaaaattatcctttcacactgttgcccaaataatctttctcaactgcaaatctgatcatatcactatagatattaaaacctttcactggcccctcattaccaaaaactaaaatgaaattcctcaccatagcactcaaaaccctttacagctgaccctcagctcccttcctagcctaactgatttctcatcacattttacctcgcacttcattctctataccaccacttctataccattgtatatcaaccaaccggtgaaattttcacattgtttctctctctctgtctctctctctctctcacaggtggggtctcactgtgttgctcagactggaatgcaatagctattcacaggcacaatcacagcacactgcagctttgaactcctggtcccaagcaatcctcccacctcagcctcccaggtagctaaaactataggtgtacaataccatgcctggtttatattattttataaaaaaaatgttcatcccttctactagactgtgaactccctgaagacagaattcatattttacttactcctgtatactcaccacctggaacccactagaagtttaataaatgttggctaattgatagaccatgaagtatcctaaaaacaaagagcttggccaggcgcgggggctcacacctgtaatcccagcacttcgggaggctgaggtgggtggatcatgaggtcagagatcgaggccatcctggccaacatggtgaaaccccgtctctactaaaaatacaaaaaaaattagttgggtgtggtggtgtgcacctgtaatcccagctacttgggaggctgaggaaggagaatcgcttgaacctgggaggtggagattgcactgagcctagatcgtgccactacactccatcctggtgacagagcgagactccatctcaaaaaaaataaaaaattaaaaaattaaaaaataaaaacaaagagctctcctgaactatttttgcaattgtataattaaaaatatctttctaggaagactttaattttcatcataatttctcagcaactaacggtatgcttcacaactgctaacacagatctctttctcccaattgaacaataaggagccagagagaattatgagttaagattgactttacaatgagcagaaaagtagtactaattagtgtgagagtgtgttttaggtctccattctttatactagactcgacagactgattaaaggacagggtcacccatacacaccggagctcagaaaaagtgcacgtaccttccacacagcgacagccctcttgcagcacccgtgcatacatatccactttggactgagaaaggagctggtctccagtcaggtatgtattgtgagaggaagcaatgtagtagttgcagaggggctgatccatgtcttggtacacttcatggtgcaatgggttaaatatgtcacaggcaggactacgcatgaagttcgtgaagcctttggaagaaagagagtgacttactacagctttcaaagcatatatacttaatggctctaagaggggcaaaaggggtcaaaaaatgttcataatgattatcttatttaccctcaggatggcatttgtggggaaaactggagcaatgagagatttgcttgaggtcaatagtatggtttagatatttgttccacccaaatctcatgttgaaatataatcccctatgttggaggtgggccctggtgggaggtgtatggatcatgggggtggacccctcaaggcttggtgctgtctttgcagtagcgcatgagttctcctgagatctgtttgtttaaaagtatatggctctctccactccactctctctcctgctccagctcaagccacgtgacctgtttcctcccacttcaccttctaccatgagtaaaagctccctccagcctccccagagaagccaagcagatgctggcaccatgcttctggtacaacctgtagaatgtgagccaattaaaactcttctttataaattacctagcctcgggtatttctttctttctttccttctttattttattttatttatttatttttttttttgagatggagtcttgctttgtcgcccaggctggagtgcaatggcacgatcttggctcactgcaacctccgcctcccaggttcaagagattctccagcctcagccttctgagtagctgggactacaggcatgcgccactgcgtgtagctaatttttttgcatttttagtagagatggggtttcaccatgttggccaggctggtcttgaattcctgacctcatgtgatctgcccgcctcggcttcccaaagtgctgagattacaggcgtgagccactgtgcccggccaggtatttcctaatggcaacacaagaacagcctaatacagtcaaatagacagtgtcaaaaaatgaaatgtgacttttaggaatagccttttaaatataacctaatatatatatacatatatatatgtatatatacatatatatgtatatatacatatatacacatacatatatacacatatatacacatatatatacacatacatatatacacatatatacgtatatatacacatatatatacatatatatacgtatatatacacatatatatacatatatacatatatatacgtatatatacacatatatatacatatatacatatatatacgtatatatacacatatatatacatatatatacacacatatatatatgtgtgtatatatatgttgactttttaagaattttgactaggtagaggaggggccaagctgtttagtgatgactgaactcaagctatgcttatgcagtgtgactgatgccatgttaaaaccatagtgataccaagaggtaccctgaacaaccagcaattgataggttattacgttcatctgaaaaacagtaaagtcagtgccatagttaaggtagtaagccaaaagttaaacactgtctaaattcagggtgtgattgacaaccaaattggtttgaaaaaatgctgctaatggctggcacattttataactttgaaatagtcctttaagattatttagaaaaccctatcagtttttttacaatctttcaaaatataatgcctgggtcaaagaggttttcactaatataacaaataaatacatggatgactcacaagtacctaaatagaataattattagggtaaattatttcaagttttcaaaaatcatttggtataattatatttgtaaatatcctcagagacttaatttcttcatgccaacttttatgtccataacttaggaaaccaggtttaattccatcttttcaggcctcaccaaagaaaagattcatttcttagcacagaaaaggcccaagttagtttatcatctctggttgtttttaaaacagtttttaatgatataagattttattttattttattattttattttttgagacagagtctcactctgtcacccaggttgaaatgcagtggcacggtctcggctcactgcaacctccacctcccaggctcaagggactctcgtgcctcagtttcctgagtagctgggattacaggcatgcgccaccatgcccagctaatttttgtatttttagtagagatggggtttcaccatgttggccaggctggtctcaaactcctggcctcaagtgatccccctccctcagcctcccaaagtgctgattacaggtgtgagccaccacacccggctaatgatctaagattttaaattattcctcttcactttaattacctaccaccacaggaagtaaatagatggtattaaaccccccttgttcacactgatctgggagcagaagaaatgagggggccaacggtcaaaattggtgagataaaccatggctttgcatgctcttataggcagctggtctttcattaaagatcatctgctctgcctgaaagatcctcctcttgggtggcagcctacatagtatttctttacatattttaaatacatatacatacatgtagctatatttctgccatattatttacgtctaacatttcaggagctagattctgggtatataactgtgggcaaattatttaacttatttgagcctcacttcctcaactaaaaaatgaagtcattgtattaatgagatttgtggttccaacagcttctgcaaagctaccaattaggaaatacagtcagttgctaccattttaaaggaaacatggcaagtcactagtctcagggataacttattttaggactgaatttcccttcatgaaattatcaggctaatttccaaaaattagccagttgagaaaagcccaaatatgtcatggcatccatcacacgtggtggtaccaggtagacttgcttgaagtggaaaatgcttatgggcattgcaaaagtaagacaaatagcaacatcatggtctttgctttgcaggaaaatatatgtgtgttgtagattttgtttgaattatttattaatataatcccatggatatgtcctgatttcttttcctaaaaacttttgctggaatttaacttaacaggctgaatcaagaaatgagaaataaagaatattggttattttaccttctatgccaagaacatttttcaccttattttcttctgaaacttcaaacttctttatgatgtcaagacaatagtccgttgtcacattattcatctaagaaaaacagaatactagtagagtacctgcaatttcataaactatgttcctccacagtagaaagacatttactgattttgcattcttcacaccgtacaaagtacctaaatgagcattgtttggggttattagtgtcacagctattttatctttggagaatgaccatgattcaatcttcctatgcattttttagattgaatcagcaaaaatagcccttcaactattagacaaatgttctctgtgaagaaatgaaataaaatcagttatcaatgtgaatccattgccaaaaatacactcactataagctagcagctatctgcaaaaattaacgtttcctacacaagcactaaagtttgctgatcataaatatatgtagaaaaagaatgattccctaccaaaacagaatgtttctaagtaaatgtacctctgtgtgtgtgtgtgtgtgtgtgtgtgtgtttgtatccatacaaccatccactgagcagagcagtctgccatggtaatacaggaacacaaaggttagcaagaggaaataaaaatgaaaagctaggtgaggtagctagcataacaactctggagctagactgcttgcgttcaaatcacctagtttatattattaatagtgtgacattgaagaggttacttaccttttctgtggctacctgatagtggagtgataaggattaaatgaattgatatttgcaaaaacattgtgtggcaccaaaaaggcagtatatgctatttattaatattaatattattgagtcagtctcaaatttgctacatgaacaatatatgctgagtgtcactgggaaaggtaaactcttcagaaataatttctttaattaaacagcaacattaagaatgtgatattttgatcaaaaatccatttagtcccacaatctaacattgacattttaaaatattaatgaataattatagaggaagctaattttgtgagctagtatttcatattttaattatattttctcaaatattccatttttgtttaggtttaatacttacattttaataaaatctagtttttctaaacagtctatttaaactgggggtgaagcactgctgtatggctgttttttgtcagttcaaaagaacacacaatgatttctttcttttcaaactagcatggtggctgatgcatcctttgagtaaattttataattcttattctatttaggggcccatattaccagaaaccacctgaaagtattataaataaatgaaactgcaatacctccaaggaactctactgacccaggcaggctttgagcagctcattaatttgtctgctgtgagctagagagatttggcacatgcagtctaaagataaataatttttcacaaaataaaatgaaccaaattgataacaattttacatgccgtgtgaagactaagttcactttgcaattattttgtttataagcccatttgttcagaaatgtagaggtcttaaactggactcaggtagactaccagaagcccatgaatcttaacaaaagcaatgaagaaacaacaaaacaactaattcactgagatgatggagctaactgcaggtgagcagagaatatgttactaattcaggatacagtgaagacttttataaccaaaaacatcatatttgaaaatattcattgaattagcaaaaatattagtaagcattctgtgaagttcacaaatttctggccaccgtagaagaattaatgggaaaaaataatctactttctaccaaaattgaggtattaaggattgactctttgcaaaatacagtaaaaccccataataatgagaattgaaatgtaagagtcaatcgactcccaaccttccccatcccctgatctcatttaattaatctcccaacagcaaaatcctgcattttacgtaattgagttttttaagacttcatttaagttataagtttattgtatgactgaaggttcaacataggttaatgctctttactgtccttcttcaccctgttttgcttcctatttgacagagctgatagagagaaataggaatttctccctactctaaccctgtttcctatggagttcacttgacagttttgtttgtcattgaacatctgagtcacttgctgtctccaatactgaatattgttctttctacaggcaactggtgctaaaagaagaacttaagataaaatgtgattattttaataatgactctacatttatataatgctgtcaatgtgcagtaaagagcttttacacacacaatcttaaataattcttacaatagtcttgtaaatttagtgtttttatccctgccttgtagatagaaaaattaatgttgagagaggttaattaaacatcaccatcaaagtcacaaaactgtaagaggcagaaccaaagatcaaatttggaccttcttgacttcaagtccaaagcactttcttgtataactattctctgggcatttttctttatttctattgaaaaattaaaatgcttacttttaaaactgataggtgtttttaatttcaatataactgaaactcctaaatcatttctttacttcaaatcaattattacaatttaacttattttattattcaagattagactccattctcttttcctttatttactgtagttctttagtctcatccagaagagaaaagactcactggtcctcacattaaaggacaactaatttcagataaacaagttgtagaaactagtcatagatctataaaatacccatattctgacactacctatttatcctcagacttcctgtaagttttttagcaaaactttccctgtgaatgaaaatttaaaacaaagtcagaaggggtaaacaattatatttcttatggctatgattctcaacaacaccaagtgtaaaatcaatgtatcatttgcaaaaattctaatattgctaaaccttactagcttatttttatcaaagggttatatttgtaactaaataagtcaaaactaagatctttataactaaaaccagaagtcccccgcctatacccagaatcactccccaaagtcaataatgccaatatttctagatatttcttttgaaatcggtctttatatatatatttggagatggagtcttgccctgtcacccaggctggggagcagggacctcactgcaacctctgcttaccgcgttcaagcaattctcctgcctcagcctcccatgtagctgggattactggcacacgccaccatgccctgctcattttgtattttagtagaaacagggtttcaccatgttggccaggttggtctcgaactcctgacctcaggtgatctgcccacctcggcctcccaaagtactgggattacaggtgtgagccaccgcacccggccatctttctattcctaattattgtatttataatgctatattgtacactttaaaaattattgacttcttactgtgttagatattaagttagatctttaacataataataagatcttctggatctgcagatctgcctctctgcctgtcctctcagcataattatatcatccagtttttatgaaatatatggtgtttaaattattccaagtatgcgaatgttgaacaatgctgaatccgttgtacactgtgattgtgtttcctttctcacagaacattttttatgattacttgctgacattcctactcatttggttaacttttaatgtacctatcacaaattcttcccaatgactctaatggtctctcaagttccacataatcaaaggcaacagataatccatgaattgtgctttttttctccctacaaaagttctccttctttccttctggttgggttctggaactgtattcagcttttgctctgactttactctgtcactcttgtgaaagagctctcaggaagtaaattatttatttccctcatgtgtttttgtgtgtgctctggtgtatttgtcttttattccacacacacatttgtttgacagtttttggcagaaaattctaggttgaatcattgctctcacgatttttggcttccagaactgctgttgagaaatctgatgccattctgattccagtccttttcacaggaccagttgttgtttgctaattagtttagtttagttttctctttttacaagcactcagggttccactttatccttggcactgtgaaatttcactctgatttgcctctttgtggatctttatactgaggttggccctcgtttgggtttgtcagtctagagaatcttacctttccatgctaataaattttttgtattatttatttgataagtttctcccttctattttctcttatttttttctatttcttttttgtttgttcttctcatgcttttaatttccaagagattttttttttctctgaatcttcttttctcgtggcatccttttatttcttaagagacaggtcctcattctgtcacccagactggagtgcagtggcacagtcatggcgcactgcagcctccaaatcctggaatcaagtgatcctccttcctcagcatcccatgtagtggggactacagccacacaccactgcacctggctgatttttttatttttatttttattcttatttttattttgtagagacagggtgtagctatgttgcccaggctggtctcgaactcctggcctcaagcaatcttcccaccttggcctcccaatgtgctggaattttaagcaagagccactgtgcccaatctgtcatagcatcttgctcttgctttatggcaacaatatttgaatcattctgataacattaacaataatttttaaagtttcctcctccttgcattacctctgtttcctccaagtttattgtctctatttatttgctttagtagtctctgttctttatagcagaggatttcctcaaacattggtaagccttggttatttaaaaccaataacctgggaactgagtattggaagagggctatggttttcacatctcaatgcatagatggtcactaacccttgcattcattctctacttctgtgaaacaaaccaccccataacctagaaacttaaaacaacgactgtttatttgataacaattgtgtagggtggcaagtcagactgggttcagttggatggttattctgctgttctcatttagagttcttcatgtgactacaggcatctggttacttgccagatggtacaagatggcctcacccacatgtctgtggttggtgctggctgttggctgggcctctttctctatgtagtctctcatccccaaggaaactcacctggtttcctcacatgatagtcccacagttccaacagggtgaggatgaaatcttcaagactccctgaggcctaggctccagaacctgtacatcagtcctaccacaatttattaatcaaagcaagtcattaaactggcacagattgaagaagcaggaaaatagaattcaattcttggtggaaggagtggcaaaggtgcattgcaaagacacatatgtacaggaatatggcagttattatagccatcttcataatccccatgttttccatatagtacccacactcagccgtgtgtggcatcacttagtcaaatcctcttacctctttttttttagatagagtctcactctgttgcccaggctggagtgcagtggcacaatctcagccaaatgcaacctccacctccagggttcaagcgattctcctgcctcagcctcccgagtagctgggactacaagcatgcatcaccacgcccagataattttttgcatttttagtggagacggggtttcaccatattggccaggctggtctcaaactcctgacctcaagtgatctgcctgcctcggcctcccaaagtactgggattacaggagtaagccaccatacccagccccccttacctcttacatacagttttatgccagggtagagaagggacagttgccctgctacaagggttggaggagaaaatctgaagccctaaccatatcttaaacagactttcaaccaatgcttgttttcaacccctcttttcctcttttcaggaatatcatgtaactaacatcaatttttgagcttatcaggggcttcccctgggcaaatggagttgcttcgaggcttctcactctatgagattgaatttcagtgctctggggtctcctttaaatcagacaagttttaaaattttgttgctcctctcctgttctctttgtatctgtggttttacagagggggattgtctttactgtattttggggtaatttcaagagggagtgaagaaacacctctaaatgaatggtcagttcatattcaactgaataagacaaccacggtaactattaacctcctcaaactagctacctctaattcatcctaaaacgaaaccacacatttcacagcatttgaatagacgatttcacagaaaatgttatctgggaaatatagccaatgcagcaaaaatattgcaagatataattactctgagtgatctctcaactgctttaattgtgaataattaagaaaaatcagccaggcatggtggctcatgcctgtattcccagcactttgggaggccaaggtgggcggatcacttgaggtcaggagttcgaggccagccttgccaacgtggtgaaaccccatctctactaaaaacacaaaaatcagccaggtatggtggcgggcacctacaatcccagcttcttgggagactgaggcaggagaatcgcttgaacccagcagtcagaggttgcagtgagccgagacagcaccactgcactccagcctgtgtgacagagcaagaccccatctaaaaaaaaaataaataaataaaaagaaaaatgatacagaaattcaggaaaacacctcaaaggaatgcttttatatgaggaaggtgcaaaaaagataaagatacattatcaccagaatgggatagttacaagcaaaagagactataattatttctcatgagagagaagattagaatgattagaatgaccataactcttaccaaaccattctggattcaatgaagggtaaggaagggagagggcacatatgattcctataattggatcagaatgatcaaagaaacattttaccagaaagaataaaggggctaaaggtgcaattttcagagctactacacgggtaatgtatagatctatatcagattacaataaggagatggccctgtagcagggaaacaggaaatctctgaaaatcctcttggaattaactatccacatgcatatttcagatgaaacatttatataaacagaaacctacttttgacttacaataaaggtagcctttgctcttagataacagctagcagaaaattttaaattttttaagttatttcattttagagacagagtcttgctctgtggcccaggcacaatcatagctcactgcagcctggaactcccaggctcaagcagtcctcccacctccaccccgcaagtagctgggactaagggcaagcaccaccacacccaactaatttttgtttaagagaaggggtctcactatattgttcagactgatcttgaactccagggctcaagtgatcctcctgcctgcccccgtagctgggattacaggggcaaaccactgggcctggctaggaggattttccaactatataaaggcgcttcaatgttcctgccttctcttccttcttcctcaatccataagaaacaaaaaaatataaagaacataggggcttgctaagaaaggttgccaaggggatgggaaaatgaaatcaaattgtcactccagaaccaaaacactaaaaaggatggaacaaaaaaaacactcagctccagtgccaagaaatggataggaactctggaggagatgtaggtggttgtttggcaaatatgaggttggggtgggtggggaatgaaacaaagcaaaacaaaacaaaacaaaacaaaaactctcaatcaactctagtaaatacttcggaaccacagattagtggatatctgtgatcctttatctgtagatgaaaggaagagaagaaagagaaatctcagccaggtaatttctggctatactggcacttcctcatggttataaaagatagtgagaattcccttggcacagccgtgttttaagaatgaaagtcctaatcaaacagcaattggacctgtcaaaggcataaattcaatcttctgagagcttcagtaaaataaaaatctgacccacaggccaatatttgatttcataaaacccttgacagcatatgtggccagcagtgatatttcatttcacaactgagtaaacctataaaagttgaatatcctggtgtctgcaccaatcttatgttatcagaagctaatgaattactgtgacacacatcatcaaattgcctcaaatttgtgccattgtgaaaatccagttttgaaactcaaaaccccacgaaactcttgactaacgactctttctacacagttagattgtgtccaatctaataaaataaatcttaacactattttaaagaatgttgaaatgcacaactttacaacaatttttaaatacagagctattttcttaggatgaattattaaagtaaaatggtttggccaaagttttatcaattatattaaatgttatagattgtaaaactactccagtatcattctataatttcaccagaaatagaagagatggacactacgtttggtggcatattttttaatctttactaatacgatgggaaagaaattgtctcctagcctagatagcatggtgagaccctgtctctaaaacagattattaaaaattagctgggtgtgatgatacacacctgtagtcccaactactcaggaggctgaggcaggaagattgcttgagctcaggagttggagtttatacgatccatgatcgcacccactgcactccagcctgggtgacagagaccctgtctctaaaaaataaataacttggttttatttcagatttttgaattactaataaagggtgaacattttcataggtttattgactttgtatgattttgtaaaggtttcaagtgttttactcatttttccattgttttttttttcctcaatggtctaggaaagtacttgccacattaaggaaattcactatttctctcttttgtatgttacaaatattttcctactctgccctttaattttgtggtgcttaataaagtggaccacatataaacaaagtttcagtacattaaaattttcctttgtgatttttacctcttgatgtatgatcactttttttataattttatagatttcttttgagtcatgctcatatgtaagtagcttcaagctaatttagaaaattaaactatatacagttaatcatctgccaggaacaaatgtcacagaattctggcttctgttttccctaactaaaatttactggcagaatgtcaacaaaactaaaatgagagaagaaacacatgccccttagcaagtgacatccagtattgctattcaaatgaactggggtaattccactagcctgaatgaatttgaagtcagtagtttataccttttaactttaattcctcacattgccacacttctgaatatcttgggcaaaggactttcctgttcatcattgcaatgttcaatttgacactgtgagataggaaaggcaggtatcatctccctttgcatggatcaggaaaccaaggctcagaaacaatcatgattgattctccaaccactaaagcttgcagtgtgtggaatgcaggtgttttggactcctggtctaatgttctttccagtacactatgagagttctgcaagtaaggatggagaagtagttatataacagactccacagaggagtaaagatgtagaaaggatgtatcctctaagggaaaatatagacatttctattacccaattccctttttctacctgtcttacggctaacattgttaataaagaatctctgcctttgccaaactatcaaactacttaaaataactaattttgacaaagcattttgctaataacactatctgtttaattcttaagaaagcaacaacaaaattcataaaagtgaatctgttatttctaaaacatatgtgattatgatactaaggtaaagtaaaatattaagtaggtattagaaagttatctaatcacatggttggttgctggctaccagcccctatcctgaaactatccaggggcccaacaatagttacctcattagcatgaactcagatatgatgaaaaggggttcattataaataatcaaagatacttctcaggaaattctaagagtttaggagctctgtgccaggaactggaacaaagaccaaatgtatgttttattatatcacactatgacagacttggagtgggagggtataagagaagtaatttggaagaaaattctaaccatgtacagatttgatgcagtttagtacacggtatcctaaaatattgcaccctagcatttgtggaaaacagcagaaaaggaaaggtatctccggccttccccccagcccttccacccataaaacctaggaagaattttctgagcttcccctgaagcagaccatacgaccctcattaaagtgaccatcagcaccttcccaatacccagaggaaaggagcaaaagacacagaggtgccaagaaaagtgtgaacaaacacgccttactaaattccccatttactgccattagatcataaccttgtcctctaaacatatttctccatgactgtccactcttcatcaaactagcataagaaatacacaggtttgcctaactctctgggtcttcagtgccttataaagtctcctctgtgttattaaaaacttattagataaatttgtatgtttttctcttgttaatcggtcttttgttataagtgcctctgccatgccctagcgatgggtgtggaaaagacacttcccctcacctatggaattttacagtcaagtatatgtgcggatacttgcccactaggaatctcacattgctccttggaaatggctagatctgtgcagctaataaaccaggcaatgcactaggaagttacatccacatctcatttaattctcactctactcttgcaagggcaatattactatcaaaaccattttataagtcacaaagtcaaggatgaaaagttaatgtgatcaagttgcaaggtaagcaaggttgtgtatccagtcctgctcactcctattccaccacacagtctagtaatttttaaaacttccatgccaaatgaagtgttaatctgcttgaaaagaggtgattagcattactgatgaagacgataagagaaacacattatcagaaaacatgtttaatgcatttaactttgggagtttgaaagagacatcaagaaaggcattaaaactggttcctacttgggtattgcctgctacctctcaaataaaagctaatagtgtggtgctagtggttggttctttagtggcatttaaatagaatagatatccacctggaattactgagggaaaaccagtctgtctgcctgtcagtctctgtctctgtctgtctgtctgtgtctgtctctgtctgtctgtctctctttctctctctctctctctcacacacacacagacacatacacacacatgcagaggcaataaacaacagaaaaacaggacagaattcatacagatttttctgtattttaaagagcatttcaaagttcaaaaaatacaattcaaaaacaaacatggaaaaacattcatccctgctatcaaaaaatgttaatcaaaccaacattaacttatcattctatagctaccatattagcactaaaagtgatccatttaataactaatcatttgttcactgttttgttaattataaactgaaacaaatcttttatatagcattatggagatatgtttcaaaagccatgaaaatattttatccaatggctcaataataagtaaataattcagaaaaaacatatacatggattttgttcaccaaatactttgtacttttttcattcttgctaaagcaaaacattgaagactctgatcaccaaattaatctcacatttaaaaaattcaaatatggcatttaaatgctataaaatgttaatataaataagggtagattttgaatcagtgagactttttgccatttatgaatctataagcagcatttactagctcaaattatgaatgtcaaatagtttttagactacaccaagagtaacataattttccaggttatgtaggagaaaattaaagaaagttaaaagaattgactctcaaatgaaaatcacttcacaaattcaatttaattcaaattagcactaaaactaagtgagcatgatttcatgtatattaacaatgtattactaattaatatttttagtatctttacaaaggtacttcttctaaagaagtaacatttccagaaaaaaaatacggcacgataattgtaataaattttattctacctcaaaaaggaaaaatccagcaaacgttaaaaagcatgttgttttacttcttcacattctctttccttttatcatagactctcaaaatcataaagtatcaaaaaaaggtctttattttgagctttctgagggtaggttttgtccactacaaaaacttagcacaatacctaggaaatatagtatctattcatacaaggaaatgaattaatctgaaatgttactaatccaagcacccacccatatttcaatctcattaatagcgtctcaaatccttgttaacaccttcaaggaagaaaacacaattgtcaaagtcatccagcacatctttggtcagctatacttcttaagagctagtggaaatttatctctctgatattcagatattaatccaatgtttaattcactggggttctgtggtagaattttatcctggttcacataaagtccttgcaatatccagatccagactgaaagaagggatcaaattaggtgacccaacttttccactcagatatatattcaacagacttgacaacgtatgtccacacaaaaacctgtacatgaatgttcacagcagcgttattcgtaacagcccccaaaaagcaaatgacccaaatttccatcaactgatgaatatataaacaaaatgtggtatagtcatacaacgatatattatttggcaataagaagaaatgaaatactgataatgctacaacatgaatgaatcttgaaaacattacgccaaatgaaagaagccagtcacaaaggtcacatatatgattccctttatatgaaatgtccagaacagataacagacaaatcaatagagacagaaatattagttgccacagcatgcttggaagagagaaatggagaataattgctaataggtttggggtttcttcttggggtgccgaaaatgttctgaaattagatagtggttatagttgcacaactcttttttccttttttttttttttgagacggagtttcacttttgtcacacaggctgcagtgcaatgacgctatctcggctcaccacaacctccgcctcttgggttcgttcaagcattctcccgtctcagcctcccgaatagctgggattataggcatgtgccaccacacctggctaattttgtatttttagtagagaccgggtttctccatgttggtcaggctggtcagaactcccgaccacaggtgatctgcccgcctcagtctcccaaagtgctgggattacaggtgtaagccaccgtgcccagccctttttttttttctttttcttttctttcttttttttttttttttttttttttgaggtggagtctcgctctgccgcccaggctggagtgcaggggctcaatctcagctcactacaacctccacctcctgggttcaagcaattctccctgcctcagactcccaagtagctgagattacaggggttcgccaccacagccagctaatttttgtatttttagtagagactgggtttcgccatgttggctaggcttgtctcaaactcctgacctcaggtgatccacccgcctcagcctcccaaagtgctgggattacaggcatgagacaccgtgcctggccaatagttgcacaactctgttgatacactaaaaaacacttaaatgtatactttaaaaatggtgaattttatggtatgtgaataatatctcaataaagcctttattaaaaaattggaaagtgttcaagcacaagctggctgattatttgtgtgagtactgtagaaagaattatttctactgattattgtactatatagtccaaatatttgatgattttttacaatttcaacagagctaaatgccgctgacttaaaatgaacaaaggagttaagcagctctttatattaagacgattggtccattaagagaattaaaagtaaacctcatcaactgcacaaaaccaaagcctcctctcaagaagtctaatataaaaggttaaaaaatttgaataaaacattcatttattcctctactttagtgagaaacagactttgaggagatatttaaaaagcagactgagaagttagctttgctgaccataattcagcctatataatattaagattaaaacaccttattttaaacatacttagagattctctttgctaatcaggacctaatttacttagccttttcacatgatcaaatggcaatttactatcagaattaccaatgacctaccacaatagtagttaagaattatgccatagttaaatatctagctattttattagtataaatataaatttatatttaaaataaataaatttgactaaatttatactaatatgaatttatactaatatatagtataaatttaaactaatattaatacatcatagtattagtataaagaaagtattaccattgtattaaaatattaacattcatttctttgtgggaaaataggcatatctgtactcaatacatttaagattaagaattatataacccagtgttcaagttatcacttcctgtcttaaaagctgctagaaactgttttaaatgactcatagataagatttttgtgaactagtgatatttaccacctttgcaaaattcaaagtatacctatatttaaccccaaaagaaagacatatctttcatgagtacttttaagtaaactttcattttaacagtctaatgataccttttgctccaccttcaaaaactgagccagttcttccacagttaggtgatctttcttgtcactgtagctcaaaagtaacaaataaaggtctcgtctcaaagacatcattttgtaaaaaacacagaactcttcaaatgtcaaagttccctgattctcatctgtgtcggcttcctgaaaagggcatagagaaaataaagtaatatgaaagttagaaataggaaattcagtactgggaaataatatttactataaaagagctagtacacaaatcccaagaggtgagcacacattctcttcgagcacacattctcttcaagcacacatggaacattataaagcaaccacatatttggccagaaagtttcaacaaattataaggaatcaacctcacacaaaccaattgttctgaccactgtaaatttataaatcaacaaagaaaccttaaaaaaaaaaaaacctgtagaaacaatacaattctagataggaaataaaacatatggaagtgaaaaatacactacatattaaaacttataaaataacattagaaacttgaagtcttaaattactagagagcaaagattttaaaaagaagttaataattcaactcaaaaaatgtgaaacaaaattaagcgaggaaaataaattataaacaaaagcaaaaagtaataaaatagaaaacaaacagctgtaacatacacgtgagaaagaaaaccaaagcccgatttctaaagaaccaataaaaatgagaaatcttgaaaaagactaatcaagaacaaaagaaagaagatatatttaacacttgagaaaaataacagtctctcattggtttctgaactgtaatccaatcaaatgtaatttttacctatgagagaatctctcttaattctccaaagatagagttgatgctcttaaagccatgggcatccttggtaactccctgctttccctccgtagaaaagtctaaacaatccatctggattgatttcttgttaaaattgtttctagtaattattgagcatgaagcttccatcatatgccttacttacaggttggctgaattattcataaaaccataaaactattggggataaataataagcaactgacccacttatgtgctcttcttcattctaagtgaacacaattctaagtaaacaaaaacagacagggaatgaacggcattttgaaatgcatagaatttgtgaagtacactcaactgttatatggtattaaacaaagctttgaaagtcaaagtggtcattaaaatctttttaaaattttgctaactttgggtcaattatgaacaaatgcttccaaattttactttcaataattacccaagaaatcatgatttgtataggtacagactttgtcccccccctttaggattggcctcttacattgaatcagcagctacctcttcaatgctgtgatcagctcctgtgcaaatgaacagacaggaggtggggctcacagcagggcaaaagtgagatgacacggaataccagaaacatggcaaaccttcccatatgtttaaagataattcatttgccctccaaagtccctcactccatctctcaggttccctatacagcaaatctcattccttcctcctcttcccattctctcatgctgttctccagtgcaatgggactcagtttcccacaatgcaaaccatctccaaccaagaacagggccacccttaaaagggtcacagaacagagccagcctctgtcttccatttattgttgcaacacataccccatgttgtctctgctcttaccacctctaagaacaagtacaaacattaaacatcatattgccctcctatgcttatttttacatgtacaaagtatcacctagaaaatcattgcaaaacatggattatgcacgcaacttatcttcaaataatagcctgttacaaattaatactctagtaatttctaatagcctaacattgtctttgccctgacttaaacttaagagagctcacttcggtactcaggtaaggattaaatgcagtcctagctggatgccacagaataagtctgggcccaagaatttttctcaatgactcatcaacagggaaagagcctttcatctaaccaacaaggagttgaatgaaattctggagagctccctaaatggcaggagtgaattgccctcctaatcctcatggatactaaatcctgaactcctcagaaacaaaatacagagctcttgaggttttagacaagggctattttttgtcatgttacttagtctttattctgatcctcacaagagccctgcgaagtaggcaaatgaggtattactgtcctctcaaagggactggagcaagtttcctccattatttgtcaggaaaacagcaacgataacaaaaaagcgttttaggaagtgaaattttggacgaatgttaaatttataaagtctttttacttgaaacaaaatcatttcttcatcaaagaaaaataaaacagtacagagcacatatattagcttccaacaaaacaaaatagctttttaatatacctaagtatgttaataacctctgtgtattttatataaggccagtgaaattgtgaaaacttacctgaaacatttgtctgacttttcttcggggcagattaacattcagtttatgcatcagctgatgtatctcttcaatattcagcaagccgtcaccattcttatcagcttcctcaaaggtctgcttcacccatgtgcagaaaggtcaaagaaaacacctgtgctctcatcaaaattaaaaactgctctctcacagaatactcgcaaagacatttatcagtaacacagaacttgagaagaaattattttgaggagcccctgcaatccataggctctgatgagctactaataatgatgacaataacaatgacaacaacaaaccaggaatggaagggaaacacataaagggggtaagggggttcccggctgggtgcagtggctcatgcctataatctcaacactttgtgaggctgaggcaggtggatcacctgaggtcaggagtttgagaccagcctggccaacatggtgaaaccctgtctctactaaaaatacaaaaattagctaggcatggtggcaggcgcctgtaatcccagcaacttgtgaggctgaggcaggagaactgcttgaacccgggaggtggaggttgcagtgagccaagattgctctccagcctgggtgacaagaatgaaactctgtctcaaaagaaaaaaaaggggcggggggtggttccctccattgcgaaatgagagttaaaccaaattattttgagcatctttaattcagacattcttattcaatcttatccaaattaaatatcaaatctattattgcaaaacactatatcactatcctaaatggaaggagtgaattaccctcctaatcctcatggatactaaaacctcatggatactaaaagctacattactggttctaatttcactctagcaagaaaatgacaccttaattcacacctccaatagcaaactccataaacataaatatttctatatgactttaaacgttatccctttttgcttttcattttctgaccagtttttctcagttatgctgccatgttcataacacaaatcttgtgtccctattagttctcattcacaaggttagagttcttcgtttatgaggcatacagatggcatgtagcaggaatggcccagtattacatctctctgacactttctgtttaagaatctctttatgatgaaaccccaaatatcataaatatagggcttatcttctcctatgcccttttacctactatctttttaccttcacaataccccatggtacatgatcttttcaattctcttttctctgtcccactcagacatttagcaaattagaccatctagttcaatctcatcattgttcagataaggacataaaatgagaggagagagagaaatctgataaaaattagtatgagaaccaggtctcaacccaggtcttttgtacctgatttagcacactcttctacacataaggtctgtctctacaccacgcttctcttcctattactggctttgatggttctcacttaattggcccaaatttctaaatcacgggcaggtaatgtgaagtacaaacataatgtgctaggaggtgccctcaaagctcaggtatgagattaagtgactgagaattagaagctgagtttagatacaaaaggtttacatcatgtgaactgaaattttaaaagatcctcagtgggaggagccttgggttgctttacatagtgagaatgcagatgaaatggtaacacaggaattgaaaattcccagttaacttttagcaaaggattttttcaaatggatgattcatagttgttgaggggtaggttacaaaaggcaagtactgcgtgcatatttagaaaaccaattaaacttcaatattgaagggtaatggagaggaaaagaataaggtgatagatagaaagaaaccagagaatcaaagtaagctaaaggtatagttttaaaaaccaagaaatgggagaatgaatgtatatcagaggagagggtacagcatatttccatttctatgcgattcaaattatgactgtagaagattatacctcagaaagtaaaaacaactagaaaggtaaggtattatgtcttctaaaattaagtagaggatattttcagatcgccttacttcatattttgtaaataccttatttcatattttttccctttaaaacttttaaaataactagcccagctctttctagttcaatttttccttatagacttgtcaggacctcattttatatgacccctggaagttaagggaggtccagatctggggggaaagtaaccgaagaaccaaaagggtgaaacatttggcccaatcactaataagtgcctgagtctcattttcttctgttttcaaggcacgcagcacccacttcgggctttcaactatggacactactctatgccccacaaagtacatggctggagttcaaagaagtgacaaaaggagtctgacggcagtaatatttttatccttttactctataattctttatcaaatataattctttatcgaagcctctcaaagtcttctccagagaagaggcagggacagccaaaccctaagcatgtgtgtattctgcagatacaaacatttaggataagcctgtgtctgtctgcaaagcctttagcaccaacacggaaatcggccttgattattggtttagggaactggtaaagtaaaaacagaggcagaatcaaaccaagaaatgtacagtagtcctaattctactgcttacttggccttgtgacagtgggttactcatatcacctcctggagcctccatttcttcacctacaatatcaaggagcacaacttttaaccttgaaatcccttccaactctaagattccataaatgaaaaaaccattctttccagtaacggtccacatagtatacaactccaggtaaaaatgtcctgatatcttaaagatgttcttcataattaagatatgagtgtccaataaagccctgaattaataatttatagccacaccataataattttaaaaagagaaacagtcattcctcagagaaaatctgggtgagactgaatgtgaagtaatgatctaggattttctatcaagagactgtaggagcatgcaaagcattgaatgatcctatctagcacaggggagggcaaacttttctgtaaagggcctgatagtgaatattttaagttttgcaggacatttgctctcagctgcaactattccactctgtcactgttatgagaaagcagccatacagatataaatgaatgaacacggttgtgttccaataaacctttattggaatttcagaaattccaataaaacctttattaaaatttcagaaccctgaaattctaatttcaagtaattttcacaggtcacaaaatgtttttcttttgattttttttaaccatttaaaacccattcttagctcaggagtccacgcaaaaatcctcctggattgggagtgggccagatttgcccagcagtttgacgggggaagaataaggtctggatttataacatacataacaggtggcctaaagccttctggaagtaataatttccctcatggggtcaagagataaggtggggaaaacatgaaggagaatggtctgatagagaaaaatgctgagcctaagtgccagaaccatcatctttgcatacagatctgctgagtattcagactttcatttatctgaataggaaagctaaagatttgccactctttacctctttttagcaatgacagcagtacctattacttgtaaactgcttattaagtgctaggcagtgttctaaggactatatataatcaactgatcttaacacacctctatatggcagacactgtcattatcatcatcaccatgttgcagataaaagacttgaaggcaaaagaacataagtaattcatccaaatttgcatagcacaggcagagtgggggctggaccgcaggcagtgcagcaccagggtctgatccctaatgacactggatttcttctagtaagtatgagtactgcatcatggccatcactcagcatggccatactgcagaaataagttacgctctagactggatggattttctcatgcagccatttaatttcattattctcatttttcattcacagttgaaattttcagtcctaagtgaaatctaataatgaacatcccaaatctgttctcttcattaatgtagttacatgtttatcaaattaaggatgtgatcccattattaagatactatctaggccaggtgcggtggctcacgcctgtaatcccagcactttgggaggccgaggtgggaggatcacgaggtcaggagatagagaccatcctagctaacacggtgaaaccccgtctctactaaaaatacaaaaaattagccgggcgtggtggcgggcgcctgtagtcccagctactcgggaggctgaggcaggagaatggcgtaaacagatgaggtggagcttgcagtgagccgagatcctgccactgcactccagcctgggcgacagagccagactccatctcaaaaaaaaaaaaaatacaaaaaattagcctggcgtggtggcgggcacctgtagtcccagctactcaggagcctgaggcaggagaatggcgtgaacccaggaggcggagcttgcagtgagccaagatcacaccactgcactccagcctgggtgacagagcgagactccgcctcaaacaaacaaacaaacaaacaaaattatctaaaaccctattaaattctgacaaatatgtatgaaaatgattccctgactcaaaataacctttctcatttttcacttcagctttctctttactattcatcaatttattatttctcttttattccttcactgacacaaaaatcaactgcttctatatttcttataaaattgtttctctgtgtagtgccacagtacacctgctttctggacagtatattttcagaatacggatcccatagactatgaaaactttcaagtgccagtaaacgtggacaatcaggttcgaaaacttttaaccaacaaagcaaaaagatgatttatgcccatctctaactcatctctttcaaggattatgagagagacttctataagtgacttgcagctatggaatgctgtgaacttgtcctagttaactggatgaggctagaagcttctggatttggttgcttccccatggccactgctcttccttctttgctacacaaccttgattttgttcaggtacccaaaagccatgtactttaatgatgagtgggaactggatgggggcgggggtgtaaatcttggtttgatgcaactgtcctcaaagtatagtcctggaggtccccataaacatgaggttccccccttttccaactacatgtctgtgtgaggccagattttcttcgtgtacttcaatcaaaacaacgtatcgcaacagactgaatgcagaagcagataagagaacccatgtgttctattgccagacattaaagagatttgtaaaacagtgaagcaatactgtttttctaacgtgttttgctttgaaaaaatacttgttataaaaatattaacatgcaacagagtttattattattataaataaacacatttttatgtctcacatttaatctctaatatgacaagtatcaataaataggtcccacataaacaaaagctctttagaatcttcagggtttttttgttagttttttgtttttgagacagggtcttggtagctcaccgctgcctccaactcctgggcttaggcaatcttcccacctcagccacctgagtagccggcactacaggcatgtgtcaccacacctggctaatctttttaattgtttgtaaagatggggtctcactattttgccgagactggtctcaaactcctggcctcaagtgatccttccccctcagcctcctaaagtgctgtgattccagccaggagccatgcacccagcctaagtcttcagtttttaagagtgaaaaaaagagagagatcaaagtttaattatgtcagttaatttctcctgcaagagattggtttaggaatgaggcagcaatagtaattttgggaaatgatgagaagttgtcttttgggggatttctgggaagtttttcttttctcttttaaaaaaaaaaaaaaaaaaaaagattcgtggccaagcctggtggcttacgcctgtaatcccagcactttgggaggctgaggtgagcagatcacgaggtcaggagatcaagaccatcctggctaacagggtgaaatgctgctctactaaaaatacaaaaaaaaaaaaaaaaaattagcggggcatggtggcaggcacctgtaatcccagctactcaggaggctgaggcaggagaattgcttgaacccaggaggcagaggttgcagtgagccgagattgtgccactgcactccagcctggacgacagagcaagactccatctccaaaaaaaaaaaaaaaattgtgagaagaaactctactacctctgtttagggctgtgtttagagatactgcctaaagctgcagcagttctctctgaccaaagggcagtcggctgcaagacgaagccaacacggtgagaatggcaggacctgggtctctgatgacatcactgaaccagtgaagtagctgcccctggaactgccccatctcaggtctcttgtttatgagaaaattaatattctttattgtttaaggcactgttagtacggtttctgatacttgtaccagaaaacattcagtatttttggttggttgttgtttaccaaatgttaaagagttagaaatcaaaccaacagatttaagcacagaaagttaaatcctgtttgtgttttgttcatttctaaatcccagttgcctttatctgcatgctgtgaatattgatgaaaacctcatggctcatcaactcagacttttcacactgtcaagatcctttcatgagctgaattatttccattcttttccagcaatactctgggtgaaggattatagccagagcagcacaaatatatcaccaacccctgcgaaaaaaattagggcacacattctaatgacggcaagggagtagcgctactccctgcaaggacagagacacctgtattttaaggccattcaaaaggtgaagaagggaatcaagggagtcaactagccttataccctcactttacagataaggaaactgaggccagaaaggccttgctatatgcccagtcaatcccagcaagaaggatgcctgcagaccaactccattaatcatttatcttgtcagcactgcaggaccacaagcatgggtttaatcaagaatgagacttagattccagtttctcaagcaattaagagagggtaaatattagtaagtaaaaaataacttcccctttggtatcaatcagttcaatttccaaactgtaagttagaaagagaaaaagcaggaaggagctcagtgcccagtatctaatcgcaactcacaaagtatttgttaaactaaactgactttataacaaagtaggattttctctaatccaaatcagtgttttcccagttacagttaatgaatatgcctatgatttaaaagaggcaatgatacttaatgggcactttccctctcttaggaaacttgaggctgtatttggagacctctgattgtggagctagattcggtctctttaaagaattttgctcctgagttcatacaagcttaagtgtccatacatttcatgcgttcatttatttggagtgagagtcaggaggggagaagacggtgtgaggggtaaagaaagagaaaggaaaattatgggaaaaattaaaacatagtctaatccttacttcacaaatgcacacacgcatacacagagagcaagagagagctgaaaataaagttctagaaaggatattggtcatgggtcctctgccttttggcaagggagtcttcatcactgatgccagccatcaggtacttgaggcctgtgatccaggtgcgggcctcctcggggttggaggtgatgaggtccagggactccatgtggttgccatggtagatggtgaagcagcagctggggtcgaagttcccctcagcttgtctgtggaatatttcagactgccggccctcagtcactttgtaaatggaatcaataagtactgtgaggaaaatgagatacacacagttatacagcaggcaaagatacttctttacatgcactaagaaacaagaaaagcaaaatcattttaaatattaaaaataagtatgaggctgggtgctcacgcttgtaatcctagcagtttgggaggtcgaggtggacagattgcctgagctcaggagttcgagaccagcctgggcaacatggtgaaaccccgtctctgctaaaataaaaaaaaaattggccgggcacggtggcgggtgcctgtagtcctagctactcaggaggctgaggcaggagaattgctcgaacctgggaggcggaggttgcagtgagccaagatcgtgccactgcacaacagcctgggtgacagagcaagattccatctccaaaaaaaaataaataagtaagtatgaaaaaattcactgcctgcaagttgtggtttcaggttaaatgtgaaacccaggccctgttttttcccactagaaaccttctctgcataacacttgtgctgcctgagctgtcttgacaacattctcctaaggcaataattcaggacgtgttgaaatttgtagtaaaaaaaaaatagatatgtcaattgaagcaaaaagactggtagaaaaggtggcaatgactatgtcaaatttgtagtttacatatttgtagaaaatatgcaaagacctagagtggactttggtgttttgcaacatgcataagaagatcgttagaaaactgaaaggaaaaagaatttctgacaatcaaatagctgagctacatggaactggcattcctagagaaaatgccatagggctaaggtggtgaaggcagagcagagcttggagaagtggagaggaacaagctgacacctgaggagaggcagaaacagatatagaaagataaggcccattccagggatgctgagcaggccgcttatggtggattggaaagctcaacagggagaataatgggagataaaactggaaaggtagacaatggctagattgtggagtggctggaatcacagagattagcattatttagttagcagagcaaatatgaaggtttggatcactgaagcacagggcaagaaggataatttcagactaataaattatttttggtctgtgtgcttgtttatttttcagtaggaatcagaagtttgtatatcctattgattatttatatacaccatctacccctcacttctgccttaatggcagggtcccaattttcttctggtatcaactcatttcccacatgactcacagggaaatgagcctatgctcagcccaaggttctgccacctttgtactctgggacttgcatcagtggcccccaggttctcaggccttcaaccttggacttggaattataccatcatctcccctgcttctcaggcctttggactcaaactgagctacaccaacagcttccctggttctccagcttgcagatgacctatcatgtgacttcttggccttcataatcacatgagccaattctactaagtcctctctcatacatctatgtatctatctatctatctatctatcctattgattgtgtttctctagggaaagctgactaatatagtgtgagggaaagaagctttaagtaggagtcacatcaaaatgactttacttgataaatttaaatggtgttgttaattcattaatcacttaatagtgttcagaatatgacaatacattttaaagcccattagctttataatgtccctcaccttttataggaatgtaaaacatctcaggctgtaaaaccatatattccaactaaatatatatatatatatatcatgtctccaacacaggggaagtattagcatttacagcattcatggacaagaaaacttttatggatttaaattccccaaagatggtcattattctgcctctcaatatccaaaatcaactatctccaaacttataaaagtataaaacttccacagatctgaagcttcaagagcccactcagtataacccgtgtgttactatgtccagccaagcaaagaattcaaagatttgttttactttttgccttctcactcttcctagagggtcgccatcggaggcgtgtccggtgctcatccaggtaaaagaggcggacaagccctttggttccacgtttcagcttgatcatctgtgtcccggactgcatcacactcatgcatctttcaactgcaaaagaaattagagtgtatccagctatcacacaatgcacaggcatactggtgtccaggttttagagtcaaataaaacctctgattcacctgcaaagactccaaggaccagaacaaatttggtagaggtaatctgaaaagtgagttgttaaggaattgattcaacaggcttaagtcagtaaaaagccttactaacagaaaaaaaaaaaaaaaaatctacttccaggtaaataatgcaatacttcatagggctatcttctgttctgttttttggtatgagacttaagaccatttgatacttggatttatgttcttaaagtaagttctcagacatgataagtcttgtgagtttttatagaaccaattataaaagtatcttataataatgctttaaatgcaatcaacagaaacaagattggcaaaatgctgactgttgttaaaatgggataatgattacatatgaattcatgttacatatttgtgatgtttgaaaatagctaaataaatttctgtaaatgtaatcagaaaaaaatcaagttttcacagttgaacataaaacacttgctgatgcattaaactgctaagataacccttctagaagaataacttgttgaatgaatccaggtaatatccaaatcacttatagtccaagttaaagttgtcatttaaatccactctgctttgagacaaatcttgctggatataggaatctgttatttttgcctgtttccccttgtttggtaatggtgccccaacttttcctttagaaacatcctctaccattttgtgtgcctttgatggcctgccaatcaccccagtgaaagagtagacacacctgacttaagcttggagcaaatctgactccctcccaagaacataaatcctgagcatatcattgcttgaaaacagaactgaaccattcaacaactgagatactcctagttggctactctaagatgtgacagttgtcataattcttattcttcctaagactgacaaatgatcccattttccccttgattctgcaagttatccagtacccttccaaatatttttttattatatcaaccagaaatagcttttatttcacaaagattaccaactaatatacagacttatgtataaaccattagagcactcaaaatacctagttctgagtacctaccttatcaagcagtatgctgttagaaacaacagataaaagaaacacaataaacaaacctcagcaacattagacttctgcttttttggctaaatattttatcttaactaggaaagataatctcatccaacaccttaacattgtatgcatagggtgcctattaaaggtcacttcaacataacaaatgttcacaatttactccatgaagtctttcctttcctcaaagaaatcaaggaggaactgcaaaaaattaagtatagtttcaggattcaatactacaaagaagatgaagtataggttgcgtttactcattttatctgacatatcaaattcccaaataataaaatattacttaagaaggctgggcgcggtggctcatgactgtaatcccagcactttgggaggccgaggcgggtggatcacctgaggtcaggagctcgagaccagcctggccaacatggtgaaaccccatctctactaaaaatacaaaaattagccaggcgtggtggcaggcacctgtaatctcaggtatttgggaggttaaggcaggagaattgcttgaacccgggagaaggaggttgcagtgaggtgagatcacgccattgcactccagcctgggcaacaggagcaaaactttgcctcaaaaaaaaaaaattacttaaaataaacacacaaacttgaaatgctcactttaaagcacagaacaaaagttgagattgagtttgatataaattagtatattcggccaccactgagcatcactcttttaggcaatgaaagctacatagttgaattcttgacagccacattaaccatctcacacgaggaattaaaggttcaagacaaaaccaccaaatcaaaccaaccaagccaaaattcccagaaaagcctattagaacttcactgaccactgacaatagatcatatcaataaacagatgtttatagacaaactccctgttccaggcacaagactatttcataaggtgaagcaaagaacaaggagactttgcctttgaccttaaagagtgtaaattttaagagaacaaaacatctatacaggatacttattaatggcaattcagagctgtggtgaagaatacagtctgtttccagcttggggtagaattccagatctgccacttactaactgtatgactacatacagctagtaactcatttccttatctataaaatgggaataattatctacttcctgaattgaagtaaggattgaatgagttaattcatgtaaagtactgaaaacagtagctggcacatccgaaacaccaaaaatggtagctatttgtaacagactgaatgtgtatttacgtccccaaagacctaaccctcagtgtgatagtatttggagatgggtcttttgagtggtaattagaaacagatgaggtcatgcaagtggggccccatgatctctctctctctctctctttccctctctttctctctccacccgcccccctccccatatgaagatacagcaagaaggtagccatctacctttttcaagccaggaaaagagtcctcaccaggaagtgaatctgttgggactctgatcttagacttttcagcatccagcattgtgagtaataaatgtctgttgtttaagctacccagtctatagtattttgttacagtaattcaagctaagacactgctatagttttattgttattgaaatagttaaaaataaatgcccagtcagaagtaaatacagaaatactatgggaggccaaagaaaaagagaatagagtaggctggaatggggagaaatgtagtaataagacaccatcaatgaagacttgggtataggaaagggtatgagttaagaatgatcagaagaaaagagaaaagatgagcctctatctttggaagagtgactcaaaagggaattgacagaatgtatgattccatgagctagataaaaccaggttgtggggggactggggatgctggttaagactttgatccaccagcaatgagaggctcactagatatatctgttcaaaggattggctggctaaaaaatataatttaggaagatgtttccttgagaagagagaataaaacaaattgtttaagccagagtggaaaaccgagttaactatattatcagagatctaacagcaaggactgcctatgtatctgacacaggaaaacaaattgtttacgccagagtggaaaactgagttaactatactatcagagatctaacagcaaggactgcctatgtatctgacacagggtcctctgttttgttcacaatccctttctttcctttctcagctccttttcctttccctgaaatggaactgccatggctataacagctcaacattttaacaggaacggtatatctgcacattgttttagcataaaatcatataaatcatataatatgatttctatgagaccctgagtctgaaacaataggcttcttaaattgtttatgtagctgctttatgctttctacctgattgctccctatcacacagaaaagccatttggatagaggtaaattgaaaaatcaagtccactgaaatcttgagagtcatctaacttacttttccctttcccaaacaagatagttgacaatgccttgtaattacaaagctaaccagagataactggttagcaccctcaataactctttgcaactcattccagtgggcaaaagtcaccaacaatacatacaaaatattcttccagtctcatctagatcatttacgtgtcagcacaagccactttcttcctattctgcctccaacagaaatgattaacagcagttaccacccctaaaaatcattgtccacccatgctctattggtagattccataaaagagaataagaatggctttgccacaggtaaacaagggaagagttctagtggcttagaatgatttaacttcatcacacacatttccagtattgaaggttctctgagaaaagtctgcaaatgcaggttacaaattctggcagctgccaatatgttcaccatccctttaattctacattctcctttatggtacgcttaagatagctaaaaaaaaaaaaaaaaaagtttatttggatacaatgcagcaacatctaccagcccatcacacagcacaaatattgtttgtatctgttatgctctagaccttcacacttgtataaaaatgtgttgcactggttgaaattgtgatatttaagccatttggcactctgcttctttcatttgtattataacagctttccatgtttctacagagtcttaataattatcattttaatggctgcctaacagagtagcataaatatttaaagagcagaacagatgagtcgaagactatattcctaactttattacatagctagagttttaaaactcttaatagagtcccatcgataaaagaaaaggcataataatgtggtctacaaggtctttttttttagacggagtctcgctctgtagcccaggctggagtgcagtggcgtgatctcggctcactgcaagctccgcctcccgggttcacgccattctcctgcctcagcctcccgagtagctgggactacaggcacacgccaccacgcccggccaattttttttgtattttttagtagagacagggtttcaccgtgttagccagtatggtcttgacctcctgacctcgtgatccacccgccttggcctcccaaagtgctgggattacaggcgtgagccaccgcacctggcctacagggtattaaataattcaattttttaaaataattaaagtcaatcctttctgccacaagcagtttaatataagtaaatttccttaggggctataaggtcactaaatccctcaagcagaaaatgttgtaaaaaatacatactttggatttgaagtaacatattaatatcatttatgttatatatgtgtatatcacttggcaatatacatatataatacatatatacatatatatgattagtatatgtcatttggatatatatacacatatatgattactatatatcatttggaggaaggttcccaagatttcaaccaagtatgtatgacatctaagaaggtttaattcttccaattatgtttgaatcagaaataatcacattctgttaggaatgtcatacatgccacctgatgctgatttttttttacagttttactgaggtgtcattgatatgcagtaaaattcaactgttttaaatgtacaattcactgacttcagtttatttacagagttgtgtgacagtctaatcacacaacatttccattatccctcatgcccatttgcagtcactccccattttcaccacagtcctggacaaccactgacctactttctatctcaataaatgggcccttcctggatagttcatgtaaataaaatcatataatatgcagtcttttgtgcttggcctttcactaagcataatgtttttgagttttctatgatgactatgttgtttcttatcttttccttcctccagccccgccacatcatgctaaactcttccactggcacttcgggtaaaaattaccctgaataggagacaggttgagtaaaataaacaatggagtactatgtaagtgtaaaagataatgaggaagatctctatgaactgatatggagtaacttccaggaggtttcaataagacaaagtatgaataggtaaatatagtatgatatcttttgtgtaagaaaagaatgggaaatgttttaaatatacaaatacctgcttatcattacaaaaacgaacccaagaaggataaatcagataacaatggccctgttacctataagaatgacagaaaatcgagtagaaaggataagaaagggaatgacactactcttagtatcccacatacttaaatcagtaagagtaggaaggggaacaaaacagaaagtaacacagtcctgcacctcttaagggtgaggatacattctgagaaatgtgtcattaggggagtttgtcattgtgtgaacatcatagtgtattcacacagacctagattgcatagcctattgcacgtctaggctgtatggtataacctactgctcctaggctacaaacctgtacaacatgctactgtactgaatactataggcaattgtaacataatggtaaatatttgtgtatctaaacacagaaaaggtacaataaaaatatggtattataatctcacaggaaccactgtcatatatgtggtccattatttactgaaatgtcagtatgtggcacatgactataaatatataaacagaaagcaatctacacacacacacatatatacatatttgtgcatgtatatttgcatgtttgtgtatatgtgtatgtttttatatacctgcatatatttccttgttctagcctttgaaaggaccaacaggcaaaatcacttctagcagtaatatgcacacttggtgctctgatcactctttgctacaaaagaaccttgagacagattttcacatacagaatcatgaccattcgccgagattagggtcatacaagaatatcacttgcactcttttgtgaacacatctattctgggacactgatcattgaactgtgaattagcaggcacaaaaacaacaacaacaaaaaaaaaagtccaggtcctttgcaagacaatctttttagtaaaaaggtacataaaaaatgtgaactgatttcctgccagcttccacagattagagtaaatctgagtaattgaaagagattagcttctgaaaacaatttcatttctatgtggaaaaagtgcaaaatgatgcaggtaatgtttgtcaaaaagtaaggaaagggagatttcctaaaaccatcagggcagaagtaaagggtatgtttgtttaattctcagcacaaacccaacacctattttgggacttggtacatagcaggtgctgagagatctagtttatggcatggcagcttgataacagcatctgcccacagttttgtgggcacaaagaagggagcaaacagagttctggtctgggctctgtcactggctgtgtgaacttcagaaggtaactgaatatcctactttcctcaacctaaaaaggcatttttctctatgttctgtgagtttataaaacagctgatctagcttccataaatgttattttatctttcaatgagaaaaaattccagttcttctgaaagctttttagaataattttaaagaaagaaactgattaacatctgggtgtcttactacagacatgatttttttttaatgatctctatataaaacataactgcttggctgtgtgtggtggctgacacctgtaatcccagcactttagaaggccaaggtgagaggatcacttgtgcccacaagttcgagaccagccaggaccacatagggagacctggtctctacaaaaaatttaaaaaattaaccaggtctcgtggcacaaacctagagtcccagctactcaggaggctaagacgagaggctctcttgagcccaggaggttgaggctgcggtgagctgtgattgcaccattgcaccccagcctgggagatagagcaagaccctagactcaatcaatcaatcaataaaatattaagtgaagccattatctgtgaagagcagtgtatataaataaatatatatataaactaattattatagtttattcatataaaactgctcttcacagcaaatggcttcacttaaaaagctattccttgccagtagtaaagccttaaagtcaaataatacaagcttatgaataaatgtgcttacaaacaaccatggagtgattcactcttactaagtcatgattcttcccagtaaagaacaaacaatgtagagtttgttaattttttttcattgcctaaatcattcctgtggagaagacaagattatttaaaaggcttttaaaaactaattggttaacagtttgaaaattgtttgcgaacgttgcatgtacatagtcaatatgtttataaacttgataaatacaaatgaggagaattcggtcaaagaaagggtgaaaggaattcatcagtagtttgttaaatgtcagacctttttctatttgtattaaacccttccacataacactttcttttttaatgatgtctattttatgtgtaacaattgtgtctgttccatgttttccatactcatggaaaacaaaaggaaatactaaaaattcataacaatatagtggcaagtagggtcaccagagccactcagagaaaggagaccctaaactctggccagcgaaaggtaagaatttcctgctagccgggcttctggccattctctgtgcaaactggttaagagaatgataaaaatcactgtttgcctcctctgcaaggttttaattaatgagaaaaaggattagtgtgacaagtcttagattgtagcgaatctggtgtactttgtgctctgaatttgtctctctttgccattctgtcatggacggcattccactggataaaacgcaggtctaggtctcccgccattcaagttggcccagcagactggtcagttataaactttgctttgggtccctgaaacaaaaactgaatgaggtttccctcttgttttatgtcctggggagcatgaccctgtgaccctgtagaggtactctctctttgtctccaccacgtggagggtgggaattttcaggttcacatcggtgactagtctgaaaggagtcaacacactcttagtccaaatgtgtcaagcccttgggtgagttttgtcttaaaaggtctcatgctaccataagcccatttctgagagtaaattcttggggatcatggaaatgcctactctaccccctctctagaaatatttcttgcttgtatgattttaaaaaataaaaaaataaaaatctgaaaaattaccatttgactttaaagaacttttggattgagttgctattagaactaagtacactattaaaacaaaaaggactttagcaatctcttattctcaataattttttaaaggtttaaattaaaagaaggatgcattataatgtcatcattagccttaaaaatcatcttaagcagttaaaatccttttcaagcccgaaaatgcctgctctaggctccttctgggaaaaataatggcaattgccccatgctacagctcggtagcaaaggctttgcccttttgcaatggcagcccgagttcaactgctggcttagagaatgagttctttctggtctgttgtttgtgtgacctttgccatttattgattttttttctctccatgaacaacttctaacttcctgtgttgaattttcccttctctgagctacctttggggtgattctagatcttgtaaaaacaactcgccctccctttggagacacctcatgtatctgtggctaagtcataacctaagttaaggcttactggtttcacttgggaaaatatcttcgtgggagggaaaaaaaaaagaaggcttaaaagccaagggtgtcagctatttgtcccagctctagctggtaaaaagagattttaaagaatttttttttaagaaaaaagagctctagaattaaaagtcagcttaattaaaaacagatatcaaagctatacgtatattcaaaagggctttatgcttttttttcttcttgaatcttgttttttgaggaaaaaaagttttcttctcagtccattgaattgtttctccatttacttcttcttgctacccttgatgcccacaagtgaggacctaaggtaatttctgacagcctgggactccttaggaaaaacagaggaggagaccccgttttaggaaaaaactctgttttcctcatggaaccccaagaactgtaaatggacagatctgctcaaaatctaagacttcgctctgttttgcattgcatcacttgatcttttttactttggggagcatcaaaaataactccacattatgaggaaactttcagccttggtgtgtaatagctaggtaagaaatatacttttagagatatagtttatgcttggtatataattagctacgtaggaaatatacttttactattgctctgtagtagtaaccattcactctaagtggcagttgcttatagtgaatggttattaccacaggaaaatactcctttctttgcacatttagataagaaaaacatgctcttgggcatgaagaaggtattgaatgggggaataggctgataatagagtcagctgattgccattgggttgcccaccagccttggaaaaatgcctttgcaacaagatacactgtggaagcactgtaatgcctcatccagttgagttcccaacttttagagaacctaggattcaatatataaatgggatctttaatccctggtgatctgttttaccttccagttgtgcctgcttattatgccctagaaactgacttcttcctcaccctgttccttaaaaggcttcaccctaaagccaataatacaatttaaaaatttacatctttaaagaaatctccatgtgtaacagtgtctgcttttcctggacaaaatggtgtgaactttaagtcacaccattttttcttggtttaaataaaatgtaaatcctctatcttgtttgatctaagagttgccctcttaaaaatgcaaatttagagttgcccagctgaccactgtttagggcaggaagcaagtaatcaagagactgatggtctaaaatgcgaaagagaaacttaaaaactggcaaataaaaaatgtattactctaacagatctacttctgtttgtctgtgtatttatatgcgttgcctgtatgatatttatataaaagagccctaataaattggcttaaagaaaaataagtacttaaataatatattttgtcaaaaaaataaaaaaacatgaatgcattttagtttttttattatagtaatctttggtaaataaatacaatgtttatttgtttttttttcttttgagacagcttgtcacccaggctggagtgcactggtgtgatcacggctcactgcagcctcaacctccctgggctcagatgatccttccaccttagccttctgagtgctgggagtagaggtgcatgccaccacacctggctaatttttgtattttttcataaaaacagggtttcaccatgttggccaggctggtctcaaactcctgggctcaagcgatctgcctgcctcagcctcccagagtgctaggattacaggcataagcctctgttttatttaaagattattaataaaaatatcttcaaaatataggcatttgggaagaaaaatggcagagagaagtcaggactaagatgcagctaccatttggatggacaggacagagtatggagactcacactgtgaaattctgctccaagaaccactgcaggaatgtgccaggaagagaaagagttcacagatcctgtggaagaaacagctcactctgtaaattccacgagacagcaaaaaaactgagttcccaaagtataagaggagaaaaccttcctttgaacttgaaaactttcaggttcccctggggaacctgaaaatccagattataggagaaggaattaaccttacctagagctgaaatggatttagggagccaagtgaaatattaaagtagaagaagcagcaggaacagccctgtaggcactcccagtcaccagctccaggctagggaagccattcttgactttatctaacaggggtccttggggaagggatcccacaggactagggagggggtcacaaggtgaaagaagcttctagctgaactttataataatttcgactgagcatgaactttcttgagcagaatctggagggacaaacagaaattgctgcaggagccatggctgacagtgtgagcaggcagggaggggtgaggcctgaaagctgtgcttgccttctcaacaaggaggcttgaagcctggggcaaggtctgagcctggtgcatagactgcctgcatataaactgcacgaagctgcatgggagctgagtgaggcctgtcactgctagtttccccccacttccctagaaaccagctcactagcttcatggaagctgtgtgaggcccgtcactgccagctttcccccacttctctggaaacctgtatgcgcagtgaggcagccgtaattactcttggaacataattccatcggccatcccacacagcagcctcagcaactcccacccaaggagagtctgagctcagacccgcctgatcctgcccccatcggatggtatttctgtgcctgcccaggtagctgaacacaaaagacataaagtcttggaaactttatggccctgcccatcgcctgagaaaccagaatatttatcctggccaacttagagcaagcttatatcctctttctactacagcagctcgtgctctcttgaaagtgccacctcctgactggaggtcaaccaactcaagcaattacagcaactcaagacagaataactctgctcccaggaaagggaaaacaatagcaaattccatctcatgcaacatactggctaaccagaggtcctgagtatgtccacatgacaatttcactgccaccaaaaccagcattcaagaaaatcagtgcactaaacaaaactacaagcaacaaatctcacagagtctacttcattcccttgccacctccaccaaagcagggctggtatccacagctaggagacatgaagatgcctgacatcacaggactcttcgcagactttccccagcaccagcccagagcctgatgccccactgggtggctagacccagaagagcaataagaatcactgcagttcaactctcaggaagccccatccctggaggaagcaggagaacaccacatcaagcaatcgccccatgggaaaaaagaatctggacagcagcccttgaatcgcagatctttccaatgaaatagtctacccaaaggagaaagaaccaaaaaagtaattctggtactatgacaaaaaaagattctatagtaccctcaaaagatcacactagttcccagcaatggatccaaaccaagaacaaatctgtgaattgccagaaaaaaagaattcataaggtaggtctattattaagctactcaagaagataccagagaaaggtgaaaaacaaagaaattaagaaaataataaaggatatgaatgaaaaatttgccagacaaatatatataataaagtaaaaacaaacacaacttctggaaatgaaagacacttagagaaatacaaaatacaccagaaagtttcaacaatagactagaacaagtagaagaaaaaacttcagagctcaaagacaagggttttaaattaacacaatctgacaaagataaggaaaaaagaattttaaaaaagaacaaagcttccaagtaatttggaattatgttaaatgactaaccctaagaataattggtattcctgagcaagaagataaatctaaaagtttgaaaaacatatttgagggaacaatcatggaaaacttccctggcctcactagagagctagacatccaaatataagaagctcaaagaacacccaggaaattaactgcaaaaagaccatcaccactgggtgcggtggatcacagctataatcccagcactttagaaggccaaggcgggcggatcacctgaggtcaggagattgagaccatcctggctaacatggtgaaaccccatttctaataaaaatacaaaaaattggccgggcatggttgcacatgcctataatcccagctactcaggagactgaggcaggagaatcgcttgaacctgggaggcagaggttgcggtgagccaagattgtgccattgcactccagcctgggcaacaagagcaaaactgcgtctggagaaaaaaaaaaaaaaaaaaaaaaaaaccatcacctaggcacattgtcaacagattatctaaagcaaaggtgaagaaaagaatcttaagagctgtgaggaaaaaccgtcaggtaacgtgcaaaggaaaacctatcagattaacagaagatttctcagcagaaaccctataagctagtagaaactgggaccctatctttggcctcctcaaacaagataattatcagccaagaatattgtaatccagcaaaactaagatccataaatgaaggggaaataaagtctttttcaaacaaatgctgacagaattcaccactaccacaccagcactacaagaactgctaaaaggagctctaaaacttgaaacaaaacctcaaaatacaccaaaacagaagctccttaaagcataactctcacagggcctacaaaaaaaacaacacaattaaaaaaaaacacaaggaattcagaaaactagcatgatgaatataacagtacatcactttcaatactaatgttgaatataaatggcctaaatgctccacttgaaagatacaggatggcagaatgaataaaaatccaccaaccaagtatctgctggttttaagagacttacttaacacataaggacacatgtaaacttaaggtagaggggtagaaaaaggtattccatgcaaatgaacaccaaaagcatgcagaagtagctattcttatatcagacaaaacaaactttaaagcaaaaacagtttaaaaagacaaagagggccaggcacggctcacacctgtaatcccagcactttgggaggcagatcacctgaggtcaggagttcaagactagcctggataacatggcaaaccccctctctattaaaaatacaaaaattagccaggcatcgtggtggagtcctgtaatcccagctactcaggaggctgaggcagggagaattgcttgaacctgggaggcggaggttgcagtgagccgagatcaggccactgcgctccagcctgggtgacagagcaagactccgtctcaaaaaaataaataaatacaaataaaaaaacaaaaaggaatgttaaataatgataaaaggattagtccaacagaaaaatatcacaatcctaaatatatatcttcctaaaactgtagctctcaaatttattaaacaattactactagacttaagaaactgatgaacaacaacacaataatactgtgggacttcaatcctccactgacagcactagacaggtcatcaagacagaaagtcaacaaaaaaacaatggacttaaactacaccctagaacaaatggaacagatatttacagaacatcttacccaacaactgcaaaatatgcatttttttcttcagcacatggaacattctccaagacagattatatgataggtcatgaaaaaagtctcaacaaatttaacaaaataaaaattataccatgtatcctttaaaccacaatggaataaaattggaaattaactccaaaagaaacgctcaaaactatacaaatacatagaaattaaataatctgctccagaatgaattttgagtcaacaataaaatccaggtggaaatttaaaaattatttgaactgaacaataggagtgacacaacctatcaaaactgctgagatacagtaaaagcagtgttaagaggaaactttggccaggcatggtggctcatgcctgtaatcccagtactttgggatgctgaggcgggcagatcacctgaggtcaagagttcatgaacagcctggccaatgtggtgaaacttcgtctctactaaaaaataaaataaaataaaataaattagccaggcatagtggcaggtgcctgtaatcccagccactcgggaggctgaggcaaaagaatcacttaaacctgggaggtggaagttgcagtgagccaagatcgtgccattgcattccagcctaggcaacaagagtgaaactctgtctcaaaaaaaaaaaaaaaagaagaggaaacttcatagcattaaatgcctatatcaaaaagtctgaaagaggacaaaaagacaatctaaggtcacacctcaaggaacttgagaaacaagaacaaactaaacccaaacccagcagaagaaaagaaaaagaaataaccaagatcagagcagaactaaatgaaactaaaactaacaaacaacaaaaaaaaaagataaatgaacaaaaagctggttctttgaaatgataaacaaaattgatagaccattatcaagattaaccaagaaaaaaagagagggctgggcttggtggctcatgcctataatcccagtacttcgggaggccgaggcaggcagatcacctgaggttgggagttcgagatcagtgactaacatggagcaaacccgtctctactaaaaatacaaaattagccgggcgtggtggtgcatgcctgtaatcccagctacttggagggctgagacaggagaatcgcttgaacctgggaggcagaggttgcagtgagccaagattgtgccattgcactctggcctgggcaacaagagtgaaactgtgtattaaaaaaaaaaaaaaaaagaaaagatccaaataagctcaattagaaacaaaacgagagatattacaatcaataatacagaaatacaaaagatcattcaaggttcccatgaacaacttaacacacacaagctagaaaacctagaggagatggataagtttctagaaatatacaaccctcctagattaaacaagaaagaaatggaaactctgaacagaccaataacaagcagtgagaatgaaacagtaatttaaaaattgccagcaaaaaaatgtccaggaccagatggattcacagctgaattctatcagacattcaaagaagaactggtaccaatcctattgacactattccaaaagatagagaaagagggaatcctccctaaatcatgctatgaagccagtatcacccaataccaaaacaaggaaaggacataacaccaacaacaaaaaaaaacagaccaatatctctgaagaatatagatgcaaaaatcctcaacaaaatactagctaatcgaatccaacagcatatcaaaaagataatccaccatgaacaagtgggtttcataccaggaatgcaaggatactttaacacacacaagtcaataaatatgttacaccacatgaacagaactaaaaacaaaaatcatatgatcatctcaacagacacagaaaaagtgtttgacaaaatccagcatcctttatgattaaaaccctcagcaaaactgccgtagaagggacatacctcaagggaataaaacctatctatgacaaatgcacagacaacatatactgaataaggaaaacttgaaagcattcttcctgaaaactggaacgagacaaggatgaccactcccaccacttctgttcaacatagtactactgaagtcctagtcagagcaatcaaacgagaaaaaaataaagggcatccaaatccgtaaagaggaagttgaactgtcattgttcgccaacgatattttatccctagaaaaccctaaagacacacccaaaatgctcccagatctgataagttaatttggtaaagtttcagaatacaaaatcaatgtacacaaatcagtagcactgctatacaccaacaacaaccaagctgagaatcaaatcaataactcaaccccttttacaatagctgaaaataaatagaatacttaaaaatatacctaaccaaggaggtgaaagatctctacaagaaaaactacaaaacattgctgaaagaaatcatagatgacacaaacaaatggaaacacattccatgctcatggacaggtagaatcaatattgtgaaaatgaccatgctgccaaaagcaatctacaagttcaacgcaatgcccatcaaaataccatcatttttttcacagaactagaaaaaaaaatcctaaaactcatatggaaccaaaaaagagcccacataacaaaagcaagactaagtagaaagaacaaatctggaggcatcacattacccaacttcaaactatactacaaggagatagttaccaaaacagcatagtactgatataaaaacaggcacacagaccaatagaacagaatagagaactaagactaagtaaaaagaacaaatctggaggcatcacattacccaacttcaaactatactacaagactatagttaccaaaacagcatagtactggcataaaaataggcacatagaccaatggaacagaatagagaacccagaaagaaagccaaatatttacagccaactgaccttcaactaagcaaacaaaagcataaagtggagaaaggccaccctattcaacaaatagtgctgggataattggcaagccacatgtagaagaatgaaactggatcctcatttctcatcttatacaaaaatcaactcaagatggatctaagacttaaatctaagacctgaaaccataaatattctagaagataacatcagaaaaacccttccagtcattggcttaagcaaagacttcatgaccaggaacccaaaagcaaatgcaatgaaaacaaagataaatagatgggacctaactaaactaaaaagcttctgcacagcagaagaaataatcagcagagtaaatggaaaacccaaaaagtgggagaaaatcttcacaaactatgaatccaacgaaggactaatatccagaatctacaaggaattcaaacaaatcagcaagaaaaaaacaaaaaatcctatcaaaaagtgggtaaggacatgaaaaggcaatcctcaaaagaagatatacaaatggacaacaaacatatgaaaaagtgctcaacatgactaatcatcagagaaatgcaaatcaaaaccacaatgcgataccaccttactcctgcaagaattgccataatcaaaaaatcaaaaaatactaagtgttggcatggatgttgtgaacagggaacagttctaccctgctggttggaatgtaaactagtacaaccactatagaaaacagtgtggagattccttaaagaacaaaaagtagatctaccagttgatccagcaatcccactactggatgtctacccagagaaatagaagtcattatatgaaaaagacacatgcatacacatgtttacagcagtacaattcacaattgcaaaaatatggaaccagcccaaatgcccatcaacgaacaagtggataaagaaaatgtaatactgtccagtcataaaaggaaatgaaataatggcattcacagcaacctgaatggagctggagaccattattctaagtgaagtaactcagaaatgaaaaaccaaacattatatgttctcacttacaagtgggagctaaactatgaggacacaaaggcataagaatgatataatggaccttggggactcagggggagggttgggatgggggtgaaggataaaagactgcacattgggtacagtgtatactgcttgggtgacagatgcaccaaaatctcagcaatcaccactaaagaacttacacatgtaaccaaaaaccacctgttccctaaatattattaaaattttaaaaattagacatttggtctaaattagacaggtaagatactactgtccttactagatgctttaaagtcataaactgcttctatggcttttgataattgttcaacttgcttgctttagagccattggattctaggtaaggcctagagacatttggagttagccatatcccctagctatgctagaaagagtccgacattatctgtggttctgccctgtatcctacactctacacctgatacataattaaaattacttacactaaaaataaaaatcatgcatttttagtagaaaggtatggaaattatagtttcttctaagagaaagtaattctgtctaatttagagggtttaagcattgttttaagatagaaaagaataaaactgaaagtttaagcaaggtgtaggaggtttgtaaaagattaatcttacaaagaaaaatttgtgtgtgagcaagacgactaaaattaaaatggcatcatttagtttttccataaattaaacattagcactgatgcagggccagaacctgagcccatgtgtcagaataacagagttctcttggagcattgatctgctctttaacagaaaattgtaaaaggttataaaaggtttattaaagtcttcttttatgattaaacttgtttaaattagatttacatataaaattttattaaaattagctttagcattactatattactgcaaagaaaaaagtttggtttacctttgatcaagatttctgcttgcctacaggaaaaggggacagagaagagacagattcagctggcctcaaactgtctttattgggtcttgttatttggaaagctgtctcctctctataaaataataaaggatttttgcttttttgaaatctttgagttaatcactttggctaaataaataaactgtggtcttaattttgtgatatcaagtgttttaaacctttgatatgtgacaaactttccaaaatcaaattctaaattagctttttttaacctgattaaccctgttagatattagttcccctagaatccaaaagaaacatattcagtttaatataattaatttaatttaaatcacatggaaaacattgtcaagtataaaatagtgcttaattttatttgggttatatccatataaatgtgttattaatatagttttcaaaattgtaattctgtcaatatattatcagtaataattattatcattatgtgccactggcataaccaaatttacttgtcaattgtgtctttaactgtgactgtcctaagacttttgtcatccacagacaattgtcctgtttgatccttttcagaggatggtttataattagctataggactctgacaggcactcttgaatgcaggcctctgataactttggtgactgggccattagaatagagaaaaaatcttccaagattctcttggagagctactatgttcaaaaatatcaagcagaaaaggagttaattgcatggactgaaccaatacaacattaaaataatctttctatgactttttgcttgaaactttgctgatcctttggtttttcagtcaagaaaacttgttttttcttttgagctatttacagcttttaacaatgaagtatactcctgtgagcaaaatttggagaatgtttctttctctctacctggtttctccagaatttggaaactatttgtgagtattcttaaattatggcaatatagtcatttgcataagtacaataagaatctgttttataggagcacagttggagacgctggttactttaccaaggctttgactgaaatggcattcttttaaatagaaacagactgctttaaggaatcagaggtgatttatagagccaataaaatcccttgaaaaaactggtcctcacataccttctctacccagtccctgtacaggagtcctaacctgtggtaagtaaagaatgccactttctaacaagcccaggagccccaagttaactttggacctccataggagaggaattcatccaattcatacaggtatttgcaggcacaaataaatccatggatgggttcaaggctttagaaggtctaatctgagactccttatggaaaaagttctaagaatgccaatttgaaagagagcttatatgacaaataattattcttgttgcattttatataactaatcaggccaaatataagactaaaacttatttttgcaaacaaattggttctaccatgatttgtcttggataaaaatgagagaatggagaaagattataatacacctattgttagattctagtcttgtctcgtttttgaggttttttttaatatgtattattttctacagtttggactgaatcttaaatcttttctggattacaagtcttcaaactaacattttcaaaatatcacccatttttctgactaaagctcaatagaattgctactacctctttcctgaggccctataggctaaaacgtatttcttacgatacaggcaagaagaaaatgtcaaacagccaccgtcctcctcttctgtaactaagacgttttgagtttaacgtctggatagactgttaaagaatggagctctccattctttaacaataaaatttctaccattaacatttgtttttcttgtttccatagaaatgcctcttactaaaagtctgtttgccttacatttcagacaacaggagattcattttccagcctatttacttaaattcccaatggtatctgatcttctttttatttttagacagggctctggctctgttgcccaggctagagggcagtggcaccatagggctcactgcagccttgacctcctgggctcaggtgatcctcccacctcagcttcctgaggagcttcctgaggggaagaagtgctgaacaattgctttacagcctttttgccacaggccagaccaccaagtggcccattacccaagataaccattgcaaccagataatgctgacctgcacaccctgtccctctttgatttgcccaactcagcctgcataccctgcccctgatatcaattcccatactttgcccaagaaaaaagccctattggctctttttggagagtcagtcagggaattttttcactctttctcatgctgcctcccttatatttgggcaaaagctccaatgaaggcttgtctgggaaaactcttttagcctcatgtcaatttctattacactgagagcccccagaacttatagttggtaacacctctataggatacttacacagtacattacacattctaaacacagagtaagtatttgttaaggttgttattgtctaattcatttcttaaagtcactgtacactttatactctatagtgtacagtacaggagtagtgtacagggcagtgtacagtacaggagtagtgtacagggcagtgtacagtacaggagtccatctacctcctttgttcaactgcattgtaaaagggagtgcctattccatactccaacaaattcatatacccccagtagctcccagttcttatacttgagccattatttccttcaccaacataaagctgattctttttcaaaacaaaaacagaaaaagtaaaaaaaaaaaaaaagaagaaaaagaaagcaaattgatttcatgcaaattgtcctaattttatccagagagttccaaatcccctgttgctttaaggctttctaaggggcaagagtcaaaacagaaaatggaagaagagatcacattttccctgaaaaacaaagccatactccctacccccatccaaagcctctgttgccctcaggcctaaagaatccaagggactaaaagcttcagagaccacctgctatgctgaagcaggcctgacaacttccaaccacagacagttggaaatcaagttgtgtggcatttaaagtaagcaccttatttctatggcagatgtttttgtcaaaaaaaaaaaatccatcctataaacaaaaatagaactctgtgtggtaaggaaaatgcctgggagaatcccctcaggtttacttttcaaaaatcatttgtcctcatccaaacctttgtcctaatatcataagcttcctttaaaaaaattaaataacataaacattgctgagtaactaagtgttcatcacagcctatttatggcattttgattggagttgttatcccaaatcagtgtactacagatttcaaaatcgtttttaaaaaatagtagaaaaatctaaatatggaagatgaaaaacactgaaaacttcttataatcaaagtatgcatagataataagagcagatgtgttacaacattttctaaatagtcaatcccaaaaaagaaaaaaaggccagcattaaactataaccctctgcataaaagatttattaagtctgaattcagaaatagttacacatactaacgtatgcacgtacatctgccacacacttcctgagcagcaccaggtagaccatacaacaagaataagcaaggctgagattaccctatgattggtgtggtttttcaagtaaagcatgggaagtgtacaataattgacaaggaacaggaaaaaatgtcatggagaacaaggtagtgtcagggatggattgaaagagaagagtaaaaattgtatcacacaatggtggcagggacatgaagacacaactgaaagcaaaacttttgagggtaaagaagacagccatcaagaaagaaccaaagtaagaaagagctgcaaccgtggggaaagtgggagttgtataagaaagatgatgacccaccgcagctcagcaaggccactgcggccagactgcctctccagattcctcctctctgggcaggccatctctgaaaaaaaggcagtagccccagtcagggacttacagataaaagccccatctccctgggacagagcacctgggggaaggggcagctgtgggcgcagcttcagcagacttaaacgtccctacctgacagccctgaagagagcagcagatctcccagcacagtgtttgaactctgataagggacagactgcctcctcaagtgggtccctgacccccatgtatcctgactggaagacacctcccagtaggggctgacagacaactcatacaggatagccctggctcgcatctggcgggtgcccctctgggacaaagcttccagaggaaggaacaggctgcaatctttgctgttctgcagcctccactggtgatacccaggcaacagggtctggagtggacctccagcaaactccagcagacctgcagcagaggggcctgactgttagaaggaaaactaacaaacagaaaggaatagtatgaacatcaacaaaaaggacatccactcagagaccccatccgaaggtcactaacatcaaagactaaaggtagataaatacatgaacagggggagaaaccagcgcaaaacgactgaaaattccaaaaaccaaaatgcctcttctccaaaggatcacaactcctcaccagcaagggaacaaaactggatggagaatgagtttgacgaattgacagaagtaggcttcagaaggtgagtaataacaaacccctccaagctaaaggagcatgttctaaatcaatgcaaggaagctaagaaccttgaaaaaaggttagacgaattgctaactagaataatcagtttaaagaagaacacaaattacctgattgagctgaaaaacacagcacaagaacttcgtgaagcatacacaagtatcaatagccgaatcgataaagcagaagaaaggatatcagagattgaagatcaactcaatgaaataaagcaagaagacaagattagagaaaaaagagtgaaaagaaacaaacaaagcctccaagaaatacgggactatgtaaaaagaccaaatctatgtttgattggtgtatctgaaagtgacggggagaatggaaccaagttggaaaacaatcctcaggatattatccaggagaacctccccaaactagcaagacaggccagcattcaaattcaggaaatacagagaacaccacaaagataatcctcaagaagaacaacccaaagacacataatcgtcagattcaccaaggttgaaatgaagcaaaaaatgttaagggcagccagagagaaaagtcaggttacccacaaagggaagcccatcagactgacagcagatctctctgcagaaaccctacaagacagaacagagtgggggccaatattcaacattcctaaaaaaagaattttcaatccagaatttccaatccagccaaactaagcttcataagcaaaagagaaataaaatcctttacagacaagcaaatgctgagagattttgtcaccaccaggcctgtcttacaagagctcctgaaggaaacactagacatggaaaagaacaaccagtaccagccactgcaaaaacataccacatggtaaacaccatcaacactattaagaaactgcatcaactaacgggcaaaataaacagctagcattatgatgacaggatcaaattcacacataacaatattaaccttaaatgtaaatgggctaaatgcccccagttaaagacacagactggcaaattggatactgagtcaagacccattggtgtgctgtattcaggagacccatctcacatgcaaaagacacacataggctcaaaataaagaaatggaggaatattttccaagcaaatggaaagcaaaaaaaaaaaagcaggggttgcaatcctagtcttcaataaaacagactttaaaccaacaaagatcaaaagagacaagggcattacataatggtaaagggatcaatgcaacaagaagagctatctatcctaaatatatatgcactcaacacaggagcactcagattcataaagcaagttcttatagacctacaaagagacttacactcccacagaataacagtgggagactttaacacctcactgtcaatattagacagatcaatgacacagaaaataaacaagtgtatccagggcgtgaactcagctctggaaccagcagacctaatagacatctacagaactctccaccccaaatcgacagaatatatattcttctcaggaacacatcgcacttattctaaaattgaccatataattggaagtaaaacactcttcagcaaatgcaaaagaacagaaatcaaaacaaacagtctctcagaccacagtgcaatcaaattagaactcaggattaagaaactccctcaaaaccacacaactacatggaaactgaatcctgaatgactactgggtaaataacaaaattaagggaaaaataaatatgttctttgaaaccaatgagaacaaagacaaaacataccagaatctctgggacacatttaaagcagtgtgtagagggaaatttacagcatgaaatgcctacaagagaaagcaagaaagatctaaaatcgataccctaacatcacaattaaaagaactagagaagcaagagcaaacaaattcaaaagctagcagaagacaagaaataactaagattagagcagaactgaaggagatagagacatgaaaaacccttcaaaaaaaaccaatgaatccaggagctggttttttgaaaagatgaacacaatagatagaccactagccagactaataaagaagaaaagaaagaagaatcaaatagacgtaataaaaaatgataaaggggagatcaccaacaatcccacagaaatacaaactacatcagagaatactatgaacacctctatgcaaataaactagaaaatctagaagaaatggataaattccaggacacatacaccctcacaagactaaaccaggaagaaggcgattccctgaatagaccactaacaagttctgaaattgaggcagtaattaatagcctaaaaatatccgaggaccagacagattcacagtcgaattctaccagaggtacaaagaggagctggtaccattccttctgaaactattccaaacaatagaaaaagagcgaatcctccctaactcattttacgaggccagcattatcctgataccaaaacctggcagagacacaacaaaaaaagaaaatttcaggcccatatccctgatgaacattgatgcgaacaccttcaataaaatactggcaaaccgaatccaacagcacatcaaaaagcttatccactacaatcaagacagcttcatccctgggatgcaaggctggttcaacatacgcaaatcaataaatgtaatccatcacataaacagaaccaatgacaaaaacgacatgattatctcaacagatgcagaaaaggcctttgacaaaattcaacagcacttcatgctaaaaactctcaataaactaggtattgatgggacgtagctcaaaataataagagctacttatgacaaacccacagctaatatcatactgaatgggcaaaaactggaagcattccctttgaaaaccagcaaaagacaaggatgccctctctcaccactcctattcaacatagtattggaagttctggccagggcaatcaggcaggagaaagaaataaagggtatcaattaggaaaagagggagtcaaattgtctctgtttgcagatgacatgattatatatttagaaaaccccattgtctcagcccaaaatctccttaagctgataaacaacttcagcaaagtctcaggatacaaaatcaatgtgcaaaaatcacaagcattcctatacacgaataacagagagccaaaccatgagtgaactcccattcacaattgctacaaggagaataaaatacctagaaatacaacttacaagggatgtgaaggacctcttcaaggagaactacaaaccaccgctcaaggaaataagacaggatacaaacaaatggaaaaacattccatgctcacggataggaagaatcaatatcgtgaaaatggccatactgcccaaagtaatttatagattcaatgctctccccatcaagctaccactgactttcttcacagaattggaaaaaaactaccttaaatttcatatggaacaacaaaagagcctgcatagctaagacaatcctaaaaaaaagaacaaagctggaggcatcatggtacctgacttcaaactatactgcaagcctacagtaaccaaaacaacatggtactggtaccaaaacagatatatagaccaatggaacagaatagagacctcagaaataacaccgcatatctacaaccatctgatctttgacaaacctgacaaaaacaaacaatggggaaaggattccttatttaataagtggtgttgggaaaattggctagccataagcagaatgctgaaattggatccctaccttacattttatacaaaaattaactcaagatggattaaagacttaaacgtaagatctaaaaccataaaaacgctagaaaaaaacctaggcaataacatccaggacataggcatgggcaaagacttcatgactaaaacaccaaaagcaatgacaacaaaagccaaaattgacaaatgagatctaattaaacaaaagagcttctacacagcaaaagaaactatcatcagaatgaacaagcaacctaaagaatgagagaaaatttttgcaacctatccatctgacaaagaatctacaaagaatttaaacaaatttacaagaaaaaaacaaccccatcaaaaagtgggcaaaggatattaacagacacttctcaaaagaagacatttatgcagccaaaaagcatgaaaaaaagctcatcatcactggtcattagagaaatgcaaatcaagaccacaatgggataccatctcatgccagttagaatggcgatcattaaaaaacagatcaggaaacaacagatgctggagaggatgtggagaaataggaatgcttttacactgttggtgggagtgtaaattggttcaaccattgtggaagacagtgtggtgattcctcaaggatctagaactagaaataccatttgacccagcaattccattactgggtatatacccaaaggattataaatcattctactatagatacatgaacatgtatgcttactgtggcacttttcacaatagcaaagacttggaaccaacccaaatgcccatcagtgatagactggataaagaaaatgtggcacatatacagcatggaatactatgcagccataaaaaggatgagttcatgttgtttgcagggacatggatgaagctggaaaccatcattctcagcaaactaacacaggaacagaaaaccaaacactgcatgttctcattcgtaagtgggagctgaacaatgagaacacatggacacagtggggtgggggcatcacaaaaaaaaaaaagaaagatgattaatatctgacagccacctcagaagcccccaatgtcagaaacacaggacactggaagggtgtctcattgacactggtaggtcaatgaaataagacacatatttcaatttcaatcactatagtctatacaattttaaacacataagtactgccatataactaactcggtcctcctagaagccattccagagtagaatttcacacttcctctaatgtgggaaaagacagaaatcctaacggaaaaagatggtaagtggctgggcgctgtggctcatgcctgtaaccccagccctttgggaggccaaggcgggtggttcacgaggtcaggagatcgagaccatcctggctaaaacggtgagaccccatctctactaaaaatacaaaaaattagccgggcgtggtggtgggcgcctgtagtcccagctactcaggaggctgaagcaggagaatggcatgaacccgggaggcagagcttgcagtgagccgagatcgtgccactgcactccagcctgggccacagagcgagactccgtctcaaaaaaaaaaaaaaaaaaaaaaaaaaaaaaaggaaaaagatgataagtttaactacttgcaaaaatatctatataaaccattcaaaacaataggctaggagaacatatctacaagaatatctaataaataaaggtttaatatcccattacataaagggttcctgcaagtcaataaaaaagacaatccaattaaaaaacagccaaaaggaaatgaaaagacaattcacagaagtaaccaataaacatgaggaagaaaatacccttactcatggttaaaaacttaaaagtcaaagtaaataatgtcacatgatatgcaaaatttttcatgttaaaaagccattgtggatgaagttaggaggctaataccaagattatgaattagcgacgttatttgaatcaacttggcaatatctatctaaatttaaaacaaacatgcattttgaccttgcaagcataataccaaggatttgtcctgcagagatactgacataatgaagcaaagatatccacacagttaattacagatacatagctgttcactgccaccctgtttgtaatggtttaaaaacaaattgaagtaggccaggtgtggtggctcatgcctgtaatcccagcactttgggaggccgaggcaggccgatcacgaggttaggagatcgagaccatcctggctaacatggtgaaaccccgtctctaccaaaaatacaaaaaaaaaattagcccggcgtggtggcgggtgcctgtagtaccaactacttgggaggctgaggtgggagaatggcatgaatccgggaggcagagcttgcagtgagccgagattgtgccactgcacttcagattggacgacagagcaagactccacctcaaaaaaaaaaaaacaaattgaaaaaaatctaaatgtccatggggctcaattaaataaatggtgggttaaccatatattatgatgtgattaaaaagaatatcataaatctaattttgccaaaaaaagttatcggagattttttttttttttttgagacagaatctcactccatcgcccaggctggagtgcagtggcacaatcttggctcactgcaacctccacctcctgagttcaagtgattctcttgcctcagcctccacagtagctgggattacaggcacccaccaccacgcctggctaattttgtaattttagcagaggcagggtttcgccatgttggccaggttgatctcgaactcctgacctcaagtgatccacccccttcgggctcccaaaatgctgggattacaggtgtgagccaccactcccgggcttaagacacatttttatgtgaacaaaaaagttacaaaactacagatagaacatgattctatttgagttatttcatgtatatacataaatatacactatataaaaaggggttcagggatacaccaccccaaagtatggcacattgacctttgaggaaatatcagaagcaggaatgactctctgacctctcccacccttctcccctgaagcaggtcataaaagaattacctgaccttcctgtaacataggatgtaagactttcattccaaaagtgccttccctatgcccaggaaaaaaaaaaaaaaaaaaaaatccttatcctcgaagacacagagacaccaagaggaatctgagcaaacaagccttgctaagttcccctcagcttaccaatatttgatcatatccttttgccatcccatcattcttctgcccaactgtacataaaaatacacaggtttccccatgctttggatcttcacctctctttttttttttttttttgagttgggggaggggcttcttcattcttaaggctcctgtgtcacataaaacttacattaaataaatttgtatgcttttctcttgttaatttgtattttgttataggagtctcagctatgaacttagtggtgggtaaggaaagatatcttttctcttctacaataggcttggaaatttctagaatttgtggaaaggaaatggtatttaaagagaaagggatgagagtaaatcccaccttaaaaccttgttgaggcgttttcttgtctttgccatgagcaaatattgttttgaaagttttaaaacatatatatgggagatgttatattcactttaaaattccatataatttgcaagagctatcaaaataaaataattgtcattgcaactctgccaactgcaagcccaataaagcaaaagaacactgaacaacctggatttaaatcctggagtcacttctcagtcacattaccttcttttctacttacttagttaactctgagccagtttcttcacattttaagagaatcgtggtgaagattaaatgaaataacatgtaaagagtgtcttgctcaattttgcatacacattaggctttcaacaaatactagtttctttccattttttctgaatgacatcagagctcagaaaatgcagcggctcaaagtagtggcagattctcagttatctgaaattctacagcaggacaataaaactgcttccaaatgttgaaggaatttgcgtttctacaccatcctaagcaatgtggcctaatcccatggcattaattccaatccacacacagataactccaaatgtaaatctcaagccccatcctttgccttcagttccagacttgctcgtataactgctgaagatgacaagcattaataagatcttaaacatcacataaatcttaaacctgcttttcttcagcctctccatctcagtaaatggttccagcatcccctaattatttaaaatccaaaccaaagattcatgattgtttcctttctccatccttcacagtcttgactctccatttgcaataacccacatctgccatttgtctccatcaatctggtgaccccctttctcaatgtcacagccaatatggtatttttaaatggtcaagtagacgtctcaaatactccagcaacctcccactgggagcgtaattaatcccaaactcctcgccaggggcctgcatggtctctttccagcctctccctcctgcccttctttccaaagatcactagactctgcacagttccccagcacactttgcactcgctgtactcgctgtttcttttccctgaaatacttgcttctcagctatgtgtatgccttactccttttttatattcaggtgaagattaagtaatttaaagggacaagtcctgtccacccaatctaaagcagcctcctagttaactactattaacagtcattttcttcatttcctgtcactgttcactaaaatgtaagctccgtaaggacagaaatgttttatcatcccatgattttctgtgcctagacgaatgcctgccacacagcagtaactacatacatttttgttcactggactaatgaattggtggttcaacaaacagatctaaaggagatccccaactcttgttggttgccttttaaaaaattaaagagtattttaagaataaaagcagagactgatttgtggttatctcagagccagtgaattttagcatttaaagctaagatctgatgaagagccaacacaaatggtaaaaaatgataatggttagcttagattttaatcgatttgtgttacttgtgctaataccaaagaacttgatttgaaagtgttttattagatcaatcagaatatagtggagtcacccagctggctgcaaacttatccagtcaaaatatcttccagaacttcaagtttcaaaatagataaacttcctaaatcaggtctttgggctgcctgcaagagtctgccatattttaggctcctctagttttctgagaattaacccttcctttggcatataccgtctacattttcttctttctgactccggcactgtagttaatcacacaaaggtgaggctcttaacactaaatctgtatatttgtttacattatgagaaacagagaaaagactttatacaaaaatggtggcaactatgattgattctggcttagagggttaaggataattcatattcttctttattctcttccctgttttccaataaacaagtaacattttacaaataaatacagtttttaaaaacttcttaaactagtacctaatatcctatgtacccaaaaggaataagaactaaaaaagagacttgaaaattaaaagacagacactaaacttctttcatatgattgaagaaatttttggaatttaagatattcttttatggctcaccacagaaactacttctaatttttaattttttagggaaaaatttattattcttaaaagttgtttatctaaccctaaaattctgatccaaatttattattaaaaatcaaactggtccacatttaagtcacctttgcctgacttacagccacagcaatgcattaagggaacaaaattctcggtattttggtaatttcacaggaccacggcagtagactcagagtagatgcttgacaaataataaaatacaagccttaaatatgagatggcactcttgcatattactgattatattattaatgctaacatcactaggatcctagtgtaatgctaggatcattgccaagtttaagtacactgtgtttaaatatgatgcatgcacttgaagcagtagaacctcaattcaacaaaaagcactgaggcagcatacttgtcaacatccgggagatgtaggagctttgcctggactccggctctcccagacgtgggtcactacaacattcagtacaggaatgaacaatgtatcgaactgttatcctgtaaggctgcttccctgaaggattgttcacagaggaaaattatgtcgcaatctgcatgctattttgaattttcataactgattcagcactccaattgctgataagtaccgtaatcagaaatctttttcctcccacagaacaagaacaattcaaacatcagaatttatccccacaatccagatctgaaaaatgaaaaagcaacaactagacctacatcttctttaaatctcaaagaaacatttgctctgtgcaagacagtgctattctaatgatagaggaaacttctgatgaataatgcagaagcacctgtggacatttaggcactagtggccatttaaatgctctttccctacgtgaacaagtgaccacaagaactcctttttttttttttttttgtcttgaagcacttgactcagaaacataaaaatagtcaagattggtttaactgaaatcacacttctgtgtgatctgtatgcatcctttcttttgttccagaaatgtgaggatccaaggttttaaacctaagccagtctggccagcttgactcatccaggacatctttcagtagtttcacagtggccatcagctctgtcagacaccggacatggcttgaaagggccatgtcagcaagtgatcattattgtgtctgaaaagagctgtgcttgatggctgaaatattacaactaccaaaaagctacaagtggaaactccatagaatcagctcatttgtagtcacagaatactctattcctacccactttcacacacgctactccctatatctccatatcaagaaaaaagtcctgtcttctttaagtcaattaccatgctttaatccagaatttggaattattcagggaaaccaaatcaagtatctattaccttctagagccatcatcatatccatgaacaaatcagctgtaaagcggtttatctttggggattaaatactttccagtccaaaatgcagtttttaaaatgcaatttttgccttctcttctgtattgagatgactaggcctatgtcaatttaactgtgtctctataaagtcatgcaaatgtaggcactttaaaatgactgctcacaaaaaaattgttaagagctctgcttaaaaatcttgcaaataaaaaaaacagttcctcatacaatttttctaaatggtggtgagggagtgttcttaaagttatatcctgatttatggaaatcttttattagtaaactaaagaggatggtctgcacatgatctgtaatattattattatgaatgctcatggcaattacattagagaagtaatcctcatttgaatttctgatattaataaaaagctcatttccaacttgccaaattcccaggctatgctgatctccaaagcctatcccacttagacacacacacacacatcaaaattcttttctgaaaaagaaaaatcactttccctcctactactaacattgccaatgaggtcagtggttgaccataacgtatttccagatttttcccttccctgagtgtgaagaactcaagtttttctctttttaccatgataaatcctattgcaggggctggaggtgagacagtcaggagacgttttagatcatgaggagggtcaccctggaggggagaaagggggctacagctcccattgctgagggcaccaagacctacctacttgttagatccccaccttctcaaatgtatcatagtccaagcatggagatgctctaagaggctatgcagtttcgaggtcataatcttattttgattattgtatatctgcttctgcactggtaatatgctccttgaaacagtttagttttcttcaaaaaaaaaaaaacctactctttcctgtttccttcactgtttctttcagcacttattatataacatcacacacacacacacacacacacacacacacacacaaacataaacacacctacttgcattattatttccgtctctcctgctggaatgtaagttccatgagggtaagaatttttatatgcttttattactgctatatctcccatacctgccagtgtttggcaagaggtaaatgctaagtagttgatgaataaatcaaaagataaattatagcagaaactccatggtgggccaggtgcgctggcccacgcctataatgccaacactttgggaggttgagagggggcagatcacttgaggccgggagttcgagatcagcctggccaacatggccaaccccatctctactaaactacaaaaattagccgggtatggtggtgcatgcctgtaatcccagctactcaggaggctgaggcacgagaaccacttgaagccagtaggcagagtttgcaatgagccgcaccactgcactcctccctcagcaacagagcgagactctgtctcaaaaaacaaacaaacaaaacaactccatggtgaagcattcctgactccatctttttttttaacttaaaggtattataggctgcaatccacgtctcctctaaattcctttgagttgttctaacagcatcaataactaagcctaaagcagactccctactgcttaccatccacgggtgccaagaaaacttgcatttcaatatcaagttaatttaactgtgaaaataatttcatgtatccttccaaaataatcaccctaatttcttcaagtcaaaacaactcagaaaataagatgtttgtgaccaaaagagggctgtaagagcctggccttcacagcccctccaaccaagaaacagcagcagcgtgttgctctgttacacctgtgcccttagaaaaggttcagactgtgcttaactgcgctgcctactggtaaccatcaaatgaggaataagcattgcgcaaggtagttttgggggaaaagcctcttttcccccaaatcaatagcattacccttcccattttcccagaggcctcactgtggtgagtgggactgaaaccatggggcttcaggtcaccatgaccaacagagggcaatggagctggttgctgagcacttacaggacagtggggactaaatgaagactgaaggatccacccataagggggccagaggttccctcactgtctagaacaactggctgaagcctggctctgggctccagaggctggagaaaactgcttctctcagaactgctgcttaagtaagcagggcccaggaggcatgagaaagtaaacccagcccctctaccaaaagccaaaccaagcctcatgccagaaagctcacagaaagaaagggagaactgcgggcagagaaaggtgttcagggaccagctatgttcttaaagttgtatttctttaaatgacagagtggaggactggatacctgggtgattcctatactattctttgacttggctatacagttgaaatgttccatatggcaagagtggttcatgggtaaaagcgtgaactatgaaggctgtgggtcttggaaaagatagttaacttccctggactggactcacttccttcatctgtaactgggcatgataatgttgtctgtttgatgggactgtggtgaggattcaatgaattaatgtaagaaaagtgctgaggacaatctctaacacataataatggcagactcaacgtgtcattcatttcttaattaaaaaaaaaaaaactaaaatctctcagctctattgccagctacactcactcatatgacctcattcagcccccatctctttttcctttccatctacttgtcacaaactccagcacccaaaatgcctagtcatagttctttttatactcataggtacttctcaagccctgcagcttgcatctcctccatctggacatttcagtaaactttcaaggctgaaagcagagcactgaggaattaaaaaagactgtgcaacccctcagccacagcctccaatggttactgatgatccataacctacagcctgctctgagaggactatgcacattgtgcacttgcctcaagactcaaaacaagattcagacttgatttaacctaccccttctgaaggttagaaatatcccatatctcaaaacaaaggcagtctttacagctgcagtacaccttatttttgtgacatatgcttcttcttaaacatttggctcactgagcaaatcctacagagatcagttcattccttctagtagtctttttgcttgcaagtctaagagctgccacctgatgaaaagccatgccttgcggtagagcattgcatgggaaattgattcttaaacatctaattaattactgattttccttaaaaattgaactccttattaaaatatcatatatgctttgaatgattgcaaattactgtttagatacttttggctgcaaataagagaacgacaaattgcttaaaagataaagaatttttaaatcccatataagaaatttggaaggcagtaaaattagtttatttagcaattgaataattcattgaaaatccaagtttcttccatgtttctactctaatcatcataaacgcataggttgacagatggctgtagcagctccaggcatcatagcctcaaatcatttcatcgtatcttttttaagaggaaagaaaactttttcaaaagtgccccaacttccccaacttccctcacatctcactggccagcattgtgtcacttgttcctacctactccaatcattcagcaggaaactggaataaccaatgtgatcaagattcacccaggactaggcagataacctagacttccctggaataggattaacctgttgaggcgctgttttaaaaaaagggaaaatgtagtcaatgttttgttgttgttgctgttgttgttgtttttattgttgctattagggaaaaaagtgaatatagcaaatttaaatcaagatatcattttgggaaattttttaaggggaagcttctaggtgctatttaactttttcaactacaactaagtagttagattttgtaggccaggcgcggtggctctcgcctgtaatcccagcactttgggaggctgaggcgggtggattacctgaggtcaagagttcaagaccagctggctaacatggagaaaccccgtttctactaaaaatacaaaaaaatagctgggtgtggtggctcacacctgtaatcccagctactcaggaggctgaggcaggagaatcacttgaacccggagtggaggttgcagtgaaccgagatcacgccattgcaccccagcttgggcaacaagagtgaaactccatctcaaaaaaaaaaaaattagattttgtgtctcagcgtgattccatgccaatctgcaaactatttgtgatgagtacaaaatgagataagtatgcttatctcacataagtgtagatatattgaaaaaaattagaaaacttttataacaattagatagtctaattttatatttgttaaatctaataaaactttggagcttatattttttatgtctcggttttttacttttagtaattgatttttactgtagtccacaaaattatcagtctgtaatggactggaaattggaacaacaacaaaacagtcattcactagagatagatcaccctatccaacttctctaatttttgtgtaaattatatacttttagaacagcttaaagctcagcagcttttccccccaaactgattggaccgtaagcctttgacagctaaagatacagtctgaacattgtaaactatacctggatgcagaaattatattaaaaaataaaactgactaggataaattaatgagccctcagtcagaggtccatttccctgtggactactcagtgccagaagaggctaaacccttaactttggccagcccctgggcacaacatcaagtaaaaaggaattcgaaagttctatatgactttggccaggccagcattattagaaaaacatggtaggtcctgtcctaataaaagatgagaaaagtcctaaggatgagcaaaataaaatgccatgtagataaggatccatatctgtagataaggaatcgattcaaagttcatattattttttcctcgaagtgggaaaatattacctacattcaattagcacttttgcccttttgctatggaaaatgcgttttgtgagtagtcccttatcatttttatttcctcagacagcaaattaattcttatacttctctacagaggacaggacaaacttgtagttaatattgaagattaggaaatgaccttagccacaattatcatacatcaataacactttcccaaaacccaagaaagaacctctcacctactttagtatgtttactcagtggatttaaagtaacctttcaaatcaccaactgcaaagacaacattccacctcaaaatgtattcaaagtgggctcttgaattgcgcttttatggaattaacctaccatcttcttatgaaaaagtcacctgacatccctgggtgcactagccagtgcacaaaggaagcaaggggttcaacagttaggaagacagtttgcacacgatctgcacatgtttaccgtcaaatcaaagcttgatgataaacatcactcagctttggcacatctactgatggcatttgttggtggattatgctttcttccccttatttatttcacaatggttatcatggcacagctttccaaatgatgtttttaagtgttcagttgtaagaatgcaagttcaagtatgctttcttcctcactacaagagaatatgatttcaaatattcaacaaattggtttacctaatggtctctttggaggggtctcccactattctactacccactatcaccccaataaatactctagtgatataaccccttcaacagttatcatcattgaactttaaaaacataacaccatatacctttaaccatgtacatgttccccaccagtttccacaaagagctaaatttaagcctgctataagagagaatcgaaatttggtttgctttcttttagactctgctacatagactttaaacatgcagaagagctgactttgccaacaaagctcatccttcttttttccaaagcagccagctgtgacttcattttggatttaggctatgatttttctgatttttctctttgcatgtgaatgtttatttgtgaagtcttgaacttcaagctacttccaactctagaaatgatttgggcaagctgccatgtttataatcttagagcctccagcttcccagataatacaaactctcttgttatttaattaatgtcaaactcataatgtcatgcaacattgctgttagatttctatttttctaacatgtctattctcctagttactcctaactagaatgagtaaaccttctgaataaatcagagacatctttacaggcaaatgattaaagggtttgactgcctgccataatattggaacaagatctgggggaaaatattaatgaataaaggattataaccctggacaagcaagcaaatgtagcttaaatatataacagtttcccccaaaaagtaaactggactttatactatatataattatattatattccatgcatctctatattacagcaccttaaacagtgtagataactagtaaatatcggttaaataaatgagtaaatgaaaaaaattgacaagatataccaccttgttggaaagataggttcttggctgccttaagcttcccataaataaaccaggggccaggggtggtgctcacaccggtaatgtcagcactttgggaggccaacgcgggaagatcacttgagcccaggagttcgagaccagcctgggaaaaatggtgaaaccttgtctccacaaaaaataaaaaatacttagcctggagtggtggtgcaagcctatggtcccagctgcagaggaggcttaggcaggaggatcacttgagcccaggaggttaaggctgcagtggggcacgttcatgtaactgcattccaggctgggctacagagcaaaaccctgtctcaaaaaataaataaataagcaatgtatatggcaatcacagtcctcggtaccaaagaccaaactccaagcctatatgaagacatctgatgttatagtcattggaaaatgaaaagggaaggagtgggctaaggggagcaacaaaaggttgactgtgttttcttctggcagtctgctttcacagccagtactatgcctgtggccatctcccaggctcaggagagcctatcttactctagcccatcagattcactttcccgggaactggaaatagaaccttgatatggtttgcatttgtgtccctgactaaatctcatgtcaaattataatccctagtgttggaggaggggcctggtgggaggtgactgagtcatgggggtggatatccccccctgctgttctcaggatagtgagtgagttctcacgagatctggttgtttaaatatgtgtggtacctccagcttctctttcttcctcctgctccagccatgtaagacatgcttccttcttctttgccttctgtcgtgattgtaagctttctgaggcctcctcagccatgctttctgtacagcctgcagaactgtgagtctttataaattacccattctcaggtactcctttatagcaatgtgagaacggacttatacaaacctctatctctgctgatcacttgtgggaaagacatctaaacaagtgagctacagggtggccatttccaaacatgccaaagcagagacagtccacagagaaagagaatgaggcagatggcagggagagccacggaggtcagagctgggcaggaaggcctgcctgtgctcccagttcacctcttgtgaaccctggtcatccttgaattccttgagatgactcaatatccaagatgtctgggtgataaaatggcagggtggaagaaaaactaaaatgagagtgagtgaatgtaataattgttcagacttcctttgagggctctgtgagccactgaacgttttaagcagagtgacccacgatgggatactcatctttacaatcagcaccctggctgaaagtagagaatgggttagaatggaggaagattgcaattaggaggcttttgtggtcctttaacagcctattgtcccagggaagtatctgttgctcatgtgtaatgctgcctactagcataatttaaatacataggctatttctcttcaaaagggcatattttatgtaacatctctaaccattacatgaaaactcattctttgtcaccagcatcagttaattattagattattggcccaaaacctccatgattatataatatatattaggactagaagttaagtcaccagagagtttccaatatttaatagtgccatatttcagaaatgcccagggagaatatcagtccactactccgctagcatggtatccaacatttcttccttaatgttgtagatcctttcctaagcctgtcaaagtaaatttcaacgaacgaattcataacataacatttgtggtagcagatattttgctaatttcacaaaatctttctaaatcctttaaggtttgcgactcactacacttctgattataaatgaatattaagctagctaaaaagaagtagagtgcaaattaggtactgaaatggagactatcatggctctgcaataagaaagaatttagctttctacaattacttgagccctatagcctccgtgtcacctggaatacatgtttaatactgattttcaacgttaaaaaaaaaaaaagtcacaaaaacaaactccttttaacactgtttcactggccctagtatttacaatttttttaaattaaaaatcttgataattcaagttttcctataacctgtctttatagattttttttttagatttaaatggtcataagtgttatactacctcatatttctctctgtatgataagcccaaatattccttaactgtgtttgatctactttgtggtcaaaatttgggggataggagagaggtcctcatcaaaactcaagatcagcaaaagctgaggaattttatcaacaccagacctgtcatataagaaatattaaagggagttcttcaatctgcaaaaaaaggatgttaacaagcaagaagaaattatctgaaaatgagtagaattggaatgttcctaacacaaagaatgacaaatgtttaaggtgacaaatatccaagtaccctgatttgatcattacacattgtatgcctgtatcaaaatattatatgtaccccataaatatgtacaactgttatgtatccaaacaaataaaaaatttttaattttttttaaactttttaaaatctcaagtttagggcacctggatcctatcaattgaaaacttatactaaaacctcaaaaaaaacccaaaggctttcctggcagagaagttattaaacactagtcagaaattaatcctgtttaatcagtcaaaaacctaaataagaccactaatgctaagattcaccagctgcagaaggttggcatactaaaaaatggatcaagagtaattgttcccagttgtaagaaatagtgaatgcattaatataataataaaaaaagaatagctaaatctgcctagcatttaataggtactcacaatgcagtattcacagtgctttgcatgcttggagtcatttaataatctaaacaaccctatgaggtatgtgctattattatccctattttacaacagaagctaccaaggcataaataagctaagtaacttccccacggtcacacagcctgtaagtggtggagtaagatttcagcatccacattctgaactacttcccaaggcttagatgttactttaaattaaaaatcactgcattctttagtataatgaaagtagaaagcaaaaaccactcaggataaattgcagactctcccacactgtctccaccatcaccttcactgaaagaagtttaaggggctccacttgtgattgttaattttatgggtcaacttgactgggccacaggatgccaagatatctgattaaacataatttgtgggtgtgtctgtgagggtagttccaaaagagattagcatttgaattggtagatagagtaaagcagattgcgctctccaatgtgtatgggcatcatccaatctgtggagggcccaaatagaacaaaaaggcagaggaaggttgaactggctctctgctacatagactttaaacatgcagaagagctgactttgccaacaaagctcatccttcttttttccaaagcagccagctgtgacttcattttggatttaggctatgatttttctgatttttctctttgcatgtgaatgtttatttgtgaagtcttgaacttcctgatatccatgtctttgggtagtgtcctcctacattgaattagacagtctatgtaaccaatggagtatgacaaaagtgacagcaggacttccaaagctaggtcataatgggccttgcagcttccaacttgttttttggttggttttttgtttgtttatttgttttttggaaagggagtctcactttgtcaccaggctggagtgtagtggcatgatcttggctcactgcaacctccgcctcctgagttcaagcaattttcctgcctcagcctcctgagtagctgggattacaggcacctgccaccatgcccaactaatttttttatttttagtagaggcggggtttcaccatgttggccaggctggtctcgaactcctgacctccagtggtccacccacctcggccttccaaagtgctgggattacagacatgagccaccaaacctggccccaacttggttacttagatcactatgctctggggttagccagtcaccatgttgtgtggacactcaagcagccctgtggagacattcacatgaagaagaactgaagcctcctgccagcatcaacttgaaagtaagcagatggtgcagtctcagctgatctgactatatactcatgacataccctgagatagaatcacctaacccaagcattctgaattcctgactcacagaaactataagtgataacaaccagttattaattttagggtaatttgttgtcagaaataggtaataaaattgtctgtgtgtctgctggcattggcattaacttttcagagtgccttgatatcgtaacatagttcccctgaaattcatctttaactgttcaaaatcattccattagttatattccacatttccatttcattggacctgccagtgtgatgcctcagcatgtacgctccatgagagcagggatcatgtctggtgttgcccatcattgtatttcccagtgtatccaacagtacctggcacatgttcagtaaatatttgctgaataaataaacaaataaacgtatgattggagaataaagaatgagtggcaaccaagtgcttcggtctacttcattgagtaatttttcttctcttctttctttcttagtcaatcccatccaaccagtggcaagttctactccagagatcctgcccagtccctgattgttatgatatggtgaaatgcaggcccagaaaagaaaagcaacttgaggtcacatcctgaattaatttctgtggctggatcacacactggaaaaaacagtcactggaatgaagagagccaataatatcaacagacaggtatacatacagaggcagtaccttgtagtgcagaaaaggaaaaaacattacatgggaaaaatgaaggaatatgaagggtggtgttacattctccaacaccccagaaccacagctccaacctctttttgtttgtagtctctggagctcagagctatttaatctccaatttgagaaattattgaagtgagtataagaagtttaaaagtactgattccagaggccgagtgtggtgattcatgcctgtaatcccagaacttagggaggccaaggcaggcagatcacttgaggtcaggagttcaagaccagcctggcctacatggcgaaaccccctcgctactaaaaatacaaaaattagccaggcatagtggcaggtgcctgtagtcccaactactcgggaggctaaggcaggagaatcacttgaacctgggaggcggaagttgcagagagctgaggtcgcttcactgcactccagcctaggcaacagaacgaggctccacctcaaaaataaaataaaataaataaaataaaaataaaagtactaattccaaaaagcatgcagttaaagaaacaattttttgaaggagaaggataagaatttccaagaaaggaaattcaaatattgattttatgctgtcatgtttatacttataattactgtctctgaatctgaacaagtgaaaaatattaacatcctgatattctcctcttctgttgataagaacaggctccttttttagaaatcaaatctgagccactgtggcggcagtgacattcagccagtagaactcctgtaaatgttcctgtctgaataaagatgggcatcaaggggttacagcaaaatttcttttttacttattcttggtgagatatagctacttcatttacacagtacttcctaattttcaaagccccttctcatacatgatctcaactcacacaatcctacgagacagaatagagagggaatattgaggtatttccccaaagcccaaaatcctgatgtccaattgcccctagatatctccagccaaatatcccagtacccccaagatactctgaactcagtatgtctaaaaccaaattctccatgaccctcaccttttttgtttttaaagaaatggagttttactatgttgcccaggctacagcactgtggctattcacaggcacaatcacggcacactgcagtctcaaactcccagtctcaatcaatcctcctgccttagcctcctaagtagctgggaatacaggcgtgcaccactgatcctggcatagcctcacctttttataggtacctgggatttgttttactcctagtataagacacatagtcacagaaatcactagtcatgaaggaaggagttatttgttgttgctttttggtttttgtttgggacagggtcttgctctgttgcctaggctagaatgcagtggcacgatcacagcttactgcagcctcaacctcccaggctcaagcgattgattcttccacctcagcctcccaaatagctaggactacaggcacatgccaccatgcccagcttttttcttttttttcagtagtgaccaggtctcactatgttgtccaggcttgaactccagtcctcctgcctcagcctcccaaagtgctgggagaagttttttaaactcacagttccctagaaacaggagggatggcaagacaatatggagagcaggtggccacacagagaaccaccaaggccagtcaggaggtaaagggaatgggataagggcaaaatgcaggcaaatgttttcattgttttccaaagcaaagaactagtgaggcaggttaagcagacttgggattgactagtttgaataattttagcaggatctggggggaaaggtgctatacttagatgtctggtatctggccctggagtgattaggcaggtggatggtggcccaggtttgagagactgataaaggacatggtgagggtatgggctatagatttgttggtttgcatgtgaaaggtgtgtttctggagagctgtttacgatctctagaaatcagctaaccctgagagaggcagttcctccaggatcaacaaggccccagatgtgaaagcattaggatacaaaaaaataaaaagaaatggttatacacccacctacatatgaaaccctcttggcttcaggctcaagcctggatgacatcaccaaccacccactggccgaagcctccccttctccttcctgaacttcgccccctctgtcctcactgttcagtccttcagcactcaccttagctgtcaccataacttctgaaatgacatccggaacagcgaccagctagtgtcacagttctgtctcaccccaccctttctcagcactgccgaccataatgtgcaactccagcctcctcattcccacactcaaatcctttgcagactcttgttttatctttaaaaagtatgtgaaattacacattcaactccataatgagagttccctaaagtccttgagtaaaactgcccttctaggaataaccttctttttatcctgatacttctctaaatgacttagagggtaaagtcaccaccatttggaaaacacaggcctaaagcagagaactgaaactcctttgcctggtctatgaagccctccttgaacctcctccctaacgagtcagcttatttcccacacaacctgcctcctgccccaagctcacgctctctatactctgaaaagataaacccataaacatatcatgctgggtttggataaaatagctaaataaagcaatgaagcacaaggaacattacaatacatacctgtggttgttttaaaatatattcacaaattcttggacactcctttcactgggagatgaagtccaattccccaccccatggacacagctagcctttgtgactcctatctaacaaatagaatgcatcagcagaacaaacactgatagagaacctagacttgttgcagctgcacaaaattaaccaccaccttcctttttgatttccaactctcttctcagagagtgaaacaattttgtatcaatgtcgtatcatgcagggccaacccacttgcttttcctattcagtaagctgaggatacaaaagcatagctaatgaaaaatgcatgtattcttaacctgagagtcaataaggaaagtgaatgtggtcttctaccataaaaacaagcatttgtcctcttaacgttttaaagaattccctacacacactttaatattcccaggatgaaagacgcttgactgcctcattcaatagtaatttaataagaatgtttctggggacagcactatcaagcagaagacacacttcctcaacctctttctcctaaacttgcagaatctgttacaccaaaagacacaatgaacaggaaattgcattttctttgcagatcaacaaagcagccaagttagatcagacagaaaaaagatccacaaagagcattaggaaaaaatacagagtctgaagacccctggcaaagcaatgcccagatgacttttgatatgaaaaaggttttaacttatgactggaaaatacttaattctgtccttcaccctcactctaaaacttaacaagactttttcaaaagtctttaaaaataataaaattaatttttttaaacttctgaaacaaaaagaaatgattgtacaatggtaaaacaaagtaaatatcattccttttattcactcaagcagctgtaagcatcaatagaatattcatgcagcactccctaagaatttctgatcctaatgcatagctagattcttaaatcctgtgcactttacctgctttcttccctttccctggtatttactgcccccactatatgcagtagaggaattctggtagaggtcctgaaagaagcaatttgtgtttcaacctgctgtatttatccaaaggcaataaaactgaatttgtacaagttttccaattgaaaactcagaagacttgaaaatttaactcttggatcaaacaggggagaaaagcataatgtaactgtaatatagtcatcttaaaatcccccagctctaggggtagccagactatgcccacaaggtcagagctcaggaatttaaattcttcacagtccccagggaacaatagtagtagtattggagatttcctgatgtccagcttcaatcctcttacattcatcaaatcaggttgaagacaaagaaacaaataaaaacaggcagaagaaccatcaccacaagatgttagggccttgggaaggaaaagcagtcctaaaagggcaactttacggacagatgggaccatttatagcctcagtatgtttacgagcttctggtcttgacgtcctccctggaaaaaagactcttcccctttacaaaggcctactcccctggtgaacatgcaacttccatcaaggagaaaggccgggtcacatttaaatttccctacgtgcctcagttattcatatgttctctctttcagcaaataaatcgtgagcatctactgtgtatgagaagtatttctaggtactgagaatacaataatgagtgtgacagacagaatgcctgtcttcattaagcaggggtgatggacatgaaacaacaaattagacaacaaagcatttcataatatttgccctaagtaccatggtaaggcacagcaggatataaagagaaagcaaatgacagaggacctggcacaggcttggctgtcagagaaggcttctcagtggaggtggctgataatctgagctctgaggctgagcaaccatcagccagggaaaagcaggggcagagccggccataaggcaggaccagcattgccagagtgctgtgacaatgcccagggaggggaggcagggccaacgacataggcctcttaggccatgttagcgatcttggtttccatcctgagagcaacaaaaatccactgaaggcttttaagcaaggaggtaacctgatgaggctggccttttctaaaagtaagcctggctgtggcttgggggacagtctggagggcaagaggggggctcagagggcaattcgagaaacccaggcacacaaggagtgactgagaccagggcagtactgagatatgtaggctcataatttgggccctgctcaaccagtaaccattaaatatctcctcaacattgatttagacatgcctgaagctgctagaggaaagtgaggcaaggaagcccttgagcatcaattccagactcgcctccactaccctatataattctgtttcggccctaaaataataacctgatcacgaaacaaaccatgctactcagcagaccttgttcccttagaaggaggtctagggaccatctgacaggcatgtacccttcaggcagggtgtgcacaccccaagtagcaccatgcacaacctatgctacacctcagagcagccctgccattgcaagggaggggtctcacttctccatcttgtatttctagtcatttcagttcccccccatatcacacagcaccctgggacaggcagctgacccatctttaatctgactctgatttggactgtgatgatggtagtgggaattgggaaaaagagaaccattcaaagcccagtaagaagtagaattaatggccgggcgcggtggctcacacctgtaatcccagcactttgggaggctgaggtgggtggatcatgaggtcagaagattgagaccttcctggttaacactgtgaaactctgtctctactaaaaatacaaaaaattagccaggcgcggtgatgggcgcctgcagtcccagctgctggggaggctgagacaggagaatggcatgaacccgggaggcggagcttgcagtgagccgagatagcgccactgcactccagcctgggcgacagagtgagactccttctcaaaaaaaaaagaagtagaattaacaagactcggggagtgagtgcttacaggcacagggaggcgtgagggaggagagggtcacacttctgcaacttccagtggtcttccacaaacagcccccccaaacccccaaataaaacagtcatgaaactaataaaaatgtgtacagctttatagcttatgctattttactctcattatatcatgtgactgtcacaacagtcctatgagatgtgataggtataatccttgtttcagaagtaaaatttccagcaatgacacaattagtacacacaggaaaatacccaaacgaagaacttccaaatccaaatccatgcccttgctactaaaatgcattatctgtatatgatacaataatctaatagtgtcataaacaagcaccagcaacttgtattacccctgagaacatgccaggagagatcattactggcagatctagtaggaatcgctatgaccaggcggccagaggcctctcaaagaaaatgttacttgggagtctagaattagcctcaagtcactgaactggaataagccttaagtcacctttaaaccacagagaaaatgacaaaacataccatgaatgaagtaggaaattaagagaaagtagttgaatacattcataacatatgtgacgcacattatacctacctcatattcaatgagctattatgaatcaagaaaaagataaatcagtattaaaatgattacaggatatagactatgtgtagaagaagaaattaccaataaacatgaaaagatgctcaacaatgctagtgtttaaagaaatgcagatttatgggaggccgaggcgggtggattacctgaggtcaggagttcgagactagcctggccaacatggcaaaaccccatctctactaaaaatataaaaattagccatgcatggtggcaggtgcctgcagtcccagctactagggagggtcaggcaggagaatcgcttgaatctggaaggcggaggttgcagtgagtcaagatcacatcattgtactccagcctgggcaacagagcgagactccgtctcaaaaaaaaaaaaatgcagatttaaacaataatattcaactgttggctggatttaaaaggctgacattacccagtgttggctagagtaaacaggctttctcatagactagggggaaaaatgtagcaccatttatcaaaatttcaaatgttcttactctgaaagtctgcaacttcagctcttgaagtttacacactgcacaaggattcaaaggcatatgtaaatgaatgcctgttatagcattatttgtagagcaaaaaacttaaatgtccatcagaactaattacttaaatcatggtacagtcatggtattatattaaaaactatgcagttgtttaagagtaagacagatataagttaggaaagaaatacaccaaactgtcaaactgtcaattgtaatatctacagaggggaatagcaagttggggggttggagggggtggcgtggaggagtatgactcaaaagagaacttttatattttatttcacatacttctatagtattaaattttcccaaggatgggcatagattaatattacaatttttaaaaactagtaagaatgttgtattatgaaaaaaataaaactctggagcttaatgttcctgagcaaatgaactgcaatgtaaacatgctctactcttatttactttgtttccagatagctttctgtttcaatatgaagttacttaccaccacctgatctctcatgaaacattaatataggggatccctaattccttctttcaattttattgataggcaaattagatgttccaattattttctctgaagtactatttctaaaatcagtcctcagagacagtaaattcttacccaggataaactaaaagaaaacctaaatatcaatcagcttccatttttcaagtcctaacttcctaggctttcttccatccaggaatctgtaaaactatgtaagttctgcctcagagtctttggacccatgccgttagctatgcaaagcaagcttattaatttgactttcttggcagatacactgttcgaatcatctgaaatgagcaagaggacacagcaaagcccttggcaaagattttagcatttatttgactttacacctaacactacctctcatttttccaagtattcctggagagttttgacagtgggaagcccgttaactttaatcactcatgctactggacccctcaaacagctgttcacatttttttgagcaccatgttaaattcctagatctgatcattttgtagcttgcactgtatttgcacagtatcatttatctaatggacacgaagaagccagcatcacatagacagccagactaagattattatccaccagagttctctagagtcagtaggacaaatctgactcaatctgacatccagtcacaataggttagaatccctgtttaggttagcaaaggaagaactttctgttttgtttttttgcgtgtgtgtgtgggaccttgttgaacacattcgcattttatgagcccactttgaacatagcactacattttcaagatcatttattcatcaaacgcttagtactaggtttcatctaccatttatagaatgcttattacatgcaggaagagttttaaatgcctcatctcatttacttgttctcctcactgctgctttcagaccactgattcctcctcacacctatgaacaaagcacaagccattggctctgacacctgctacctcgcctcaaaggagtcataacccaccctctcaggcactcaccctcatccgctgatgatttctgcaccaagccccacttctattctgccatcatccctggcaacatgaacttgaaattggctgatacactacactttggcagttttattcctggaccacttcacttgcaataatctgtcctccacctacctcagcctcccactttaatagtcccacctaagacctctaattatacaatgccactaattgcataattcccaaaatctccacttccagatttccactagtctacaagactactgccacgtgggtgggtgggtaatttacatacattgctggaagatatatagatacagatacagatatagatgtagatagatatagatatagatatagatatagatatagatatagatatagatatagatatagatatagatatagatatatagatatagatgatgcagtctcactgtgttgcccaggctggtctcaaactcctggcctcaagcaattttccagccttgacctcccatgggctgggattacatgcattggctactacacctgacttgaccacctagtttttgtttcgttttgttttcttcccttcctctggtgtcccaattatttcaccttattgggaggtccaaatcattggctttatttgaactgtccaaatgccttccttatggccctctttacccagtgttggttccacagtctcacacatgcactcaattccttcaccccgcattcccttacccatgttagttcctattctccacatcctttatgcctgcacaaaacaagggaacaaagctcattttaaatatataccctcacttttcaaataggccctcatttcccttgtcagttcatttcatcacatccaaaatgacttctacacaacttttctcttcaaatctccaatatccttcccactcttcactgataactttgcttctaatttcaccaatagaagaaataggtagaaaaattcctcattccaactaccatcttcacctatgcctgtacactccacttcttcactctcctacatcatcaatttattttttctctgctggattattcataagaatcttcaaatatgctgtcaaaactaccttaaaaaattatgttccctgatcctatatccctccctagtgaccactccatgtctgcatatatctttaaggaaaaactcaaaaaaaattgtctgtctccatttcttccccttcctctctcttttgaatcaattccaaccaggcttttgtctccacctctccactgaaaccaggctgatctagcatgcccatgacctccatgttgccaaatccaatggtcatttctcagtgctcattttactcaactccgcagcagcatttcacccagctgaacatacccttctccttgaaactcttccctcccatggctcctgggacatcatattccctggtgtttctcatgtcatattgggcaatcctccttggtttactttgttggataatcctcctttcctgagataaatctggaggagcccaggactcagcctatgaccttcttctttctctcactctttagtgatcctagcaagtaccatgattttaaatacgtgatgattccctaatgtatatctacaaagctacaacctctctcctgaggtcaagaattgaatattcaaacttcctgtcaatgtctctacctgtacatctaatcgatatctcagtcttaacatatcaaaagaagaactcttgtcccccactcatacacacataaaccattttcttcctctctcgggcctctccatctcagaaatgttgccaccatcaccatttatcctgcaagaatctctttcacactccacatctgaccaatcaggaagtcacatcaagtcaactctcaaaacatattctaagtctgaccacttctcataacttccccagcttctgctccagtccagaccaccatcatttcatgtaataatatcatgactggtctccctgtctcctctcatctcatagtaagtccatcctccatggtgcagtctaagaggtcccttaaagagaatcctaccattgccccacttaatattttgcaatggcttccaattacccttaggaaaaactctaaatcccatggtctgaccactggctgcttctctgactcatcttctaccattccattctttgtatcatcgactttgcttccactgccctggcctccttgctattacttaaatacaccattcctgaccctgtcacagggcctttgcacttgctctgttctcttcctgaacactctgcctttagatgttatatggttcactccctcactttatccaggcttctactcaaatatcacctcttataaaggtcttcttggattcttctacctaaaatattccccagctaggtgtggtggctcatgcctgtaatctcagcactctgggaggccaagtcaggaggatcaattgagcctgggagttcaagaccagcctgagcaatatggcaaagccccgtctctaccaaaaatttaaaaattagccgagcatggtggcacatgcctgtagtcccagttactcgggaggttagaacgatcattcaagcccaggaggttgaggctgcatgattgccatgattgcccactgcactctggcctgggtaacagagcaagaaacttgtgagaaaaaaaaaaagaagaagaagaagaagagaaaatattcccctttagtcgctatttgtgtttcacatctttattttattggatcagtcttgcactttcagaattctcgcagataacagcagctgcctgaatccaaatctctccatacattcaccatggaagcccaaataaagccttccatccataactagggggtcagacaatactacaaacttccatgtacatataagtgataaaataaacagcataacccagcatagccaaccctagaatcggacatcacctgcatggaaaagagaagggggtagtggggacttaggagtggtagaaaacaaaaatctcttccaaaaagaaagggtcccacccaaaaagctagtaaaccaaagaaagcattcagaaaagaattaaagatgaaattttaaaagaaataaaattattaaatacattttaaaatgcaaattctttggagaaaaatcaataaaacagattacaaaatactagcaaaactacccaaggaagaaaagaatgagaaagcacaaataaataagaaacttcaaaagagaaagaaccattgaaacagcagatacgtttaaaagataatcttctactgactcaacgaaataaatttgaaaatctaaataaaagggataatttcctaaaaagatatactttcctcctacttcaccccaaaacagatagtaatagttcaattttcatagaaggaatagagaaaattacccccccccaaataaaaactaccaccacaaagaagcaccagaccaatgtgatttaatgggtgaaattctaccaaagcttcaaaggatagatcatccttatgctgcttatattgttccagagcatagaaaaagaagcataaactgctaaattattttcatgaagcagatataatactgatatctaaactttatttcataaaagattatactcaaaactatatacaaccctcacttatgaatatttacacacatataaaactaacagcaaataaaatattatttcattaaccagtgaaattttttcaggaatgagaaaatgtttccttcttagacaattcattaatgtaattcaccatttcaccagatataagaagaaaaatcatatgattatcttcagaaatactaaaagggctttcaaattccatgccactcctaacttccaaaagcattcaataaaatagaaattagcggttatttccttgtgagtatgtgtgtgcctgtgtgaattcctcagacataaagtcagcatcttaatagaaaaacaccagaggcattcaactaaggtcaggaataaggcaaggatgcccactgtctccatctaacattgtattagaagaggcattagacaatgtaatcagataagaaaaaaacaatcaaaggcatgagaattgaaagggaaataaaattataactatttttaggttatgtaaccatataacctataaaacccaagataatcaaagataaaaattttaaaaatttagtaaggtagaaagttataaaattcacatactaaaataaatagcctgcatgcaataacacagtaaccagctagaaaatataatgggagagaagattctcatatatgagtaacaacaaggacaagtttaaaaaaaaaaaaaaaaagtttctgcaactaaataagctgattcttaagttaaaaaaaaatgtaagaataggtcagaaaagagacttctgcttccaaccaagatgagtaacccacatgaaacaaacagaatatatgaacaacagttttcaaggctttggagtcaagcaatgaagaacagtgatctctgagagacaggaaccaaatgaagtaggcctatggttgcctcagcttactgcctggagagattttccagactataaaacagaaaaggggaacctaggaagagatcagtggtctctgtcagttgagaagacaaggctgggagtctagggaggccaagacaactacagttcacaggacaggttactggagaggaaacagctgcctagagaagagctccggagatagatgcggactctagcattcggctgagtactaattagtgcatatatgtgagaaaaccacccacagcgagattgggaccaccataaggaggaaacactagtcagaggtcacagtttaactttataataataatctattatttccaaaatatttattgaatcagaaaatctgaaactacgcttattgagaaagagctaagatattcccaaacattccgcattatttacgctttaaactttaccaataaaatacaaagggattcatatagtaaacaataccttgctttcttatcttgcaagatggcaggtgaaaactttaaaaggctggatactaagaagagactggaagccaagaaagctgatactagtggcaaagtgaaaaagggtaagtcaaggtgaaaaaggctaagtcaaggcgaaaaagtccaagaagaggaaactccagtgcagccgaaatcctgtcctgatcagaggaactggcagatattccctgtctactgtgtattccagaaaggccagatacaagaggaggtactcgccactaaattcaagattgaaaaggaaaaggaaaaggttcatgcaactgttacaaaaccggttggtggtgacaaggatggtggtacccaggtggttaaactctgcaaaatgcatagatattatcctaccgaagatgtgcctcgaaagctgttgagccacagcaaaaagccctcagtcagcacagaggaaactgcgaggcaacatcactcttgggaccgttctgatcatcctccctgggcaccacacaggcaagagggtggctttcctgaagcagctgggcagtggcttgttacttgtgactggatctctagttctcaatcaagttcctctgtgaggagcacaccagaaatttgtcatcaccacctccacaaaaattgatatcagcaatgtgagaatcccaaaacatctcactgataccaacctcaagaagcagcagctgcggaagcccagacacgggaaggtgagatctccaacacagaaaaagagaaatacgagattacagaacggtgcaagtttgattagaaagatgtggacttgcacattttactaaaataatcaaagctgatccatgtttgccctgacgaatagagtttatccccacaaattggtgctctaaatttcttaccaaaaacctaattaaataactgattttaaaaaaaaagaatattccttaaaaaataaaatttacttttaaaaaagtttatttctctagtcaatctctattcacttttgatgcaactacttcagtaactgaaatagttgatgacaagttaactcaatggtcaaatattcctaccgacaagtatgcctttcacatttggaaagaagtagtcacacatataattgtactctttgtccctggctgcctgccaaaagcaatcacagttcaatattacagcttctccttcacaagtaattaagaagttaatcttacttagaaaacgtaattatccagcagaccatagcaccaacttaactggttgacatgagtgaaatctcaaagacaaaggagccataccacattcaaagacaaaatcaaaattgtcttcttagctgccacatcatcactgtttggagatgtgtgaagcccatcacaacccatcagtaacggggaaccaagacatctcagcttctttaaaacaccaagaagcaatggggctgaaggacactgggcacagttaaattcctagttcgtcaggacaagagatgatgtcttaataactaaggagacttcccaagctcaaaacttcagaatattccttcactgctctgaccacaggccaggcgtgagatgtctattcacttctttttttttttttttttttttttttttttttttttttttttccgagatagggtttcactctgtcacccaggctggagcacagtggcatgatcacggctcactgcctgaacctcctgcattcaagcaatcctccctgttcagcctccagagcagctcagagtacagactaatgccatcaggtctggctcatttttgtttttgtttttggttttttgttttgagatagactctctgttgcccaggctggagtgcagtagcatgatctcggctcactgcaactccacctcccaggttcaagcgattctcctgcctcagcctcccgagtagctgggatgacaggcgcccaccaccatgcccagctaatttttgtatttttagtagagatggggtttcaccatgttggccaggctggtcttgaactcctgacctcaggtgatccagccacctcggcctcccaaaggactgggattacaggtgtgagccactgcgctcagctaatttttgtaatttttttagagatggagtctcactatgttggccaggatagactcgaactcctgggctcaagcaatccaccaccttcagcctccaaaagcattgggattacaagcataagccaccacgcccagctgtctattcacttctaataatttcctaacatcagtcgatcattagaaaaagagaagttctgcttaatttgacactggcatatcaagtgcctgctatgttatatgttaacttggaaagaatcattacctatattcatgagtgggggagccagatgtcttctagaatggatggatctcctgacaaggcacccatacctgaattatgaacgtggctgcccactctctgtggcagtcctccgtgcctaacaggctgaacacaattgaaagtcggacttttcctaatacagcagagccacggcctgcctggatataacatcttttgggaaactatattcttttcaaaagtcaacagccacttttaccaacctattctctctccaagatggctctcagagcaaattctgaaattcttaagaatactgcatacactgaaggcatttgaaattgagatggaagcagcaggccaactccaaggctatttccagtcaacccctgtaggtcttacacaataaagactttttggtggttagtataccttagaaacttgctgtgtgcacagttccattctggagaatacagagattgacaaaggcagacagcaccatttttgcccctgaaaaacatatacttcatcctaatatcctaattttaaagtgatctaactacagctgctcctgaactttagctgaataatttcaattactacaggagttgggggtagggggtttgccctaaaataacttttctatccatctacccatatcagtctctagagttttgcctcatcttctgtgcattgggattttacattatcaaaagaaaatcaacatgccccttttttaaaaaagaaaaatcccttgttgaaaaagaaattgacaattttccttttcctatgtatctcaggatgagtgactcccctagagtgacttcataggtaattgaatttcatatgaaatttaccaaataacaaaggtctgatatactctacagatcattccatatagctgaaatacctatctgcctgcctgaggcttttaaacaaaatgccacatgaagaactggcatatttagaatagggaagtattgtcctctgccaaatttgtcagcattgcccatagcagaggtggacaggaaacatttcaaataccatatatgataccttccctggtggtctagtggttaggattcggcactctcatataccatataagaggcaaacaatcaactttttcaacaactttgtagttcacatagcacaaccttattgatttttggctaaggcaatgaaagggttctgtgctcagaccagagagatagagagcagggagagagagagaggttgaacagagcactgagtccagggttacttacactgggtcacagagcaaccctagctggagggtaacaaggcatattttgattagcccatctataagccaggttctgaagacacactgaacccaggagggagtctcaaaggctactggctctttatcaaagccaactcatagctcagattctgagccttggttctaattgctagcatcccatccccccatacctgaacctttcacttgccttaccaaatccttcagtgccttcatttccttctgtcactcataaaaagaacaagctttgaagcagaaatgtttgggggaaaaacagcaacctgtaccagctataaaataaacacatctccagacctctgaataaagaaggggaaaaaaagtgtctggcagggtctctccccctttcctctctgatactagatttttatttcccacctcattcatataaaaaagataacccacagagttatgcaccaaactgtgagcaaaaatgaatacagttagggttgtggtctgctctctgttcatttggtaatttccataagcaagctcagagcactcaggtagttagttttcttttctaaagctaaggagctaatcttaagcaaataggcacttcctacttcttcaagcatttgactcaactagagacagtacataaacacagtgtttggtaatgttgtaatggtatctgataacactctagaaacacctcttaatgaatcagcagaatctacctgagttagggctgtcaccttccatattctggttaggggcccatcacccacatagttcaatgaaaggccttgaaggtattgctttaacaagctcatgatgaggacactcactagaactagagaagctattgccatgatctgaaaactgtatatgagctaggcacggtggctcttgcctataatccaacactttgggaggccaaggtgggagaatcctttgaggccaagagttcaagatcagccttagcaacagactgagaccctgtctgcacacacacaaaaaaaatatttaattaaaaaattagctagtcatagtggtgcacacctgtagttccagctacttgggtggctgaagtaggagaatagtttgagcccaggagttagaggtggcagtgagctataatcgcaccactgcactccagcctaggtgacagagtgacaccgtctctaaaaaaaaattaaaaataaaaataaaacctatatatgtatatatacaagttttttttttttaatcttaagcctaaaataagagactaaaataagaggccaaagagaatggagacacattgcaaccaaatacccccagccccagtgggatctctaaatttttcttagattattattgcctttcaggtttatgtatttctttttttgttttgtttttttagatggagtctcactctgtcgtcctgactggagtgcagtggcgcaatctcagctcactgcaacctccacctcccaggttcaagtgattctcatccctcagcctccaagtagctgggattacaggcgacaaccaccacgcccggctactttttgtatttttagtagagatggggtttcgccatgttggccaggctggtcttgaactcctgacctcaggtaatccgcccaccttggcctcccaaaattctgggattacagactggagccaccactcccagttcaggtttatgtatttcttacctttcttcttttttggctataatttaaaaaagtattaaatcttttcttctgattgaaaaatctccaatgttttataaataaacaatcatggtgtgccagctccatcgtaggacactagtgcagattataaggatgccaagtggaatgagacactgtccctgttatgtaaatctcctaggagaaacacactctgatattttcaatagttaaattctagaaaggttttctggctaagttcatatcttgtgttttctacatcctcttaaaatcttactatttaaaatataaagacaaaagagcaatctacaaaaatctatgtatatctcttttgtaacctgtgatttaatcaatttagacaactgcctttggttagatttgggtaactaagaatatgcatggagaagcaaatcctgacctaattctatcactaactaactgctgaaaccttttgctctctttccgcttttgctcctttctcccactttccataagccagtcaaagtattcaagctccacattattctagctgtagagacttctgctccagatattaatgtctataaaaatattatctcccagcaaaaccttccctgtctctcaaaagtaggaaacatttacccattccttttgtatcttctcccacttagttgtgtgtgcctcacgcaggggctatggcttatttacccagctatcctttgcacacagtataatgcaagatgcataacagctactaagcagtcaataaacattagctccatgaacttcccctccaacatttagcttaatatctctacatgctaaatgctgaatttgtactgattggctgatataaactcttaatttgccaatcattagaggaaaagcattactatcaagtttgcaccactattgtttaggctattatgtcttcaaactattatagcaaaattcaggctatgcaacaagcagaagcaaacattaatgagacagtgcacttgtgataccaaagcattcctcagccaactgtcttttactctgccttttactccctgctataatcattcagttaatatttgctaaccgatgagttgaatagtgatgcatcataaacagtctgatgacagtaccaattataaagacaagaaaggaccatgtgtttatgttcagaaaagaaactggcaaaggcagcatagtagaggggattcagctgggactgaactcagggtgcctgattatcttggctagttcgctattccacaagtgtaaagaaacctatggtgctcatccaccctagtggaaaagcatctttcctactgaaattaccttccagctgcataatgtctgaactatagggctctaaaaagagatttcaacccttcggtcaagactccctgagcacctgctgtaactcaggttctataataaacaataaaagaataagatctcagacactcacagtctagtctaaatgctggcaaacattttttgtataaagccagatagtaaatgttttaggctgtgtggtccatacagcctctgtggcaatcacttttgcatgcagagcaaaagcagcgttagaaaatatgtacactattaaatatggctatgtttgggttgtagtctgctttatatacaaaatcaggcaactgactgaatttggcccacagggcgtagtttgccaactcttggtattcaggtacatttttttaaattgcaaaacagtgagctgtatgttgatgaaagcttccccttgcatttgcataacatttcataatttatgaagctatttcatatatattagctcaaaatttaatccctcataccaaccctttaaaataggtaggtcttattatcttcattttataaataagaaaactaaggctcaaataaattaatttccttaagtcatcatataggtagagatggagctaagatttgagcttccaccttacaggcgtagattactaaatgctcaccaaaacttacttcctcttcctccagtgcacacagaccgactgcattttccagactcctttgcagttgggtgtggccatgtgattaggttctggccagtggaatttgggcattgccctttaaaacttcctcataaaaactggctaacatgatcctctgctttcttttctccttccatttggccagaggaggtactcctagggtaatcttttgggtaacatgttgacaacagcagaaccacaagacagaagcagcctgggccgctgaatcatctcttggaagagagccactcaagcaggaacacttgtattagactgggaaagcagtaagaaatgtgtattaagccactgagatagctttatctgcatattactttagctaatagagcctgtgcccaggtccagtgttgtttgcattcaactatagccaagatgcaaaggatgagtttaccaggccaatgagacagaagagatcatatttcagaaggggacattcaggcaaagcaaagagtgctttcaagaaagaagaaattgttctacatggttaaatagtaaactagcaaggtagtggaaggagaggaggcaaagataagcactgggaaagacctgtgccaacactgcggtaaaaggacttggagagaacaagagacagcaattagatctgcctctagcacactcaatctaaggaagaagaggctggaggcagggagaccacccctagagtctgatcagccccggcctcaccagagcagagctgtgagccggcaaaatattttctttatgtaccctgatttttaaataaatctgattttttccaattataaatgtaatatatgataattacaaatgtataaagaagtatgaagaagaaaataaatcacaaataatctcatactcaaagataaccagtattaatatttcagagcataaacttctgagctcattttacctttctctttagcagatatgtttaggcatgaagaaaaatggaaatgtaagataatattttcaattgactataactatcagcatcttctcatatcaatcaccatagatattcacatactattagtagccttgtgcacacagtatagatgtgctatcattttttaaaatcaattgtctactagtatatatttaggttgctccctttttcttgctattacaaaaattattgcaataaacttacttatacatttatcttcgtgcaaatgtacaagcaatttgacaggactaatttctgagccaaagagtttttctactgtcaaattgccctccagagagatggtactaattcagattcccactagtggtgtataaaagtgccaattttcccacacttttggtgacattgaatgtcatcttttttttccttttaattctttggcaatctggtaaggcaaaaacatatatatctatctcattcttttaatttttgaaaacacagttactcaagtttttagttctcttctttgtattttaaaatattctctctggtctatggatgatcctaaacatatatttattatctttaaagttacagtgtgtttaatttatacaactgggctaagtgaatagaagcagagtcatttttggatttgaaagacttagtgtgaaagaagttaacacaaataatcacatgttaattctcctcaaggggtatcaaggatggtgggtgaattagcattgtcagaattgagtagataatctatttctgcttttatgtgctctaaataacaagccaggtactcattaaaattagctaaggatttgtttaagttattgcttctttggtgtttttcacacctttatcatatgcttgacttatctttggttttggttatatactagctagggcaaagggtaaatatacaaggaagcttagagaaaaaatataagtagaaaactaatataggttgtcaaacctgagaaaaaggaaatgatgagacacagatgaggtgtgtgtgtgtgtgtgtgtgtgtgtgtgtgtgtgtgcatgtgtgtgtaagacagatactaaaatgagcaggcatgtattattaggacatatattccaaggtaacatttattaaaggcctatgtaccaagcactggacaagacttgttatccacattattttatctgatcctcacaactctttgaagtgcacagaatccatattttttaaatgaaaatgcccaaaatccatatttttaaattgtgtgccagagaaattgaccaagggattagccaaaagctcagccactattagaactttcgcttgtcttttgctataattttattccaaattccatactctcccccactgtacactaaaaaaatcctggattagaatttccagtgctctccctgacaccagtgttcctcttctctcatgtaggggtacaaagaaacaaataaatgataaagtaaaaaggggaatgggttgcatgtgagaataagggatggtcccagcaactttaataaaggaataagaaaataaattatctattgagtatatgagaaattaaattgaagggaatgtaaccttagaatagtgtcagaaaagtcaggaataaataagttcaggataaagaagtagcacaataaaataatggcatgaaaaaacacacatatttgtaaaatgaaaatatttctaaaatgaaaaataataactagaaaccacataattataaaactgattggctcaactgagaaatattatgtccagccccttaatcttaacctgctgttaaaggaacactttctccattgtgttaatattcttaataatcacatgccaacttccccaccactttttaaatgcagtaaccaaaactgaaccctttcatcaaaagagtcacgttggccaagcgcgatggcacatgcctgtaatcccagcactttgggaggctgaggggggtggatcacctgaagtcaagagttcaagaccagcctggccaacatggcgaaaccccatctctacttaaaaaaaaaaaaaaaaaaaaaaaatacaaaaattagccaggagtggtggcgtgtgcctgtaatcccagctactcaggaggctaaggcaggataattgcttgaacccaggaggcagagcttgcaatgagccaagtttgcaccactgcactccagcctgggtgacagagcaagactccatctcaaaaaaaaaaaaaaaaaaaaaaagagtcacatcacccagcaaatacaaagagaatgctagtcaggaactgctaacactatttgcagtaacaatcaacaagttgagaactttcatctgtttgttgctctctgtgaacctcatcggggcttctgccaagcctgccaatatttgcttcactttgctttgtttctgttcttaataacacttacccgagcttagaacaagaaaaagcactggacttagaaagatcccctagcccaacacaagaggtagacaactgactccaaggtctgacagttaattcaggtcaaagccagatacaatcaaccattgattcttatcttcgtgggcatgcatggggttttataaaccaaatatattctaaattgtatttctatgtaaaaaataagacgaattgagaaaactagggaaaagatgtctaaaaacagaaaggacaactgtggagagattacaacaaataggagagggtgagggttcagaggggaaaataagaaacgtgagcctaggctgggtgcggtggctcacacctgtaatcccagcactttgggaggccaaggcggacagatcacctgaggtcgggagttcaagaccagcctggccaacatggtgaaaccttgtctctactaaaaatacaaaaattagccaggtatggtggcacacgcctgtaatcctgctacttaggaagctgaggcaggagaattgcctgagcccaggagacagaggttgcagtgagccaagatcacgccactgcactcctgcctgaacctcagagagagactcagtctaaaagaaaaagaaaaagaaaagcgagactaaagagtagaatgggatggcttcattcttcatccattgtattcttcctttgtccccttgtgcataactggggacataaatggtgtaactcctttctgtttacatgtgtgtgtgcatgtatgtactacatgtactgacatctctggaaaaacacaaatccacatgccaaaatatcaaccacagttatgcccgaggagtgggcatcaccacttgctttcatccactacttcttcagaaaaaaaaaaaaaggcatacatttgtggtcaaaaacagtaagtagtaatgagagaatatgaaataagttgagaatgactatacacaaagattaaatagagaactggctaagcacatttttttaaataaaataagaaacttgaaggccaggcacaatggctcatgcctgtaatcccagcattctgggaggctaatgcaggaagatcacttcaagccaggagttcaaaaccagcatgggcaacatactgagaccccatctctaaaaaaatacaaaaattagccagacatggtggcatgcacctgtagtcccagctactcgagaggctaaggtgagaggttcatttgagcccaggaggtcaaggctacagtgagccaagattgtgccactgcactctagcttggacaacaaaatttgtatgttcttattctctcattttcttagttaattttctggccttttcatttttaaaaccatcagtgagaacataagaaaataagttagtaaataaaaggaatacaaaaatgagaaaataaggaaggtataatatcattgaaattaagattaaaacctcaaaatcagaaaaatactcatggtgtgagaggcacctgtttactaagtccaactgaagacctgtctcctgttcatactgttcatatttcaacaagtagaaataggaaggtggagatatgaaatggctcacacgatgtatagtcttcgttctcttttgttgatcacataaaagtttaatttctttatgagacctacatcaatggcgtaactcctttctgtttacatgtgtgtgtgcatgtatgtactacatgtaccaacacctctggaaagacacaaatccacatgccaaaatatcaaccatggttatgtccaaggagtgggaaaggcaagaagaaagttcattttagcatttgatataaatcaagattgcttgtttttttaaaacagtccttgggtataaccttagacattcaaaataaaacaaagaaaaaagattatcaagggcaaatgatgagctcagacataaagatgaaatgcaaagagaaattataaaagaggaatgaaattgtcctttaaagctgccttttatttcatttcttcttttctcatttgattttatttcaccatctggggaaagagggttgcctcagagccctgcttgtatattttctcaagttttatctttatacatcctccctgataaaactgaaaatattcacatggattttaaagaaaagcaagaagcaagaggtcactggattagacgaaaaccttatgtaacacacatatgcaaccatgacttattctttaaacagatcgatagaaataatcattcacctttctttagagagacagctgaagtaactctagctcactcatggtagcttctgttttgctgacaagtaattagagacagttacagatcatttgtcaaaacttcaatgggtagggttcatggccctgatctgaaccaatttctcaagcagatgacaagaccctttcccttgggctgtgtaatctatctttcatagcatttctagactctttttcccaaaataccacttttacatcacccatatactccaaaacttaccatgttctcaccttgctctttagatccagcacaaactcctcagggagatattaaaaacacggctaaccattcttaccccactgcttccctgtgccaaaccctgtgtaacctaccatactgttcccctttccatctcgcactcaggaagtatatatttgcaggcccatttattccaaggaatatcaggccaacctgtcggctggggaaaggcatatgcacaaaggaggagatgttaaatggagatgtcttcatagagacagagaaccttttacaaaaacaggcaatcgattgcttcctgcctatgtatcttaccacctctaacaaagtaataacatttctaagagagggaacagagctgcaagtccaggttccaaagtcagccagcaggattcaaatgtcagctctaccagttacagctgacctagagcaagttcttttctctctctgcacctcagattccttgcctctaaaatgaatataactatatgcacttcacagagttatgatgaagattgctagttgccaaaattagtagtaggtactcgattttttttctaatgaatttgatcccaacatttgctatagaaaactatagaatctgtccttttcctctgatgctatgttctgaagcagtaaccctaatcaaaataacttaggcggttactttgatgagcatttatatagtcacaataatgtaaatgtaagtaatcacagtaatgtgaactttgtttattgatattaaacttttaaagtcaatctatgatcaaaacataggaggagtgattctgagtatagaaaaagaatgaaaaaataattatactaagagaagttaggagggataaaagaggcaaaggtttggcaaagggagagtgatggtcactaggtagagtaatccagctggcagagcaggaaaccaaaatgtaagtgaattgttaaaactacagggataaccaatacagtaaccaaagaggacatggggcaatataagtgagctatttctcatctatcatagaagaaaatcaataattaatatcaaaagttgagaaatcaataagtggcagtgtaagtgcatcagttggagatataaaagtaacactaaaaccctacaaaaaggaaagtaaaagagttaaaagtaatttatttggaaagaggcgaagaaggctgagaaaaaactgtatttttcgttaatagttctataatattgtgtttaaatttttcaactttttaaattaacaaggcgtaacaaaaaactctattcacaataccgactaaaatcataaaaataaacctaccaggaaatgtgaacaacctacatgaagaaagctctaaatcttgactgatataatagaaggacctaagagaaaacgtaaaatatgatgaatcctactgtgttcctgaaagggggaatcaatgtcttaaagttggcagttctcctgagttaatctataaatgtaatgtaattccaaccaaaaccccaactaagtgacttctggaactagacaggcagttctaaaatttatctggaatacaaaatacatgaaaagagccaaaaatttctgactaagaacaataagggagaacttgccctcacagataattcagaaataaactaacagctctgtagaacagactaaagcacacaacattacaggtatcaccttcttcattaaatagggaaacagccatattccacaatgtgaaacaccaagaaatggccacagaccttcctgccctaatgttacatttggactgattatgcaagcaatatgacaacattcaaaccaaattcctacaacctaggaaaagttgaggaggggttctctaacttcttggagaaatcattttttgtttgccataaaagaataggatactcataattaggcacaattctgtctagtggacaagaggtcacgaccttactaagaacagaagtgttaaatttcttatcaggcaatgactttcttgtaactaatttatcccaaatacaaggcagtgactgaataacaagtgtatgcagaaaaagcagcagttatgaattctacagcagctttgatcaggggcaaaggacaccaatgtggacttgagagcctaatgttttcttatgaaagatcatcttagctaagaaacttgaataaagaccattgtttcctcaactatttactgcaacagctttctggtctccagtgctccagcctcacccgttccaccatcagtctccaaactgttgtcagagagctctttctaaaactcaaatctgattattctctccccagcttaaaaccttctgttgccttttttttttttttttttttttttttggtaataatgtctaaatttcttaacctggattaccaggtctttattataacacctggtccttgctactccttcagcttcaacccttgcttatacacctgacatcatcctcatcatatttcaaggctcagttcaaatgtcacctccagaaatcctttgctgacttctccatactcaggtaccactggaatgttcctctattacagtattactgttattacagtaatataagcatgtttgtgcactataccagaagttactacaagagagctaagttctttttattcatcttcatatccccaaccagcaccttgtagataaagcacatggtctatctctattaattgtacccattaatgattagcagttgagaattccacaagaagctctccattttcctccctaaaaaaaacagcctgtacaaaggattcaaatgacatagcatgagcaaaatcacaaatatctaaatgtagcaacttctaaaagaaaaaaatctgtatgactgagaagggtagatacagctctcatgatctgggaattggatggctcaattccagccacagatctgttacacgtcttcaagaaaattatgcagtctccctatgactattttttcttcttataaaagaatgagattgctatggtttcttcctgctcagaaatctaggactcgctcttacgttgacatctacccttccatcaggcattcgtacacagcatgcacactgctggcatgtaggctatactaggccatgggggaaattagtagcagatggtaccaaagttctaggtcaaagtgtatttactgtcatcccagaacaaatatgatttcttttcattaaagtatatgaaatatacattatccttatttgtacaactataccatcttacatatctggggtccttttctatctttcaaatgctttcagagaccagtaattcttacaacaaccttgtgaggtaagcaagaaagtagtattatctcttcttactaaaaaggaaattgaggttcagagacacaacaagatgataaaaacaccttccttacatgcctcaagcttgctcctgcttctagttttatgttgcagttcaggtccctacgtcttctcagtgttgttcagaatcactaagatgagctttagtgcattacatgaaattctaaggtaaacaacaacaataacaataatttcctaattatatacacaaatacaaaatataggagcaaacatgggctttatacttcatggtcttcctgcctccgaataaacattcctcaactttgtactccagtcaattgaagccactccactaatgttactgtttaacaatgcaactcagatttcatgatatttcagaatctatcaatttcacacactcagatatagagttgatctgcataattcaagatgttccttttaaaattgatctggaaatcagaagaaagattttttgaaaaatagtcttgctaccaactgaaatgattttaataccaagatggctagtcagtaatgaaaatttttcattcagcagaataaaatcactaagataaataatagaaaatctattaaataaaatatgaaatatttgctcaatgaaaaatctctggtaagacatctgtatgtgaaaacatctaccttgaaacaagacaccttacattcatcaactttgaaagcttatatgagtaggaaaattatatcaaatttccactatgtttaagaattaaagctctattttaaatttaaagatcatcttatgtggtaaaggtaatagaagtcactttcatcattacttccataatgtgtaaagcaagacgaccctgatagtatgctgtgcagttcaatttactcctacattctgcatacataagagtttccaaacatattataagacaaaactctaaatggaaatccttctgacaaactgcatgttaagtaagccaaatccttccctatttctgtatgaaagcttcttcccaggcttagaaaactcaggtatactcaagaaaatctcaaccatggtacaatttatgttttgaataaaaagcaaacatcaatgctggtactgggaacatggcacattaaagctgaaaccataaactagcaacaatctccagacaggctttcagatcagcattgatgggataaagttacatttgagtagacgcatatgaataacctgaaatgacagacaaatttcagtttgaaggtaactttagaagacatttcttgacatgtcatttattctgtctgaccaggaaggaataattcttataattcaagaacaatctccatagattttcaatttctaatctcctaactcatactttaagatgtttttctcatgctcctggagctgacaggctgtaagaacatgatacatggatcctgcctccattttatctgtgctaaatacttctgccattctattttatagagctaattatttttactatccctgactagttttaattgatacaaattgggaatcattctctccagattattgtagaaagttaaaatatagctttattcatcattattcaaactgaacaagacttgacaatgtttcagttaaaacctactgttcataaatgtcagacaaatgaaatttttaggcatgtctgtatcctgacttataacctaagaatacaaattattttctcactgaccattttaatataatgatatactttcagtttgccagcatgcaaattctactcttataaaagtctacatttatacgaaaaaaacacttctgcctaaacaaaaatactttgttacctcatttcatactgaaatataataaatatgttctgaagaattcaaataaatatttaacttaactaaacatgaaataaaataaatgtttaccatcttttactaggactattacacttaccttaaaattagtagtatgagtcttacctttttctggacttaagtttttatacacttcaaggtctgccattaaatttaatactattacacattattggcaagagcagtacaatttctctctaaaggcaaagccttttcctgatacacatttccaaaaagggtggggggaaaaaaggcaaagaaatccttagcagcccccagaacttggctcatgctgccctttatggcatgatgagatcttcacaattcaggctttatagtgtggagaaaataaatccatgagatatgattatagaactttgtcccaaagtgaaaagcacagccagataagcacgctggaagcatct

SEQ ID NO: 1375 - DNA, 196435 bp, Homo sapiens; identical to SEQ ID NO: 1374

SEQ ID NO: 1376 - DNA, 224327 bp, Homo sapiens
gtttaaaaatgtgttttaattatattttcatgaattccaggaagaacatcattgcagttaatgttacaaaaaaaaaaaacaaagagggacatctgaacatgcaataaaaaagtgaattcacagtgaaaataatgcatgtcagtactaaaatagagttgcttggttccctgaaggaaaagggtttcttctaattatctgttcacttggattttattatgagaaaatattctgtgaaagctttggggaagttttcaatttgtgctactattatcattagagtctgatggaagtccctcattctgaaagccgttgttcgcagtctgtaattcaatcagaaaattcaaaagtacaacaggtagtttggcaactcgcttcttgttacatacaaagccattagcaaaaatatgtaacaaaatttatgtaaaacaaacaattttgtccttatgtacaaaagacagccttcttcctcacaccctcacggcctattccaaaaagtgggaagggcatggggagcagctatccatcccctttcaactctcattatgggtgggataagaacatcctaaaaggcaaggtaactattttaaagtttttaaaactgagttataaaaatgcatctgggcttctgaacaaagagggaaacataggaaaaatgataacagattaaagtaaggaattcatccctttgtcgtttgcaaagtctcttaatcaactcaacagttagagagtaaaaatgactacatttgtgactgcaatctgaggacacagtaaaggacatcttggtgaaacacacacacattataacccgagctgctgaggagtttcacatctagggcatgcacatatttcatactgatacagtttacaacaactcaagggagaaagatcataataggtacatgggaaatgtcaccaaatctatatacaaacgcattaacagggagaacacatgaagtcaaagggagacccaaatacaagtttaaaaatacatttgaaaatcattccaaagccaaggaacttatttactgaaaactctgacattctacagaataccttgaaaaccttaagaatgcagttttaaataattcacagtctcaaaagaaaataaatttctggtttatcatcactgcttggctcagtctgcaaaacagaattatctgaacaaaactggtcaacgtggccatagtgaagagccgtgcatgccccctctgggatgccccggccttcaaggccaccccctttcgtgttcttcaggtagcctgcgatgtaggagccggtggagtggcgattcactgcaggggtgggtgctgagggtttgtttctaagaaccactcctgccccattgctggggtttggaactttctgcttgttggcttcctgtttctccttggcacgactagcaatattgcgcactctgctctgacttctggatgacaacttcctgaccagtgcccgggggagctgattggcatcctgctttgaatatagcacttggcagttgtcttcctggtcaaaggacacaagcttccgaagctgctcggtcagggcatctataggctctaacgactttgtcttcacagtcacgcccttcttgtctctaatgccagttgtaacaaaactcttactaatacactggtacttgctctcaaaattgcaggcaatgtcctctgatgttaagtcccccagacttttggatttgcaaggactaggcagtttcagagcaggcaaaggaagatgtgccaactgcttgggtacagggacatgcatatcttgagcactagattgctggggcacacaggtctggaacatttttgcatctgaatctgagaaatgattatgcacaaagccagcaccctgataggctagataagaaatactttgagttttgacatcttgaatattgttgaatatttcagggacagaagggcggagggtctctttacagtagccgtttctcaaacctctttgaaagtgttctaccacaccctgattgtacttgagttttaaaggagaagcaagttgacttgtgccctctctcctatattcacaggttgttagagaaagattttctgattctccatcaatttccacaaggctgctctccccagaattgaaacagagagtgggatcagctattacatcctccagggtcaaatcaggggaagaggcagggctgcagctcttcagtgtttcccagtcttctcccttggtaggactttttggtaaccagccacgagaagtattaggggatccaggcaggttgctttctaaggccgctgtcttggccttactagaaaggtcatcatctggtttggttttagagatgggagtgcaggtagtttcataaactgtgttcgttgcatgtttggtggtctcagaactcgagagtgctatcagctccggagatgagcacaggaaggaagacttggattttcccttgcaaaaaccatgcttgatgggcatttttaggcccaggctaggcaagggacaatggcctgacatcacactggtattatgaagatgagaaacaactgtgagagcctgattgttggtctcatcaaactggccaatcagggctgagatggaactgcccggctcattctcatttgttaaagtgacattgtcaataagatgggaaattacactctcctgcagaattgcagttgaatgtaggtcaggtatgtcagaacagagcatggagacgtctgacaaagaaaaggatgttgcagctcggcccttacccctattaccttccaggttcttaatttctaggttgctatgagaaaggacgcttcctgacaagatgcttttcccttccacaaagtcctcaggattacccttttccttgattttcacaccatgcagatcttgtgtggggttaactacaggatcgggagccaaatgctgctttggggagagagacttgctgggacaggggttttcctggcaattgcttgtggcatttgatgtggttctcccacccctaggacttgacatgcccagctgttctcctgtgactgacatgtgggcagtagatacaatggtgtccccttggctggtatctttgtggagcagagcactggaggaggatgataactttttgttgaaatttagaaaatgtggatcttttatacttgctttcccttttcttctgccatctttatcttctgctgaaggagacaaacaatattttaggtgacatctatcactttatgtaggacctgcaaacactcatgttgtcttcggacagacaaatggagaatgtaaatctgttacactgtgacagaatataattatggattgcataggtttgcaacaaagtgtctgtgtgatgaataaatggtaaaatatatttataggaatttcactggagcttccctttgaatatctattacatctgctaaggatgtaatattcattgtcaaaaaaatgtcaatgagttaccatacttttacagtgaggattaccttaagttgtttcctattcagatttgtactacacagaagcatggcaatagaaacagaacaagacagctctgttaaacaaagcattgtggtacctgtaagcaagatactataagctttcaaagttatacatgtattagttaaaacaaaaaaagaagaaaagaagaaaaacataataatatcattttcaaaacattttgggagcatatttaatttagtcaattaatttctaaaataattggaaggtgcaataaatgcattaaaatatcaatatctgttgagttaaaatgtaaagataaaaattggtcatcaattccatgtcattgctaatatctaattttttgttaatcatatatttctttttaatacacaaatttcatattgcatccttccctaaaagtggcagtaagttgtcaggcacagtaaaggaaaaccataaaaacacaattcacagtaatttgggatagcccatcatggttagtatactgctaggagagtatgaggtattcaattcttcatcagattattttaataatttaatgctttcagagtcatgatatataagaaaaagaacttgttcaacttgttattaaatagtttccaaactaaaaatattcatcataaaaattttgaaaacctcaaaaaattataaagaaaaaattaaataccatatgatgttaccactgagacagccactgtaagattttgcagaggaacagaataatatatagaattttgtagtctgctttttctgtacttaatgcaacataactatgtattgttttatatttaccgaaactttaatacacatgactaatttatataactgttttttaaaagtagacaagaaacattacctcaaaattgctttctaactcaccttaatggtattaacatcttaactgtggcattaacagatagaaccaatttctactgaatatagctttatttttcccaaagatggggttttaaaatacattttaaggcacatgttttatctcttctctgacactgctcttagcaaaatttcaagcttttaaatgttctttttctccttcaaataaaccactgaagaatatcttgtaacaaaaatcaatacaagtaaaatggtgtttgtgggaaaagagagcactgaaattagaccatttgataaaagttaaaagaataattttgctaaaggaaatcagtaccacattttacttgtctgagatgattctgatttaattaaaacatatttgttgcagagatatcaaatgcacacagttttggcgcttaaatttacccccagataggatgggttgggagtcaccaacatcagtcaaaaattctctggcacactgcaaggcggtcttcactctttattgagctcctgatatgagtcaatgatacactcaaattaaggaaaaagacaggcagcacctggtccctatgcttgtggagcccacaaccgtgctgaagctgcaggcacacctctatctctgtcagcatccaaggatcagggaagtgaggccacaggaaaacactgcctgagccacatcttgagaaaaaagatttgcctgtttttgaaaaaggtggctcgtttttaacatctggctttctttctccataaacatttccaatcatggaaatgtgttatatggtaagaaaagtaatacaactatattcaccctcaaaacaaatcagtaaatatggcactcatttggaaaatcaatatttcaaatcctattttgcaggtttcatcttcctctctgtgccatcacacctaatggctcccctatccctcactgtcaatttcagatgttgatattatgaagctcttggtgaggaggaaatggatctacctggcccccaaagtttaaaatcttctggtctggaagatcacattacaaagtatttatttttcagtatattttactttgactacagaatgtcagccacttcataatggtaaacagggactgacatgcagcctagaagggtttattctcagagaaacttaaagcatcttacctagagagttttcttttccttcaatgtcttttgctgtttcagatacaggcagcgacaaagctcccagaaggtttctgtcaacaggcatagagacagggcgtgcttgcaaactgcgtgtggtcctcctcagcacgccatcttgatctcttgtggcctcggacacagaatcctttatctccaccatttcttggaagcccattttgctctttttcctgcctttggctggggcgctagctgtgcgtcgcagaattctatctccaatggatcgcttccgtacataatgggaattgttttctgaagaactgtgcctaggattcttattgaacagtcccttcagaccctggagttgtctgttctgaagacacaaaagaaccaaccacaagttaagcaaatgccatcacatcaacaacttgccttgaaaatgacagctccatgaaaaatgaatataaaccaaaatcgtacagccattgaaatatattcaaaccaagaaagcagcagctcacagcatgtttgcacaacttcatgcacatcttatcaaccttactttgcaaggacttcagccttccattcttacatcaagctttcccagaagtttcctacccagagatgacaaagtggtaggaaaagtctccacagctcatagactgctatgaacttcaggcgccttaaagcaacagatgcatgtttcaaagtggtaagcaggaagatggagtgatatgaaaaagcatgctgccataaccacttaaaaagaaatatgccagccagaacaaagcaccatgctgagaaactacctttgtagctcctagaaagtgcaatatagtataactggggttgagtattaaagggctccactgtaaaggaaaaaaacaaaacacaacaaaacacaattggggctcattgaagagggtgtcacaagtaaacacaaaagaaaaaatgcatacatgtctataaaccctttctcttagttttggggatttttagtcttatgctcattcattgttcaaccaatatccactacactgtgatgtgtggatcccaacccgaacacatcttgaaaggaataaagagtatgactcataaatggacatttatttagcagagaagatggaggtgatatagaacactttcagattttaatttatttctggctcaagtttgttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgccggccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggccctggctcaagttttaaacaaattcagaatgtaattgtttccctcaatgtgataaatgctagagataatctgtagttaacctgggattcctagaattcaagaatcatttttgaattatttacatttgtgtctacttagatgagaggcaagaccccaacaagcagcacaaacagaaatccaggactaaacacaggaagttatggtataaaacttcacgagtcttagaaattaggatccttacccccacctccacgcccttgctgacagatatgaaaataaactttacactccctaattcatgctgaaatggtccattccttattagttaggttgtagtcataataacattaatattagccaacatttctgagcatttactgcgtaccaggcagctttctaaggataagatatatatttatttatgagataggtattatttttatcccacattcacagatgaggaagcttccagctatacagattttctggcaaagagcacgggacatttctaggccccattcaatgctttaacagtccctccaaatcccgtgtggtcctgaaaattcatactggtaaccaagtccccaattacttgacatgaccagaggacaacctattgatttgtaaacctcaaatgagttctataaccaagacaacagcatcaggaaagaactagaatgcatttacatggtcgccttttcagtcctataggtagctttaaaatccattcacaatttttagattttcagttaaaaacattggtaccaaatgaatgtagcctgcctagaagtcgctgggatcacagcccagttagtacaggtaactcatcaaccatctgagacactgcatttcccactgaggccagttgagtctttttaaggattaaaataaaactcaacatttaactatatcttcattgttttagcccaacagattactgcctgagagaataatagttttctcaattctattaagcccagagagggcccctgtatagaagaaatgagtacacaccttaaatagtgaaaagagtacaggtggatcaggacatgactggaatagcagactgggcttgctgggcctccttagagtttttggttcaagaacagtttgtcaaaatttacattcctattatgcaattaatcagtagcattgttaaggaccatattaatgtatatgactttaaatcctatgatctttctcacctttccatagatttcattgatggttatgtgtacaaatatggatgcttctgtcagtccttccaaatagacatgccggtagcctgataaaaggaaagagagtcgtttctttttagttgaacttgcatttggctttctcatgggtgcaacaaaattaagtatctgacttgactgtagttctttttttttttgagacagagtgttgctctgttgcccaggctggaatgcagtggcatgatcttggctcactgcaaaccccgcctcctgggttcaagcaattctcctgcctcggcttcccgaatagctgggattacaggcatgcaccaccacacccggctaattttttatttttagtagggacggggtttctccatgttggtcaggctggtctcgaactcctgaccttaggtgatcctcccacctcggcctcccagagtgctgggattacaggtgtgagccactgcacccagcccaactatactcctttacattttacaaagtttgttaaaagtcacatttattacatgacacatattttatcacgtatgctattatgtaagtaacatatcatatattacgtcttccaaataaaaaggaatggtcagtctagagagaaaaggccagctcatacctaccaggcactaagctgctgaaggtcacagttctttgtccaacaaagtctcgtccaatgggatcgtgatcccacacaaggaaccgaaccaaagctatttctggcatgtgtactgtaaatgtcagtgtttcttcccacacagggttaaatcctcagagaaataggaaaagaaaaatcagaaaagcaaaggacttggctgaaaatgagttggcagcaacatctgcaaagcagacggtgaaaattgcttgcaatggttattaaactcatgaagacaactaagccacactcaaggatgccttactggaataaagcctcgaaatttacccccttgctagaaaataattggtaagaaaattgcctgtaaattatcacatcaaatctattaatctttgatgcctaactgtattgtagagaagctctttagtattcagaatgcttcaataagttaaaaaattatctatagtagtgatctaagaataatgttttagacaaaacaataaagaatgatatcctctcccaacagaattatgcttctcatgcaccaaagatcctgctgctgtaataaccaccaacaaccattttataaggtgcatttgcaggtttcaactcctattgtacatacatcctcttatttcttatagcaattctctaagttttttttagaggatgtttagagtttttagagtagagcagggttttggtttttgtttctttctaattaaaaaatatatattactgactttcaaaaatatattactttcaaaaactgtacaagtaacactcatcttttaaagtagggaatatcagtatttataagacattttgtagttgagaaaattgatgttcatagacaataatgtgcccaaggccacacaaggccttatagttagtgacagggtcaaattagaccatgcactattgattcccagtagcttctcacgaagcaagaccttactgcatgaatgatggcatattttcacagctactgaaaaataagttaataaggtatataattcacctcaaatactaaaatgcaaaaatacatttacttggtaaaattctctccaataaaataactataaaagttgttaaaaattcaagtactccataagtttctgtttttcttcctttctaaaaatgaaaataagtgtttaaaaatgtatgcatttcggaggtatcaaccacttaaccctatcaaaaagcctcgagctaatgaaataattatgagctgaaaaatcactgagatacctctcttgaatcagagaagatctttttgttgacttagtgatgacctctcaattatttctgagactaaaaaaagaaagaagaatctattgaacatcggtgggaaaatgcaatttgagaaggtttctttctgtgtacatgtttttcctaagttataggtttgccctactctgaaactgtagtgttccttcagggactccttgtgaacccttaatttctcaaattaatgattgtgcttcaaatgtattttacagtattaatcacaagagattgaggaaaaataggtatacaataatgtttgtgaaatgtatgaacaaacaaattttaaaagattacaaataaaaagacatgaggcttgggtaaagaaaaatttctttatattatggcgaaaatataagaagaatgctgcccctccaatcgtatgtaaatattcaagaagtaaactcgccagactatattgtgcttgcctttagagttttacatgctccagaaaaagtgagaaattatcaagacacataggcttcacaaatgagagctttgagaaaacgcatgtcataaaaatacaatataaacatataatggaggcatttcctcagtgaatttttaacccaattctttaaaatatcatttactctttttactagaaaaaaaatttcctttaaaagcaaaagtctagagagcctagattacaataccataaaaataagccacgcatcaattccacagttacttagttttatgtgttgaaaagcttttaacataaactcagatgggagttacggattttagagatttcttgctcttctacatagacactttttttagtgtaaattctatttctagaccatcttcattaaaaagtgaacacagattaccatcttaccattgtcatctaccacacgggtttgatctttacaacaatctactggcaatccaataatttcaacttcaacaaaagggtcaatgatctattaagtaaagagaaagtactattacaaataacatatttctatacatatgttaattaatctgagaatattggccaaaatgtctacatttcgacagcaactgattttacaaggtgcttagtaagaaaaagaaatggtactaggtgtggtggattcagatatatgagacaagtataaaaaatattaaattactgtttgctagtatttattaacgccaacaactttacccactgaacctacaactttagttcagggcaaataccaaacagaactgagatgttttgcccatgcacaaatgctgagagcagctgtatctataatagtcaaacactggaaacaacctaaatttctatcatgagtaggatggataattgtggaatatacgttttttgttttttgttattttgttttttgagatagggtcttactctgtagctcaggtcggagtgcagtggcatgatcttagctcatggcagcctccacctcccaggtttaagccatcctcccacctcagcctcccgagtagctgggactataggattgtgcaccacacctggctaattttggtaatttttgtagagatggggttttgccatgttgtccaggctggtctcaaactcctgagctcaggcaatctgcccacctcagcctctcaaagtgctgggattataaatgtgagccaccgtgcctggtcagaagtatgtgttcaatgaatactctcaacaatgagaaaagaataaagttctcctatataacataacgttgagcaagccagacataaaagagtacctactctaagagtccatttatataaagtttaggaatagacaaaatttgtctgctgtgataggggttggtgtttgctatgagaggcagtggggagggtagatattgactgggaaggtggacaggagccttctagggattctggatatactctgccttgatctgggtggcataataattaatcaagctatgcatgtttgattcttatactttaattcccatcctctcctctagggggaaatatcttgtattgttggtcatctgtagactctcctttctggtaccagttctgggcgacgaacaatgaaggaataaaacccaaagaatctagaaagagctgacctaagaaagtctaaagcagagaaagtagacttcttaaagcatttatggcggtaccaaattgtagagctctgtgatttccttccttaagatccaaaaatgatggtttaataggcgggagtgacaaagaacctgaagtaatggatcagctctgagaggaagggcatgagcataggagaagctgctatatagcgagaaaacagaagccaagaaggtataatggaaacaatgggctaagagctctggaaagaaaaaagactgtggccgcagatgaagacattttaaaatcacgcgacacaggtacagcagatgataataagaatcagcacatggccaaggagcaggtggctgatgtgcagcagggaggagcattgcaggaggacaggaatgtgaggttatattattaacggaacattgcctttctaggttaagatatactcttaggtgttgttctgttaataatataattgtctttgcactccaattttagcaatgctagtgtcaaccttaaattgtgaattcaattgtgtgctcttatgccttcaaaatagatgatggacagcagtacagcaagaactgtgtgacttaccaataaatcagttaatgtctgataagctgaggtcagtgctcagttatgaacacacatacatctctgaagacatttcggataaaatgtaaatgcactaagataatcacataattaaccacttagacacgtagtcataggcaacttacctcgcctcgatctccaaacatggagtctggaggtttggggagttgctgtccactgataactttcaggatgagctgctttttggggttggcaggaagagggtcaccagagaaagggttgaaagtacctaggccaagtaaagtataagttggtaacataagaagaaacacacacgcatgcacagcttaagcttgtaaacaaagaaacaaacaaacaaaaacaaatgctgaattacatgatcacataactatcagtgtggcatagctgtggttttcattagaaaccatgttgccaaaggccagtggagtgggccaacttaaagcaagtgtttgcaatgcaatgatcaactgtggaatgaaggaagagaagcattttatttgaacaccaacagtgtaaaaagaagaacaattatgtcagattcaaataattttctaacctaaactatctcaggcatgagtgaatataacaaacagaaagaagacttgaaattaagtaaacagcagagcaagaaaatgtgcaaagtgtaaaatcttgaagataatcctgtcaacaacttttttatctgaattgttatatatgtaatttggaaattttaaaaataattttaatgagcagaaccaaaagaaagtgttgtttgatctaacacattatcctttttttgctttgttttgtttcttttgagatggagtctcactctgtcacccaggctggagtgcagtggtgtgatcttggctcactgcaacctctgcctcctgggttccagcgattctcctacctcaacttcccaagtagctgggactacaggcacgcaccactatgcccagctaattctgattttcagtagagacggcgttttaccatgttggccaggctggtctcaaactcctgacctcaggtgatccgcccaccttgacctcacaaagtgctggaattacaggcgtcagcccccatgcccagcctatcctttctcttttgttagcactgttttgtaattggactacactgagtaaaagggcttgataaaattgtttcaggtggaattgaagcttcccagcaggtcacagactcacattacttaagatagtttctgaaagattgggctcagaccttaaaaagcagtccagcttatatggggcactggatttcaagtgataacccaatgctatccatgtccctctttcacacacgacctctcaagataacattctaaacatcacggctaaccaaatattaagtagtggtgacaagaattctaattcacattcaaacaccttaacctatctttttgaaaaaaaaaagttgaaaaactctggggtatcacactttctaaacagcttccttaataaaggttgcctgcatttagactatgaaattaacacacacctgcatttatgactatgaaattaatacacacctttgcacatttgctggggtttgaggacatagccacaattgccatttgccttgaatttggctcggtttaactgcatcattcgtccttcagattgataattcagtgccactgtgcaagttgaaagtgggagagaattaggcaagatggtggcatagtgagaatatacagagaaccactccttcccaaggaatacacacctagctggcagcctgcgttccagtaggggagagggttgaagttactggaatcaatgcggtaggcagaggggtaaatcctcgtgagttgcttttgattataaatcatgaactgctctgatttttgctgaacaacctgatgtgctcttgtttcactgaatgataacacatttcctgtggttcctggcagtttttaatcgagaaaaaaggaagtgagaactacagcaaagaaaacaccacgcacagaagactttataataatgtcagattataccaatagcaaaaagcagagcactagagagtggattcaaccagagtagaggcagctcctcaacagaaaagacccataacattccattcatagggttcttttgccattttgaggccaaatcagagctgtgtgtcttgctcaagtagctgtctatttctgggtcccctgttctccctaagaattcaatcataccgctaatttatgcctatctggctagcatgaaaagaacaggtagaaaaaataacttaaacagaatatatttgccaaatatatagacaaccatggataaataaaactagatagcttcttcctgataacaggaagacattcattgaaggcactcatctaaaaggcacacaagtaaaacatgtattactagtaacatccaggatccaagaaaataaaggaaaatgaacaattataaaaataaaaagttgagttttaaagttgctttgaatagaactatggaacaagtcaaaacctatttgggagaaaggaataataatggagaaaaagaggtcaaaagcattataaaggaataaaagttttaagaacaaagacagacattcacctagccacgcatataaactatggaacaaagtaaaggaaggtaaaagtacatgaagcctgtactaaagtttctgccagcacaatcatcaggaggggtcaatctagactcacagaagctgcaaatttgggggtcataatggagtaaagctccaaacatttaatattccactcttgtctccaatcccaccttttgtaccatatctacaaagcccccgctatttccactccttcaccaagaacccataccctatccccaaaatggccgcccatatgtcatttgaacatgctggaaaagaccagcccagataaaaagacccaaagttacccagaatctcattcttattcagccctaataagctgagtgtgtctgagcccagacagagagatgtggtccatgaaaccaaagagttgaactgtatatggtctcgctttgccagctgggcctgagtcatatctagactctgcatgtttattaacacacagtttcccagggcccctgtggtcctcagggttgtacacccttagatgttagatgctgcccaactgacaatgatactcccgagttagaagagtcaggaatacaaactgtggcaaagaaatgagaggattacagtttttaatgtgatgatgtttctagtttagaccctttccttaaagatacatgttcatatattttttattggcataacctattaacacagtttacatatctcaagcatactaatattgaacttaattgcagattttgatgagggatgttttaaacattataggagaaaatatctttttgacaagcctaattcagatagaataggactataatcactactactgttttgtctgtctctctacataaatatgcacatcacaatatcattgatacgaccttgctaattaggcacatatcaattagtatattaatagagttgagttgtatcacattaggataagccatgcattcattatctagttttcattttgtggctggcaaaaaaattaaaaagacaaaaacagctgaagttccagagctaaatagtactcaagattaatttccattaagttaataggattatgttttccaagccatttattggaaatttttattccctaaaccaaatatacctttaacttaatgcaatcattccctgagtttatttttgagctaagggcaattgttgtaagagtgtgttgctcagttgctgagaatcctacaggttctcatgctctcacatgtgaaattcatttaaatcttgtataattgttaccatttgaagaaggaatcaaggccaaagggaagaaatctttctgcaaatagaaaaagatacatttgtggagtgggggctgggcagggggagatgggagggaagaatcctggaggtttgtgaggacacaatgttgttttcccttcactaaaacttgttgagaaatttggaggtcctgatttacatttcggttccactaaaattaaaattagatgaaaagccacatgacagtaggttttttttctgtaagcattcagtaactaaatgaaatagaagataaaggagacaagagtaactagcaggaaagccaaggatatgaatagatgtgactagaatttctcagctccgtgtggcaactgataggtaaaaaacagtgacggagagaatgctactgagatttctgctctttttgttaaaacttcaatctggattaagctattttcacccaagtcaaaactttcattgagaaaatatagggcttttcaaggtgtgattttagccaattaatttcttcttttggtcattcgcatttggaatggccatctgtgacctggtcctcaagccgggcctggacttcacagttcaagtgttgcaggaagatcttgccctgaggcacttgtctttgtatagtaataaagtcctctttggccctgtgggaactttctctggcctctggtcaatcaggcaaccacagtaatcagtagaaccctccatgtgaactcaacactatagcagcagtgagtttcctgacactcaaattggtttctacatagtcccaaaaatgtgtgttgataatgggattaacaaaaattcattaacaattgaaaaagaaaggtcaagaatgtttattcagagcagaatgagaaaactctccatccttaccgtcatccacaatgtcctgagcggccacggagtttgtgtacacaaccaaatcagagagttctcggcagagcttcatggttttccttcggcgacccaatctgtgaagtacccacagaggatgcatgacattttggagttgaaagaggtttgggttcttggttatcccactttccttatttaagacaatgatttaatagggaatacctgccccaggtcctaagggagccaggattggcacccaagtgtgcttcctagttcagtgctctttccaccacaaaatcctactacagtagtccccccttatcctcactttccctttccagagtttcatttgcccatagttaaccatggtctaaaaatattaagtggaaatttcagaaataaacaattcatgagattttttttctttttttgagacagagtctctctctgttgcccaagctgcagtgcagtggcgcattcttggttcactgcaacctctgcctcccaggttcaagtgattctcctgcctcagcctcccgagtagctgggactacaggtgcacaccaccacgccagctaattttttgtaattttagcagtgaaagggtttcaccatgttggccaggctggtctcaaactcctgacctcaagtgatccacctgcattggcctcccaaaatgctaggattacagacgcaagccacagcacctggccatgagttttaaattgtatgccattcttagtagcatgatgaaatcttgtgaggtcctgctccgtcccactctggacatgagtcatccctttgtccagcatatccatgatgtatgtgtcatctggtagacatcttcttatgtgactgactgtggagtggaggttttgcagtgcttatgttcaagtaactcttattttacttaataatggccctaaagtgcgggagtagtaatgctggcaattcagatatgccaaagagatgctgcaaagcacttccttgaagtgaaaaggtgaaaatgtttgacttaataaggaaagagaaaaacaacatatatatagggttcactaccatctgtggtttcaggcatccactgcagtcatttctcatgatgacgtggggactattgtaatgtggttttattcactgctctgccaggaatcacagcctcttctcatgcatttgtgagttctgctgtggaaggctggattcccactgtgacccagttagggagtaacaccagagttcatcagggaactacatggcctttgcagggaggagaccagggctaaaatggaacagaaacactgcatagtgggtagcgggccacaagaattatacacctaaagggaaatatgccaaatttccatagtgattattggagagatgtaattacaaaggatgtttactttcttctttatactttttctatattctctagctttcttaaaacaaacattcattactttatctagtgctgtttttatcttagatattttaatagttttctctctcctacaaaccactcataggatctcctctgcaaccttacaaattgtaccaccactctcttctgcagtcaagtcctccacagaccatcacattcccctcacacacacactttttcttatgggaaacaactaccaaaaacaaacctaaactttagtgttcaattaaactttatacttaagctccaacagaatatctatacataaaatagtaactaattaggaagggcagaggagatgtatgtggtccgtactctaggcaacagaaataacatgtgttattgtctgccttttcggttataagtatcatagtgggtgtgaagaggtattccattgtagttttgatttatatctccctaatgtccaacaatgttgagcacattttcatgtgtttattggccatttgtatatcttctttttgtgaggtttcttttcgatagttagatgttcccctataggagaaaagtgggtaagtgaggggaatgtgatggtctgctgagaactttactgtggtaaaaatcaatagaaaaaagaacgcatgttccttctttaccatataattaggaaattctatagccactggtgaaaatctgattttgtgaaggctaatgattataaatcggtgtgaagtcatgcctagaaattataagtaaaactctaagacattccgtgatatggagaaattctacagaaaattaactctttttattcctcatcctagaggtgcattaggttactaaagtcccaaaaggacatcatcatagatgctcaggccctgatatctattatgggaaaatctatagttgacactaagcagcatgcaaaatgatttcatgtgataactgtattgatgtctcctttgcacacattaagattattgtagctttcctcaaacactgccttttccctggctatatgtgtcagagttaagcctttctcaaacttacatatgacaacagtcacagcagaagtctcccagcaggtgatcctattattttctctttatcctttactgtaactatatattcaattttctgttccctagagtagggaccacacacatctcctctgcccttctaattagttactattttatgtatacatattctgttggagctcaaatataaagtttaattgaacactaaagttttattcctacagggcttctatgcttctaatttcaaataatttcatttttcaataaaggcaaaagtgtgtatatgtatccatatctatctaatatatataatttatatttctttgtgaaagttatggtataaataaactgccaggaactcctgtaatgaatcatgtgtcacgatttggattctgaaaatatggtcatgttacttatcataaatactactggcaataaagcaaacaaacaaacaaaaaagaactttttttgaatacttatttaatcaggccagggcttacagggctaattagtttaattcctttaatccttacaatgactctaagagacagatacaatgaggagccaaacttgtcgcatgttaaagttggtaactggaggaacaagaatttgaaatctggctgatttcagattcctggctcctaacatgggcttagcatccatcttctttagtctcttgtgacggtctttgtattagttcatgtgctccctccctcttctctgaagataccttttacttgacaactgctgcagctaacatttataaagagctcattatgtgccaggcacagagctgagttccctacataaattatcatttcatatccagctgttcttcacatgttcgacagcacagaatactttccttgtgatccaattctctagacatgtacaagaaaaatgactaagctgacaaggatggaggggcctcaggagtgtgagtaggaaacatggagatgctttcttacctgtacagctggccaccctccttgccagtactctgctgtgtgtcttcctcatcatcagtactgtaagatttagaccgtgattttgtagttttctgccagaaaaatcaaaacaaacttaacaaactcattgtatcaagtatatttacaacatgcagagaatgagctgggctttaaaatgcacatgtgcacaaacataacttggagggagaaaatgaccaaatattgcagcttgcttcagcattaataacaagcctatctaaggccataattatattaaaatattaatacaaaactgagagtttcatgctcagaaactgacttcggagacacataaagttgatgtatcagaaagactttattagtcatgcattttgaaggtttctactaggggtagagtcaaagttgcagtatctatgtaaatgattataagggacaaaatgcccttttgtataggaagctcactattaataaactgtaaaaggcacatttggttttttaagaaaggacatgtagtaacttttaaaaaaataaataactaccatttctgcttttgatcagtatgcactcaaatgatcatctaaatcaaatttcccttttgagattttgacccattttcatttctagcagcaggaaaaaaaattgctacccacagaatacaggctgaaaggctccaggtctaatctggtgtcttttggacagatcagctgtttcacaataaaacttttttgggatggtatgatttcatccccaccaatttggagatagtcccagtatttaggcaacacagacctcaacaatacaaatgatgggccgggcgtggtggctcgcgcctgtaatcccagcactttggggggctgaggtgggtggatcacctgaggtcacaagttcaagaccagcctggccaaaaaatggtgaaacctcatctctactaaaaatacaaaaattagctgggcgtggtggcaggtgcctataatcccagctacttgggaggtggaggcagaagaatcgcttgaacccaggaggtggaggttgcagcgagccgagatcccaccattgtactccagcctggacaacaagagcaaaactccatctctaaataaataaataaacaatacaaatgatggggaaggaccaccccaataattgccgaaaaccttgccatcgaaaatgcagtgtctacaaacaaaggtaagatgtttagacagagaaccctggacatcaggaatgtggcttagaaagggaaagggtctccatccccaaattaccataggaccatgccaccttctagattttctcatgcttctcctaaacccccccaaaaatcaaacaagctacactgttggcataaacacactcaacttctctctatttcagtgacagtaagatgccagtttggtttggaaacttctccggcattatttatgccttgagtacctcagcttgcaggtatggaagccctaccatttgatgatctcatgttccgtctttcaccaggctggtaaactggctaacctcactagcttcctattggatctttagaaagagtgtggcaagaacatctatttcaaaggattattgttgtgatggttaaataaatggcacagaaagtcattctgtaatctatataacattacctttccatttaaaatactgtcaatatttattaaaataatctataaatagtctaatggacaacaatttattcttataacttgaggtatgataaattttagttaggtgaagtactccctaaaacatctactttgaaagactattttaattgtaatgacaagttgcaatccagaaatgaaatattctctaattccacatagttagtaatttgagttatacagtaataaatgtctttttaagaatcatttttactataaaatgcaaaaattagaaataagaaatgaatcaccaatgacagataacattcagagaatgatatattttctggacatacagttttgacacatcttttcatggttatcataccatagaatctacttctcatcttactttttcatttaatgtttcacaggtcgagctcttccgagggatcatcttttaatggctgcatcattgtccattatgtgaatgattcacggattacttacacagtctttggaggtgaacattttggttgttttcaatattttgtgataatgactaatctgactagcctactaacaaattatctcactgacgggcaggaaattctaaatatgacattccttaaagtagaagaaatggccttacagaaacctcacgtataatgtaaagttctccatctaataattgaattcttatgtaagttttactgacaaacagctaatctgtccagaagacaccagattagtgtaacatcttttttcactattttattgaagtgtaacatacagttgggacagtacactggtcataagtgtgcaggttgatgtctttcacaaatcaaaaccacacatacgacgaaatagaatattatctgtcccccaaaagccttctgatcctccaattctgtcattcctttctctgtgaaggtaataactattctgatgtctactctatagggtttcttttgcctggttttgaatttaatattgatggaataaaactgtatgtactctcttgggtctggtttattttgctcaacatcatgtttataaagatcatattattgcatatagttgtaattttgtcattttcttagttgttaactattctcttatatgaatacaccacaatttttactcattctattatcaatggacatttgtactttttcctctttgtactattaccaatctcaatataagtattgttacttctgtcttttttttttttttctgtagatggagtttcactcttgttgcccaggctggagtgcagtggtgcaatctcgcctcactgcaacctctgcctcctgggttcaagcagttctcatgccttagcctcctgagtagctgggattacaggcacacaccaccacacctggctaatttttgtatttttagtagagacagtgtttggccatgttggccaggctggttttgaacacctgacctcaggtgatccacccaccaaggcctcccaaagtgctgggattacaggtgtgagccaccacgcctggcctatttctgtcttttgacatatacctaacaatagaactgctaagtcatagtacatagtgcagctttagcagatactgtgaaatagtgggccaaagtacttgcacaaatgtgcacaaccataagtagtgtttgagaattcaactgcttcatcctcactaacatttggttcttgccatcttttaatgttacctgttgtggcgggcatatatggaatcacatagtcattttaaattgtgtttcccagatgactgacgggtgaattccttttctttattagcaatttggatatcttcttttgtgaactgcctgtttaagtgttttgcccatcttttagaaattaagttgcctatctttttattgatttatagaagctatttatatattcaggatagaatatataatacacataccagttttaataacacatacccattatgtattggatatgtatatttaagatgttaaatacagttttttggatatattattggatatatgtattcaaaatattctttcccagtatgcaacttgctttttgatactgttgatgcgtagaagttcttaacttttaaagtagtttaaatatcaatcttttcctttgctgacgtgctggttaagaaatcttcagttattccaaggtcatgatgatattctcctgttatcttccagaatctttaaattaactgaagtatgcatagttattactcttaattcataccttatgttttccaaagttggtcatgagggatcgtccatgtgatttctttccactttcctttacatctggactctgaataaataaaggcataatataactatttatcttctttgcttttgtctttttccttagttctggtggaatagcaagggggccctcttttctcttctgtttgcctctaggtgagaaacaagcagactccactcatttcctcctgctccacactccactaccacaaaggtggctctgcctgccttggaaagggaaatattggcatggagagatggatgccagccaggacgcagcagctgcctgcaccttcccaaagctgaggtcaagggctctcagcagtgtgcaggtgtgctggccctcatggtgcctgttcaccaggctctccacagcacaggatgtgttcttttaaatgttctgagtggggttaagtcattttcagttaagtagggattcagttttggaaaatgaccaaaagtcattagcagccaattctattgaataaagaaagtggatcacattgactaaacagtgctatgtgggattttaaaacattataaataaataaaatccaaggatatctatgagataatagattgtttttgtttaaagtaaaccaagcaaagtttatgtgttcgttgaaataattccctctgtgatgagcactggaaagaggtattgtagcctctgaatttttcctcacataggttaattttccagttagagatactgggccaactctctttcctggagcctatgtctcattaggtaacagaaagtccacctgctaagagagtttaaactcttattcatttgtcatccttaaaaatatgttaggtggttcattactaataacatggtataaggagagaccagtaggccctacctgaccaagactccagctaaacagagaagaagcaggtaaccacataaatggaataaatgtgggtgagaaaaaacagttaaagccaaaaggttgggaaggggatctgtatatgcccatagatgctaatcaaagatgcaagtaggggtaggaagagattgggtggagtccaagaactggttggggaaagagcagttcaaaaaatgctggaggagtaatggtgaggggtttacaaggtgattgatgttaggtaactgttaactgattcatacatgtttattgcttttggagatctattaatgcggatcattaactgttcaaaaactgtggaattaagaaggcagctggatgtgatcatagacatagcactgctctccaagtcagaagacccagttctgccaacaagtagctacatttcctttagcaagcctcttctcttggtccgctttttttttttttttaatctgtgaaatggaccaattaatctgtgagttcctctctatttctagtagggactatgccatttattatccaaaacaggaccttttaagaataaaatgggatacttttaataattatgctgggacaacaggtataaagcacggctgtcacaggcaaattgaggtatatggtcaccctatttagtaggaacctattataccctaaggataatgctaattgcattacatatattctcatttactatgcataaccaaccctgggaataagtataattaaattccaattttacagaaaaggaaagcagaaatacagaaagttagattatatgcccaaagttacaaagcttgttggtgataaaacaggattctgtctagctacaagtcctctctctggcttccttccacttctccaacattttctatcccattctcactctctttttttttttttttttttattatactttaagttttagggtacatgtgcacattgtgcaggttagttacatatgtatacatgtgccatgctggtgcgctgcacccactaacgtgtcaactagcattaagtatatctcccaatgttatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcgtcattttttatggctgcatagtattccatggtgtatatgtgccacattttcttaatccagtctatcattgttggatatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctcttattggtctattcagagattcaacttcttcctgttttagtcttgggagagtgtatgtgtcgaggaatgtatccatttcttctagattttctagtttatttgcgtagaggtgtttgtagtattctcttatggtagtttgcatttctgtgcgatcagtggtgatatcccctttatcattttttattgtgtctatttgattcttctctctttttttctttattagtcttgctagcggtctatcaattttgttgatcctttcaaaaaaccagctcctggattctttgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttagcattatgtaatggccttctttgtctcttttgatctttgttggtttaaagtctgttttatcagagactagaattgcaacccctgcctttttttgttttccattggcttggtggatcttcctccatccttttattttgagcctatgtgtgtctctgcacgtgagatgggtttcctgaatacagcacactgatgggtcttgactgtttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcgtttgagggtaacccgacctttccctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccacatcactttcaggtacaccaatcatacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttgcttttcagctccatcagctcctttaagcacttctctgtattggttattctagttatacattcttctaaattttttcaaagttttcaacttctttgcctttggtttgaatgtcttcccgtagctcagagtaatttgatcgtctgaagccttcttctctcagctcgtcaaaatcattctccatccagctttgttccgttgctggtgaggaactgtgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctgtttgtttgtctgtgccctgcccccagaggtggagcctacagaggcaggcaggcctccttgagttgtggtgggctccacccagttcgagcttccaggctgctttgtttacctaagcaagcctgggcaatggcgggcgcccctcccccagcctcattgccgccttgcagtttgatctcagactgctgtgttagcaatcagcgagattccgtgggcgtaggaccctctgagccaggtgtgggatatagtctcgtggtgcgccgtttcttaagccggtctgaaaagcgcaatattcaggtgggagtgacccgattttccaggtgcgtccgtcacccctttctttgactcggaaagggaactccctgaccccttgcgcttcccaggtgaggcaatgcctcgccctcccattctcactctctttatgtaggaaacagatatctacaaatacctatcaccaactttgacctctccctgagcaccggcacatctttcactgaattattgagtaagacattgtcctaggaacttggcatatacataacgacaagagcaaacaagagagatgcagactctctccctactgggcttgcagtctaatcgtagacacaaaagattacaacacactgtcataagactataatggggaaagcttagggcactgtgggatggcacagggagaccatctacctggatttgaggattaagaacttccaaggggacatgacacaaaagctgaagcctaaaggtgagtacaagttatctatgtgaaatggggaagacgaagtgtactatggccaagaaaacagccaatatgaaagccatgtggtaagagcacggtaccaggaaatgaagaaagtggaggtgtgcacgtgtggactcctacacatgcacactctgtgggtgtcaccgctaggagccagaacagaaaggaaggatcttatgggctattatctctgaatttgagctttatcctccaaactatgaggagccctgagatggttgaagacaggagagtgacatgaccagatgcacatttctgaactatcactatggcagtggtgtgaatgagacattaagcagggcagctgagagcttaggaacttgttaaggttattcaggcagcagcagttcagatataaagaaagcagcagattccagaactcttaagaaccatttcctgtgactactaagttcttccagcctgaaggcaaatttcatttttacttttcttcagagctccgcaggaaaaagacaggacaagtagaaaccagtcctgcactgttaattgacggtccagaaaagtagaagctggagtgacgtgctgcccagagccatactcagcacattctcagctttggatttaaaccgacatatgtatctggcacagagggcctcgtctcaacagtaacttgcctttgcttgcccagtgaaccaaaaccatatttttaaaacatagcagtgttaaaaacctcaaaaataagtaaaaaggagatgagttttgctacactacctctcaaaaatttttggttctcttaccactttacctgatggagaaattgtcattaggatctcttcagtgaaagcaaaagatagaagggcttaatttgtttcttccaaaatatccaagccttatggttgcatttccaatgagaataatctaggatggggcaaagacttctccaaacgcataagggaagtaactggcccagataagccaatgagagttcaccaaggacaagaagcagaatcaagatgggctaaacaagtctgatcttacaggcacttgtggtgttgaaaataaatggctggaggcgaggagggtggaaagattgttactattcatagaaattattaagaaaatccagaattacatggtaaactataagggcagtaatgctgtcattgaccttttggttgtctccccagtattccatctgcccctctaacatgcagtttgagaggagctaaccttgacaagagcttcagaggtaagttctcactggcattagcaagccaatattatcctatactctggccaagtactgtttcaggaaggacacttacccatggccactatgattagcttgggggtaggcacatgaactaggttaacaaaactctcgtttgttagttggggcaaatatgctgtctcaatctctctggatatggaccaagaaacatgtaactcatggggctattggcagttatctcgcaaccatcatagacaggagaaccagacttgagatgacactgatggcatgataggtagagcaaaaaaatagagctacaatgacaccactgagccttgggattaaatccaccccataggccattctacaaataaatttgccgcttaccaacatcttcttcatcattgaagccattttgtattaggatttctaagtttagaaactaaatgggcctgaggaacagcctggcagttggatggctagacttgtatagggtccagagggcaaccatcaatgcagagtgatcacttaggatccaagggcggtcacccccatatgatcttccttctgcctgaagagccctcagccctgaaaaacaggtggtaagtagcagggaaggcagacatctaatgaatgtggagaggtgggagtgtaagggacacagtgggctgaaacttcttccctcacctgagcatgcattaggaagatgagtctggaaacactgggctttgtcctgagggtccaagtggagcagtatttgagtcatttctacctccacccaatccacttttaactatttctcatatcattttgcaataagagattttcatttctcaagcaaaatgaggacagaaatagaagaagttggaggagcatttcacaaatgattagaaacaaagtatgagatgctttttttttcctgttgaaggataagtacaagagggaatcagatacctgcttcaggtgtgcatttaagccttcatgcgtggccttcagtagtgcccgcactgtgaaactatcaggatcttctttatctcgaatttgagattcttttaacagtgactccagttttttccttatgaaagattccacctgatgctcagtggtcccattactctgcaaagaattaagtaacacaaatgatttccttaagaaacacaccgaattagaatataccctttgatcaagccacaattgcttctataatttcacttctctcaattacttgtaagaaattaagctcaagttcattgtaccatctcagtcttccctcctccacaaatcctttaataataaggattactatttattaagaactaattctctgccagctactcttcatgtgactgcattcagtcctcaggaaccttataagtattattatcatttccatttcagtgatatagaatctgatgcttagagagaaatcaagtaagttgttcctggttacatagctagcaaataactgaagcaggattcaaactcaggactccaaagcccttccccctatgcttatgctatttgatgcttttaacagataaaaggccagggaaagtttttggaaactaagttttctaaacctacataaataaattagaacaaaaatatgctattaaaataaaactacttttttcactgaggagaaaagaatgctatggaaatttcaggagttgaggattattgtgagatatatttccttactatttccaatcccattgtatagttagggggaaccccaattattacctcagccatgatttgtcattacaattactttaagatcacaacaaatttcaaggggtttggatatcagagctatgacctgtccagatgatgactcacagaattttgaggtgatcatgggatatagattctctcaaagtcctgcttagcacagcttttcggccatttgttctgcttgaaaccaatggccccagcctccgttcatagctcttctgctcttccagtgcacctacctctccctgtttccaatacctttccataaattcttcaaccacttgctaaagaccaaccccccaaagggaggaaagggatactccttcacaagagcaattcccacattcttcacgaaaagtttaaggctgttcttccatttgcaaatctatttctaagaggtcattatatgtggactctgcataatgggtagctttccaataatgcattcattttcacaaaatcctgtaagagcaaagcaattataaatgccctaaggaaaaatttcaaaaatctataccaggataggttattgaatttccctgtatcactatcacatgcattaatatctttaacatgcccaattaatgaggcactccacttccctggagacctccaggtccagaaggagatgcaaggatgaaaaaagagttggctcttaacatcagaagggaacaccctcctgtcatgctagaaaaggcatgtccccaaatattctaccctggtcatcagagatgcccacaaaagcacagacaaccaatacaacagagtttctgataaggaacacggcattactacctgagtgactgagaaggccccacaaaagaggtgggaagtgattgtaactcattgtaactgagatttcaacagtgatggaaagaagggctttcctgccaaccacagttctagcaaaggatttacatgaattaagaatgttctgtaaatgcaaagaacacatgagttttcctagagttcatggagtagggtagtggcagataaagaactttggagagcggagggacttgaaagcaagaggtatggagctgctaagagagtctttgagtgaacaagtccttgggtagcaactctagaaacagtattaatctggcagcgtatgccaaaagaggaagtgtgtctgcagatgaaacatcaggcacactgggccccagtgcaggtactaagtgcctaggccaatgtgctgggggtagttaataaagttgagagatagtttgggaacaaaactcattttgtattaaaaaaaaaaccatgtattgtgtttctgctgtgccaggtgagaagtattaaagaggaataccccccactgtcacagagccctcagtgtcattgagaaggccaacacatccctggataattacacaagcaggaacaagtagagaggggtagcatatgcacacagaggaggcgcaacttgtccagccttggggaatcgggggacaattccaggagcataagaaacctgagtcaagccttaaaagataagtatattagtttcctgtgacttggccaggtgccatggctcatgtctgtaatcccagcactttgggaggccaaactgggaggatcgcttgagtccaggagtttgatatcagcctgggcaacataatgagaccctgtctctacaaaaatttacaaaattagctgggcatggtggcatgcacctgtagccctagctacttgggaggctgaggtggaaggatcccatgagcccaagagtttgaggctgcagtgagctatgatcatgccacatcactccagcctgagccacagagcgaagccctgtctctaaaaaataataataaaataaagtttcctgtgaccaatttaacaaattgctacaaacctgatatcttaaaacaatagaaatgtacttattttctcacacgtctggaggccaaaagtatgaagtctaggtgttggcagggctacactccctctgaaagctctaggggaggatccttccttgcctcttccagcttatggtggccctatgtattccttggcttgtggcagcatcactccaatttctgtctctgtctttatatggtcttctcatgcatgtctcacccatctgtttgtgtcttctcttcttatgaggacattgtcattggatttagggcccacgtggttaacccaggattatattatcttgaagtccttaacttaattacatccgcaaagaccctttttccaaataagctcacatacataagtaccacggattaagacttgaacctatctttcagtggccacaaatgaacccactgtaatgactaacagctgatcatctggcaaagagtagggggacagcatttcaatgtgaggaaaagcatggagaaaacaaaaagtatcaaaagaaccagtaatcatatgagcaaggagaaatgagccacagggaaatacagaaaaagcaactaagattgtacacagtagtccccctttatgcatgggagatacatcaaaaaatcctcattggatgctgaaaaccatggatagtcctgacccctatgtatgctgtgttttttcccatatagtaatgggtggatacactggacaaagggatgattcacatcccacgtggggtggagtagacagtgcaagatttcatcacacttctcagaatggtgcacaattcacaacttacaaattgtttattatagaatttttcaatcaatattttgggccatgattgactgcaggaagcaaacccacaaataagggggagactgtattgtactaaggctcccaaagcactgtcatgtaaagatacttcatttgagctgctgaaccctgtttaaggcaaacactagggctagccaattttttctcataatgacacaggcagaaaggttcagccactcaaccaaacacacaggcctatgaaaatggctgaattgcagcttgaacctcctaagacttcccattcaagactgtggctatttttccatacaatgcagcagccatccctcttatattgttacagaaaaagagaaaagagaaattcttgagtcaaagtaaccatgcacaggttcatattttaaaaagccattatttctatcatggaaccagggaaatacatcatcacaatccctctgggaaaaacaatttcacttaaggtcagaagcaaatccaagaaaagaactccacgtctctaacccccaacgcatttgatcaagacccagggcccaaaggagtgtgcatttgctgcgaggacaaaaaaaaagaaagcatttaagagcacctagggtatccagtatcacacagaatgctccaaatgagcatccatttccttctctcactcagggcctcacaaagaggcagagacttcaagtaaggagaagatctgtggccataacaccaagtcactttcactgtcagcaaggaaaggctcaaaatacaaagccagagccgatccagagctggtaaaataaagaatgcttaacacaaaagctataattattcacttcacatcctccaaatactgggagctgctaaaggaatgatatctctgcctgttgatctttttctgctctgtgatttactgcacaagaaaattggcagctgtgaagaacaaataaatgtgtggctgaggtttcattaatatattatcattcagccctggaatccaatagcactactgaaaggaagctaagacagacacttgacctcgagacctatcaggcaccatgcacctgcagcagggaccacagctgaaagccatatgtatcttgctcttttgttctctgggccaatgggtgagaaaggacgctgcagctgggggctgggggagagcagtcatttcatatggtgggtagtttccaccagagaagtaatcagggttctcaattcccttttttgagagataaatctgatctaggaatccctctaccacaagtaaataaattaaacatattctcattttgtctccagcatgaagctaaatcatcgctgaatatgcagaaggatgccccaaaccacaaccatcattccagactgggaagatccaggaaaggggagaaattgggtgctgctccttgaaaggaaccttccaaacagtgggctctacctgcactacacattgcaatcaccagcagagtgctcagaaatcccaggccatgccccagacccatgtatcagaatctctgggccaagacccagacactgcggtttttgaaagctacccatcattccaatatgtggccagagttgaggaactttgcattaaaaaaaaaaaggcaaaaaagttgaggacctttgctttaaaaaaaaaaaaaaaaaaggcaaaaaactaaaaactgaagtatttcaacatccccccaatttttttttcctttggctaaagtccaaagatgggaagaataatatattgctgccctttctgagtgccttactgctttccaagctgtaagacctgaaggtcttggctgaagaacagctgcttctcagccattcaagcctgtgtgtttactcctgtcctctaccatctcctgcctgctcctttagctcacttaacaacatattcttctgttcaaggaccagtcatatccatgtattagaaacaactagaatcttccagggagattccaagtcacctttatcattctctaccccttgtcgccaggatgtactagcatgcccagcacctgggctttttgactcaatgaatgctttcaacagcaagaccttgtaacctcaagaggtaactcatgctgtctttgagtgctggtatgttttaaacgaacaagattcataatcctttttaggatagctcaaagcataaaaggaatgataggaaaaaagatgagggaggaaaattattaaagtgtttagtgagagatatacacatgcagactggataatggttttagaatataagacaaaaattgctacatgtcactgcaccaggactcctttagaacttgctggaaggcttggtgtttatgggatcagctttacgtaggagatacagagctaatgtttatgcccaagaagctggcaaaacagatttagagagcacaagataaaagacactgcataactcagcagaagcagaaaaaaattaatgaagttaaaatacagaggtggaaagtgtgtagagcacactgacattagaagacccataaagatgaataatggtgacttcgcctcacagaatcaaatctgttagattactactctgtggttgaaaggaacttgtcctctgtgtctctgagttgtatgattcttgggtcactgaacacactggctttaccttgtggcttacccattgtgagccagattttctctatggctggagccacaaaataatatgtggtagaagcttaaaagattcagttaattcaacaacagaagcatttattacataagaaaaaaacttaacagtatggcttaaaccgctagcttaaaagtaacaggagtcttgtcctcctgctctgcatctaactccagggtggtgccgggagagcctcaaatcccgcttctggcctttgcgcttggggttctttctgcctggaacattcctcctcaggtatcagcatggctaactcttcacttctttcaggcctttgttcaaatgcatcttccctgtgaggcctttcgttgacatcccatctaaaatttcaatagatcccttacatatacacatgcataagtgtgcacacatgcacacagacacacacacacttttttcctttagcactgatcactgtctagtacactatatattttacttatttgtcttatttcttgtctatcctcctcttctcccattgatgtgtaaacttcacaaaggcaatgatttttgtctattttgttactgatatatcctccaatacctacaacaatgatgagcacatgtccaacaggagatgtttaataaaagtttattgaatgtacaaatgaatcttacatgacctcatgagagttggtgttccagtgtaaatgaatgcaaagttaaaatgtgtatttattgcaataattcagatataaatctaaccacattctctcaacttaaaactgaggttaagagcttcctctaagataattattggttcatataaactatccaaagtacaccctcttttgcagaaatatgatcagatattcagtttctcagggaatttattataaattcaccagtcagggcatttgagccctctgccaacaataggactataaatggtctgattacaagataatactttgcctttctaaacacggcattgccttttctcagaaaagctcaaaaatagcaaaaaacaatttgaaatatttctccaatgttgatttacttcttttctcttccaaaatataacaaagagatgcctataaacatttacagttaaggtgctctactttcacttagggccaaaccaaagaatccaaatgaaagatcatatctaactccatggaatcatgttccaaaccatctcctgatgtgggtttccagaaatcaactactcttagtaaagaaaagaggaatccagttggatactccaatttgttcccataagactacagcttactattttttgcataactacatatatttaacttaggaagttggagagctcactggcatcagaagaaaaatgaaatagctgagtgaataatgatagatctacactatggctggcaaccaagagatctagaaaacaagatgcaaaatgataaaaaatcagagacaaaaatctggtttataaagtaatgctaaaaaaaaagctaaattatccataatcataattaattataaaaaataaatacctagaggagaaaaaagcaactatttaaaatattaactgtataatgacacctcaagcatagttttcaatcatgtaactctatttagattttctgtaaccatagccctattaattaatggtatttaattttgctaacataaactattaaaaggcaagagaagaatacagatagtaacttttccttttcacttcaagctgaatcttctccatttggcccatttaaagggcattaaagccaagaaagaagtgtctactgagacatcagctctcattaagctcttgtcccctttgaaaataatgccagctcattttcacaactacaggaaagccaacacagaattatctgagagtggactgttgttaacaatgtaataactgaattcagggcaatggtgtaaattacaagaatttatacaaaatttctctctcttttttttttttttttttagagggtagaatcatagtcctgatgtctagaggactaaccttttctgtagaaataaaattctataccaaactatcatccctgtgtgctcctctcaggttgctgtgttactctagcaatcacatgagttatagagttacagaaagaagcgatgaggcatctttttaagtcttatatttccctcaggtttgtatttcccttggatcacctggctaaatgatgcttttctttttttgcggggggggtggggtgtggggttggaggtggggacggagtctcgctctgtcgcccaggctggagttcagtggcgcgatctcggctcactgcaagctccgcctcccaggttcacgccattttcccgcctcagcctccggagtagctaggactacaggcgcccaccaccacgcccggctaattttttttgtatttttagtagagacggggtttcaccatgttagccaggatggtctcgatctcctgacctcgtgatctgcccgcctcggcctcccaaagtgctgggattacaggcgtgagccaccgcgccaggcctaaatgatgcttttctacaaaggaggctccttcatctagaaaagggggctgacacaccaagtgagtaacaaactattccatgccactttattgaagacttgacaaattaaagatttagccaagaggtccatgtctggaagggcttggaaatccctctggtccaaggtacattttcttaaagagggcatgggcatcccagagaagcaggtccacgtgcaggtggggttcctccagccagccttgacagggagcatggggggctgctagcacgaggtagggaaggcaatgctaaaagtaaagccagcttttattatcaaagacagtaacatttccaactacaatttgatttttgaatttgtaataggaaatttatccctggagagagggttgaatgaattaatcactaaaattccttccaacactcagacacaagaatccttgactcattcattcaacaaacatttgaatgtctatgtgccagcaaataaagtaattttcaatgaatatcctttctacaccacagccaccataattgtgaggcctccaacacagtagcaacttggaactccattttaatacagcatatcaaggataaaaaatatggtcatgcctgcaacttacataatggagcttgaatttgcactcgtcttcaatttcatctgcactgtcctcatcagaaacttccccttcctctgcatcatccccaaggtgataaggcaacttcttaccctgaaatggaacaaaacatcccatttaaaaatgagaataaattcacaatagccaaaaggtggaagtaacccaagcatccattgatggatgagaggataaacaaaacgtgtatgtacatacaatggaatcttagcctttaagaagaaggaaattctgatacatattacaaaatgaaggaaccttgaaggtattatgctgattgaaataagctagacataaaagaaagtgtattgtatgattccatttatatcaaattcatagagacagaaagtaaaatggtgatggcaaagggctgaaggtaggagggtatcgggagttgttgctgaatgggtatagagtttcagttttacaagatgaagagttttggagattggctgcacacaatgggaatgtatttaatactactgaacacactttaaaaagggtttattgtatacatttaaaaatagttaagatgttaggtagattttaggtcacatgtattttactacaattaaaaatcatttttgaaaagtaaaaactgaaaataaaatgttgtatcattaagctaatcattacttcagactgactagaaagcagacagtctgaattaggggcaaaataagggggagtggagactttcaaaaaagggaagtcttattactttcaattaagtagaattaattagagatactatagtttgaaaaatcaaaccaggcttctattcaaaaatagatgacttggaacctggagccaggcccagtggctcacacctgtaatcccagcactttgggaggctgagatgggaagatcacttgaccctaggatttcaagaccagcctaggcaaaaaaataagcctctgtctctacaaaaaataaaaaaatttgctaggcatggtagcatgtgcctatgatcccagctacacaggaggttgaggcaggaggatgacttgagtccaggaggttgaggctgcagtgaatcatgtttgtaccactgcactccagcctgggtgacaaagtgagaatccccctccaccaaaaaacaagatgacttggctgggcacaaaagctcatccctgtaatcccaacactccaggaggccaaggcaggaggattgcttgaggctaagagtttgagaacagcctgggcaacatagtaagaccccatttctatttttattaaaaagtgaaagaatagatgactcttcacaacaaactaccattccatcccattatgtacaactgctatggtgtgaatgctggtgtcccccaaaatccatgtattagaacctaatacctcacccatatgatagtattaagaggtgaggcatttgggaagtgattaagtcatgagggctccaacgagctcccttgccccttctgtcacgtgaggacaaatagtaggtactatctatgagaaacaggccctcaccagacgccaaatctgccatcaccttaatcttggacttcccagcatctagatccacgagcaatgaattctgttgtttacaagttgcccagtccaaggtggttttgttatagcagctcaaaggaactaagacaacaacaagcatgctaatatccctcagagcagcttattcacctaagcaggttacatgtgtccttaacacttatgcctcactttgcatttcacaagcccctctttcacagacaatgcagcgagactcctgcccagcttgagcacctcccccaggaccaggccactcttgacttacctaacaacacactttaaaaatgaggggctttttgacagggaacattcttataagatattaagacagttaagttatagaattatatatataatattatctcagtgattaaaaaacagcaaaaaagtctaaaaataaatatggtcaattgttaagggtaattatctctttataacagtactatgagggaaatttacattctcctttcctgcatttcccaaattatattcaaaaacagtaaatgtaaactaaaaaggacagcagggggtaaggcccaggggtctgagaaaggcttcgagggcagctatctgtattagcaaggctttttactacaggcagaaaggaatatttattaccaaaatattgaattgcttccagaatcagagggtgggaggtggaacaaaaccaggctctgaggctaagaggccaaggcgactgcagtaggcagcctctaaataatagtaccaatgtctcctgtctcagtattcacacccttctgcaatcccctccctttgagcgtggcctggacctagtgcccgacatctaatgaactgagtacagcaaaagtgatgggaggttacttatcagatcaggttatagaaacactataccttcttgcttgcttgcttctccaaacttctctcctttcctggagctctctctctctctctctcttctttctctctctctctttctctctctctcttctgtctctctctctctctctttttctctctctcttctctctttctctcttctttctctctctctcatacacacacacacacacacacacacacacacacacacacacactggtgtcgtgagctgtgctatggagagacccacatggcagggaggtgagagaggcctcagtagccaacagcctgaaaggaactgaaatgtgccaacaacaaccactaaaggaatctcggaagcagagcttccctcagttcagctgtgagatgactgcagccccagaggacaccttaattacagcctcaagagagaccctgagcagaggacccagctaagccacacccaggttcctgacctacagggactgtggaatattcaatgtttgttttaagctgtcaaatgttggggtaatttgctatgcagcaatagatacctaacgtaagcaccaaccaaaatcatggggcagaacaaatccactgaagataccatttccaacacaactaagcacagagatagtggctttcactccatcatccacgcaatggacatcaggaactactgccagaagtgctgtcatgggccctaaaggtagctgccagcatgtccaccctactccctccacccaccaggatgggttcaacttggtcccactttcctactgtagtttctgcttcaatgtctgggacaggttcacttgattggtggcttctagatggggggcccatatcccagttctaagaaaggctgcaaaagcaaactttgagctcctctaaggggatctcttaaaacatagggatggagacttccttaaacatggaaggatgttcacatgcctgacagccaaaataatgataaatttctaaatatcatcccaggctgatctctaaactcaagcttcaatgactttaagtattcctgctctgcacagcactattacccctttcagaattctggatccccccttacccgcttcctccctccatagggctaccagcttagtcatattttcggagaaatgtctttctcagttttcctacaccttccttgatacccaaagctcttgaccttgagtccttatcactagtgacaatttcaaagctgggtaaatcatttatataatgaaagcataatctacattaagaatctaaacaattgggatttaggcaaatattttcttcaacttacagaagggaatttgtaagattaaaaagttggggccagctgggcatggtggctcacacctgtaaccccagccctttgggaggccgagggagattggtggatcacctgaggtcacgagttcaaggccagcctgggcaacatggtgaaaccccgtctctactaaaaatacaaaaattagccaggcgtggtggtaagcacttgtaatcccagctactcgggaggctgaggcaggagaatcgcttgaacctgggaggcagaagttgcagtgagccaagatcgtcccactgcactccagcctgggtgacagagtgacactccgtttcaaaaaaaaaaaaaaaatgttggggccaggcacagtggctcctgcctgtaatcccagaactttgggaggccaaggaggacagatcacctgacatcaggagttcaagaccagtctgggcaacatggtgaaacctcatctgtactaaaaatacaaaaattagccaggcatggtggcaggcacctgtaatcccagctattcaggaggctgaggcaggagaattgcttgaacccaggaggcggaggttgcagtgagttgaggttgcaccattgtactccagcctgggcgacagagcgagactccgtctccccaccaaaaaaaaaaaaaaaaaaaagttgggatctaatttgtgtatcattaataacaaggcagctcagaatcaaagcatttatttctgtatattattttaggtcctattgatatagaaagctcctaaaaatcagtttttctatttttctttattttaggaacatttgtagagtagttataatatggcagcaccagaaataaggtactcaattaagaggtgatcagacatactcagaaacaagctatcaagatatcaactttcttcacttattcagaatctgctttgttttaggtaccatggcagacagcaagatgaaactgtacacaagacatttaaaatgtagtgatagcaattccctcttttgaaacagcataaaatagaataaaaaccaacatatgtttttaaatgttctacagaatagaaataaatatgaaaaataacatcaccaagaaaagaataataataatcctcaactgatatgcatcactgataccactgactagaaaggaaagtgtaactgtgatgagcaggtggtgctgagcaggtaaggacacagaactaagcttcaattccccttcatctgagggtggcatgaggtgagggaacaaaaagaagaagctgcctctcagagtattcataagacaggttaattttcagtcctttaaaaatctaattaaaagacctggcattatcagagccctatttttggtcagctttttccaggctggcaaatattttatacaggcagatagggagaaaaacaatgcaaatgaacactgtttttcaaggcctcttttcaatggtgttactccaaaggaaaattataaaataaatttagatagcactttatatggctaactaatttaactgtggtccaatgttgatgtaaatgaagaatgatccaggtgtcttccagaggtccctttctgatctacatatatttcatgcagaagttacactctagaattaatttgtctatggtatatggaaatattgctagagactggactggaagcatggtcacttctcagcttcaagatatctggctgcacagccccaggagaatgcaaacaactccgcgattcacatctgtaaaagcaggaaccttgaaccacacagctaaagttatttcagcaaaaagagtctatcgaaaattactatttgtttttttttttcataagcaacgttttatttacaggcataccttagaattattatgagtgtggtttcagatcactgcaataaaatgaatatcacaataaagagaggcacacggattttttggtctcccagtgaatataaaagttacaattgtgctatactgtagcctattaagtgtgcaatagtattacgtctaaaaaaagtacatacgttaatttaaaatatttaatgctataaaaagctaatgatcatctgaacctttggcaaattgtaatcattttgctggcggagggtcttgtttcgatgtggatagctgctgactgatcagggtggtggttgctgaaggttaggtgactgtggcaatttgcttcttttttgttttgttttgttttgttttgagatgcagttttgctcttgttgcccaggctggagtgcaatggcacgacctcggctcactgcaacctccgccccccgggttcaagcgattctcctgcctcagcctcccaagtagctgggattacaggcatgcaccaccatgcccagctaattttgtattttttagtagagatggggttttaccatgttggtcaggctggtcttgaactcctgacctcaagtgatccacccgccttggcctcccaaggcattagccaccacacctggccagcaatttcttaaataggacaaaaactaagtttgctccattgattgactcttcctttcacaaaagatttctctgcagcatgtgatgctgtttaacagcattttacctacagtagaacttctggcaaaattggagtaaatgctctcaatccttcctaatgctttatcaactaaggttttgtacacctcaagaacccacttgctttgcttattcatataagtaattcctcatctatttaagtttaatcatgagattgcagcaatcttcaggctccacttcttttttttttttttgagatggagtctcgctctgtcgcccaggctggagtgcagtggtgcgatctgcaagctccgcctcccgggttcacaccattctcctgcctcagcctcctgagtagctgggactacaggtgcctgccaccacacctggctaatttttttgtatttttagtagagacggggtttcactgtgttagccaggctggtctccatctcctgacctcatgatctgcccacctcggtctcccacaggctccacttctagttctcttgttatttctaacacatctacagtgactttctccactgaagtcttgaacccctcaacgtcatccatcaggattggaatcatcttcttctaaactcctgctaataatctgttgacctcctcaaaaaaaatcgcaaatgttcttaatggcatttagaatggtgaatcctttctagaaggttttcaatttagtttacccagacttatcaaaggaatcactatttatggcagttataggcttacaaagtatatttcttaaataataagacttgaaagtcaaaattatacatagaacaacgagctacagaatagatgttgtgtagcaggcatgaaaacaacattaatctacttatacatctcattagagttcttgggtgaccaggtgcattgtcaatgagcagtaatattttgaaaggaatcttttttcctgagcagtaggtctcaatagtgggcttaaaatattcagtaaaccatgctgtaaaaatatgtgctgtcatcaggctttgttattccatttacacagtgcaggcagagtagatttagcataattcttaagagcctaggggatgaaaaatgagcactggcttcaacttaaagtcattagctgcattagtctctaacaagagactcagcctgttcttgacgctttgaaggcaggcaatgactcctctgcagctattaaagtcccagatggcatcatctcccaatataaggctgttttgtttacattgaaaatctgttgtttaggctgggcacagtggctcacgcctgtaatcccagcactttgggaggccaaggcaggcaaatcacctgaggccaggagttcgagaccagcctggccaacatgatgaaaccccatgtctactaaaaatacaaaaattagctgggcgtggtggcacgtgcctgtaatcccagctacttgggaagctgaggcaggagaatcacttgaacccaggaggtagaagttgtagtgacccaagatggcgccactgcactccaacctgggtgacagagtgatactccatctccaaaaccaaaaagaaatctgttgtttagtgtagccaccttcatcaattatcttagctaaaccttctagatcccttgctgcagcttctccaccaacacttgctgcttcaccttgcacttttatgttatggagatggattcttgccttaaacttcatataccaaactctgctagctccagacttttcttctgcagcttcctcacctctctcagccttcacaaaatttaagagagttgctctggattgggctttggcttaacggaatgttgtagctggtttgatcatttatccagaccactcaaactttctctctatcagcaataagttaaggctattttgctttcctatcattgtgtgtttactgaagtagcacttttaattttcttcaagaatttttcttttgcattcacaaaatggctaactcttgggcacaagaggcccagctttcagcctgtcttgtcttttaacacatcttcctcactaagcttaatcatttgtagtttttgattgaaagtgagagaaatgtggagatgccagaggaaaatggcatccaggaggcaggactaacttgcagctcccactcggacaatggaagagcatgtgaagactcgcatcgtgaacttgtgctacaagaactactgcaggaacataccaggaaaaccaaaagaattcacagaccctttgaaggaagcagactgctgttccaagctctgtgagacagctgaaaaactgtgagtggccaaagtgtgaggagggaagatccaccctcgaaaacacatcctcactggggaatctgaaattctagatcacaggtgatatggtttggctgtgtccccacccaaatctcatcttgaactgtaatccccataatacccacgtgactagggagaaatctggggggaggtgattggactatgggggcagataccccatgctgtttttgtgatagtgaatgagttctcacaggatctgatgactttataaagggctcttcccacttcacactcactcttctctctcctgccatcttctgaagaaggtgactgtttcctcttcaccttctgccatgattgtaagtttcatgaagcctcctagccatgcttcctgctaagcctgagaaactgtgagtcaattaaacctctttcctctataattacccagtctcaggtatttctttatagcagtgtgaaaactgactaatacagtagattggtactgcagagagtcgggtactgctatacagatacttgaaactgtggaattgactttggaactaggtaacagacagaggttggaacagtttggagggctcagaagaagataggaagatatgggaaggtttggggcttcctagaacttgttgaatggttttgaccaaaatgctgatggtgatgtgaacaaagaagtccaggttgaggtggtctcagatggagatgaggaactttttgggaactggagcaaagatcagtcttgctatgctttagcaaagagactggtggcattttgcccctgccctagagatctgtgcaactttcaacttgagagagatgatctgaaattggaacttatgtttaaaagggaagcagagcataaaagtttggaaaatttgcagcctgatgatgtgatagaaaagaaaaatccagctgggcatggtggctcatgcctgtaatcccagcactttgggaggccaaggcaggtgggtcacctggggtcaggagtttgagaccagcctgaccaacatggtgaaaccccgtttctactaaaagtacaaaattagccaggcatggtggcacatgcctgtaatcccagctacttgggaggctgaggcaggagaattgcttgaactcaggaggcggaggttgcagtaagctgagatcatgccactgcattccagcctgggcaacaagagtgaaactccatctcaaaataaaaaagaaagaaaagaaaaacccattttctggggagaaattcaagctagctgcagaaatttgcataagtaaaatggagctgaatgttagtcaccaagacaatggggaaaatgtctacaggacatgtcagtaaccttcatggcagcccctcccatcacagacccagaggcctaggtagaaaaaatgctttcatgggccaagcccagggccctgctactgctctgtgcagccttgggacttggtactctacaacctagccatggctaaaaggggccaacattcagctcaggccattgcttcagagggtgtaagctccaagccttggaagtttccacatggtgttgagcctgcaggtgcacagaagtcaagaactgaggtttgggaacctctgcctagatttcaaaggatgtatggaaacacctggatgcctaggcagaagtatgctacaggggtggagccctcaaggcagtatggaagagaaatgtggagttggaggccccatacaaaatccccactggaccactgtgtagtaaagctgtgaaaagagggccaccgtcctccagaccccagaatgatagatccactgacagcttgcactgtgtgcctggaaaggatgaagacactcaatgccagcctgtgaaagcagctgggaggggtgttgtaccctgcaaagccacaggagtggagccacccaagaccataggagctcacctcttgcatcagcatgacctggatctgagacatagaatcaaaggagattatattggagctttaagatttaatgagtgccctgttggattttggacttgcatggagcctgtatctcctttgttttggccgatgtctcctttttggaatgggagcatttatccaatgcctgtacccccattggatctttgaagtaacgaacttgcttttgattttacaggctcctaggcagaagggacttccctcgtctcagatgagactttggacttggacttttgggttaagcctggaaagagttaagactttgggggactgttggaaagacatgactgtgttttgaaatgtgaggacatgagatgtgggagcagccaggagcagaatgatatggtttggctgtgttcccacccaaatatcatcttgaatcataatcctcataatacccacatttcttgggagagacctggtgggaggtaattggatcatgggggcagtttccccatgctgttctcatgatagtgagttcttatgagatctgatggttttataacaggctcttctcccttcactgttcacccttctctctcctgccaccttgtgaagaaggtgcctgcttcctttttgccctctgccatgattgtaagtttcatgaggcttcctagacatgcttcctgttaagcctgtgaaactgtgagtcaattaaacctctttttataatttctctgtgtcaggtatttctttatagcagtatgacaacagactaataaaatgagagaaggatttggccttaccaagagctgaaacaaatttagagagctgagcaaaatataaaggtagaagaaacagcaggaagagccctgtgggcacacccagtacccagggaaaccacttctgactgtctcacaggggcctttggggaggctaccagtagaactggggaaagaatacagggagaaggaaactttgagatgaactttgtaataattacaaccaagcgtaaacatttatgggcagaatctgggggcagtgacgggagcaaacaggaagtgcagataggagcacagaggccatggcaggtggggagaggtggggcctgaaaggccagcttgctttctcagtggggaggcttgtagcctggggcaagatctcagccctactcatgagctgcctggatataaactcggtgctggtggtgggaatgagactggccttgctggctgagtgggaactaggtgaggcctgtcactgccagctttccccacttccctggtgacctgtatgatgcagcagaggcagccataatccccctgggaacataactccattggactgagaaccacactcccagcccctacagcagcgacagcaaaccctgctcaagaagagtctgagcttagacacgcctgaccctgcatccaactgatggtctttctctacccaccgtggtagctgaagacaaaagacataatctcttgggagctctatggccctgcccattggctgagaaacccaaatatgtatccaggtgaccttagggcaagcttgtatcagctgatgatctcttaaaagtgctaccttctggctggaggataaccaacaactagcacaaccagcattcgagaaaaccagcacactaaacaaaacaaccaaggaccctcacagagtctacttcactcccctgctacctccaccagaacaggtctccatggctgagagacctgaagacagatcacttaacaggactctttgcagatattcctgagtaccaggctggagcctggtagccccactgggtggctagacccagacaagcaataacaatcactacagtccagctatcaggaagtcccatgcctagaggaagtgggagggcaccacataagaagaccaccctgtgggacaaaagaatctgaacagcagcctttgaataccagatcttccctctgacgtagtctacccaaatgaaaaggaaccagaaaaacaattctggcaatatgaaaaagcaagtttctttaacaccctcaaaagatcacaatatctcaccaagaaaggatccaaaccaagaagaaatccctgacttgccagcaaaagcattcagaaggttgataattaagctactcaaggatgcaccagagacaggtggaaaacaatttaaagaaattcaaaagtaatgcagactatggatgaaaaaatatccagagaaatagacggcatcaatacaaaacaatcacaacttctaaaaataaaagatactcttagagaaatgcaaaatacactggaaagtttcaacaaaagaatcaaacaagtagaagaaagaacttcagagcttgaagacaaggcttttgaattaacccaatctgacaaagacaaagaaaaaagaattaaaaaaagaacaaagcctggaagaagtttgggattatgttaaatgaacaaacctaagaatacttggtgttccccaggaagaagagaaatctcacagtgtggaaaacctatttgagggaataattgaggaaaatttccctggctttgctggagatctatacatccaaatacaagaagctcaaagaacacctagaaaattcatcacaaaaagatcatcacctagacacatagtcatcaggttatctaaagtcaagatgaaggaaagaatcttaacagctgtgaggcaaaagcattaggtagtctataaagaaaaacctataagattaaaagcagatttctcagccaaaatcctacaagctagaaaggaatggggtcctatcttcagcctccttaaaataattatcagccaagaaatcttgtgtccagcaaaactaggcttgataaataagggaaagataaagtccttttcagacacacgcaataatccaatttcagatcataggcaacaaaaatgctgagagaattcgccactaccaagctagcactacaaaaaaaaaaaaaaccaaaaaaaaaaaaaaaaaaaaaaaaaaaaaaacctaaaaggagtgctaaatcttgaaagaaaacctcaaaatacaccgaaataaaacctccataaagcataagtcccacagggcctataaaacaatacaatgaagaaaaaaaaaagtattcaggcaaaaaaaactagcaaaatgaatctaatagtaccttatctctcaaaacaaattttgaatgtagatggtctaaatgctccacttaaaaggcacagaatggcagaatgaataagaattcaccaaccaaatatctgctgtcttcaaaaaactcacataagatataaggactcataaacttaaagtaaaggggtagaagaagatatttcatgcaaatggacaaaaaaagtgggcaggagcagctatccttatatcagacaaaacaaactttaaagcaacagcagttaaaaaaaacaaagagggacactataccatgataaaagaactagtccagcaggaaaatatcacaatcctaaatatatattcacctaacactggagctcccaaatttataaaacagttactactagacctaagaaataatgtagacagcaacacaataatagtgagagaattcaatactccactaacagcactagacaggtcatcaagacagaaagtcaacaaagaaacaatggacttaaactataccctagaacaaatagacttagcagatatttacagaatattctacccaacaactgcagaatatatattctattaattaggacaggaaacattctccaagacagaccatatgacaggccacaaaacaagtctcaacgaatttaagaaaatcataattatagcaagtactctctaggatcacggtggaataaaattggaaatggactccaaaaggaaccccacaaaacgtgcaaatacatataaattaaataatctgctcctgaataattgttgcgtcaacaatgaaatcaagacggaaacttaaaaattccttgaactgaacgataatagtgacacaacctttcaaaatctctgggatacagcaaagtgatgctaagaggaaagttcatagcattaaatgcctatgtcaaaagtctgaaagaggacaaacagataatcttaggtcacacctcaaggaactagagaaacaaaaacaagccaaccccaaattcagcagaagaaaagaaataacaaagatcagagcagaactaaatgaaattgaaacaacaacaaaaaatacaaaagataaatgaaacaaaaacctggttctttgaaaagataaacaaaattgatagaccatttgcaagattaaccaacaaaagaagagagaagatccaaataagctcaattagaaacaaaatgagagatattacaaccgatatcacagaaatacaaaagttcattcaaggatactatgaacacctttacatgcacaaactagaaaacctagaggagatgggtaagttcctggaaatatacaatcctcggaggttaaaccaggaagaaacagaaactctgaacaaaccaacaacaagcagtccgactgaaatgctaataaaaaaaattgccaacaacaacaaaaaatgtccaggaccagatggattcacggcttaattctatcagacatgcaaagaactggtaccaaatctattgaaactattccaaaagatgagaaagaaagaatcccccctaaatcatgctatgaagccagtatcaccctaacaccaaaaccagaaaaggacataacaaaaaaaaaagaaaattacagaccaatatcgctaatgaacatagacgcaaaaatcctcaaccaaatactagctaattgaatccaacagcatatcaaaaagataatccaccgtgatcgagtgggtttcataccaaggatgcagggatggtttcacatgtacaagtcaataaatgtgatataccacataaacagaatcaaaaacaaaaatcacatgatcatctcaatagatgcagaaaaagcatttaacaaaatccagcatctctttatgattaaaaccctcagcaaaatcggcatagaagggacataccttaaggtaataaaagccatctatgacaaacccacagccaacattatactgaacagggaaaagctgaaagcattccccctgagaactagaacaagacaaggatgcccactttcaccacttctgttcaacatagtactggaaatcctagccaaggcaatcagacaagcgaaagaaataaagggcttccaaatgtgtaaagaggaagtcaaattgttgctgttcgctgatgatatggttgtatacctagaaaaccctaaaggctcatccaaaaagctcctagatctgataaatgaattcagtaaagtttcaggatacaagatcaacatacacaaatcaatagcactgctatataccaacaacaaccaagctcaaccccttttacaatagctgcaaaaaataaaacaaaatacttaggaagatacctaaacaaagaggtgaaagatatctacaaggaaaactacaaaacactgctgaaagaaatcatagatgacacaaacaaatggaaacacattccatgctcaaggatgggtagaatcaatattgtgaaaataaccatactgccaaaagcaatctataaattctatgtaatccctatcaaaataccatcatcattcctcacaaaactggaaaaaaaatcctaaaattcatatggaactaaaagagggcccgcatacccaaggcaagactaagcaaaaagaacaaatttggacgcataacattacctgacttcaaagtataatataagaccatagtcaccaaaacagcatggtactggtatataaaaataggcacatagaccaatggaacagaatagagaacccagaaagaaagccaaatacttacagtgaactgatctttgacaaagcaaacaaaaacataaagtggagaaaggacaccatattcaacaaatagtactggaatattggcaaagcacatgtagaagaatgaaactggatcctcatctctcaccttctacaaaaatcaactcaagatggatctgagacttaaatataacacctgaaaccatatacattctaaaagttaacactggaaaaaccccttctagacattggctgaggcaaagacttcatgactaagaacccaagagtgaatgtaacaaaaacaaagataaagagatgggacttaattaaactaaaaagcttctgcatagcaaaagaaataatcagtggagtaaacagacaactcacagagtgggagagaatcttcacaaactatgtatctgacaaaggactaatatctacaatctacaaggaactcaaacaaatcaggaagaaaaagacaaataataccatcaaaaagtaggctaaggacatgaatagacaattctcaaaaaaagatatacaaatggtcaacaaacatatgaaaaaatgctcaacatcactaataatcagggaaatgcaaatcaaaaccacaatgcaataccaacttactcctgcaagaatggccataatcaaaaaatcaaaaaataacagatgttggcatagatgtggtgaaaacagaacacttttacactgctggagggaatggaaactagtacaaccattatggaaaacagtggagattccttaaagaactaaaagtaaatattttcctcttggtagataccactcctgcatctctaccaagaggcaaagaagtcattatatgagaaagacacttgtacacatatttttagcagcacaagtcacaattgcaaagatatggaaacagcccaaatgcccatcaatcaacgagtggataaagaaaatgtggtatacatatatacaccgtggaatactactcagccataaaaagaatgaaatatggcatttgcagcaacctagatggaactggagaccattattctaagtgaagtaactcaggaatggaaaacaaaacatatgttctcacttataagtgggagctaagctatgagggcacaaaggcacaagaatgatataatagactttggggactcgggtgaaagagtgggagggggcaagggataaaagactgctcactgggtacagtgtacattgctgaggtgacaggtgcaccaaaatctcagaaatcaccactaaaaaacttatccatgtaaccaaacactacctgttcccacaaaacctactgaaattaataaatattttttaaaaagtaagagacatgtgagttgcctttcacttggacacttggaggccattgtagggttatcaactggcttaatttccatactgttatgtcttaggaaacagggagaactgaggagtgggagagagatggggaatcaggtggttcatggagcagttagtacacacacaacacttatcaattaagtttgccatcttatataggcagggattatgcctcccaagaacaattgcaatagtagcattaaagatcaccgatcacagatcaccacaacagatacaataataatgaaaaagttttaaatagagcaagaattaccaaaatgtgacacagagacacaaagtgagcccatacttttggaaaaacagtgccgaaagacttgcttgacatagagttgccacaaaccttcaatttgttacacacacacacactcacacaaaatgcagtgtctgtgaaatgcaataaagtaaaatacaataaaatgaactttgctggtgggggagccaagatggccgaataggaacagctccgggtctacagctcccagcatgagcaacgcagaagaccggtgatttctgcacttccatctgaggtaccgggttcatctcactagggagtgccagacagtgggcgcaggacagtgggtgcagtgcaccatgcgcgagccgaagcagggcaaggcattgcctcaatcgggaagcgcaaggggtcagggagttccctttcccagtcaaagaaaggggtgacagacggcacctggaaaatcgggtcactcccaccccaatactgcgcttttccgacgggcttaaaaaacggcgcaccaggagattatatcccgcacctggctcggagggtcctacgcccatggagtctcgccgattgctagcacagcagtctgagatcaaactgcaaggcagcagcgaggctgggggaggggagcccgccattgcccaggcttgcttaggtaaacaaagcagcctggaagctcgaactgggtggagcccaccacagcttaagaaggcctgcctgcctctgtaggctccacctctgggggcagggcacagacaaacaaaaagacagcagtaacttctgcagacttaaatgtccccgtctgacagctttgaagagagcagtggttctcccagcacgcagctggagatctgagaacaggcagactgtctcctcaagtgggtccctgacccctgacccccaagcagcctaactgggaggcaccccccagtaggggcagactgacacctcacacagccgggtactcctctgagacaaaacttccagagaaacaaccagacagcagcatttgcggttcacgaaaatctgctgttctgcagccactgctgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctttcctcctccaaaggaacgcagctcctcaccagcaacggaacaaagctggatggacaatgactttgccgagttgagagaacaaggcttcagatgatcaaactactccaagctacaggaggaaattcaaaccaaaggcaaagaagttgaaaactttgaaaaaaatttagacgaatgtataactagaagaaccaatacagagaagtacttaaaggagccgatggagctgaaagccaaggctcaagaactacatgaagaatgcagaagcctcaggagccgatgcaatcaatttgaagaaagggtatcagtgacagaagatgaaatgaatgaaatgaagcgagaagggaagtttagaggaaaaagaataaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccccagtctagcaaggcaggccaacattcagattcaggaaatacagagaacgccataaagatactcctcgagaaaagcaactacaagacacataattgtcagattcaccaaagttgaaatgacggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccagtaccagccactgcaaaatcatgccaaattgtaaagaccatcgaggctaggaagaaactgcatcaactaacgagcaaataaccagctaacatcataatgacaggatcaaattcacacataacaatattaactttaaattaaatggactaaatgctccaattaaaagacacagactggcaaattggataaacagtcaagacccatcagtgtgctgtattcaggaaacccatctcacgtgcagacacacacataggctcaaaataaaaggttggaggaagatctaccaagcaaatggaaaacaaaaaaaggcagaggttgcaatcctagtctctgataaaacagattttaaaccaacaaagatcaaaagagacaaagaaggccattacataatggtaaagggaccaattcaacaagaagagctaactatcctaaatatatatgcacccaatacaggagcacccagattcataaagcaagtcctgagtgacctacaaagagacttagactcccacacattaacattgggagactttaacaccccactgtcaacattagacagatcaacgagacagaaagttaacaaggatatccaggaattgaagtcagctctgcaccaagcggacctaatagacatctacagaactctccacctcaaatcaacagaatataaatttttttcagcaccacaccacacctattccaaaattgaccacatacttggaagtaaagctctcctcagcaaatgtaaaagatcagaaattataacaaactgtctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaataaagacacaacataccagaatctctgggacacattcaaagcagtgtgtagagggaaatttatagcactaaatgcccataagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaattgatagaccgctagcaagactaataaagaagaaaagagagaagaatcaaatagacgcaataaaaaatgataaaggggatatcaccactgatcccacagaaatacaaactaccatcagagaatactacaaacacctctacgcaaataaactagaaaatctagaagaaatggataaattcctcgacacatacaccctcccaagactaaaccaggaagaagttgactctctgaatagaccaataacaggctctgaaattgtgtcaataatcaatagcttaccaaccaaaaagagtccaggaccagatggattcaaagccgaattctaccagaggtacaaggaggaactggtaccattccttctgaaactattccaatcaatagaaaaagagggaatcctccctaactcattttatgaggccagcatcatcctgataccaaagccgggcagagacaaaaccaaaaaagagaattttagaccaatatccttgatgaacatcaatgcaaaaattctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaagcttcatgctaaaaactctcaataaagtaggtattgatgggacatatctcaaaataataacagctatctatgacaaacccacagccaatatcatactgaatgggcaaaaactggaagcattccctttgaaaactggcacaagacagggatgccctctctcaccactcctattcaacatagtgttggaagttctggccagggcaattaggcagaagaaggaaataaagggtattcaattaggaaaagaggaagtcaaatggtccctgtttgcagatgacatgtttgtatatctagaaaaccccattgtctcagcccaaaatctccttaagctgataagcaacttcagcaaagtctcaggatacaaaatcaatgtacaaaaatcacaagcattcctatacaccaataacagacaaacagagagccaaatcatgagtgacctcccattcacaattgcttcaaagagaataaaatacctaggaatccaacttacaagggacatgaaagacctcttcaagaagaactacaaaccactgctcaaggaaattaaagaggatacaaacaaatggaagaacattccatgctcatgggtaggaagaatcaatatcataaaaatggccatactgcccaaggtaatttatagattcaatgccatccccatcaagctaccaatgactttcttcacagaattggaaaaaactactttaaagttcatatggaaccaaaaaagagcctgcaacgccaagtcaatcctaagccaaaagaacaaggctggaggcatcacgctgcctgacttcaaactatactacaaggctacagtaaccaaaacagcatggtactggtaccaaaacagagatatagatcaatggaacagaacagagccctcagaaataacgccccatgtctacaactatctgatctttgacaaacctgagaaaaacaagcaatggggaaaggattccctatttaataaatggtgctgggaaaactggctagccatatgaagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcagtggcaacaaaagccaaaattgacaaatgggatctaattaaactaaagagcttctgcacagcaaaagaaactaccatcagagtgaacaggcaacctacaaaatgggagaaaagttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactagccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctataactagaaataccatttgacccaccaatcccattactgggtatatacccaaacgactataaatcatgctgctataaagacacatgcacatgtatgtttactgtggcattattcacaatagcaaaggcttggaaccaactcaaatgtccaagaatgatagactggattaagaaaatgtggcacatatacaacatagaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaacgagaacacatggacacaggaaggggacatcacactctggggactgttgtggggtggggggaggggggagggatagctttaggagatatacctaatgctaaatgacgagttaatgggtgcagcacaccagcatggcacatgtatacatatgtaactaacctgcacattgtggacatataccctaaaacttaaagtataataataataaaataaaaataaatttaaaaaatgaactttgcctgtattttatcagaaaatttacacatatataaatgtgtatgcatgcatgattggaacatatgtgtgtaacagttgtaataataaacaacttgtcaatctccaaagtggtaagtagtcatagacatcctgccttttcaatcagagattgctctgatagtaaaggaacacaataaatcagttgccttgtttttgctttaaatggggttgcgctggtccgcagatccaggcagctccttaatgtctaaacaacattactactagcaaatggatctcagatgctcttgaaatacttgcagttcacattgttgccaccctttcccatgagtgcctcagactttctgcctctgattcatcctgatgccataagccctgggatattctgtgtcaaataactcaaagcccagttatgcaaaggagactcaattagtccacattaaatatccactgtgagttccactgtccaaaggagaaagatttcaatcaaatgaatttattctgcatttaacatcctgactgctgactaaagaatatttaggaagtagaaacatttacaaggttataaagatgacatttcattttctaacccacaaatcaatttttactataaaagtttgctttagcaagacttgggcaaattggccttcatgttatctcttgcattatgtggagcttttattcaaaatacctttatgcatataaatgcctagcaacacctttttgatgtattcagaatctataattttatttaattggtagaaaacaggttttgaccaattctaagaatgaatatgttccatcttttccatgtgctgctctcccttaaagccccagttgaagtcctgccatgaaattacattgcctccttgactttcctgctcctcctatatatttgttttttcatacacacctcttttaagtaaaatataacccagtttgaattttaataccctattgctttcctttacatttttaatcacaaaatgatgtggccacccaaggtggttttagtacaaacacacaaaattcactggaaataagtaaaaccacaaagtcagtgatctgaaaactgaaagaactgtctttctggctattctttgcatgaataatatttattgtagtaagcttcctctctcagaaaatctgtttatgaaatgtcattctgttcacctactgctctttcacacgtacatgagtcctgtggggcattattatgtctgtgcctgtgttcctctttgaagtgagctcttctcacttgcataaccaagactgatcaaccatgaagctttttgttttttttggtttttttgacagacagttattggagcttgaaatgggagaaaaagtctgaaagaactgctttcagatatggatacaaggagccttctcctttcctgaacctcacgctcctacacacacatttctctctagtgtgaactattacagactaaaatatcaaacatttggcttacagtattgatgtttccacttcataagtacaaatctcagaatatgtgctcactcaacaataagcttcttctgaagacacgactataaaaaaattggaataaggcgcatacatagatctagacaatccttcatatattgattctaattattattctcccttgaaacccatttttattctttaagggagggcaggcttagctgataatgaatgtcttttattgcattacttgaagtaattaccttcactagaattttgcctttcaaactttgagggcttggaagctgcttgcactcccctgtatcaacagatgacaggtccagtttgtctccgaatattcctttcaggtactgagcaatcttcctttgctgctggatactgcagtgattctcgatagacaatataacaggaaacctgagaaaagagcaacacagtccagaggcgtcaggtgcaggcaactcacagggacttttgaaaatgattcagtattcactgtgttgttacaatcctagtgacagtatttgcgatactgatgatggttaaaatgcttctaaaatgagaaagattagaaatgcatttaaaaaattcctctgagcaaatatactttgctaagcataatggatgaacaaaataccaatccacatgggatggcttttctaatattttgcatcaggaaacaatggtagatatattatgtttcttttaaaagaagagaaaattttaaaagagatgagaagtctaaagaaagtaaactcatataatgtaattttgtcttatttattcaaaagtctaacagcttctaagagaccactgaatgtcattaaatgaagctattgactctaaaatatataattaacccccaccttgaaaattatgattgaggataaaataacataagggaattctgtgttttatagcatcctacgtcgcacatttcaaaatcactttgatagaattatatactagtctttgtcaaaaaataaaaataaaaaccagccaagcattcattctacaccagcactcaggtttctgcacagaaaacatgagatccatgtaaataattacctaaaggagttggtggctaaggcagaaaggagatcagggctgattacatgattttactcctctctcaaccttattttttcctcagaataagaaattatttcaaattcaggttcattgacttttttctagttttccgttacatgtcttcagacataataggcaatatatttaaatcacctaatatatcaacatataccaatatttaaatcacctaatatatcaatgtgcagaaaaactttttccaggctttcatgacaagcacaagttccacaatacgggctatgaccgccagacctaccttctctcctcattagtaaaacctgatgctgtgggccatcttacagatgagcctttgtggctgaggtaggtttccttactcgactacaatctgtttgctattcatttcttcacataggttttaccctaaagtgctagaagagggaaaagcaacagcaacaacaaactgacaaccctgagttgtcctgcagtcacatcagggagttttaacaaggaattttcacattgtcaattcatttacaaaaaatctattagtggcagggagtggtggctcatgcctgtaatcccagcactttgggaggccgaagcaggcagatcacttgaggccaggagttcgagaccagcctgggcaatatagtgaaacactgtctctactaaaaatacaaaaattagccaggcattgtggcacgtgccggtaatcccagatactcaggaggctgaggcaagagaatcgcttgaacccaggaggcggaggttgcagtgagctgagatcatgccactgcactccagcatgggcgacagagcaaggctgcctcagaaaaaaaaaaaaaaaaaaaaaaaaaaaaaaaaaaaagcctaattagtgcttgatgatgtttagtgtaaagctgtgcttctcaacagggaacgaggcaattattccccccagtacaggagacgcttgtcaatatctgaagacatttttggtggtcacacttcaggggtgctattggcacataatgaatagaagctgaggatgttgctttccaccctacgctgcacaggacagctctctaccaaaaaaaaaaaaaaaaaaaaaaaattatcagtacacaatgtcattagtgccaaggttgagaaaccctgatataaagatgcaaccaaagttaagaaaggagaggaaaaggctgaacttttaaaatgtactaaacaagtttattaactcttttaatttgaagtgcttttcttctaagagttcccaaacttgaagtaaattgtcaaatcaccagaggatcttccaagatacataggtggcaggccttctcaacaccctacttcatacattgggaaataaaggcaaaattacttcacccatttggctaggacctgtagaaatcagggttgtaaagacccattagaatgcagtgttcaagattcttccacgtgggaggcatcataaactaaatctgctatacagcaagtgtgtcttattagaaaagcatttttaacctcatgtttaattaatgagaagaccaaatattggaaattttaaaggctactaacttctaaaaaattaattttacacaattgtaattttaatttgtttcctttaattcaaaaatcctttcttgaatagctggtatactgaaggtacctgctaggcaacaaaaatgaatacaaaataataagagattgctcatattttcagtgagttcacagtcttacagatgtaaaagaaggcaagtaaccaaccaattgcaagagggtgctatatgatatgacagaaatatgtgcagggtgctaaatacagagaaaatatggagaaaaagaagatttaaatcagctggtggtattagtaacttgttggagggacaatacttaaacggccttgtagaataagcaacaattaatcagatagactaacggggaaggttgttccaggcagagagaacagcatacgtaagagtggggagttgagaaagagccaggctcaatagggaagctgaaagacagtcattgaaggcagaatcctaaatctctgtggaataatggtggaagatgatagtggaagacaagggagatgccagaccttaagggatatgaagacatgcctgtgtattgagagagcttctgacaggctttaagacaagaattgaatcaccatgctcatatttcagaaagaaaattatagcaccagtgttgaggatgaaccaaaggggaaataaaaatgaacaggaggcaatggagtcaaaagataacttgggaagtagaattgccaagaattggttgagtctagaatgactcccagtttctggctgaggccagtgctgcccctaactattaataagaggaaatggagcgagaatcaagaggaagtttggcagaatgagatgctgagttccccttggggagtaagctccttaatggcaggagtcttatcttctgctcactgttgtggctccccacacctatgggatactcagatgaatattcactgaggatttttatttttatttttatttttctgagatggagtctcactctgtcacccaggctggagtgcagtggtgcaatctcagctcactacaacctccaccttctgggttcaagcaaatctcatgcctcagcctcccaagtagctgggattacagatgtgtaccactacatccacctaatacttgtatttttttagtagagacagggcttcgccatgttgaccaggctggtctcaaactcctggcctcacgtgatccaccctcctcagcctcccaaagtgctacaggagccaccgtgcccggcctcactgagtatgtttcaacatgggcctagaacttgaggggaaagttctggacatagaatttgataaatatccagaaagtgatctagggcaaaaccttagaaaacagttaaccattagaggaatgaggaaatagattaacagaagactgcagtacaaaaaaaagagattgagaagcaacgagagcaatggaggggagaatgatataatggaaaccaaaaaaggcaagtagtggggaggaaatattcaacactgtcaaatgacaaggagagggtcaagtaacataaggactccagacacctcagtgtatagataagacatccatcatgatcagaacccactaattatgtacacagtaacctatgtttccagattttatggacactctacaccctggatttagaaatttagaggtcactatttgcaagaatgtctttaaggaggcatattgagaaagaatgggacaaggaataaatgcagcatgagaaagtacaaacgggaaggccacattatttgttcacaatgttttgctgagaaggagggagaaaactagtctagcaaagagggcagtgtagagtccaaggaagaggatgtggttttgtagctacgttacatcaggcaatgctccatgcgggaggctaccgcttagctcacaggtgctgctttacttactcattcttcacaaaggcatgcttgttgatggtctccacaacatctctgaagagaatttttgaagtgagagtgtaaccatgatgtactactggctctccatctgggccatcccaacagtcaactgccaaaaacagaactttatatcaacaacccaaagtctctggtgtttattaatatttctggaaataccagacacatattaagtccattatctgaaattatacccatttcaatcctgacaaagacgtgacacagacacagaaatcggtgttctggcatatttatcagaacaaggaattaaagaattgcttttcctcaagacacaatgatttggttttgagtgtggttaaaaagatgtcatattcttaaacagctcagaattcaccaaaaactcattagaacttatctaaatccagtcaagtgtgcccaaggatagggagatttcttgaaaggtcatttacccaatttcacttcttcttcttcttcttcttcaggttatgaaggtcttttagaaagtcacagtgtccttcccaaatcaataatatagttttcattattgttcacttaggctcacaatgttttcattagattgattttcatttcattaatactacagtagttataaaataacatcaacttcctaagttcaaatcctcgagcgctgccaagatttatgtgaatttgggcaaataacttaatcatttgaagacttgttttccccatctagaaaaggagagtaatagcacttacatcataaatttgagtgacagttaaatatatgtaaagtagcttgtaacactgcatggcatatagtaactatgattgttattgatactattaatattgctctctacccacacaatctcattagctctcagctggagaaagacagtaggtttttcaccatgcccctctgactaagaatttgctttctcttgtttttatattttgcccccaggctaattcctcaaaacactactttcacctcattgctcctttgctcaaaagcctacttggtgcatagcacagcatccaacacagagaagtaagtagtctgtaaatatatgctaaatggattaataaatatcttacctcatacaatagctcttgcgtgcttacctccaacgcccctgtctcttgtgctagagcctggctaatcattcactaaccctgtttcttcttttatcgagggaacacagctggactctatttcctagccttcctttgcaggaggatgtggccagtgaaatgtgggcagaaagtatgtgcaccacttccaggtatggttgacagaaacctgctgccttacataatcattcgtcttctttcctcttctgctgtgactttagaagtggtgaagatggcacagccacaagatggaaaaagacaaaactgcttgagagattcacccactaggaacacctattttgaacttgacataatcaagaaataaacttcagttgttttaaggcacaggaaatttgaagttttattgttaaaaggacaatgttgccttaattaccatgctagctcctgtctgacaattcaatcttactttctcctacacccaagctcacaggcttgttcttctggttaggcaaattttctcacacacattcccacctccatgtgtcttttcttctttctttaaagtcaactgacatatccccttctcattttgcttacctaaatcctaatcaaggcaaaactaggatcccccacagaacctcgctagcccacaggatctctcttttccttatggcaagaggtcatcatctcaaacaccaccaaaagcctagcagttaatataaataagtgcagcggctcaatgggaaatgtgtgcctgaatgagataactacttactgttaatcattactaagtaggaatgagaaccttggttgccagaacttctgaggaaactaaaatgtctagattttattgctgtgaattttcccaatttttaaatactggcaattaatccatttttaaaactacaatatgggtcaaacataaacatttctgcaagctgaatttgcataatggaatgctgattgaaagtctgcctttagagttcgagaccggcctggccaacatggtgaaaccccttctccgctaaaaatacaaaaattagctgtgtgtggtggcggatgcctgtaatcccagctactcaggaggctgaggcaggagaatcgcttgaacccgggaggtggaggatgcagtgagtcgagctcgtgacattgcaactccagcctgggcaacaagagtgaaactccgtctcaaaataaaagaaactctgcctttaattaggaccacacagttgtgaaccacatatgttctctattttagtagcaccttcccctatatgtgtgttttgtgtattaccccaggagatatctctgtttttcttttaaaatattcaaaatgctcaccataattacaatgtgattgtaatggttaatttttcatgtcaatgaggcttggctatgatgttcagttatttggtcaaacaccagtctatatgttctgtgaagatattttaaaaataggattaacatttaaatcagtaggctttgggtaaagccgattatgctccacaatgtgagtgggcctcgcccagtcagctgagagccttaagagcaaagactgaggttacccttcaaggataaattctcaacactgcaacacagaaactgcctgaattccagcctgctggccagctctacagatttcagatttgccaacacccacaagcatgagagtcaattccttaaaaatcagacaacgaatctcaatctcttgctttctctacatatcttattggttctgtttctctgcagaaccccgactaatacagctatctatattaatccactaaacactggctgttcaaatatccctatgggaaaaaaatagaaaaaataaaagaagaaaaaacattcacagttgataccacaggaatgctaaaaacaatgtttaaggataaaatgctgttaagaaaaccaaaggttctgagatactatcagagagtgtctactattccttggggcctgcaaatgaggtcatatgtatcaacaacatcttctcacaagagaagcgtcatccatatttttccatgtacttgacagtctttaatttgtctctggaaataattatggaaaaaacttaacaggtgtttcaaataatatataattttaacaatttttaccctgttttgtggtcccttcttggagaagaaagagcataacaggattcttcataaaggaactaatagcttttccaaaagaatgcaaaggcgacaaagcaataccttgcccgacttgcttatggtgtctacatcaaaaattaaaactacacgagtcatgaaagaaggcactctttggctagtatttacaacataggcagaatattcataactgaggataggaggttctcctaatgttcaatttttatatctaattccatcacttgtctgtgagatgaagataacaacattcccaaatggtactggcatcttaatatgtggcattcgtggccaggttcaaatggcagtgaagtttcctgtaagtgctaatgctgtaaatgggaatgttggcaaggtagaaatcctctgtccaattcccctgctcataaaagagccggggcccatttttcaatcaggttacacactatggaaccccaaaagcaaagcaactccaacaaagatttagccattctgaaggccaaatagctaacatgacagcttttcataatggagcttaaagacgttccaccctgatagcactcccagagataactggagaagtcataaaccgattacaacagcaatgcaacatcagtcccataatgagaatgaaaatcccctggacagaacatccatatttattaagcaactcaggctgaaaatcaagcgaataaaaggccatgtaaaaatgttatccatttgatttgctgacaagcccacctcaccaaaaagacttattgctcttcctcaagacactgtgtacatatcctgactaaggacattattgcagctgaactaatggagatggaaaacataacattaccaaaatagaagcttgaaagtagagagaacctccaggtcacaatagtgtgaaaatactgtagaatcattcttctccatctctcaagtgctacacttagcaaaagctgcttcagaaaacagctgtgggacctgaaattttcaacccatgaccggctacattctataaattgtgttctttaaattctaactgcagctgtttaagaataaaaataccttcatctggccacatggcagataaaatgccactaggtatacagcagtacccctttatcctcgggagataaattctaaggctcccggtagatgcctgaaactgcaaagtactgaaccttatacatacacccttgtttttttcctacatatacatacctataataaagtttagtttatagattaggtcagtaagatattcacaataactaatagtaaaacagaacaattatactgcaataaaagttatgtgaatgtggtttctctctcaagatattttactgtatcacctttcctcttgtggtgaagaagggacagagtaggacggtgtgagatttcatcacactacttagaatggtacacaacttaaaacttatatgttgtttctctctggaatttctatttaatattttcggggtgcagctgaccatggctaactgaaaccatggaaaatgaaaccgcagataagaggagactactatacacacactggtgtctctgtgcccaagcttcaaatgtggactaaggtcttcaaatcacaggactgacagatattgttaggaggaccacagagatcatgtcaccaaatgctaagccttcaggaacatctaaatatttaggtggtaggcctaatcacaaatgaagcaaattcctccttttaatgccaacctctcctctatgttgtgctcctcactttctctggccatccttatatgacatgacagcctcattcaattccttagggctggtcatgtcattcaatgcttgctcctccaaaaacacacagactttctggagaacagtgcaattcaagagtcagaccaacctgagttcaaatcccagcttccaagcttcctaacctcgggaacttaagccatttatttaactatgagttgaatctcttaagaagagattattccctctttcttggtggtgttataagaattaaatgagaatgcacggaaaacacttagccaggacctggtccactaaagttgctaaaatcatagtaggtcctcttttccttcctacaatacattcaaatccaaggtgacaaccactatttccaataagaaataggtcaaacacacaaaaacaaaatgaacaaacaaatacaaagaaataggtcaaatgcaaagctggccaagtctctgagataaatataattattctcctcaagaaaaacattccagaaatagtagttcaacttctattgtccagttatagattattctaataataagaactttaagccaaatactagggaaagaatttactgatgcaagctggtgaggaagatatttgggagcatataaaaaattacatatccttcaaaattataccatagctgtgcatagcctcgtttgtacaagtatctggagaaggtaaccttttggacatacagagccaagtagcttctttatattacagcagcgactggaaaacaggaagtaagaaggtacaagagaaggctcttgttcaatgtcatctactgcacacaatttccaaaagctcccattttagaattaaaagactactggaaaagcaacaactaaaaatcatgtgtactttatcatgaattatcttaatcagataactttccttcttaataccccaaacaaagctggaggtttagaagttttgagtcggtataaggaattaatgacagaaacatggttaggcttgggtaggatactgattttggacaggtaaaccaaaaagagaagcctaggtatctgaaagaactgaaaagcaaaagaaatagagcagaagagacagaattaacaaagttgtaaaattgtctagagttgactgtcacttcatggagtcactaaaagtcattttctgtacttgaacctccaagaaaatgtcactatttacaatgataggcaaccatcagtgtgaatccaatgaggctgtgtgctcagggcatctctatgcatgccagacatgaaaacttgttgagtgctaagcaaacaaagggctgaataatggctgagagcagaatgtcaccttgagacatcttactgcttgaaaggattttcttcctcttaatattttatagcatcttcattattcagttgtttaagctactcaattgttaatcactattgctggtatgtactctctgcaactattgcaaaaatactattgaacgactaaatttacagagcattcaatttgtagtcatcctaatgtttctgtatgcaggtagtttttaatacctgcccattttttaagcatgttgatttaccttaataacattactgtcacttttgtagcagaaaattcaagctagaaactatctgacaaagaaaggcccttccagttaagcagtcttatctcattgtcctactgctttattcattgccctgcactttccaccatgcctaggaaaaccagtcatcccactgctgactcccagcacattccccaccaaaatcaaaagacaattccctgtgactcatggcatctccattcaatcataaaccaactcccttttatcttcagactccctttggaattctcctcaacctccttaccctggctaagcaccagcttaccttcgagggcactacttcctttctccaaggatgctcttttgtataaatcacagaagatttagatataaaccaaaaggcattatctatgcctttactgctacttttaaatgattgttcttctacactcattaaaaaatctctcctcttttgaagcttattctatccagctatacctttctggcatcttctaatcaccttttcttttttttttaattattatttcttattattattatactttaagttttagggtacatgtgcacattgtgcaggttagttacatatgtatacatgtgccatgctggtgcgctgcacccactaactcatcatctagcattaggtatatctcccagtgctatccctccccccctccccccaccccacaacagtccccagagtgtgatgttccccttcctgtgtccatgtgctctcattgttcaattcccacctatgagtgagaatatgcggagtttggttttttgttcttgcgatagtttcctgagaatgatgatttccaatttcatccatgtccctacaaaggacatgaactcatcattttttatggctgcatagtattccatggtgtatatgtgccacattttcttaatccagtctatcattgttggacatttgggttggttccaagcctttgctattgtgaataatgccgcaataaacatacgtgtgcatgtgtctttatagcagcatgatttatagtcctttgggcatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagtactttttttttgatggaatctcattctgttgcccaggctggagtgcaaaggcatgatctcggctcactgcaacctctgcctcctgggttcaagtgattctcctgcctcagcctcctgagcagctgggactacaggtgcatgccaccatgcccggataattcttgcagttttagtagagatgcggtttcaccatgttggccaggctggtctcaaactcctgacctcaagcctcagcctgtctcagcctcctaaagtgctgggattacaggcatgagccactgcgcctggccacattgtttttatacttaagtgtctggtttatagttttaatctccaatctgctcctgtctgcatactttgtaaattaaaacaccatgtagccatctatttaatcccttagcactgacctcctccaggccaataatcccttgcttcactctgtttccatgatgctcacccatgacacaatctggaaattgtcacctgtgactaaatcccattgcaatgacagctctgttctcattttcttaaagtgtgatgacaactttccacatttttctatttatttgagtcttctagtctcttaatcttattttatggccccctatccacttcgcttcctttcctagaaccatggagcccctgtcagttacttataagagctctcaccaataccttgaagatatttaatatgatctagaaatcccgagacttggatcaattccataatctgtcttcactacttctctaagcagatgagtactgctggggatgggatcaaagggagtctaagcatccagattttgaatcagtaaagactgtttttgaaatcagcttgggcttccctgacttaccttgtcaattcctttcccattctctgatgacttctttaacaatttgctgattttaagccctgtggccaatctccactcactttatactgagtggatgatgttctctcctacttctctgagaaaacaggcatgcgccctttcaaaaatctcttgtcccctttattccacctgaaaacaaacctatattatttcccccacttccaagtctcaaagttgccccccagcctatatcatcaaacatttggatgcagaaaaatgcccagtcaccaatcgacagcaggtaaccaactgcccactaacatatcaccaacctacatagcaaaggccaccaacaattccctgctgtcaaatacaactaaattggatacttagttttattttatttttctgttccctgtggcatttctggctattcctttctaaccctttcatcctttagatccaagtactcctgttctctgcactggccttgctggctccccttgtgctccctactcctaatcgttgtattgctgaagtcctcaggcctcttcctcttttccccttctctctgtaagtgatcttgtacacttccatgattttaactaccacataccaagttcagcattttggaatccttatcttgcccagactcttcattaagttcagacattgttatccaaatgactgataaagatgtccacatacatgttacaaaatcaatctaaattcagcagatggaaaactggactcatttagactcttgttctcagattccctatagtatggagtggcaccatccaccttctagctctccccttcgttccttttattcttttctctcaccagtttccactaagtttacctcttcaatactgcatccttaacatcatctctttctcacttagtccaagattttggaatcctcccttggattcactgtgatagccttcccaccaacttcctgcttccagtttcacctcccttctccctccacaaacacacatgtcaaaaaaaaaaaaaaacttttaaaattatcctttcacactgttgcccaaataatctttctcaactgcaaatctgatcatatcactatagatattaaaacctttcactggcccctcattaccaaaaactaaaatgaaattcctcaccatagcactcaaaaccctttacagctgaccctcagctcccttcctagcctaactgatttctcatcacattttacctcgcacttcattctctataccaccacttctataccattgtatatcaaccaaccggtgaaattttcacattgtttctctctctctgtctctctctctctctcacaggtggggtctcactgtgttgctcagactggaatgcaatagctattcacaggcacaatcacagcacactgcagctttgaactcctggtcccaagcaatcctcccacctcagcctcccaggtagctaaaactataggtgtacaataccatgcctggtttatattattttataaaaaaaatgttcatcccttctactagactgtgaactccctgaagacagaattcatattttacttactcctgtatactcaccacctggaacccactagaagtttaataaatgttggctaattgatagaccatgaagtatcctaaaaacaaagagcttggccaggcgcgggggctcacacctgtaatcccagcacttcgggaggctgaggtgggtggatcatgaggtcagagatcgaggccatcctggccaacatggtgaaaccccgtctctactaaaaatacaaaaaaaattagttgggtgtggtggtgtgcacctgtaatcccagctacttgggaggctgaggaaggagaatcgcttgaacctgggaggtggagattgcactgagcctagatcgtgccactacactccatcctggtgacagagcgagactccatctcaaaaaaaataaaaaattaaaaaattaaaaaataaaaacaaagagctctcctgaactatttttgcaattgtataattaaaaatatctttctaggaagactttaattttcatcataatttctcagcaactaacggtatgcttcacaactgctaacacagatctctttctcccaattgaacaataaggagccagagagaattatgagttaagattgactttacaatgagcagaaaagtagtactaattagtgtgagagtgtgttttaggtctccattctttatactagactcgacagactgattaaaggacagggtcacccatacacaccggagctcagaaaaagtgcacgtaccttccacacagcgacagccctcttgcagcacccgtgcatacatatccactttggactgagaaaggagctggtctccagtcaggtatgtattgtgagaggaagcaatgtagtagttgcagaggggctgatccatgtcttggtacacttcatggtgcaatgggttaaatatgtcacaggcaggactacgcatgaagttcgtgaagcctttggaagaaagagagtgacttactacagctttcaaagcatatatacttaatggctctaagaggggcaaaaggggtcaaaaaatgttcataatgattatcttatttaccctcaggatggcatttgtggggaaaactggagcaatgagagatttgcttgaggtcaatagtatggtttagatatttgttccacccaaatctcatgttgaaatataatcccctatgttggaggtgggccctggtgggaggtgtatggatcatgggggtggacccctcaaggcttggtgctgtctttgcagtagcgcatgagttctcctgagatctgtttgtttaaaagtatatggctctctccactccactctctctcctgctccagctcaagccacgtgacctgtttcctcccacttcaccttctaccatgagtaaaagctccctccagcctccccagagaagccaagcagatgctggcaccatgcttctggtacaacctgtagaatgtgagccaattaaaactcttctttataaattacctagcctcgggtatttctttctttctttccttctttattttattttatttatttatttttttttttgagatggagtcttgctttgtcgcccaggctggagtgcaatggcacgatcttggctcactgcaacctccgcctcccaggttcaagagattctccagcctcagccttctgagtagctgggactacaggcatgcgccactgcgtgtagctaatttttttgcatttttagtagagatggggtttcaccatgttggccaggctggtcttgaattcctgacctcatgtgatctgcccgcctcggcttcccaaagtgctgagattacaggcgtgagccactgtgcccggccaggtatttcctaatggcaacacaagaacagcctaatacagtcaaatagacagtgtcaaaaaatgaaatgtgacttttaggaatagccttttaaatataacctaatatatatatacatatatatatgtatatatacatatatatgtatatatacatatatacacatacatatatacacatatatacacatatatatacacatacatatatacacatatatacgtatatatacacatatatatacatatatatacgtatatatacacatatatatacatatatacatatatatacgtatatatacacatatatatacatatatacatatatatacgtatatatacacatatatatacatatatatacacacatatatatatgtgtgtatatatatgttgactttttaagaattttgactaggtagaggaggggccaagctgtttagtgatgactgaactcaagctatgcttatgcagtgtgactgatgccatgttaaaaccatagtgataccaagaggtaccctgaacaaccagcaattgataggttattacgttcatctgaaaaacagtaaagtcagtgccatagttaaggtagtaagccaaaagttaaacactgtctaaattcagggtgtgattgacaaccaaattggtttgaaaaaatgctgctaatggctggcacattttataactttgaaatagtcctttaagattatttagaaaaccctatcagtttttttacaatctttcaaaatataatgcctgggtcaaagaggttttcactaatataacaaataaatacatggatgactcacaagtacctaaatagaataattattagggtaaattatttcaagttttcaaaaatcatttggtataattatatttgtaaatatcctcagagacttaatttcttcatgccaacttttatgtccataacttaggaaaccaggtttaattccatcttttcaggcctcaccaaagaaaagattcatttcttagcacagaaaaggcccaagttagtttatcatctctggttgtttttaaaacagtttttaatgatataagattttattttattttattattttattttttgagacagagtctcactctgtcacccaggttgaaatgcagtggcacggtctcggctcactgcaacctccacctcccaggctcaagggactctcgtgcctcagtttcctgagtagctgggattacaggcatgcgccaccatgcccagctaatttttgtatttttagtagagatggggtttcaccatgttggccaggctggtctcaaactcctggcctcaagtgatccccctccctcagcctcccaaagtgctgattacaggtgtgagccaccacacccggctaatgatctaagattttaaattattcctcttcactttaattacctaccaccacaggaagtaaatagatggtattaaaccccccttgttcacactgatctgggagcagaagaaatgagggggccaacggtcaaaattggtgagataaaccatggctttgcatgctcttataggcagctggtctttcattaaagatcatctgctctgcctgaaagatcctcctcttgggtggcagcctacatagtatttctttacatattttaaatacatatacatacatgtagctatatttctgccatattatttacgtctaacatttcaggagctagattctgggtatataactgtgggcaaattatttaacttatttgagcctcacttcctcaactaaaaaatgaagtcattgtattaatgagatttgtggttccaacagcttctgcaaagctaccaattaggaaatacagtcagttgctaccattttaaaggaaacatggcaagtcactagtctcagggataacttattttaggactgaatttcccttcatgaaattatcaggctaatttccaaaaattagccagttgagaaaagcccaaatatgtcatggcatccatcacacgtggtggtaccaggtagacttgcttgaagtggaaaatgcttatgggcattgcaaaagtaagacaaatagcaacatcatggtctttgctttgcaggaaaatatatgtgtgttgtagattttgtttgaattatttattaatataatcccatggatatgtcctgatttcttttcctaaaaacttttgctggaatttaacttaacaggctgaatcaagaaatgagaaataaagaatattggttattttaccttctatgccaagaacatttttcaccttattttcttctgaaacttcaaacttctttatgatgtcaagacaatagtccgttgtcacattattcatctaagaaaaacagaatactagtagagtacctgcaatttcataaactatgttcctccacagtagaaagacatttactgattttgcattcttcacaccgtacaaagtacctaaatgagcattgtttggggttattagtgtcacagctattttatctttggagaatgaccatgattcaatcttcctatgcattttttagattgaatcagcaaaaatagcccttcaactattagacaaatgttctctgtgaagaaatgaaataaaatcagttatcaatgtgaatccattgccaaaaatacactcactataagctagcagctatctgcaaaaattaacgtttcctacacaagcactaaagtttgctgatcataaatatatgtagaaaaagaatgattccctaccaaaacagaatgtttctaagtaaatgtacctctgtgtgtgtgtgtgtgtgtgtgtgtgtgtttgtatccatacaaccatccactgagcagagcagtctgccatggtaatacaggaacacaaaggttagcaagaggaaataaaaatgaaaagctaggtgaggtagctagcataacaactctggagctagactgcttgcgttcaaatcacctagtttatattattaatagtgtgacattgaagaggttacttaccttttctgtggctacctgatagtggagtgataaggattaaatgaattgatatttgcaaaaacattgtgtggcaccaaaaaggcagtatatgctatttattaatattaatattattgagtcagtctcaaatttgctacatgaacaatatatgctgagtgtcactgggaaaggtaaactcttcagaaataatttctttaattaaacagcaacattaagaatgtgatattttgatcaaaaatccatttagtcccacaatctaacattgacattttaaaatattaatgaataattatagaggaagctaattttgtgagctagtatttcatattttaattatattttctcaaatattccatttttgtttaggtttaatacttacattttaataaaatctagtttttctaaacagtctatttaaactgggggtgaagcactgctgtatggctgttttttgtcagttcaaaagaacacacaatgatttctttcttttcaaactagcatggtggctgatgcatcctttgagtaaattttataattcttattctatttaggggcccatattaccagaaaccacctgaaagtattataaataaatgaaactgcaatacctccaaggaactctactgacccaggcaggctttgagcagctcattaatttgtctgctgtgagctagagagatttggcacatgcagtctaaagataaataatttttcacaaaataaaatgaaccaaattgataacaattttacatgccgtgtgaagactaagttcactttgcaattattttgtttataagcccatttgttcagaaatgtagaggtcttaaactggactcaggtagactaccagaagcccatgaatcttaacaaaagcaatgaagaaacaacaaaacaactaattcactgagatgatggagctaactgcaggtgagcagagaatatgttactaattcaggatacagtgaagacttttataaccaaaaacatcatatttgaaaatattcattgaattagcaaaaatattagtaagcattctgtgaagttcacaaatttctggccaccgtagaagaattaatgggaaaaaataatctactttctaccaaaattgaggtattaaggattgactctttgcaaaatacagtaaaaccccataataatgagaattgaaatgtaagagtcaatcgactcccaaccttccccatcccctgatctcatttaattaatctcccaacagcaaaatcctgcattttacgtaattgagttttttaagacttcatttaagttataagtttattgtatgactgaaggttcaacataggttaatgctctttactgtccttcttcaccctgttttgcttcctatttgacagagctgatagagagaaataggaatttctccctactctaaccctgtttcctatggagttcacttgacagttttgtttgtcattgaacatctgagtcacttgctgtctccaatactgaatattgttctttctacaggcaactggtgctaaaagaagaacttaagataaaatgtgattattttaataatgactctacatttatataatgctgtcaatgtgcagtaaagagcttttacacacacaatcttaaataattcttacaatagtcttgtaaatttagtgtttttatccctgccttgtagatagaaaaattaatgttgagagaggttaattaaacatcaccatcaaagtcacaaaactgtaagaggcagaaccaaagatcaaatttggaccttcttgacttcaagtccaaagcactttcttgtataactattctctgggcatttttctttatttctattgaaaaattaaaatgcttacttttaaaactgataggtgtttttaatttcaatataactgaaactcctaaatcatttctttacttcaaatcaattattacaatttaacttattttattattcaagattagactccattctcttttcctttatttactgtagttctttagtctcatccagaagagaaaagactcactggtcctcacattaaaggacaactaatttcagataaacaagttgtagaaactagtcatagatctataaaatacccatattctgacactacctatttatcctcagacttcctgtaagttttttagcaaaactttccctgtgaatgaaaatttaaaacaaagtcagaaggggtaaacaattatatttcttatggctatgattctcaacaacaccaagtgtaaaatcaatgtatcatttgcaaaaattctaatattgctaaaccttactagcttatttttatcaaagggttatatttgtaactaaataagtcaaaactaagatctttataactaaaaccagaagtcccccgcctatacccagaatcactccccaaagtcaataatgccaatatttctagatatttcttttgaaatcggtctttatatatatatttggagatggagtcttgccctgtcacccaggctggggagcagggacctcactgcaacctctgcttaccgcgttcaagcaattctcctgcctcagcctcccatgtagctgggattactggcacacgccaccatgccctgctcattttgtattttagtagaaacagggtttcaccatgttggccaggttggtctcgaactcctgacctcaggtgatctgcccacctcggcctcccaaagtactgggattacaggtgtgagccaccgcacccggccatctttctattcctaattattgtatttataatgctatattgtacactttaaaaattattgacttcttactgtgttagatattaagttagatctttaacataataataagatcttctggatctgcagatctgcctctctgcctgtcctctcagcataattatatcatccagtttttatgaaatatatggtgtttaaattattccaagtatgcgaatgttgaacaatgctgaatccgttgtacactgtgattgtgtttcctttctcacagaacattttttatgattacttgctgacattcctactcatttggttaacttttaatgtacctatcacaaattcttcccaatgactctaatggtctctcaagttccacataatcaaaggcaacagataatccatgaattgtgctttttttctccctacaaaagttctccttctttccttctggttgggttctggaactgtattcagcttttgctctgactttactctgtcactcttgtgaaagagctctcaggaagtaaattatttatttccctcatgtgtttttgtgtgtgctctggtgtatttgtcttttattccacacacacatttgtttgacagtttttggcagaaaattctaggttgaatcattgctctcacgatttttggcttccagaactgctgttgagaaatctgatgccattctgattccagtccttttcacaggaccagttgttgtttgctaattagtttagtttagttttctctttttacaagcactcagggttccactttatccttggcactgtgaaatttcactctgatttgcctctttgtggatctttatactgaggttggccctcgtttgggtttgtcagtctagagaatcttacctttccatgctaataaattttttgtattatttatttgataagtttctcccttctattttctcttatttttttctatttcttttttgtttgttcttctcatgcttttaatttccaagagattttttttttctctgaatcttcttttctcgtggcatccttttatttcttaagagacaggtcctcattctgtcacccagactggagtgcagtggcacagtcatggcgcactgcagcctccaaatcctggaatcaagtgatcctccttcctcagcatcccatgtagtggggactacagccacacaccactgcacctggctgatttttttatttttatttttattcttatttttattttgtagagacagggtgtagctatgttgcccaggctggtctcgaactcctggcctcaagcaatcttcccaccttggcctcccaatgtgctggaattttaagcaagagccactgtgcccaatctgtcatagcatcttgctcttgctttatggcaacaatatttgaatcattctgataacattaacaataatttttaaagtttcctcctccttgcattacctctgtttcctccaagtttattgtctctatttatttgctttagtagtctctgttctttatagcagaggatttcctcaaacattggtaagccttggttatttaaaaccaataacctgggaactgagtattggaagagggctatggttttcacatctcaatgcatagatggtcactaacccttgcattcattctctacttctgtgaaacaaaccaccccataacctagaaacttaaaacaacgactgtttatttgataacaattgtgtagggtggcaagtcagactgggttcagttggatggttattctgctgttctcatttagagttcttcatgtgactacaggcatctggttacttgccagatggtacaagatggcctcacccacatgtctgtggttggtgctggctgttggctgggcctctttctctatgtagtctctcatccccaaggaaactcacctggtttcctcacatgatagtcccacagttccaacagggtgaggatgaaatcttcaagactccctgaggcctaggctccagaacctgtacatcagtcctaccacaatttattaatcaaagcaagtcattaaactggcacagattgaagaagcaggaaaatagaattcaattcttggtggaaggagtggcaaaggtgcattgcaaagacacatatgtacaggaatatggcagttattatagccatcttcataatccccatgttttccatatagtacccacactcagccgtgtgtggcatcacttagtcaaatcctcttacctctttttttttagatagagtctcactctgttgcccaggctggagtgcagtggcacaatctcagccaaatgcaacctccacctccagggttcaagcgattctcctgcctcagcctcccgagtagctgggactacaagcatgcatcaccacgcccagataattttttgcatttttagtggagacggggtttcaccatattggccaggctggtctcaaactcctgacctcaagtgatctgcctgcctcggcctcccaaagtactgggattacaggagtaagccaccatacccagccccccttacctcttacatacagttttatgccagggtagagaagggacagttgccctgctacaagggttggaggagaaaatctgaagccctaaccatatcttaaacagactttcaaccaatgcttgttttcaacccctcttttcctcttttcaggaatatcatgtaactaacatcaatttttgagcttatcaggggcttcccctgggcaaatggagttgcttcgaggcttctcactctatgagattgaatttcagtgctctggggtctcctttaaatcagacaagttttaaaattttgttgctcctctcctgttctctttgtatctgtggttttacagagggggattgtctttactgtattttggggtaatttcaagagggagtgaagaaacacctctaaatgaatggtcagttcatattcaactgaataagacaaccacggtaactattaacctcctcaaactagctacctctaattcatcctaaaacgaaaccacacatttcacagcatttgaatagacgatttcacagaaaatgttatctgggaaatatagccaatgcagcaaaaatattgcaagatataattactctgagtgatctctcaactgctttaattgtgaataattaagaaaaatcagccaggcatggtggctcatgcctgtattcccagcactttgggaggccaaggtgggcggatcacttgaggtcaggagttcgaggccagccttgccaacgtggtgaaaccccatctctactaaaaacacaaaaatcagccaggtatggtggcgggcacctacaatcccagcttcttgggagactgaggcaggagaatcgcttgaacccagcagtcagaggttgcagtgagccgagacagcaccactgcactccagcctgtgtgacagagcaagaccccatctaaaaaaaaaataaataaataaaaagaaaaatgatacagaaattcaggaaaacacctcaaaggaatgcttttatatgaggaaggtgcaaaaaagataaagatacattatcaccagaatgggatagttacaagcaaaagagactataattatttctcatgagagagaagattagaatgattagaatgaccataactcttaccaaaccattctggattcaatgaagggtaaggaagggagagggcacatatgattcctataattggatcagaatgatcaaagaaacattttaccagaaagaataaaggggctaaaggtgcaattttcagagctactacacgggtaatgtatagatctatatcagattacaataaggagatggccctgtagcagggaaacaggaaatctctgaaaatcctcttggaattaactatccacatgcatatttcagatgaaacatttatataaacagaaacctacttttgacttacaataaaggtagcctttgctcttagataacagctagcagaaaattttaaattttttaagttatttcattttagagacagagtcttgctctgtggcccaggcacaatcatagctcactgcagcctggaactcccaggctcaagcagtcctcccacctccaccccgcaagtagctgggactaagggcaagcaccaccacacccaactaatttttgtttaagagaaggggtctcactatattgttcagactgatcttgaactccagggctcaagtgatcctcctgcctgcccccgtagctgggattacaggggcaaaccactgggcctggctaggaggattttccaactatataaaggcgcttcaatgttcctgccttctcttccttcttcctcaatccataagaaacaaaaaaatataaagaacataggggcttgctaagaaaggttgccaaggggatgggaaaatgaaatcaaattgtcactccagaaccaaaacactaaaaaggatggaacaaaaaaaacactcagctccagtgccaagaaatggataggaactctggaggagatgtaggtggttgtttggcaaatatgaggttggggtgggtggggaatgaaacaaagcaaaacaaaacaaaacaaaacaaaaactctcaatcaactctagtaaatacttcggaaccacagattagtggatatctgtgatcctttatctgtagatgaaaggaagagaagaaagagaaatctcagccaggtaatttctggctatactggcacttcctcatggttataaaagatagtgagaattcccttggcacagccgtgttttaagaatgaaagtcctaatcaaacagcaattggacctgtcaaaggcataaattcaatcttctgagagcttcagtaaaataaaaatctgacccacaggccaatatttgatttcataaaacccttgacagcatatgtggccagcagtgatatttcatttcacaactgagtaaacctataaaagttgaatatcctggtgtctgcaccaatcttatgttatcagaagctaatgaattactgtgacacacatcatcaaattgcctcaaatttgtgccattgtgaaaatccagttttgaaactcaaaaccccacgaaactcttgactaacgactctttctacacagttagattgtgtccaatctaataaaataaatcttaacactattttaaagaatgttgaaatgcacaactttacaacaatttttaaatacagagctattttcttaggatgaattattaaagtaaaatggtttggccaaagttttatcaattatattaaatgttatagattgtaaaactactccagtatcattctataatttcaccagaaatagaagagatggacactacgtttggtggcatattttttaatctttactaatacgatgggaaagaaattgtctcctagcctagatagcatggtgagaccctgtctctaaaacagattattaaaaattagctgggtgtgatgatacacacctgtagtcccaactactcaggaggctgaggcaggaagattgcttgagctcaggagttggagtttatacgatccatgatcgcacccactgcactccagcctgggtgacagagaccctgtctctaaaaaataaataacttggttttatttcagatttttgaattactaataaagggtgaacattttcataggtttattgactttgtatgattttgtaaaggtttcaagtgttttactcatttttccattgttttttttttcctcaatggtctaggaaagtacttgccacattaaggaaattcactatttctctcttttgtatgttacaaatattttcctactctgccctttaattttgtggtgcttaataaagtggaccacatataaacaaagtttcagtacattaaaattttcctttgtgatttttacctcttgatgtatgatcactttttttataattttatagatttcttttgagtcatgctcatatgtaagtagcttcaagctaatttagaaaattaaactatatacagttaatcatctgccaggaacaaatgtcacagaattctggcttctgttttccctaactaaaatttactggcagaatgtcaacaaaactaaaatgagagaagaaacacatgccccttagcaagtgacatccagtattgctattcaaatgaactggggtaattccactagcctgaatgaatttgaagtcagtagtttataccttttaactttaattcctcacattgccacacttctgaatatcttgggcaaaggactttcctgttcatcattgcaatgttcaatttgacactgtgagataggaaaggcaggtatcatctccctttgcatggatcaggaaaccaaggctcagaaacaatcatgattgattctccaaccactaaagcttgcagtgtgtggaatgcaggtgttttggactcctggtctaatgttctttccagtacactatgagagttctgcaagtaaggatggagaagtagttatataacagactccacagaggagtaaagatgtagaaaggatgtatcctctaagggaaaatatagacatttctattacccaattccctttttctacctgtcttacggctaacattgttaataaagaatctctgcctttgccaaactatcaaactacttaaaataactaattttgacaaagcattttgctaataacactatctgtttaattcttaagaaagcaacaacaaaattcataaaagtgaatctgttatttctaaaacatatgtgattatgatactaaggtaaagtaaaatattaagtaggtattagaaagttatctaatcacatggttggttgctggctaccagcccctatcctgaaactatccaggggcccaacaatagttacctcattagcatgaactcagatatgatgaaaaggggttcattataaataatcaaagatacttctcaggaaattctaagagtttaggagctctgtgccaggaactggaacaaagaccaaatgtatgttttattatatcacactatgacagacttggagtgggagggtataagagaagtaatttggaagaaaattctaaccatgtacagatttgatgcagtttagtacacggtatcctaaaatattgcaccctagcatttgtggaaaacagcagaaaaggaaaggtatctccggccttccccccagcccttccacccataaaacctaggaagaattttctgagcttcccctgaagcagaccatacgaccctcattaaagtgaccatcagcaccttcccaatacccagaggaaaggagcaaaagacacagaggtgccaagaaaagtgtgaacaaacacgccttactaaattccccatttactgccattagatcataaccttgtcctctaaacatatttctccatgactgtccactcttcatcaaactagcataagaaatacacaggtttgcctaactctctgggtcttcagtgccttataaagtctcctctgtgttattaaaaacttattagataaatttgtatgtttttctcttgttaatcggtcttttgttataagtgcctctgccatgccctagcgatgggtgtggaaaagacacttcccctcacctatggaattttacagtcaagtatatgtgcggatacttgcccactaggaatctcacattgctccttggaaatggctagatctgtgcagctaataaaccaggcaatgcactaggaagttacatccacatctcatttaattctcactctactcttgcaagggcaatattactatcaaaaccattttataagtcacaaagtcaaggatgaaaagttaatgtgatcaagttgcaaggtaagcaaggttgtgtatccagtcctgctcactcctattccaccacacagtctagtaatttttaaaacttccatgccaaatgaagtgttaatctgcttgaaaagaggtgattagcattactgatgaagacgataagagaaacacattatcagaaaacatgtttaatgcatttaactttgggagtttgaaagagacatcaagaaaggcattaaaactggttcctacttgggtattgcctgctacctctcaaataaaagctaatagtgtggtgctagtggttggttctttagtggcatttaaatagaatagatatccacctggaattactgagggaaaaccagtctgtctgcctgtcagtctctgtctctgtctgtctgtctgtgtctgtctctgtctgtctgtctctctttctctctctctctctctcacacacacacagacacatacacacacatgcagaggcaataaacaacagaaaaacaggacagaattcatacagatttttctgtattttaaagagcatttcaaagttcaaaaaatacaattcaaaaacaaacatggaaaaacattcatccctgctatcaaaaaatgttaatcaaaccaacattaacttatcattctatagctaccatattagcactaaaagtgatccatttaataactaatcatttgttcactgttttgttaattataaactgaaacaaatcttttatatagcattatggagatatgtttcaaaagccatgaaaatattttatccaatggctcaataataagtaaataattcagaaaaaacatatacatggattttgttcaccaaatactttgtacttttttcattcttgctaaagcaaaacattgaagactctgatcaccaaattaatctcacatttaaaaaattcaaatatggcatttaaatgctataaaatgttaatataaataagggtagattttgaatcagtgagactttttgccatttatgaatctataagcagcatttactagctcaaattatgaatgtcaaatagtttttagactacaccaagagtaacataattttccaggttatgtaggagaaaattaaagaaagttaaaagaattgactctcaaatgaaaatcacttcacaaattcaatttaattcaaattagcactaaaactaagtgagcatgatttcatgtatattaacaatgtattactaattaatatttttagtatctttacaaaggtacttcttctaaagaagtaacatttccagaaaaaaaatacggcacgataattgtaataaattttattctacctcaaaaaggaaaaatccagcaaacgttaaaaagcatgttgttttacttcttcacattctctttccttttatcatagactctcaaaatcataaagtatcaaaaaaaggtctttattttgagctttctgagggtaggttttgtccactacaaaaacttagcacaatacctaggaaatatagtatctattcatacaaggaaatgaattaatctgaaatgttactaatccaagcacccacccatatttcaatctcattaatagcgtctcaaatccttgttaacaccttcaaggaagaaaacacaattgtcaaagtcatccagcacatctttggtcagctatacttcttaagagctagtggaaatttatctctctgatattcagatattaatccaatgtttaattcactggggttctgtggtagaattttatcctggttcacataaagtccttgcaatatccagatccagactgaaagaagggatcaaattaggtgacccaacttttccactcagatatatattcaacagacttgacaacgtatgtccacacaaaaacctgtacatgaatgttcacagcagcgttattcgtaacagcccccaaaaagcaaatgacccaaatttccatcaactgatgaatatataaacaaaatgtggtatagtcatacaacgatatattatttggcaataagaagaaatgaaatactgataatgctacaacatgaatgaatcttgaaaacattacgccaaatgaaagaagccagtcacaaaggtcacatatatgattccctttatatgaaatgtccagaacagataacagacaaatcaatagagacagaaatattagttgccacagcatgcttggaagagagaaatggagaataattgctaataggtttggggtttcttcttggggtgccgaaaatgttctgaaattagatagtggttatagttgcacaactcttttttccttttttttttttttgagacggagtttcacttttgtcacacaggctgcagtgcaatgacgctatctcggctcaccacaacctccgcctcttgggttcgttcaagcattctcccgtctcagcctcccgaatagctgggattataggcatgtgccaccacacctggctaattttgtatttttagtagagaccgggtttctccatgttggtcaggctggtcagaactcccgaccacaggtgatctgcccgcctcagtctcccaaagtgctgggattacaggtgtaagccaccgtgcccagccctttttttttttctttttcttttctttcttttttttttttttttttttttttgaggtggagtctcgctctgccgcccaggctggagtgcaggggctcaatctcagctcactacaacctccacctcctgggttcaagcaattctccctgcctcagactcccaagtagctgagattacaggggttcgccaccacagccagctaatttttgtatttttagtagagactgggtttcgccatgttggctaggcttgtctcaaactcctgacctcaggtgatccacccgcctcagcctcccaaagtgctgggattacaggcatgagacaccgtgcctggccaatagttgcacaactctgttgatacactaaaaaacacttaaatgtatactttaaaaatggtgaattttatggtatgtgaataatatctcaataaagcctttattaaaaaattggaaagtgttcaagcacaagctggctgattatttgtgtgagtactgtagaaagaattatttctactgattattgtactatatagtccaaatatttgatgattttttacaatttcaacagagctaaatgccgctgacttaaaatgaacaaaggagttaagcagctctttatattaagacgattggtccattaagagaattaaaagtaaacctcatcaactgcacaaaaccaaagcctcctctcaagaagtctaatataaaaggttaaaaaatttgaataaaacattcatttattcctctactttagtgagaaacagactttgaggagatatttaaaaagcagactgagaagttagctttgctgaccataattcagcctatataatattaagattaaaacaccttattttaaacatacttagagattctctttgctaatcaggacctaatttacttagccttttcacatgatcaaatggcaatttactatcagaattaccaatgacctaccacaatagtagttaagaattatgccatagttaaatatctagctattttattagtataaatataaatttatatttaaaataaataaatttgactaaatttatactaatatgaatttatactaatatatagtataaatttaaactaatattaatacatcatagtattagtataaagaaagtattaccattgtattaaaatattaacattcatttctttgtgggaaaataggcatatctgtactcaatacatttaagattaagaattatataacccagtgttcaagttatcacttcctgtcttaaaagctgctagaaactgttttaaatgactcatagataagatttttgtgaactagtgatatttaccacctttgcaaaattcaaagtatacctatatttaaccccaaaagaaagacatatctttcatgagtacttttaagtaaactttcattttaacagtctaatgataccttttgctccaccttcaaaaactgagccagttcttccacagttaggtgatctttcttgtcactgtagctcaaaagtaacaaataaaggtctcgtctcaaagacatcattttgtaaaaaacacagaactcttcaaatgtcaaagttccctgattctcatctgtgtcggcttcctgaaaagggcatagagaaaataaagtaatatgaaagttagaaataggaaattcagtactgggaaataatatttactataaaagagctagtacacaaatcccaagaggtgagcacacattctcttcgagcacacattctcttcaagcacacatggaacattataaagcaaccacatatttggccagaaagtttcaacaaattataaggaatcaacctcacacaaaccaattgttctgaccactgtaaatttataaatcaacaaagaaaccttaaaaaaaaaaaaacctgtagaaacaatacaattctagataggaaataaaacatatggaagtgaaaaatacactacatattaaaacttataaaataacattagaaacttgaagtcttaaattactagagagcaaagattttaaaaagaagttaataattcaactcaaaaaatgtgaaacaaaattaagcgaggaaaataaattataaacaaaagcaaaaagtaataaaatagaaaacaaacagctgtaacatacacgtgagaaagaaaaccaaagcccgatttctaaagaaccaataaaaatgagaaatcttgaaaaagactaatcaagaacaaaagaaagaagatatatttaacacttgagaaaaataacagtctctcattggtttctgaactgtaatccaatcaaatgtaatttttacctatgagagaatctctcttaattctccaaagatagagttgatgctcttaaagccatgggcatccttggtaactccctgctttccctccgtagaaaagtctaaacaatccatctggattgatttcttgttaaaattgtttctagtaattattgagcatgaagcttccatcatatgccttacttacaggttggctgaattattcataaaaccataaaactattggggataaataataagcaactgacccacttatgtgctcttcttcattctaagtgaacacaattctaagtaaacaaaaacagacagggaatgaacggcattttgaaatgcatagaatttgtgaagtacactcaactgttatatggtattaaacaaagctttgaaagtcaaagtggtcattaaaatctttttaaaattttgctaactttgggtcaattatgaacaaatgcttccaaattttactttcaataattacccaagaaatcatgatttgtataggtacagactttgtcccccccctttaggattggcctcttacattgaatcagcagctacctcttcaatgctgtgatcagctcctgtgcaaatgaacagacaggaggtggggctcacagcagggcaaaagtgagatgacacggaataccagaaacatggcaaaccttcccatatgtttaaagataattcatttgccctccaaagtccctcactccatctctcaggttccctatacagcaaatctcattccttcctcctcttcccattctctcatgctgttctccagtgcaatgggactcagtttcccacaatgcaaaccatctccaaccaagaacagggccacccttaaaagggtcacagaacagagccagcctctgtcttccatttattgttgcaacacataccccatgttgtctctgctcttaccacctctaagaacaagtacaaacattaaacatcatattgccctcctatgcttatttttacatgtacaaagtatcacctagaaaatcattgcaaaacatggattatgcacgcaacttatcttcaaataatagcctgttacaaattaatactctagtaatttctaatagcctaacattgtctttgccctgacttaaacttaagagagctcacttcggtactcaggtaaggattaaatgcagtcctagctggatgccacagaataagtctgggcccaagaatttttctcaatgactcatcaacagggaaagagcctttcatctaaccaacaaggagttgaatgaaattctggagagctccctaaatggcaggagtgaattgccctcctaatcctcatggatactaaatcctgaactcctcagaaacaaaatacagagctcttgaggttttagacaagggctattttttgtcatgttacttagtctttattctgatcctcacaagagccctgcgaagtaggcaaatgaggtattactgtcctctcaaagggactggagcaagtttcctccattatttgtcaggaaaacagcaacgataacaaaaaagcgttttaggaagtgaaattttggacgaatgttaaatttataaagtctttttacttgaaacaaaatcatttcttcatcaaagaaaaataaaacagtacagagcacatatattagcttccaacaaaacaaaatagctttttaatatacctaagtatgttaataacctctgtgtattttatataaggccagtgaaattgtgaaaacttacctgaaacatttgtctgacttttcttcggggcagattaacattcagtttatgcatcagctgatgtatctcttcaatattcagcaagccgtcaccattcttatcagcttcctcaaaggtctgcttcacccatgtgcagaaaggtcaaagaaaacacctgtgctctcatcaaaattaaaaactgctctctcacagaatactcgcaaagacatttatcagtaacacagaacttgagaagaaattattttgaggagcccctgcaatccataggctctgatgagctactaataatgatgacaataacaatgacaacaacaaaccaggaatggaagggaaacacataaagggggtaagggggttcccggctgggtgcagtggctcatgcctataatctcaacactttgtgaggctgaggcaggtggatcacctgaggtcaggagtttgagaccagcctggccaacatggtgaaaccctgtctctactaaaaatacaaaaattagctaggcatggtggcaggcgcctgtaatcccagcaacttgtgaggctgaggcaggagaactgcttgaacccgggaggtggaggttgcagtgagccaagattgctctccagcctgggtgacaagaatgaaactctgtctcaaaagaaaaaaaaggggcggggggtggttccctccattgcgaaatgagagttaaaccaaattattttgagcatctttaattcagacattcttattcaatcttatccaaattaaatatcaaatctattattgcaaaacactatatcactatcctaaatggaaggagtgaattaccctcctaatcctcatggatactaaaacctcatggatactaaaagctacattactggttctaatttcactctagcaagaaaatgacaccttaattcacacctccaatagcaaactccataaacataaatatttctatatgactttaaacgttatccctttttgcttttcattttctgaccagtttttctcagttatgctgccatgttcataacacaaatcttgtgtccctattagttctcattcacaaggttagagttcttcgtttatgaggcatacagatggcatgtagcaggaatggcccagtattacatctctctgacactttctgtttaagaatctctttatgatgaaaccccaaatatcataaatatagggcttatcttctcctatgcccttttacctactatctttttaccttcacaataccccatggtacatgatcttttcaattctcttttctctgtcccactcagacatttagcaaattagaccatctagttcaatctcatcattgttcagataaggacataaaatgagaggagagagagaaatctgataaaaattagtatgagaaccaggtctcaacccaggtcttttgtacctgatttagcacactcttctacacataaggtctgtctctacaccacgcttctcttcctattactggctttgatggttctcacttaattggcccaaatttctaaatcacgggcaggtaatgtgaagtacaaacataatgtgctaggaggtgccctcaaagctcaggtatgagattaagtgactgagaattagaagctgagtttagatacaaaaggtttacatcatgtgaactgaaattttaaaagatcctcagtgggaggagccttgggttgctttacatagtgagaatgcagatgaaatggtaacacaggaattgaaaattcccagttaacttttagcaaaggattttttcaaatggatgattcatagttgttgaggggtaggttacaaaaggcaagtactgcgtgcatatttagaaaaccaattaaacttcaatattgaagggtaatggagaggaaaagaataaggtgatagatagaaagaaaccagagaatcaaagtaagctaaaggtatagttttaaaaaccaagaaatgggagaatgaatgtatatcagaggagagggtacagcatatttccatttctatgcgattcaaattatgactgtagaagattatacctcagaaagtaaaaacaactagaaaggtaaggtattatgtcttctaaaattaagtagaggatattttcagatcgccttacttcatattttgtaaataccttatttcatattttttccctttaaaacttttaaaataactagcccagctctttctagttcaatttttccttatagacttgtcaggacctcattttatatgacccctggaagttaagggaggtccagatctggggggaaagtaaccgaagaaccaaaagggtgaaacatttggcccaatcactaataagtgcctgagtctcattttcttctgttttcaaggcacgcagcacccacttcgggctttcaactatggacactactctatgccccacaaagtacatggctggagttcaaagaagtgacaaaaggagtctgacggcagtaatatttttatccttttactctataattctttatcaaatataattctttatcgaagcctctcaaagtcttctccagagaagaggcagggacagccaaaccctaagcatgtgtgtattctgcagatacaaacatttaggataagcctgtgtctgtctgcaaagcctttagcaccaacacggaaatcggccttgattattggtttagggaactggtaaagtaaaaacagaggcagaatcaaaccaagaaatgtacagtagtcctaattctactgcttacttggccttgtgacagtgggttactcatatcacctcctggagcctccatttcttcacctacaatatcaaggagcacaacttttaaccttgaaatcccttccaactctaagattccataaatgaaaaaaccattctttccagtaacggtccacatagtatacaactccaggtaaaaatgtcctgatatcttaaagatgttcttcataattaagatatgagtgtccaataaagccctgaattaataatttatagccacaccataataattttaaaaagagaaacagtcattcctcagagaaaatctgggtgagactgaatgtgaagtaatgatctaggattttctatcaagagactgtaggagcatgcaaagcattgaatgatcctatctagcacaggggagggcaaacttttctgtaaagggcctgatagtgaatattttaagttttgcaggacatttgctctcagctgcaactattccactctgtcactgttatgagaaagcagccatacagatataaatgaatgaacacggttgtgttccaataaacctttattggaatttcagaaattccaataaaacctttattaaaatttcagaaccctgaaattctaatttcaagtaattttcacaggtcacaaaatgtttttcttttgattttttttaaccatttaaaacccattcttagctcaggagtccacgcaaaaatcctcctggattgggagtgggccagatttgcccagcagtttgacgggggaagaataaggtctggatttataacatacataacaggtggcctaaagccttctggaagtaataatttccctcatggggtcaagagataaggtggggaaaacatgaaggagaatggtctgatagagaaaaatgctgagcctaagtgccagaaccatcatctttgcatacagatctgctgagtattcagactttcatttatctgaataggaaagctaaagatttgccactctttacctctttttagcaatgacagcagtacctattacttgtaaactgcttattaagtgctaggcagtgttctaaggactatatataatcaactgatcttaacacacctctatatggcagacactgtcattatcatcatcaccatgttgcagataaaagacttgaaggcaaaagaacataagtaattcatccaaatttgcatagcacaggcagagtgggggctggaccgcaggcagtgcagcaccagggtctgatccctaatgacactggatttcttctagtaagtatgagtactgcatcatggccatcactcagcatggccatactgcagaaataagttacgctctagactggatggattttctcatgcagccatttaatttcattattctcatttttcattcacagttgaaattttcagtcctaagtgaaatctaataatgaacatcccaaatctgttctcttcattaatgtagttacatgtttatcaaattaaggatgtgatcccattattaagatactatctaggccaggtgcggtggctcacgcctgtaatcccagcactttgggaggccgaggtgggaggatcacgaggtcaggagatagagaccatcctagctaacacggtgaaaccccgtctctactaaaaatacaaaaaattagccgggcgtggtggcgggcgcctgtagtcccagctactcgggaggctgaggcaggagaatggcgtaaacagatgaggtggagcttgcagtgagccgagatcctgccactgcactccagcctgggcgacagagccagactccatctcaaaaaaaaaaaaaatacaaaaaattagcctggcgtggtggcgggcacctgtagtcccagctactcaggagcctgaggcaggagaatggcgtgaacccaggaggcggagcttgcagtgagccaagatcacaccactgcactccagcctgggtgacagagcgagactccgcctcaaacaaacaaacaaacaaacaaaattatctaaaaccctattaaattctgacaaatatgtatgaaaatgattccctgactcaaaataacctttctcatttttcacttcagctttctctttactattcatcaatttattatttctcttttattccttcactgacacaaaaatcaactgcttctatatttcttataaaattgtttctctgtgtagtgccacagtacacctgctttctggacagtatattttcagaatacggatcccatagactatgaaaactttcaagtgccagtaaacgtggacaatcaggttcgaaaacttttaaccaacaaagcaaaaagatgatttatgcccatctctaactcatctctttcaaggattatgagagagacttctataagtgacttgcagctatggaatgctgtgaacttgtcctagttaactggatgaggctagaagcttctggatttggttgcttccccatggccactgctcttccttctttgctacacaaccttgattttgttcaggtacccaaaagccatgtactttaatgatgagtgggaactggatgggggcgggggtgtaaatcttggtttgatgcaactgtcctcaaagtatagtcctggaggtccccataaacatgaggttccccccttttccaactacatgtctgtgtgaggccagattttcttcgtgtacttcaatcaaaacaacgtatcgcaacagactgaatgcagaagcagataagagaacccatgtgttctattgccagacattaaagagatttgtaaaacagtgaagcaatactgtttttctaacgtgttttgctttgaaaaaatacttgttataaaaatattaacatgcaacagagtttattattattataaataaacacatttttatgtctcacatttaatctctaatatgacaagtatcaataaataggtcccacataaacaaaagctctttagaatcttcagggtttttttgttagttttttgtttttgagacagggtcttggtagctcaccgctgcctccaactcctgggcttaggcaatcttcccacctcagccacctgagtagccggcactacaggcatgtgtcaccacacctggctaatctttttaattgtttgtaaagatggggtctcactattttgccgagactggtctcaaactcctggcctcaagtgatccttccccctcagcctcctaaagtgctgtgattccagccaggagccatgcacccagcctaagtcttcagtttttaagagtgaaaaaaagagagagatcaaagtttaattatgtcagttaatttctcctgcaagagattggtttaggaatgaggcagcaatagtaattttgggaaatgatgagaagttgtcttttgggggatttctgggaagtttttcttttctcttttaaaaaaaaaaaaaaaaaaaaagattcgtggccaagcctggtggcttacgcctgtaatcccagcactttgggaggctgaggtgagcagatcacgaggtcaggagatcaagaccatcctggctaacagggtgaaatgctgctctactaaaaatacaaaaaaaaaaaaaaaaaattagcggggcatggtggcaggcacctgtaatcccagctactcaggaggctgaggcaggagaattgcttgaacccaggaggcagaggttgcagtgagccgagattgtgccactgcactccagcctggacgacagagcaagactccatctccaaaaaaaaaaaaaaaattgtgagaagaaactctactacctctgtttagggctgtgtttagagatactgcctaaagctgcagcagttctctctgaccaaagggcagtcggctgcaagacgaagccaacacggtgagaatggcaggacctgggtctctgatgacatcactgaaccagtgaagtagctgcccctggaactgccccatctcaggtctcttgtttatgagaaaattaatattctttattgtttaaggcactgttagtacggtttctgatacttgtaccagaaaacattcagtatttttggttggttgttgtttaccaaatgttaaagagttagaaatcaaaccaacagatttaagcacagaaagttaaatcctgtttgtgttttgttcatttctaaatcccagttgcctttatctgcatgctgtgaatattgatgaaaacctcatggctcatcaactcagacttttcacactgtcaagatcctttcatgagctgaattatttccattcttttccagcaatactctgggtgaaggattatagccagagcagcacaaatatatcaccaacccctgcgaaaaaaattagggcacacattctaatgacggcaagggagtagcgctactccctgcaaggacagagacacctgtattttaaggccattcaaaaggtgaagaagggaatcaagggagtcaactagccttataccctcactttacagataaggaaactgaggccagaaaggccttgctatatgcccagtcaatcccagcaagaaggatgcctgcagaccaactccattaatcatttatcttgtcagcactgcaggaccacaagcatgggtttaatcaagaatgagacttagattccagtttctcaagcaattaagagagggtaaatattagtaagtaaaaaataacttcccctttggtatcaatcagttcaatttccaaactgtaagttagaaagagaaaaagcaggaaggagctcagtgcccagtatctaatcgcaactcacaaagtatttgttaaactaaactgactttataacaaagtaggattttctctaatccaaatcagtgttttcccagttacagttaatgaatatgcctatgatttaaaagaggcaatgatacttaatgggcactttccctctcttaggaaacttgaggctgtatttggagacctctgattgtggagctagattcggtctctttaaagaattttgctcctgagttcatacaagcttaagtgtccatacatttcatgcgttcatttatttggagtgagagtcaggaggggagaagacggtgtgaggggtaaagaaagagaaaggaaaattatgggaaaaattaaaacatagtctaatccttacttcacaaatgcacacacgcatacacagagagcaagagagagctgaaaataaagttctagaaaggatattggtcatgggtcctctgccttttggcaagggagtcttcatcactgatgccagccatcaggtacttgaggcctgtgatccaggtgcgggcctcctcggggttggaggtgatgaggtccagggactccatgtggttgccatggtagatggtgaagcagcagctggggtcgaagttcccctcagcttgtctgtggaatatttcagactgccggccctcagtcactttgtaaatggaatcaataagtactgtgaggaaaatgagatacacacagttatacagcaggcaaagatacttctttacatgcactaagaaacaagaaaagcaaaatcattttaaatattaaaaataagtatgaggctgggtgctcacgcttgtaatcctagcagtttgggaggtcgaggtggacagattgcctgagctcaggagttcgagaccagcctgggcaacatggtgaaaccccgtctctgctaaaataaaaaaaaaattggccgggcacggtggcgggtgcctgtagtcctagctactcaggaggctgaggcaggagaattgctcgaacctgggaggcggaggttgcagtgagccaagatcgtgccactgcacaacagcctgggtgacagagcaagattccatctccaaaaaaaaataaataagtaagtatgaaaaaattcactgcctgcaagttgtggtttcaggttaaatgtgaaacccaggccctgttttttcccactagaaaccttctctgcataacacttgtgctgcctgagctgtcttgacaacattctcctaaggcaataattcaggacgtgttgaaatttgtagtaaaaaaaaaatagatatgtcaattgaagcaaaaagactggtagaaaaggtggcaatgactatgtcaaatttgtagtttacatatttgtagaaaatatgcaaagacctagagtggactttggtgttttgcaacatgcataagaagatcgttagaaaactgaaaggaaaaagaatttctgacaatcaaatagctgagctacatggaactggcattcctagagaaaatgccatagggctaaggtggtgaaggcagagcagagcttggagaagtggagaggaacaagctgacacctgaggagaggcagaaacagatatagaaagataaggcccattccagggatgctgagcaggccgcttatggtggattggaaagctcaacagggagaataatgggagataaaactggaaaggtagacaatggctagattgtggagtggctggaatcacagagattagcattatttagttagcagagcaaatatgaaggtttggatcactgaagcacagggcaagaaggataatttcagactaataaattatttttggtctgtgtgcttgtttatttttcagtaggaatcagaagtttgtatatcctattgattatttatatacaccatctacccctcacttctgccttaatggcagggtcccaattttcttctggtatcaactcatttcccacatgactcacagggaaatgagcctatgctcagcccaaggttctgccacctttgtactctgggacttgcatcagtggcccccaggttctcaggccttcaaccttggacttggaattataccatcatctcccctgcttctcaggcctttggactcaaactgagctacaccaacagcttccctggttctccagcttgcagatgacctatcatgtgacttcttggccttcataatcacatgagccaattctactaagtcctctctcatacatctatgtatctatctatctatctatctatcctattgattgtgtttctctagggaaagctgactaatatagtgtgagggaaagaagctttaagtaggagtcacatcaaaatgactttacttgataaatttaaatggtgttgttaattcattaatcacttaatagtgttcagaatatgacaatacattttaaagcccattagctttataatgtccctcaccttttataggaatgtaaaacatctcaggctgtaaaaccatatattccaactaaatatatatatatatatatcatgtctccaacacaggggaagtattagcatttacagcattcatggacaagaaaacttttatggatttaaattccccaaagatggtcattattctgcctctcaatatccaaaatcaactatctccaaacttataaaagtataaaacttccacagatctgaagcttcaagagcccactcagtataacccgtgtgttactatgtccagccaagcaaagaattcaaagatttgttttactttttgccttctcactcttcctagagggtcgccatcggaggcgtgtccggtgctcatccaggtaaaagaggcggacaagccctttggttccacgtttcagcttgatcatctgtgtcccggactgcatcacactcatgcatctttcaactgcaaaagaaattagagtgtatccagctatcacacaatgcacaggcatactggtgtccaggttttagagtcaaataaaacctctgattcacctgcaaagactccaaggaccagaacaaatttggtagaggtaatctgaaaagtgagttgttaaggaattgattcaacaggcttaagtcagtaaaaagccttactaacagaaaaaaaaaaaaaaaaatctacttccaggtaaataatgcaatacttcatagggctatcttctgttctgttttttggtatgagacttaagaccatttgatacttggatttatgttcttaaagtaagttctcagacatgataagtcttgtgagtttttatagaaccaattataaaagtatcttataataatgctttaaatgcaatcaacagaaacaagattggcaaaatgctgactgttgttaaaatgggataatgattacatatgaattcatgttacatatttgtgatgtttgaaaatagctaaataaatttctgtaaatgtaatcagaaaaaaatcaagttttcacagttgaacataaaacacttgctgatgcattaaactgctaagataacccttctagaagaataacttgttgaatgaatccaggtaatatccaaatcacttatagtccaagttaaagttgtcatttaaatccactctgctttgagacaaatcttgctggatataggaatctgttatttttgcctgtttccccttgtttggtaatggtgccccaacttttcctttagaaacatcctctaccattttgtgtgcctttgatggcctgccaatcaccccagtgaaagagtagacacacctgacttaagcttggagcaaatctgactccctcccaagaacataaatcctgagcatatcattgcttgaaaacagaactgaaccattcaacaactgagatactcctagttggctactctaagatgtgacagttgtcataattcttattcttcctaagactgacaaatgatcccattttccccttgattctgcaagttatccagtacccttccaaatatttttttattatatcaaccagaaatagcttttatttcacaaagattaccaactaatatacagacttatgtataaaccattagagcactcaaaatacctagttctgagtacctaccttatcaagcagtatgctgttagaaacaacagataaaagaaacacaataaacaaacctcagcaacattagacttctgcttttttggctaaatattttatcttaactaggaaagataatctcatccaacaccttaacattgtatgcatagggtgcctattaaaggtcacttcaacataacaaatgttcacaatttactccatgaagtctttcctttcctcaaagaaatcaaggaggaactgcaaaaaattaagtatagtttcaggattcaatactacaaagaagatgaagtataggttgcgtttactcattttatctgacatatcaaattcccaaataataaaatattacttaagaaggctgggcgcggtggctcatgactgtaatcccagcactttgggaggccgaggcgggtggatcacctgaggtcaggagctcgagaccagcctggccaacatggtgaaaccccatctctactaaaaatacaaaaattagccaggcgtggtggcaggcacctgtaatctcaggtatttgggaggttaaggcaggagaattgcttgaacccgggagaaggaggttgcagtgaggtgagatcacgccattgcactccagcctgggcaacaggagcaaaactttgcctcaaaaaaaaaaaattacttaaaataaacacacaaacttgaaatgctcactttaaagcacagaacaaaagttgagattgagtttgatataaattagtatattcggccaccactgagcatcactcttttaggcaatgaaagctacatagttgaattcttgacagccacattaaccatctcacacgaggaattaaaggttcaagacaaaaccaccaaatcaaaccaaccaagccaaaattcccagaaaagcctattagaacttcactgaccactgacaatagatcatatcaataaacagatgtttatagacaaactccctgttccaggcacaagactatttcataaggtgaagcaaagaacaaggagactttgcctttgaccttaaagagtgtaaattttaagagaacaaaacatctatacaggatacttattaatggcaattcagagctgtggtgaagaatacagtctgtttccagcttggggtagaattccagatctgccacttactaactgtatgactacatacagctagtaactcatttccttatctataaaatgggaataattatctacttcctgaattgaagtaaggattgaatgagttaattcatgtaaagtactgaaaacagtagctggcacatccgaaacaccaaaaatggtagctatttgtaacagactgaatgtgtatttacgtccccaaagacctaaccctcagtgtgatagtatttggagatgggtcttttgagtggtaattagaaacagatgaggtcatgcaagtggggccccatgatctctctctctctctctctttccctctctttctctctccacccgcccccctccccatatgaagatacagcaagaaggtagccatctacctttttcaagccaggaaaagagtcctcaccaggaagtgaatctgttgggactctgatcttagacttttcagcatccagcattgtgagtaataaatgtctgttgtttaagctacccagtctatagtattttgttacagtaattcaagctaagacactgctatagttttattgttattgaaatagttaaaaataaatgcccagtcagaagtaaatacagaaatactatgggaggccaaagaaaaagagaatagagtaggctggaatggggagaaatgtagtaataagacaccatcaatgaagacttgggtataggaaagggtatgagttaagaatgatcagaagaaaagagaaaagatgagcctctatctttggaagagtgactcaaaagggaattgacagaatgtatgattccatgagctagataaaaccaggttgtggggggactggggatgctggttaagactttgatccaccagcaatgagaggctcactagatatatctgttcaaaggattggctggctaaaaaatataatttaggaagatgtttccttgagaagagagaataaaacaaattgtttaagccagagtggaaaaccgagttaactatattatcagagatctaacagcaaggactgcctatgtatctgacacaggaaaacaaattgtttacgccagagtggaaaactgagttaactatactatcagagatctaacagcaaggactgcctatgtatctgacacagggtcctctgttttgttcacaatccctttctttcctttctcagctccttttcctttccctgaaatggaactgccatggctataacagctcaacattttaacaggaacggtatatctgcacattgttttagcataaaatcatataaatcatataatatgatttctatgagaccctgagtctgaaacaataggcttcttaaattgtttatgtagctgctttatgctttctacctgattgctccctatcacacagaaaagccatttggatagaggtaaattgaaaaatcaagtccactgaaatcttgagagtcatctaacttacttttccctttcccaaacaagatagttgacaatgccttgtaattacaaagctaaccagagataactggttagcaccctcaataactctttgcaactcattccagtgggcaaaagtcaccaacaatacatacaaaatattcttccagtctcatctagatcatttacgtgtcagcacaagccactttcttcctattctgcctccaacagaaatgattaacagcagttaccacccctaaaaatcattgtccacccatgctctattggtagattccataaaagagaataagaatggctttgccacaggtaaacaagggaagagttctagtggcttagaatgatttaacttcatcacacacatttccagtattgaaggttctctgagaaaagtctgcaaatgcaggttacaaattctggcagctgccaatatgttcaccatccctttaattctacattctcctttatggtacgcttaagatagctaaaaaaaaaaaaaaaaaagtttatttggatacaatgcagcaacatctaccagcccatcacacagcacaaatattgtttgtatctgttatgctctagaccttcacacttgtataaaaatgtgttgcactggttgaaattgtgatatttaagccatttggcactctgcttctttcatttgtattataacagctttccatgtttctacagagtcttaataattatcattttaatggctgcctaacagagtagcataaatatttaaagagcagaacagatgagtcgaagactatattcctaactttattacatagctagagttttaaaactcttaatagagtcccatcgataaaagaaaaggcataataatgtggtctacaaggtctttttttttagacggagtctcgctctgtagcccaggctggagtgcagtggcgtgatctcggctcactgcaagctccgcctcccgggttcacgccattctcctgcctcagcctcccgagtagctgggactacaggcacacgccaccacgcccggccaattttttttgtattttttagtagagacagggtttcaccgtgttagccagtatggtcttgacctcctgacctcgtgatccacccgccttggcctcccaaagtgctgggattacaggcgtgagccaccgcacctggcctacagggtattaaataattcaattttttaaaataattaaagtcaatcctttctgccacaagcagtttaatataagtaaatttccttaggggctataaggtcactaaatccctcaagcagaaaatgttgtaaaaaatacatactttggatttgaagtaacatattaatatcatttatgttatatatgtgtatatcacttggcaatatacatatataatacatatatacatatatatgattagtatatgtcatttggatatatatacacatatatgattactatatatcatttggaggaaggttcccaagatttcaaccaagtatgtatgacatctaagaaggtttaattcttccaattatgtttgaatcagaaataatcacattctgttaggaatgtcatacatgccacctgatgctgatttttttttacagttttactgaggtgtcattgatatgcagtaaaattcaactgttttaaatgtacaattcactgacttcagtttatttacagagttgtgtgacagtctaatcacacaacatttccattatccctcatgcccatttgcagtcactccccattttcaccacagtcctggacaaccactgacctactttctatctcaataaatgggcccttcctggatagttcatgtaaataaaatcatataatatgcagtcttttgtgcttggcctttcactaagcataatgtttttgagttttctatgatgactatgttgtttcttatcttttccttcctccagccccgccacatcatgctaaactcttccactggcacttcgggtaaaaattaccctgaataggagacaggttgagtaaaataaacaatggagtactatgtaagtgtaaaagataatgaggaagatctctatgaactgatatggagtaacttccaggaggtttcaataagacaaagtatgaataggtaaatatagtatgatatcttttgtgtaagaaaagaatgggaaatgttttaaatatacaaatacctgcttatcattacaaaaacgaacccaagaaggataaatcagataacaatggccctgttacctataagaatgacagaaaatcgagtagaaaggataagaaagggaatgacactactcttagtatcccacatacttaaatcagtaagagtaggaaggggaacaaaacagaaagtaacacagtcctgcacctcttaagggtgaggatacattctgagaaatgtgtcattaggggagtttgtcattgtgtgaacatcatagtgtattcacacagacctagattgcatagcctattgcacgtctaggctgtatggtataacctactgctcctaggctacaaacctgtacaacatgctactgtactgaatactataggcaattgtaacataatggtaaatatttgtgtatctaaacacagaaaaggtacaataaaaatatggtattataatctcacaggaaccactgtcatatatgtggtccattatttactgaaatgtcagtatgtggcacatgactataaatatataaacagaaagcaatctacacacacacacatatatacatatttgtgcatgtatatttgcatgtttgtgtatatgtgtatgtttttatatacctgcatatatttccttgttctagcctttgaaaggaccaacaggcaaaatcacttctagcagtaatatgcacacttggtgctctgatcactctttgctacaaaagaaccttgagacagattttcacatacagaatcatgaccattcgccgagattagggtcatacaagaatatcacttgcactcttttgtgaacacatctattctgggacactgatcattgaactgtgaattagcaggcacaaaaacaacaacaacaaaaaaaaaagtccaggtcctttgcaagacaatctttttagtaaaaaggtacataaaaaatgtgaactgatttcctgccagcttccacagattagagtaaatctgagtaattgaaagagattagcttctgaaaacaatttcatttctatgtggaaaaagtgcaaaatgatgcaggtaatgtttgtcaaaaagtaaggaaagggagatttcctaaaaccatcagggcagaagtaaagggtatgtttgtttaattctcagcacaaacccaacacctattttgggacttggtacatagcaggtgctgagagatctagtttatggcatggcagcttgataacagcatctgcccacagttttgtgggcacaaagaagggagcaaacagagttctggtctgggctctgtcactggctgtgtgaacttcagaaggtaactgaatatcctactttcctcaacctaaaaaggcatttttctctatgttctgtgagtttataaaacagctgatctagcttccataaatgttattttatctttcaatgagaaaaaattccagttcttctgaaagctttttagaataattttaaagaaagaaactgattaacatctgggtgtcttactacagacatgatttttttttaatgatctctatataaaacataactgcttggctgtgtgtggtggctgacacctgtaatcccagcactttagaaggccaaggtgagaggatcacttgtgcccacaagttcgagaccagccaggaccacatagggagacctggtctctacaaaaaatttaaaaaattaaccaggtctcgtggcacaaacctagagtcccagctactcaggaggctaagacgagaggctctcttgagcccaggaggttgaggctgcggtgagctgtgattgcaccattgcaccccagcctgggagatagagcaagaccctagactcaatcaatcaatcaataaaatattaagtgaagccattatctgtgaagagcagtgtatataaataaatatatatataaactaattattatagtttattcatataaaactgctcttcacagcaaatggcttcacttaaaaagctattccttgccagtagtaaagccttaaagtcaaataatacaagcttatgaataaatgtgcttacaaacaaccatggagtgattcactcttactaagtcatgattcttcccagtaaagaacaaacaatgtagagtttgttaattttttttcattgcctaaatcattcctgtggagaagacaagattatttaaaaggcttttaaaaactaattggttaacagtttgaaaattgtttgcgaacgttgcatgtacatagtcaatatgtttataaacttgataaatacaaatgaggagaattcggtcaaagaaagggtgaaaggaattcatcagtagtttgttaaatgtcagacctttttctatttgtattaaacccttccacataacactttcttttttaatgatgtctattttatgtgtaacaattgtgtctgttccatgttttccatactcatggaaaacaaaaggaaatactaaaaattcataacaatatagtggcaagtagggtcaccagagccactcagagaaaggagaccctaaactctggccagcgaaaggtaagaatttcctgctagccgggcttctggccattctctgtgcaaactggttaagagaatgataaaaatcactgtttgcctcctctgcaaggttttaattaatgagaaaaaggattagtgtgacaagtcttagattgtagcgaatctggtgtactttgtgctctgaatttgtctctctttgccattctgtcatggacggcattccactggataaaacgcaggtctaggtctcccgccattcaagttggcccagcagactggtcagttataaactttgctttgggtccctgaaacaaaaactgaatgaggtttccctcttgttttatgtcctggggagcatgaccctgtgaccctgtagaggtactctctctttgtctccaccacgtggagggtgggaattttcaggttcacatcggtgactagtctgaaaggagtcaacacactcttagtccaaatgtgtcaagcccttgggtgagttttgtcttaaaaggtctcatgctaccataagcccatttctgagagtaaattcttggggatcatggaaatgcctactctaccccctctctagaaatatttcttgcttgtatgattttaaaaaataaaaaaataaaaatctgaaaaattaccatttgactttaaagaacttttggattgagttgctattagaactaagtacactattaaaacaaaaaggactttagcaatctcttattctcaataattttttaaaggtttaaattaaaagaaggatgcattataatgtcatcattagccttaaaaatcatcttaagcagttaaaatccttttcaagcccgaaaatgcctgctctaggctccttctgggaaaaataatggcaattgccccatgctacagctcggtagcaaaggctttgcccttttgcaatggcagcccgagttcaactgctggcttagagaatgagttctttctggtctgttgtttgtgtgacctttgccatttattgattttttttctctccatgaacaacttctaacttcctgtgttgaattttcccttctctgagctacctttggggtgattctagatcttgtaaaaacaactcgccctccctttggagacacctcatgtatctgtggctaagtcataacctaagttaaggcttactggtttcacttgggaaaatatcttcgtgggagggaaaaaaaaaagaaggcttaaaagccaagggtgtcagctatttgtcccagctctagctggtaaaaagagattttaaagaatttttttttaagaaaaaagagctctagaattaaaagtcagcttaattaaaaacagatatcaaagctatacgtatattcaaaagggctttatgcttttttttcttcttgaatcttgttttttgaggaaaaaaagttttcttctcagtccattgaattgtttctccatttacttcttcttgctacccttgatgcccacaagtgaggacctaaggtaatttctgacagcctgggactccttaggaaaaacagaggaggagaccccgttttaggaaaaaactctgttttcctcatggaaccccaagaactgtaaatggacagatctgctcaaaatctaagacttcgctctgttttgcattgcatcacttgatcttttttactttggggagcatcaaaaataactccacattatgaggaaactttcagccttggtgtgtaatagctaggtaagaaatatacttttagagatatagtttatgcttggtatataattagctacgtaggaaatatacttttactattgctctgtagtagtaaccattcactctaagtggcagttgcttatagtgaatggttattaccacaggaaaatactcctttctttgcacatttagataagaaaaacatgctcttgggcatgaagaaggtattgaatgggggaataggctgataatagagtcagctgattgccattgggttgcccaccagccttggaaaaatgcctttgcaacaagatacactgtggaagcactgtaatgcctcatccagttgagttcccaacttttagagaacctaggattcaatatataaatgggatctttaatccctggtgatctgttttaccttccagttgtgcctgcttattatgccctagaaactgacttcttcctcaccctgttccttaaaaggcttcaccctaaagccaataatacaatttaaaaatttacatctttaaagaaatctccatgtgtaacagtgtctgcttttcctggacaaaatggtgtgaactttaagtcacaccattttttcttggtttaaataaaatgtaaatcctctatcttgtttgatctaagagttgccctcttaaaaatgcaaatttagagttgcccagctgaccactgtttagggcaggaagcaagtaatcaagagactgatggtctaaaatgcgaaagagaaacttaaaaactggcaaataaaaaatgtattactctaacagatctacttctgtttgtctgtgtatttatatgcgttgcctgtatgatatttatataaaagagccctaataaattggcttaaagaaaaataagtacttaaataatatattttgtcaaaaaaataaaaaaacatgaatgcattttagtttttttattatagtaatctttggtaaataaatacaatgtttatttgtttttttttcttttgagacagcttgtcacccaggctggagtgcactggtgtgatcacggctcactgcagcctcaacctccctgggctcagatgatccttccaccttagccttctgagtgctgggagtagaggtgcatgccaccacacctggctaatttttgtattttttcataaaaacagggtttcaccatgttggccaggctggtctcaaactcctgggctcaagcgatctgcctgcctcagcctcccagagtgctaggattacaggcataagcctctgttttatttaaagattattaataaaaatatcttcaaaatataggcatttgggaagaaaaatggcagagagaagtcaggactaagatgcagctaccatttggatggacaggacagagtatggagactcacactgtgaaattctgctccaagaaccactgcaggaatgtgccaggaagagaaagagttcacagatcctgtggaagaaacagctcactctgtaaattccacgagacagcaaaaaaactgagttcccaaagtataagaggagaaaaccttcctttgaacttgaaaactttcaggttcccctggggaacctgaaaatccagattataggagaaggaattaaccttacctagagctgaaatggatttagggagccaagtgaaatattaaagtagaagaagcagcaggaacagccctgtaggcactcccagtcaccagctccaggctagggaagccattcttgactttatctaacaggggtccttggggaagggatcccacaggactagggagggggtcacaaggtgaaagaagcttctagctgaactttataataatttcgactgagcatgaactttcttgagcagaatctggagggacaaacagaaattgctgcaggagccatggctgacagtgtgagcaggcagggaggggtgaggcctgaaagctgtgcttgccttctcaacaaggaggcttgaagcctggggcaaggtctgagcctggtgcatagactgcctgcatataaactgcacgaagctgcatgggagctgagtgaggcctgtcactgctagtttccccccacttccctagaaaccagctcactagcttcatggaagctgtgtgaggcccgtcactgccagctttcccccacttctctggaaacctgtatgcgcagtgaggcagccgtaattactcttggaacataattccatcggccatcccacacagcagcctcagcaactcccacccaaggagagtctgagctcagacccgcctgatcctgcccccatcggatggtatttctgtgcctgcccaggtagctgaacacaaaagacataaagtcttggaaactttatggccctgcccatcgcctgagaaaccagaatatttatcctggccaacttagagcaagcttatatcctctttctactacagcagctcgtgctctcttgaaagtgccacctcctgactggaggtcaaccaactcaagcaattacagcaactcaagacagaataactctgctcccaggaaagggaaaacaatagcaaattccatctcatgcaacatactggctaaccagaggtcctgagtatgtccacatgacaatttcactgccaccaaaaccagcattcaagaaaatcagtgcactaaacaaaactacaagcaacaaatctcacagagtctacttcattcccttgccacctccaccaaagcagggctggtatccacagctaggagacatgaagatgcctgacatcacaggactcttcgcagactttccccagcaccagcccagagcctgatgccccactgggtggctagacccagaagagcaataagaatcactgcagttcaactctcaggaagccccatccctggaggaagcaggagaacaccacatcaagcaatcgccccatgggaaaaaagaatctggacagcagcccttgaatcgcagatctttccaatgaaatagtctacccaaaggagaaagaaccaaaaaagtaattctggtactatgacaaaaaaagattctatagtaccctcaaaagatcacactagttcccagcaatggatccaaaccaagaacaaatctgtgaattgccagaaaaaaagaattcataaggtaggtctattattaagctactcaagaagataccagagaaaggtgaaaaacaaagaaattaagaaaataataaaggatatgaatgaaaaatttgccagacaaatatatataataaagtaaaaacaaacacaacttctggaaatgaaagacacttagagaaatacaaaatacaccagaaagtttcaacaatagactagaacaagtagaagaaaaaacttcagagctcaaagacaagggttttaaattaacacaatctgacaaagataaggaaaaaagaattttaaaaaagaacaaagcttccaagtaatttggaattatgttaaatgactaaccctaagaataattggtattcctgagcaagaagataaatctaaaagtttgaaaaacatatttgagggaacaatcatggaaaacttccctggcctcactagagagctagacatccaaatataagaagctcaaagaacacccaggaaattaactgcaaaaagaccatcaccactgggtgcggtggatcacagctataatcccagcactttagaaggccaaggcgggcggatcacctgaggtcaggagattgagaccatcctggctaacatggtgaaaccccatttctaataaaaatacaaaaaattggccgggcatggttgcacatgcctataatcccagctactcaggagactgaggcaggagaatcgcttgaacctgggaggcagaggttgcggtgagccaagattgtgccattgcactccagcctgggcaacaagagcaaaactgcgtctggagaaaaaaaaaaaaaaaaaaaaaaaaaccatcacctaggcacattgtcaacagattatctaaagcaaaggtgaagaaaagaatcttaagagctgtgaggaaaaaccgtcaggtaacgtgcaaaggaaaacctatcagattaacagaagatttctcagcagaaaccctataagctagtagaaactgggaccctatctttggcctcctcaaacaagataattatcagccaagaatattgtaatccagcaaaactaagatccataaatgaaggggaaataaagtctttttcaaacaaatgctgacagaattcaccactaccacaccagcactacaagaactgctaaaaggagctctaaaacttgaaacaaaacctcaaaatacaccaaaacagaagctccttaaagcataactctcacagggcctacaaaaaaaacaacacaattaaaaaaaaacacaaggaattcagaaaactagcatgatgaatataacagtacatcactttcaatactaatgttgaatataaatggcctaaatgctccacttgaaagatacaggatggcagaatgaataaaaatccaccaaccaagtatctgctggttttaagagacttacttaacacataaggacacatgtaaacttaaggtagaggggtagaaaaaggtattccatgcaaatgaacaccaaaagcatgcagaagtagctattcttatatcagacaaaacaaactttaaagcaaaaacagtttaaaaagacaaagagggccaggcacggctcacacctgtaatcccagcactttgggaggcagatcacctgaggtcaggagttcaagactagcctggataacatggcaaaccccctctctattaaaaatacaaaaattagccaggcatcgtggtggagtcctgtaatcccagctactcaggaggctgaggcagggagaattgcttgaacctgggaggcggaggttgcagtgagccgagatcaggccactgcgctccagcctgggtgacagagcaagactccgtctcaaaaaaataaataaatacaaataaaaaaacaaaaaggaatgttaaataatgataaaaggattagtccaacagaaaaatatcacaatcctaaatatatatcttcctaaaactgtagctctcaaatttattaaacaattactactagacttaagaaactgatgaacaacaacacaataatactgtgggacttcaatcctccactgacagcactagacaggtcatcaagacagaaagtcaacaaaaaaacaatggacttaaactacaccctagaacaaatggaacagatatttacagaacatcttacccaacaactgcaaaatatgcatttttttcttcagcacatggaacattctccaagacagattatatgataggtcatgaaaaaagtctcaacaaatttaacaaaataaaaattataccatgtatcctttaaaccacaatggaataaaattggaaattaactccaaaagaaacgctcaaaactatacaaatacatagaaattaaataatctgctccagaatgaattttgagtcaacaataaaatccaggtggaaatttaaaaattatttgaactgaacaataggagtgacacaacctatcaaaactgctgagatacagtaaaagcagtgttaagaggaaactttggccaggcatggtggctcatgcctgtaatcccagtactttgggatgctgaggcgggcagatcacctgaggtcaagagttcatgaacagcctggccaatgtggtgaaacttcgtctctactaaaaaataaaataaaataaaataaattagccaggcatagtggcaggtgcctgtaatcccagccactcgggaggctgaggcaaaagaatcacttaaacctgggaggtggaagttgcagtgagccaagatcgtgccattgcattccagcctaggcaacaagagtgaaactctgtctcaaaaaaaaaaaaaaaagaagaggaaacttcatagcattaaatgcctatatcaaaaagtctgaaagaggacaaaaagacaatctaaggtcacacctcaaggaacttgagaaacaagaacaaactaaacccaaacccagcagaagaaaagaaaaagaaataaccaagatcagagcagaactaaatgaaactaaaactaacaaacaacaaaaaaaaaagataaatgaacaaaaagctggttctttgaaatgataaacaaaattgatagaccattatcaagattaaccaagaaaaaaagagagggctgggcttggtggctcatgcctataatcccagtacttcgggaggccgaggcaggcagatcacctgaggttgggagttcgagatcagtgactaacatggagcaaacccgtctctactaaaaatacaaaattagccgggcgtggtggtgcatgcctgtaatcccagctacttggagggctgagacaggagaatcgcttgaacctgggaggcagaggttgcagtgagccaagattgtgccattgcactctggcctgggcaacaagagtgaaactgtgtattaaaaaaaaaaaaaaaaagaaaagatccaaataagctcaattagaaacaaaacgagagatattacaatcaataatacagaaatacaaaagatcattcaaggttcccatgaacaacttaacacacacaagctagaaaacctagaggagatggataagtttctagaaatatacaaccctcctagattaaacaagaaagaaatggaaactctgaacagaccaataacaagcagtgagaatgaaacagtaatttaaaaattgccagcaaaaaaatgtccaggaccagatggattcacagctgaattctatcagacattcaaagaagaactggtaccaatcctattgacactattccaaaagatagagaaagagggaatcctccctaaatcatgctatgaagccagtatcacccaataccaaaacaaggaaaggacataacaccaacaacaaaaaaaaacagaccaatatctctgaagaatatagatgcaaaaatcctcaacaaaatactagctaatcgaatccaacagcatatcaaaaagataatccaccatgaacaagtgggtttcataccaggaatgcaaggatactttaacacacacaagtcaataaatatgttacaccacatgaacagaactaaaaacaaaaatcatatgatcatctcaacagacacagaaaaagtgtttgacaaaatccagcatcctttatgattaaaaccctcagcaaaactgccgtagaagggacatacctcaagggaataaaacctatctatgacaaatgcacagacaacatatactgaataaggaaaacttgaaagcattcttcctgaaaactggaacgagacaaggatgaccactcccaccacttctgttcaacatagtactactgaagtcctagtcagagcaatcaaacgagaaaaaaataaagggcatccaaatccgtaaagaggaagttgaactgtcattgttcgccaacgatattttatccctagaaaaccctaaagacacacccaaaatgctcccagatctgataagttaatttggtaaagtttcagaatacaaaatcaatgtacacaaatcagtagcactgctatacaccaacaacaaccaagctgagaatcaaatcaataactcaaccccttttacaatagctgaaaataaatagaatacttaaaaatatacctaaccaaggaggtgaaagatctctacaagaaaaactacaaaacattgctgaaagaaatcatagatgacacaaacaaatggaaacacattccatgctcatggacaggtagaatcaatattgtgaaaatgaccatgctgccaaaagcaatctacaagttcaacgcaatgcccatcaaaataccatcatttttttcacagaactagaaaaaaaaatcctaaaactcatatggaaccaaaaaagagcccacataacaaaagcaagactaagtagaaagaacaaatctggaggcatcacattacccaacttcaaactatactacaaggagatagttaccaaaacagcatagtactgatataaaaacaggcacacagaccaatagaacagaatagagaactaagactaagtaaaaagaacaaatctggaggcatcacattacccaacttcaaactatactacaagactatagttaccaaaacagcatagtactggcataaaaataggcacatagaccaatggaacagaatagagaacccagaaagaaagccaaatatttacagccaactgaccttcaactaagcaaacaaaagcataaagtggagaaaggccaccctattcaacaaatagtgctgggataattggcaagccacatgtagaagaatgaaactggatcctcatttctcatcttatacaaaaatcaactcaagatggatctaagacttaaatctaagacctgaaaccataaatattctagaagataacatcagaaaaacccttccagtcattggcttaagcaaagacttcatgaccaggaacccaaaagcaaatgcaatgaaaacaaagataaatagatgggacctaactaaactaaaaagcttctgcacagcagaagaaataatcagcagagtaaatggaaaacccaaaaagtgggagaaaatcttcacaaactatgaatccaacgaaggactaatatccagaatctacaaggaattcaaacaaatcagcaagaaaaaaacaaaaaatcctatcaaaaagtgggtaaggacatgaaaaggcaatcctcaaaagaagatatacaaatggacaacaaacatatgaaaaagtgctcaacatgactaatcatcagagaaatgcaaatcaaaaccacaatgcgataccaccttactcctgcaagaattgccataatcaaaaaatcaaaaaatactaagtgttggcatggatgttgtgaacagggaacagttctaccctgctggttggaatgtaaactagtacaaccactatagaaaacagtgtggagattccttaaagaacaaaaagtagatctaccagttgatccagcaatcccactactggatgtctacccagagaaatagaagtcattatatgaaaaagacacatgcatacacatgtttacagcagtacaattcacaattgcaaaaatatggaaccagcccaaatgcccatcaacgaacaagtggataaagaaaatgtaatactgtccagtcataaaaggaaatgaaataatggcattcacagcaacctgaatggagctggagaccattattctaagtgaagtaactcagaaatgaaaaaccaaacattatatgttctcacttacaagtgggagctaaactatgaggacacaaaggcataagaatgatataatggaccttggggactcagggggagggttgggatgggggtgaaggataaaagactgcacattgggtacagtgtatactgcttgggtgacagatgcaccaaaatctcagcaatcaccactaaagaacttacacatgtaaccaaaaaccacctgttccctaaatattattaaaattttaaaaattagacatttggtctaaattagacaggtaagatactactgtccttactagatgctttaaagtcataaactgcttctatggcttttgataattgttcaacttgcttgctttagagccattggattctaggtaaggcctagagacatttggagttagccatatcccctagctatgctagaaagagtccgacattatctgtggttctgccctgtatcctacactctacacctgatacataattaaaattacttacactaaaaataaaaatcatgcatttttagtagaaaggtatggaaattatagtttcttctaagagaaagtaattctgtctaatttagagggtttaagcattgttttaagatagaaaagaataaaactgaaagtttaagcaaggtgtaggaggtttgtaaaagattaatcttacaaagaaaaatttgtgtgtgagcaagacgactaaaattaaaatggcatcatttagtttttccataaattaaacattagcactgatgcagggccagaacctgagcccatgtgtcagaataacagagttctcttggagcattgatctgctctttaacagaaaattgtaaaaggttataaaaggtttattaaagtcttcttttatgattaaacttgtttaaattagatttacatataaaattttattaaaattagctttagcattactatattactgcaaagaaaaaagtttggtttacctttgatcaagatttctgcttgcctacaggaaaaggggacagagaagagacagattcagctggcctcaaactgtctttattgggtcttgttatttggaaagctgtctcctctctataaaataataaaggatttttgcttttttgaaatctttgagttaatcactttggctaaataaataaactgtggtcttaattttgtgatatcaagtgttttaaacctttgatatgtgacaaactttccaaaatcaaattctaaattagctttttttaacctgattaaccctgttagatattagttcccctagaatccaaaagaaacatattcagtttaatataattaatttaatttaaatcacatggaaaacattgtcaagtataaaatagtgcttaattttatttgggttatatccatataaatgtgttattaatatagttttcaaaattgtaattctgtcaatatattatcagtaataattattatcattatgtgccactggcataaccaaatttacttgtcaattgtgtctttaactgtgactgtcctaagacttttgtcatccacagacaattgtcctgtttgatccttttcagaggatggtttataattagctataggactctgacaggcactcttgaatgcaggcctctgataactttggtgactgggccattagaatagagaaaaaatcttccaagattctcttggagagctactatgttcaaaaatatcaagcagaaaaggagttaattgcatggactgaaccaatacaacattaaaataatctttctatgactttttgcttgaaactttgctgatcctttggtttttcagtcaagaaaacttgttttttcttttgagctatttacagcttttaacaatgaagtatactcctgtgagcaaaatttggagaatgtttctttctctctacctggtttctccagaatttggaaactatttgtgagtattcttaaattatggcaatatagtcatttgcataagtacaataagaatctgttttataggagcacagttggagacgctggttactttaccaaggctttgactgaaatggcattcttttaaatagaaacagactgctttaaggaatcagaggtgatttatagagccaataaaatcccttgaaaaaactggtcctcacataccttctctacccagtccctgtacaggagtcctaacctgtggtaagtaaagaatgccactttctaacaagcccaggagccccaagttaactttggacctccataggagaggaattcatccaattcatacaggtatttgcaggcacaaataaatccatggatgggttcaaggctttagaaggtctaatctgagactccttatggaaaaagttctaagaatgccaatttgaaagagagcttatatgacaaataattattcttgttgcattttatataactaatcaggccaaatataagactaaaacttatttttgcaaacaaattggttctaccatgatttgtcttggataaaaatgagagaatggagaaagattataatacacctattgttagattctagtcttgtctcgtttttgaggttttttttaatatgtattattttctacagtttggactgaatcttaaatcttttctggattacaagtcttcaaactaacattttcaaaatatcacccatttttctgactaaagctcaatagaattgctactacctctttcctgaggccctataggctaaaacgtatttcttacgatacaggcaagaagaaaatgtcaaacagccaccgtcctcctcttctgtaactaagacgttttgagtttaacgtctggatagactgttaaagaatggagctctccattctttaacaataaaatttctaccattaacatttgtttttcttgtttccatagaaatgcctcttactaaaagtctgtttgccttacatttcagacaacaggagattcattttccagcctatttacttaaattcccaatggtatctgatcttctttttatttttagacagggctctggctctgttgcccaggctagagggcagtggcaccatagggctcactgcagccttgacctcctgggctcaggtgatcctcccacctcagcttcctgaggagcttcctgaggggaagaagtgctgaacaattgctttacagcctttttgccacaggccagaccaccaagtggcccattacccaagataaccattgcaaccagataatgctgacctgcacaccctgtccctctttgatttgcccaactcagcctgcataccctgcccctgatatcaattcccatactttgcccaagaaaaaagccctattggctctttttggagagtcagtcagggaattttttcactctttctcatgctgcctcccttatatttgggcaaaagctccaatgaaggcttgtctgggaaaactcttttagcctcatgtcaatttctattacactgagagcccccagaacttatagttggtaacacctctataggatacttacacagtacattacacattctaaacacagagtaagtatttgttaaggttgttattgtctaattcatttcttaaagtcactgtacactttatactctatagtgtacagtacaggagtagtgtacagggcagtgtacagtacaggagtagtgtacagggcagtgtacagtacaggagtccatctacctcctttgttcaactgcattgtaaaagggagtgcctattccatactccaacaaattcatatacccccagtagctcccagttcttatacttgagccattatttccttcaccaacataaagctgattctttttcaaaacaaaaacagaaaaagtaaaaaaaaaaaaaaagaagaaaaagaaagcaaattgatttcatgcaaattgtcctaattttatccagagagttccaaatcccctgttgctttaaggctttctaaggggcaagagtcaaaacagaaaatggaagaagagatcacattttccctgaaaaacaaagccatactccctacccccatccaaagcctctgttgccctcaggcctaaagaatccaagggactaaaagcttcagagaccacctgctatgctgaagcaggcctgacaacttccaaccacagacagttggaaatcaagttgtgtggcatttaaagtaagcaccttatttctatggcagatgtttttgtcaaaaaaaaaaaatccatcctataaacaaaaatagaactctgtgtggtaaggaaaatgcctgggagaatcccctcaggtttacttttcaaaaatcatttgtcctcatccaaacctttgtcctaatatcataagcttcctttaaaaaaattaaataacataaacattgctgagtaactaagtgttcatcacagcctatttatggcattttgattggagttgttatcccaaatcagtgtactacagatttcaaaatcgtttttaaaaaatagtagaaaaatctaaatatggaagatgaaaaacactgaaaacttcttataatcaaagtatgcatagataataagagcagatgtgttacaacattttctaaatagtcaatcccaaaaaagaaaaaaaggccagcattaaactataaccctctgcataaaagatttattaagtctgaattcagaaatagttacacatactaacgtatgcacgtacatctgccacacacttcctgagcagcaccaggtagaccatacaacaagaataagcaaggctgagattaccctatgattggtgtggtttttcaagtaaagcatgggaagtgtacaataattgacaaggaacaggaaaaaatgtcatggagaacaaggtagtgtcagggatggattgaaagagaagagtaaaaattgtatcacacaatggtggcagggacatgaagacacaactgaaagcaaaacttttgagggtaaagaagacagccatcaagaaagaaccaaagtaagaaagagctgcaaccgtggggaaagtgggagttgtataagaaagatgatgacccaccgcagctcagcaaggccactgcggccagactgcctctccagattcctcctctctgggcaggccatctctgaaaaaaaggcagtagccccagtcagggacttacagataaaagccccatctccctgggacagagcacctgggggaaggggcagctgtgggcgcagcttcagcagacttaaacgtccctacctgacagccctgaagagagcagcagatctcccagcacagtgtttgaactctgataagggacagactgcctcctcaagtgggtccctgacccccatgtatcctgactggaagacacctcccagtaggggctgacagacaactcatacaggatagccctggctcgcatctggcgggtgcccctctgggacaaagcttccagaggaaggaacaggctgcaatctttgctgttctgcagcctccactggtgatacccaggcaacagggtctggagtggacctccagcaaactccagcagacctgcagcagaggggcctgactgttagaaggaaaactaacaaacagaaaggaatagtatgaacatcaacaaaaaggacatccactcagagaccccatccgaaggtcactaacatcaaagactaaaggtagataaatacatgaacagggggagaaaccagcgcaaaacgactgaaaattccaaaaaccaaaatgcctcttctccaaaggatcacaactcctcaccagcaagggaacaaaactggatggagaatgagtttgacgaattgacagaagtaggcttcagaaggtgagtaataacaaacccctccaagctaaaggagcatgttctaaatcaatgcaaggaagctaagaaccttgaaaaaaggttagacgaattgctaactagaataatcagtttaaagaagaacacaaattacctgattgagctgaaaaacacagcacaagaacttcgtgaagcatacacaagtatcaatagccgaatcgataaagcagaagaaaggatatcagagattgaagatcaactcaatgaaataaagcaagaagacaagattagagaaaaaagagtgaaaagaaacaaacaaagcctccaagaaatacgggactatgtaaaaagaccaaatctatgtttgattggtgtatctgaaagtgacggggagaatggaaccaagttggaaaacaatcctcaggatattatccaggagaacctccccaaactagcaagacaggccagcattcaaattcaggaaatacagagaacaccacaaagataatcctcaagaagaacaacccaaagacacataatcgtcagattcaccaaggttgaaatgaagcaaaaaatgttaagggcagccagagagaaaagtcaggttacccacaaagggaagcccatcagactgacagcagatctctctgcagaaaccctacaagacagaacagagtgggggccaatattcaacattcctaaaaaaagaattttcaatccagaatttccaatccagccaaactaagcttcataagcaaaagagaaataaaatcctttacagacaagcaaatgctgagagattttgtcaccaccaggcctgtcttacaagagctcctgaaggaaacactagacatggaaaagaacaaccagtaccagccactgcaaaaacataccacatggtaaacaccatcaacactattaagaaactgcatcaactaacgggcaaaataaacagctagcattatgatgacaggatcaaattcacacataacaatattaaccttaaatgtaaatgggctaaatgcccccagttaaagacacagactggcaaattggatactgagtcaagacccattggtgtgctgtattcaggagacccatctcacatgcaaaagacacacataggctcaaaataaagaaatggaggaatattttccaagcaaatggaaagcaaaaaaaaaaaagcaggggttgcaatcctagtcttcaataaaacagactttaaaccaacaaagatcaaaagagacaagggcattacataatggtaaagggatcaatgcaacaagaagagctatctatcctaaatatatatgcactcaacacaggagcactcagattcataaagcaagttcttatagacctacaaagagacttacactcccacagaataacagtgggagactttaacacctcactgtcaatattagacagatcaatgacacagaaaataaacaagtgtatccagggcgtgaactcagctctggaaccagcagacctaatagacatctacagaactctccaccccaaatcgacagaatatatattcttctcaggaacacatcgcacttattctaaaattgaccatataattggaagtaaaacactcttcagcaaatgcaaaagaacagaaatcaaaacaaacagtctctcagaccacagtgcaatcaaattagaactcaggattaagaaactccctcaaaaccacacaactacatggaaactgaatcctgaatgactactgggtaaataacaaaattaagggaaaaataaatatgttctttgaaaccaatgagaacaaagacaaaacataccagaatctctgggacacatttaaagcagtgtgtagagggaaatttacagcatgaaatgcctacaagagaaagcaagaaagatctaaaatcgataccctaacatcacaattaaaagaactagagaagcaagagcaaacaaattcaaaagctagcagaagacaagaaataactaagattagagcagaactgaaggagatagagacatgaaaaacccttcaaaaaaaaccaatgaatccaggagctggttttttgaaaagatgaacacaatagatagaccactagccagactaataaagaagaaaagaaagaagaatcaaatagacgtaataaaaaatgataaaggggagatcaccaacaatcccacagaaatacaaactacatcagagaatactatgaacacctctatgcaaataaactagaaaatctagaagaaatggataaattccaggacacatacaccctcacaagactaaaccaggaagaaggcgattccctgaatagaccactaacaagttctgaaattgaggcagtaattaatagcctaaaaatatccgaggaccagacagattcacagtcgaattctaccagaggtacaaagaggagctggtaccattccttctgaaactattccaaacaatagaaaaagagcgaatcctccctaactcattttacgaggccagcattatcctgataccaaaacctggcagagacacaacaaaaaaagaaaatttcaggcccatatccctgatgaacattgatgcgaacaccttcaataaaatactggcaaaccgaatccaacagcacatcaaaaagcttatccactacaatcaagacagcttcatccctgggatgcaaggctggttcaacatacgcaaatcaataaatgtaatccatcacataaacagaaccaatgacaaaaacgacatgattatctcaacagatgcagaaaaggcctttgacaaaattcaacagcacttcatgctaaaaactctcaataaactaggtattgatgggacgtagctcaaaataataagagctacttatgacaaacccacagctaatatcatactgaatgggcaaaaactggaagcattccctttgaaaaccagcaaaagacaaggatgccctctctcaccactcctattcaacatagtattggaagttctggccagggcaatcaggcaggagaaagaaataaagggtatcaattaggaaaagagggagtcaaattgtctctgtttgcagatgacatgattatatatttagaaaaccccattgtctcagcccaaaatctccttaagctgataaacaacttcagcaaagtctcaggatacaaaatcaatgtgcaaaaatcacaagcattcctatacacgaataacagagagccaaaccatgagtgaactcccattcacaattgctacaaggagaataaaatacctagaaatacaacttacaagggatgtgaaggacctcttcaaggagaactacaaaccaccgctcaaggaaataagacaggatacaaacaaatggaaaaacattccatgctcacggataggaagaatcaatatcgtgaaaatggccatactgcccaaagtaatttatagattcaatgctctccccatcaagctaccactgactttcttcacagaattggaaaaaaactaccttaaatttcatatggaacaacaaaagagcctgcatagctaagacaatcctaaaaaaaagaacaaagctggaggcatcatggtacctgacttcaaactatactgcaagcctacagtaaccaaaacaacatggtactggtaccaaaacagatatatagaccaatggaacagaatagagacctcagaaataacaccgcatatctacaaccatctgatctttgacaaacctgacaaaaacaaacaatggggaaaggattccttatttaataagtggtgttgggaaaattggctagccataagcagaatgctgaaattggatccctaccttacattttatacaaaaattaactcaagatggattaaagacttaaacgtaagatctaaaaccataaaaacgctagaaaaaaacctaggcaataacatccaggacataggcatgggcaaagacttcatgactaaaacaccaaaagcaatgacaacaaaagccaaaattgacaaatgagatctaattaaacaaaagagcttctacacagcaaaagaaactatcatcagaatgaacaagcaacctaaagaatgagagaaaatttttgcaacctatccatctgacaaagaatctacaaagaatttaaacaaatttacaagaaaaaaacaaccccatcaaaaagtgggcaaaggatattaacagacacttctcaaaagaagacatttatgcagccaaaaagcatgaaaaaaagctcatcatcactggtcattagagaaatgcaaatcaagaccacaatgggataccatctcatgccagttagaatggcgatcattaaaaaacagatcaggaaacaacagatgctggagaggatgtggagaaataggaatgcttttacactgttggtgggagtgtaaattggttcaaccattgtggaagacagtgtggtgattcctcaaggatctagaactagaaataccatttgacccagcaattccattactgggtatatacccaaaggattataaatcattctactatagatacatgaacatgtatgcttactgtggcacttttcacaatagcaaagacttggaaccaacccaaatgcccatcagtgatagactggataaagaaaatgtggcacatatacagcatggaatactatgcagccataaaaaggatgagttcatgttgtttgcagggacatggatgaagctggaaaccatcattctcagcaaactaacacaggaacagaaaaccaaacactgcatgttctcattcgtaagtgggagctgaacaatgagaacacatggacacagtggggtgggggcatcacaaaaaaaaaaaagaaagatgattaatatctgacagccacctcagaagcccccaatgtcagaaacacaggacactggaagggtgtctcattgacactggtaggtcaatgaaataagacacatatttcaatttcaatcactatagtctatacaattttaaacacataagtactgccatataactaactcggtcctcctagaagccattccagagtagaatttcacacttcctctaatgtgggaaaagacagaaatcctaacggaaaaagatggtaagtggctgggcgctgtggctcatgcctgtaaccccagccctttgggaggccaaggcgggtggttcacgaggtcaggagatcgagaccatcctggctaaaacggtgagaccccatctctactaaaaatacaaaaaattagccgggcgtggtggtgggcgcctgtagtcccagctactcaggaggctgaagcaggagaatggcatgaacccgggaggcagagcttgcagtgagccgagatcgtgccactgcactccagcctgggccacagagcgagactccgtctcaaaaaaaaaaaaaaaaaaaaaaaaaaaaaaaggaaaaagatgataagtttaactacttgcaaaaatatctatataaaccattcaaaacaataggctaggagaacatatctacaagaatatctaataaataaaggtttaatatcccattacataaagggttcctgcaagtcaataaaaaagacaatccaattaaaaaacagccaaaaggaaatgaaaagacaattcacagaagtaaccaataaacatgaggaagaaaatacccttactcatggttaaaaacttaaaagtcaaagtaaataatgtcacatgatatgcaaaatttttcatgttaaaaagccattgtggatgaagttaggaggctaataccaagattatgaattagcgacgttatttgaatcaacttggcaatatctatctaaatttaaaacaaacatgcattttgaccttgcaagcataataccaaggatttgtcctgcagagatactgacataatgaagcaaagatatccacacagttaattacagatacatagctgttcactgccaccctgtttgtaatggtttaaaaacaaattgaagtaggccaggtgtggtggctcatgcctgtaatcccagcactttgggaggccgaggcaggccgatcacgaggttaggagatcgagaccatcctggctaacatggtgaaaccccgtctctaccaaaaatacaaaaaaaaaattagcccggcgtggtggcgggtgcctgtagtaccaactacttgggaggctgaggtgggagaatggcatgaatccgggaggcagagcttgcagtgagccgagattgtgccactgcacttcagattggacgacagagcaagactccacctcaaaaaaaaaaaaacaaattgaaaaaaatctaaatgtccatggggctcaattaaataaatggtgggttaaccatatattatgatgtgattaaaaagaatatcataaatctaattttgccaaaaaaagttatcggagattttttttttttttttgagacagaatctcactccatcgcccaggctggagtgcagtggcacaatcttggctcactgcaacctccacctcctgagttcaagtgattctcttgcctcagcctccacagtagctgggattacaggcacccaccaccacgcctggctaattttgtaattttagcagaggcagggtttcgccatgttggccaggttgatctcgaactcctgacctcaagtgatccacccccttcgggctcccaaaatgctgggattacaggtgtgagccaccactcccgggcttaagacacatttttatgtgaacaaaaaagttacaaaactacagatagaacatgattctatttgagttatttcatgtatatacataaatatacactatataaaaaggggttcagggatacaccaccccaaagtatggcacattgacctttgaggaaatatcagaagcaggaatgactctctgacctctcccacccttctcccctgaagcaggtcataaaagaattacctgaccttcctgtaacataggatgtaagactttcattccaaaagtgccttccctatgcccaggaaaaaaaaaaaaaaaaaaaaatccttatcctcgaagacacagagacaccaagaggaatctgagcaaacaagccttgctaagttcccctcagcttaccaatatttgatcatatccttttgccatcccatcattcttctgcccaactgtacataaaaatacacaggtttccccatgctttggatcttcacctctctttttttttttttttttgagttgggggaggggcttcttcattcttaaggctcctgtgtcacataaaacttacattaaataaatttgtatgcttttctcttgttaatttgtattttgttataggagtctcagctatgaacttagtggtgggtaaggaaagatatcttttctcttctacaataggcttggaaatttctagaatttgtggaaaggaaatggtatttaaagagaaagggatgagagtaaatcccaccttaaaaccttgttgaggcgttttcttgtctttgccatgagcaaatattgttttgaaagttttaaaacatatatatgggagatgttatattcactttaaaattccatataatttgcaagagctatcaaaataaaataattgtcattgcaactctgccaactgcaagcccaataaagcaaaagaacactgaacaacctggatttaaatcctggagtcacttctcagtcacattaccttcttttctacttacttagttaactctgagccagtttcttcacattttaagagaatcgtggtgaagattaaatgaaataacatgtaaagagtgtcttgctcaattttgcatacacattaggctttcaacaaatactagtttctttccattttttctgaatgacatcagagctcagaaaatgcagcggctcaaagtagtggcagattctcagttatctgaaattctacagcaggacaataaaactgcttccaaatgttgaaggaatttgcgtttctacaccatcctaagcaatgtggcctaatcccatggcattaattccaatccacacacagataactccaaatgtaaatctcaagccccatcctttgccttcagttccagacttgctcgtataactgctgaagatgacaagcattaataagatcttaaacatcacataaatcttaaacctgcttttcttcagcctctccatctcagtaaatggttccagcatcccctaattatttaaaatccaaaccaaagattcatgattgtttcctttctccatccttcacagtcttgactctccatttgcaataacccacatctgccatttgtctccatcaatctggtgaccccctttctcaatgtcacagccaatatggtatttttaaatggtcaagtagacgtctcaaatactccagcaacctcccactgggagcgtaattaatcccaaactcctcgccaggggcctgcatggtctctttccagcctctccctcctgcccttctttccaaagatcactagactctgcacagttccccagcacactttgcactcgctgtactcgctgtttcttttccctgaaatacttgcttctcagctatgtgtatgccttactccttttttatattcaggtgaagattaagtaatttaaagggacaagtcctgtccacccaatctaaagcagcctcctagttaactactattaacagtcattttcttcatttcctgtcactgttcactaaaatgtaagctccgtaaggacagaaatgttttatcatcccatgattttctgtgcctagacgaatgcctgccacacagcagtaactacatacatttttgttcactggactaatgaattggtggttcaacaaacagatctaaaggagatccccaactcttgttggttgccttttaaaaaattaaagagtattttaagaataaaagcagagactgatttgtggttatctcagagccagtgaattttagcatttaaagctaagatctgatgaagagccaacacaaatggtaaaaaatgataatggttagcttagattttaatcgatttgtgttacttgtgctaataccaaagaacttgatttgaaagtgttttattagatcaatcagaatatagtggagtcacccagctggctgcaaacttatccagtcaaaatatcttccagaacttcaagtttcaaaatagataaacttcctaaatcaggtctttgggctgcctgcaagagtctgccatattttaggctcctctagttttctgagaattaacccttcctttggcatataccgtctacattttcttctttctgactccggcactgtagttaatcacacaaaggtgaggctcttaacactaaatctgtatatttgtttacattatgagaaacagagaaaagactttatacaaaaatggtggcaactatgattgattctggcttagagggttaaggataattcatattcttctttattctcttccctgttttccaataaacaagtaacattttacaaataaatacagtttttaaaaacttcttaaactagtacctaatatcctatgtacccaaaaggaataagaactaaaaaagagacttgaaaattaaaagacagacactaaacttctttcatatgattgaagaaatttttggaatttaagatattcttttatggctcaccacagaaactacttctaatttttaattttttagggaaaaatttattattcttaaaagttgtttatctaaccctaaaattctgatccaaatttattattaaaaatcaaactggtccacatttaagtcacctttgcctgacttacagccacagcaatgcattaagggaacaaaattctcggtattttggtaatttcacaggaccacggcagtagactcagagtagatgcttgacaaataataaaatacaagccttaaatatgagatggcactcttgcatattactgattatattattaatgctaacatcactaggatcctagtgtaatgctaggatcattgccaagtttaagtacactgtgtttaaatatgatgcatgcacttgaagcagtagaacctcaattcaacaaaaagcactgaggcagcatacttgtcaacatccgggagatgtaggagctttgcctggactccggctctcccagacgtgggtcactacaacattcagtacaggaatgaacaatgtatcgaactgttatcctgtaaggctgcttccctgaaggattgttcacagaggaaaattatgtcgcaatctgcatgctattttgaattttcataactgattcagcactccaattgctgataagtaccgtaatcagaaatctttttcctcccacagaacaagaacaattcaaacatcagaatttatccccacaatccagatctgaaaaatgaaaaagcaacaactagacctacatcttctttaaatctcaaagaaacatttgctctgtgcaagacagtgctattctaatgatagaggaaacttctgatgaataatgcagaagcacctgtggacatttaggcactagtggccatttaaatgctctttccctacgtgaacaagtgaccacaagaactcctttttttttttttttttgtcttgaagcacttgactcagaaacataaaaatagtcaagattggtttaactgaaatcacacttctgtgtgatctgtatgcatcctttcttttgttccagaaatgtgaggatccaaggttttaaacctaagccagtctggccagcttgactcatccaggacatctttcagtagtttcacagtggccatcagctctgtcagacaccggacatggcttgaaagggccatgtcagcaagtgatcattattgtgtctgaaaagagctgtgcttgatggctgaaatattacaactaccaaaaagctacaagtggaaactccatagaatcagctcatttgtagtcacagaatactctattcctacccactttcacacacgctactccctatatctccatatcaagaaaaaagtcctgtcttctttaagtcaattaccatgctttaatccagaatttggaattattcagggaaaccaaatcaagtatctattaccttctagagccatcatcatatccatgaacaaatcagctgtaaagcggtttatctttggggattaaatactttccagtccaaaatgcagtttttaaaatgcaatttttgccttctcttctgtattgagatgactaggcctatgtcaatttaactgtgtctctataaagtcatgcaaatgtaggcactttaaaatgactgctcacaaaaaaattgttaagagctctgcttaaaaatcttgcaaataaaaaaaacagttcctcatacaatttttctaaatggtggtgagggagtgttcttaaagttatatcctgatttatggaaatcttttattagtaaactaaagaggatggtctgcacatgatctgtaatattattattatgaatgctcatggcaattacattagagaagtaatcctcatttgaatttctgatattaataaaaagctcatttccaacttgccaaattcccaggctatgctgatctccaaagcctatcccacttagacacacacacacacatcaaaattcttttctgaaaaagaaaaatcactttccctcctactactaacattgccaatgaggtcagtggttgaccataacgtatttccagatttttcccttccctgagtgtgaagaactcaagtttttctctttttaccatgataaatcctattgcaggggctggaggtgagacagtcaggagacgttttagatcatgaggagggtcaccctggaggggagaaagggggctacagctcccattgctgagggcaccaagacctacctacttgttagatccccaccttctcaaatgtatcatagtccaagcatggagatgctctaagaggctatgcagtttcgaggtcataatcttattttgattattgtatatctgcttctgcactggtaatatgctccttgaaacagtttagttttcttcaaaaaaaaaaaaacctactctttcctgtttccttcactgtttctttcagcacttattatataacatcacacacacacacacacacacacacacacacacacaaacataaacacacctacttgcattattatttccgtctctcctgctggaatgtaagttccatgagggtaagaatttttatatgcttttattactgctatatctcccatacctgccagtgtttggcaagaggtaaatgctaagtagttgatgaataaatcaaaagataaattatagcagaaactccatggtgggccaggtgcgctggcccacgcctataatgccaacactttgggaggttgagagggggcagatcacttgaggccgggagttcgagatcagcctggccaacatggccaaccccatctctactaaactacaaaaattagccgggtatggtggtgcatgcctgtaatcccagctactcaggaggctgaggcacgagaaccacttgaagccagtaggcagagtttgcaatgagccgcaccactgcactcctccctcagcaacagagcgagactctgtctcaaaaaacaaacaaacaaaacaactccatggtgaagcattcctgactccatctttttttttaacttaaaggtattataggctgcaatccacgtctcctctaaattcctttgagttgttctaacagcatcaataactaagcctaaagcagactccctactgcttaccatccacgggtgccaagaaaacttgcatttcaatatcaagttaatttaactgtgaaaataatttcatgtatccttccaaaataatcaccctaatttcttcaagtcaaaacaactcagaaaataagatgtttgtgaccaaaagagggctgtaagagcctggccttcacagcccctccaaccaagaaacagcagcagcgtgttgctctgttacacctgtgcccttagaaaaggttcagactgtgcttaactgcgctgcctactggtaaccatcaaatgaggaataagcattgcgcaaggtagttttgggggaaaagcctcttttcccccaaatcaatagcattacccttcccattttcccagaggcctcactgtggtgagtgggactgaaaccatggggcttcaggtcaccatgaccaacagagggcaatggagctggttgctgagcacttacaggacagtggggactaaatgaagactgaaggatccacccataagggggccagaggttccctcactgtctagaacaactggctgaagcctggctctgggctccagaggctggagaaaactgcttctctcagaactgctgcttaagtaagcagggcccaggaggcatgagaaagtaaacccagcccctctaccaaaagccaaaccaagcctcatgccagaaagctcacagaaagaaagggagaactgcgggcagagaaaggtgttcagggaccagctatgttcttaaagttgtatttctttaaatgacagagtggaggactggatacctgggtgattcctatactattctttgacttggctatacagttgaaatgttccatatggcaagagtggttcatgggtaaaagcgtgaactatgaaggctgtgggtcttggaaaagatagttaacttccctggactggactcacttccttcatctgtaactgggcatgataatgttgtctgtttgatgggactgtggtgaggattcaatgaattaatgtaagaaaagtgctgaggacaatctctaacacataataatggcagactcaacgtgtcattcatttcttaattaaaaaaaaaaaaactaaaatctctcagctctattgccagctacactcactcatatgacctcattcagcccccatctctttttcctttccatctacttgtcacaaactccagcacccaaaatgcctagtcatagttctttttatactcataggtacttctcaagccctgcagcttgcatctcctccatctggacatttcagtaaactttcaaggctgaaagcagagcactgaggaattaaaaaagactgtgcaacccctcagccacagcctccaatggttactgatgatccataacctacagcctgctctgagaggactatgcacattgtgcacttgcctcaagactcaaaacaagattcagacttgatttaacctaccccttctgaaggttagaaatatcccatatctcaaaacaaaggcagtctttacagctgcagtacaccttatttttgtgacatatgcttcttcttaaacatttggctcactgagcaaatcctacagagatcagttcattccttctagtagtctttttgcttgcaagtctaagagctgccacctgatgaaaagccatgccttgcggtagagcattgcatgggaaattgattcttaaacatctaattaattactgattttccttaaaaattgaactccttattaaaatatcatatatgctttgaatgattgcaaattactgtttagatacttttggctgcaaataagagaacgacaaattgcttaaaagataaagaatttttaaatcccatataagaaatttggaaggcagtaaaattagtttatttagcaattgaataattcattgaaaatccaagtttcttccatgtttctactctaatcatcataaacgcataggttgacagatggctgtagcagctccaggcatcatagcctcaaatcatttcatcgtatcttttttaagaggaaagaaaactttttcaaaagtgccccaacttccccaacttccctcacatctcactggccagcattgtgtcacttgttcctacctactccaatcattcagcaggaaactggaataaccaatgtgatcaagattcacccaggactaggcagataacctagacttccctggaataggattaacctgttgaggcgctgttttaaaaaaagggaaaatgtagtcaatgttttgttgttgttgctgttgttgttgtttttattgttgctattagggaaaaaagtgaatatagcaaatttaaatcaagatatcattttgggaaattttttaaggggaagcttctaggtgctatttaactttttcaactacaactaagtagttagattttgtaggccaggcgcggtggctctcgcctgtaatcccagcactttgggaggctgaggcgggtggattacctgaggtcaagagttcaagaccagctggctaacatggagaaaccccgtttctactaaaaatacaaaaaaatagctgggtgtggtggctcacacctgtaatcccagctactcaggaggctgaggcaggagaatcacttgaacccggagtggaggttgcagtgaaccgagatcacgccattgcaccccagcttgggcaacaagagtgaaactccatctcaaaaaaaaaaaaattagattttgtgtctcagcgtgattccatgccaatctgcaaactatttgtgatgagtacaaaatgagataagtatgcttatctcacataagtgtagatatattgaaaaaaattagaaaacttttataacaattagatagtctaattttatatttgttaaatctaataaaactttggagcttatattttttatgtctcggttttttacttttagtaattgatttttactgtagtccacaaaattatcagtctgtaatggactggaaattggaacaacaacaaaacagtcattcactagagatagatcaccctatccaacttctctaatttttgtgtaaattatatacttttagaacagcttaaagctcagcagcttttccccccaaactgattggaccgtaagcctttgacagctaaagatacagtctgaacattgtaaactatacctggatgcagaaattatattaaaaaataaaactgactaggataaattaatgagccctcagtcagaggtccatttccctgtggactactcagtgccagaagaggctaaacccttaactttggccagcccctgggcacaacatcaagtaaaaaggaattcgaaagttctatatgactttggccaggccagcattattagaaaaacatggtaggtcctgtcctaataaaagatgagaaaagtcctaaggatgagcaaaataaaatgccatgtagataaggatccatatctgtagataaggaatcgattcaaagttcatattattttttcctcgaagtgggaaaatattacctacattcaattagcacttttgcccttttgctatggaaaatgcgttttgtgagtagtcccttatcatttttatttcctcagacagcaaattaattcttatacttctctacagaggacaggacaaacttgtagttaatattgaagattaggaaatgaccttagccacaattatcatacatcaataacactttcccaaaacccaagaaagaacctctcacctactttagtatgtttactcagtggatttaaagtaacctttcaaatcaccaactgcaaagacaacattccacctcaaaatgtattcaaagtgggctcttgaattgcgcttttatggaattaacctaccatcttcttatgaaaaagtcacctgacatccctgggtgcactagccagtgcacaaaggaagcaaggggttcaacagttaggaagacagtttgcacacgatctgcacatgtttaccgtcaaatcaaagcttgatgataaacatcactcagctttggcacatctactgatggcatttgttggtggattatgctttcttccccttatttatttcacaatggttatcatggcacagctttccaaatgatgtttttaagtgttcagttgtaagaatgcaagttcaagtatgctttcttcctcactacaagagaatatgatttcaaatattcaacaaattggtttacctaatggtctctttggaggggtctcccactattctactacccactatcaccccaataaatactctagtgatataaccccttcaacagttatcatcattgaactttaaaaacataacaccatatacctttaaccatgtacatgttccccaccagtttccacaaagagctaaatttaagcctgctataagagagaatcgaaatttggtttgctttcttttagactctgctacatagactttaaacatgcagaagagctgactttgccaacaaagctcatccttcttttttccaaagcagccagctgtgacttcattttggatttaggctatgatttttctgatttttctctttgcatgtgaatgtttatttgtgaagtcttgaacttcaagctacttccaactctagaaatgatttgggcaagctgccatgtttataatcttagagcctccagcttcccagataatacaaactctcttgttatttaattaatgtcaaactcataatgtcatgcaacattgctgttagatttctatttttctaacatgtctattctcctagttactcctaactagaatgagtaaaccttctgaataaatcagagacatctttacaggcaaatgattaaagggtttgactgcctgccataatattggaacaagatctgggggaaaatattaatgaataaaggattataaccctggacaagcaagcaaatgtagcttaaatatataacagtttcccccaaaaagtaaactggactttatactatatataattatattatattccatgcatctctatattacagcaccttaaacagtgtagataactagtaaatatcggttaaataaatgagtaaatgaaaaaaattgacaagatataccaccttgttggaaagataggttcttggctgccttaagcttcccataaataaaccaggggccaggggtggtgctcacaccggtaatgtcagcactttgggaggccaacgcgggaagatcacttgagcccaggagttcgagaccagcctgggaaaaatggtgaaaccttgtctccacaaaaaataaaaaatacttagcctggagtggtggtgcaagcctatggtcccagctgcagaggaggcttaggcaggaggatcacttgagcccaggaggttaaggctgcagtggggcacgttcatgtaactgcattccaggctgggctacagagcaaaaccctgtctcaaaaaataaataaataagcaatgtatatggcaatcacagtcctcggtaccaaagaccaaactccaagcctatatgaagacatctgatgttatagtcattggaaaatgaaaagggaaggagtgggctaaggggagcaacaaaaggttgactgtgttttcttctggcagtctgctttcacagccagtactatgcctgtggccatctcccaggctcaggagagcctatcttactctagcccatcagattcactttcccgggaactggaaatagaaccttgatatggtttgcatttgtgtccctgactaaatctcatgtcaaattataatccctagtgttggaggaggggcctggtgggaggtgactgagtcatgggggtggatatccccccctgctgttctcaggatagtgagtgagttctcacgagatctggttgtttaaatatgtgtggtacctccagcttctctttcttcctcctgctccagccatgtaagacatgcttccttcttctttgccttctgtcgtgattgtaagctttctgaggcctcctcagccatgctttctgtacagcctgcagaactgtgagtctttataaattacccattctcaggtactcctttatagcaatgtgagaacggacttatacaaacctctatctctgctgatcacttgtgggaaagacatctaaacaagtgagctacagggtggccatttccaaacatgccaaagcagagacagtccacagagaaagagaatgaggcagatggcagggagagccacggaggtcagagctgggcaggaaggcctgcctgtgctcccagttcacctcttgtgaaccctggtcatccttgaattccttgagatgactcaatatccaagatgtctgggtgataaaatggcagggtggaagaaaaactaaaatgagagtgagtgaatgtaataattgttcagacttcctttgagggctctgtgagccactgaacgttttaagcagagtgacccacgatgggatactcatctttacaatcagcaccctggctgaaagtagagaatgggttagaatggaggaagattgcaattaggaggcttttgtggtcctttaacagcctattgtcccagggaagtatctgttgctcatgtgtaatgctgcctactagcataatttaaatacataggctatttctcttcaaaagggcatattttatgtaacatctctaaccattacatgaaaactcattctttgtcaccagcatcagttaattattagattattggcccaaaacctccatgattatataatatatattaggactagaagttaagtcaccagagagtttccaatatttaatagtgccatatttcagaaatgcccagggagaatatcagtccactactccgctagcatggtatccaacatttcttccttaatgttgtagatcctttcctaagcctgtcaaagtaaatttcaacgaacgaattcataacataacatttgtggtagcagatattttgctaatttcacaaaatctttctaaatcctttaaggtttgcgactcactacacttctgattataaatgaatattaagctagctaaaaagaagtagagtgcaaattaggtactgaaatggagactatcatggctctgcaataagaaagaatttagctttctacaattacttgagccctatagcctccgtgtcacctggaatacatgtttaatactgattttcaacgttaaaaaaaaaaaaagtcacaaaaacaaactccttttaacactgtttcactggccctagtatttacaatttttttaaattaaaaatcttgataattcaagttttcctataacctgtctttatagattttttttttagatttaaatggtcataagtgttatactacctcatatttctctctgtatgataagcccaaatattccttaactgtgtttgatctactttgtggtcaaaatttgggggataggagagaggtcctcatcaaaactcaagatcagcaaaagctgaggaattttatcaacaccagacctgtcatataagaaatattaaagggagttcttcaatctgcaaaaaaaggatgttaacaagcaagaagaaattatctgaaaatgagtagaattggaatgttcctaacacaaagaatgacaaatgtttaaggtgacaaatatccaagtaccctgatttgatcattacacattgtatgcctgtatcaaaatattatatgtaccccataaatatgtacaactgttatgtatccaaacaaataaaaaatttttaattttttttaaactttttaaaatctcaagtttagggcacctggatcctatcaattgaaaacttatactaaaacctcaaaaaaaacccaaaggctttcctggcagagaagttattaaacactagtcagaaattaatcctgtttaatcagtcaaaaacctaaataagaccactaatgctaagattcaccagctgcagaaggttggcatactaaaaaatggatcaagagtaattgttcccagttgtaagaaatagtgaatgcattaatataataataaaaaaagaatagctaaatctgcctagcatttaataggtactcacaatgcagtattcacagtgctttgcatgcttggagtcatttaataatctaaacaaccctatgaggtatgtgctattattatccctattttacaacagaagctaccaaggcataaataagctaagtaacttccccacggtcacacagcctgtaagtggtggagtaagatttcagcatccacattctgaactacttcccaaggcttagatgttactttaaattaaaaatcactgcattctttagtataatgaaagtagaaagcaaaaaccactcaggataaattgcagactctcccacactgtctccaccatcaccttcactgaaagaagtttaaggggctccacttgtgattgttaattttatgggtcaacttgactgggccacaggatgccaagatatctgattaaacataatttgtgggtgtgtctgtgagggtagttccaaaagagattagcatttgaattggtagatagagtaaagcagattgcgctctccaatgtgtatgggcatcatccaatctgtggagggcccaaatagaacaaaaaggcagaggaaggttgaactggctctctgctacatagactttaaacatgcagaagagctgactttgccaacaaagctcatccttcttttttccaaagcagccagctgtgacttcattttggatttaggctatgatttttctgatttttctctttgcatgtgaatgtttatttgtgaagtcttgaacttcctgatatccatgtctttgggtagtgtcctcctacattgaattagacagtctatgtaaccaatggagtatgacaaaagtgacagcaggacttccaaagctaggtcataatgggccttgcagcttccaacttgttttttggttggttttttgtttgtttatttgttttttggaaagggagtctcactttgtcaccaggctggagtgtagtggcatgatcttggctcactgcaacctccgcctcctgagttcaagcaattttcctgcctcagcctcctgagtagctgggattacaggcacctgccaccatgcccaactaatttttttatttttagtagaggcggggtttcaccatgttggccaggctggtctcgaactcctgacctccagtggtccacccacctcggccttccaaagtgctgggattacagacatgagccaccaaacctggccccaacttggttacttagatcactatgctctggggttagccagtcaccatgttgtgtggacactcaagcagccctgtggagacattcacatgaagaagaactgaagcctcctgccagcatcaacttgaaagtaagcagatggtgcagtctcagctgatctgactatatactcatgacataccctgagatagaatcacctaacccaagcattctgaattcctgactcacagaaactataagtgataacaaccagttattaattttagggtaatttgttgtcagaaataggtaataaaattgtctgtgtgtctgctggcattggcattaacttttcagagtgccttgatatcgtaacatagttcccctgaaattcatctttaactgttcaaaatcattccattagttatattccacatttccatttcattggacctgccagtgtgatgcctcagcatgtacgctccatgagagcagggatcatgtctggtgttgcccatcattgtatttcccagtgtatccaacagtacctggcacatgttcagtaaatatttgctgaataaataaacaaataaacgtatgattggagaataaagaatgagtggcaaccaagtgcttcggtctacttcattgagtaatttttcttctcttctttctttcttagtcaatcccatccaaccagtggcaagttctactccagagatcctgcccagtccctgattgttatgatatggtgaaatgcaggcccagaaaagaaaagcaacttgaggtcacatcctgaattaatttctgtggctggatcacacactggaaaaaacagtcactggaatgaagagagccaataatatcaacagacaggtatacatacagaggcagtaccttgtagtgcagaaaaggaaaaaacattacatgggaaaaatgaaggaatatgaagggtggtgttacattctccaacaccccagaaccacagctccaacctctttttgtttgtagtctctggagctcagagctatttaatctccaatttgagaaattattgaagtgagtataagaagtttaaaagtactgattccagaggccgagtgtggtgattcatgcctgtaatcccagaacttagggaggccaaggcaggcagatcacttgaggtcaggagttcaagaccagcctggcctacatggcgaaaccccctcgctactaaaaatacaaaaattagccaggcatagtggcaggtgcctgtagtcccaactactcgggaggctaaggcaggagaatcacttgaacctgggaggcggaagttgcagagagctgaggtcgcttcactgcactccagcctaggcaacagaacgaggctccacctcaaaaataaaataaaataaataaaataaaaataaaagtactaattccaaaaagcatgcagttaaagaaacaattttttgaaggagaaggataagaatttccaagaaaggaaattcaaatattgattttatgctgtcatgtttatacttataattactgtctctgaatctgaacaagtgaaaaatattaacatcctgatattctcctcttctgttgataagaacaggctccttttttagaaatcaaatctgagccactgtggcggcagtgacattcagccagtagaactcctgtaaatgttcctgtctgaataaagatgggcatcaaggggttacagcaaaatttcttttttacttattcttggtgagatatagctacttcatttacacagtacttcctaattttcaaagccccttctcatacatgatctcaactcacacaatcctacgagacagaatagagagggaatattgaggtatttccccaaagcccaaaatcctgatgtccaattgcccctagatatctccagccaaatatcccagtacccccaagatactctgaactcagtatgtctaaaaccaaattctccatgaccctcaccttttttgtttttaaagaaatggagttttactatgttgcccaggctacagcactgtggctattcacaggcacaatcacggcacactgcagtctcaaactcccagtctcaatcaatcctcctgccttagcctcctaagtagctgggaatacaggcgtgcaccactgatcctggcatagcctcacctttttataggtacctgggatttgttttactcctagtataagacacatagtcacagaaatcactagtcatgaaggaaggagttatttgttgttgctttttggtttttgtttgggacagggtcttgctctgttgcctaggctagaatgcagtggcacgatcacagcttactgcagcctcaacctcccaggctcaagcgattgattcttccacctcagcctcccaaatagctaggactacaggcacatgccaccatgcccagcttttttcttttttttcagtagtgaccaggtctcactatgttgtccaggcttgaactccagtcctcctgcctcagcctcccaaagtgctgggagaagttttttaaactcacagttccctagaaacaggagggatggcaagacaatatggagagcaggtggccacacagagaaccaccaaggccagtcaggaggtaaagggaatgggataagggcaaaatgcaggcaaatgttttcattgttttccaaagcaaagaactagtgaggcaggttaagcagacttgggattgactagtttgaataattttagcaggatctggggggaaaggtgctatacttagatgtctggtatctggccctggagtgattaggcaggtggatggtggcccaggtttgagagactgataaaggacatggtgagggtatgggctatagatttgttggtttgcatgtgaaaggtgtgtttctggagagctgtttacgatctctagaaatcagctaaccctgagagaggcagttcctccaggatcaacaaggccccagatgtgaaagcattaggatacaaaaaaataaaaagaaatggttatacacccacctacatatgaaaccctcttggcttcaggctcaagcctggatgacatcaccaaccacccactggccgaagcctccccttctccttcctgaacttcgccccctctgtcctcactgttcagtccttcagcactcaccttagctgtcaccataacttctgaaatgacatccggaacagcgaccagctagtgtcacagttctgtctcaccccaccctttctcagcactgccgaccataatgtgcaactccagcctcctcattcccacactcaaatcctttgcagactcttgttttatctttaaaaagtatgtgaaattacacattcaactccataatgagagttccctaaagtccttgagtaaaactgcccttctaggaataaccttctttttatcctgatacttctctaaatgacttagagggtaaagtcaccaccatttggaaaacacaggcctaaagcagagaactgaaactcctttgcctggtctatgaagccctccttgaacctcctccctaacgagtcagcttatttcccacacaacctgcctcctgccccaagctcacgctctctatactctgaaaagataaacccataaacatatcatgctgggtttggataaaatagctaaataaagcaatgaagcacaaggaacattacaatacatacctgtggttgttttaaaatatattcacaaattcttggacactcctttcactgggagatgaagtccaattccccaccccatggacacagctagcctttgtgactcctatctaacaaatagaatgcatcagcagaacaaacactgatagagaacctagacttgttgcagctgcacaaaattaaccaccaccttcctttttgatttccaactctcttctcagagagtgaaacaattttgtatcaatgtcgtatcatgcagggccaacccacttgcttttcctattcagtaagctgaggatacaaaagcatagctaatgaaaaatgcatgtattcttaacctgagagtcaataaggaaagtgaatgtggtcttctaccataaaaacaagcatttgtcctcttaacgttttaaagaattccctacacacactttaatattcccaggatgaaagacgcttgactgcctcattcaatagtaatttaataagaatgtttctggggacagcactatcaagcagaagacacacttcctcaacctctttctcctaaacttgcagaatctgttacaccaaaagacacaatgaacaggaaattgcattttctttgcagatcaacaaagcagccaagttagatcagacagaaaaaagatccacaaagagcattaggaaaaaatacagagtctgaagacccctggcaaagcaatgcccagatgacttttgatatgaaaaaggttttaacttatgactggaaaatacttaattctgtccttcaccctcactctaaaacttaacaagactttttcaaaagtctttaaaaataataaaattaatttttttaaacttctgaaacaaaaagaaatgattgtacaatggtaaaacaaagtaaatatcattccttttattcactcaagcagctgtaagcatcaatagaatattcatgcagcactccctaagaatttctgatcctaatgcatagctagattcttaaatcctgtgcactttacctgctttcttccctttccctggtatttactgcccccactatatgcagtagaggaattctggtagaggtcctgaaagaagcaatttgtgtttcaacctgctgtatttatccaaaggcaataaaactgaatttgtacaagttttccaattgaaaactcagaagacttgaaaatttaactcttggatcaaacaggggagaaaagcataatgtaactgtaatatagtcatcttaaaatcccccagctctaggggtagccagactatgcccacaaggtcagagctcaggaatttaaattcttcacagtccccagggaacaatagtagtagtattggagatttcctgatgtccagcttcaatcctcttacattcatcaaatcaggttgaagacaaagaaacaaataaaaacaggcagaagaaccatcaccacaagatgttagggccttgggaaggaaaagcagtcctaaaagggcaactttacggacagatgggaccatttatagcctcagtatgtttacgagcttctggtcttgacgtcctccctggaaaaaagactcttcccctttacaaaggcctactcccctggtgaacatgcaacttccatcaaggagaaaggccgggtcacatttaaatttccctacgtgcctcagttattcatatgttctctctttcagcaaataaatcgtgagcatctactgtgtatgagaagtatttctaggtactgagaatacaataatgagtgtgacagacagaatgcctgtcttcattaagcaggggtgatggacatgaaacaacaaattagacaacaaagcatttcataatatttgccctaagtaccatggtaaggcacagcaggatataaagagaaagcaaatgacagaggacctggcacaggcttggctgtcagagaaggcttctcagtggaggtggctgataatctgagctctgaggctgagcaaccatcagccagggaaaagcaggggcagagccggccataaggcaggaccagcattgccagagtgctgtgacaatgcccagggaggggaggcagggccaacgacataggcctcttaggccatgttagcgatcttggtttccatcctgagagcaacaaaaatccactgaaggcttttaagcaaggaggtaacctgatgaggctggccttttctaaaagtaagcctggctgtggcttgggggacagtctggagggcaagaggggggctcagagggcaattcgagaaacccaggcacacaaggagtgactgagaccagggcagtactgagatatgtaggctcataatttgggccctgctcaaccagtaaccattaaatatctcctcaacattgatttagacatgcctgaagctgctagaggaaagtgaggcaaggaagcccttgagcatcaattccagactcgcctccactaccctatataattctgtttcggccctaaaataataacctgatcacgaaacaaaccatgctactcagcagaccttgttcccttagaaggaggtctagggaccatctgacaggcatgtacccttcaggcagggtgtgcacaccccaagtagcaccatgcacaacctatgctacacctcagagcagccctgccattgcaagggaggggtctcacttctccatcttgtatttctagtcatttcagttcccccccatatcacacagcaccctgggacaggcagctgacccatctttaatctgactctgatttggactgtgatgatggtagtgggaattgggaaaaagagaaccattcaaagcccagtaagaagtagaattaatggccgggcgcggtggctcacacctgtaatcccagcactttgggaggctgaggtgggtggatcatgaggtcagaagattgagaccttcctggttaacactgtgaaactctgtctctactaaaaatacaaaaaattagccaggcgcggtgatgggcgcctgcagtcccagctgctggggaggctgagacaggagaatggcatgaacccgggaggcggagcttgcagtgagccgagatagcgccactgcactccagcctgggcgacagagtgagactccttctcaaaaaaaaaagaagtagaattaacaagactcggggagtgagtgcttacaggcacagggaggcgtgagggaggagagggtcacacttctgcaacttccagtggtcttccacaaacagcccccccaaacccccaaataaaacagtcatgaaactaataaaaatgtgtacagctttatagcttatgctattttactctcattatatcatgtgactgtcacaacagtcctatgagatgtgataggtataatccttgtttcagaagtaaaatttccagcaatgacacaattagtacacacaggaaaatacccaaacgaagaacttccaaatccaaatccatgcccttgctactaaaatgcattatctgtatatgatacaataatctaatagtgtcataaacaagcaccagcaacttgtattacccctgagaacatgccaggagagatcattactggcagatctagtaggaatcgctatgaccaggcggccagaggcctctcaaagaaaatgttacttgggagtctagaattagcctcaagtcactgaactggaataagccttaagtcacctttaaaccacagagaaaatgacaaaacataccatgaatgaagtaggaaattaagagaaagtagttgaatacattcataacatatgtgacgcacattatacctacctcatattcaatgagctattatgaatcaagaaaaagataaatcagtattaaaatgattacaggatatagactatgtgtagaagaagaaattaccaataaacatgaaaagatgctcaacaatgctagtgtttaaagaaatgcagatttatgggaggccgaggcgggtggattacctgaggtcaggagttcgagactagcctggccaacatggcaaaaccccatctctactaaaaatataaaaattagccatgcatggtggcaggtgcctgcagtcccagctactagggagggtcaggcaggagaatcgcttgaatctggaaggcggaggttgcagtgagtcaagatcacatcattgtactccagcctgggcaacagagcgagactccgtctcaaaaaaaaaaaaatgcagatttaaacaataatattcaactgttggctggatttaaaaggctgacattacccagtgttggctagagtaaacaggctttctcatagactagggggaaaaatgtagcaccatttatcaaaatttcaaatgttcttactctgaaagtctgcaacttcagctcttgaagtttacacactgcacaaggattcaaaggcatatgtaaatgaatgcctgttatagcattatttgtagagcaaaaaacttaaatgtccatcagaactaattacttaaatcatggtacagtcatggtattatattaaaaactatgcagttgtttaagagtaagacagatataagttaggaaagaaatacaccaaactgtcaaactgtcaattgtaatatctacagaggggaatagcaagttggggggttggagggggtggcgtggaggagtatgactcaaaagagaacttttatattttatttcacatacttctatagtattaaattttcccaaggatgggcatagattaatattacaatttttaaaaactagtaagaatgttgtattatgaaaaaaataaaactctggagcttaatgttcctgagcaaatgaactgcaatgtaaacatgctctactcttatttactttgtttccagatagctttctgtttcaatatgaagttacttaccaccacctgatctctcatgaaacattaatataggggatccctaattccttctttcaattttattgataggcaaattagatgttccaattattttctctgaagtactatttctaaaatcagtcctcagagacagtaaattcttacccaggataaactaaaagaaaacctaaatatcaatcagcttccatttttcaagtcctaacttcctaggctttcttccatccaggaatctgtaaaactatgtaagttctgcctcagagtctttggacccatgccgttagctatgcaaagcaagcttattaatttgactttcttggcagatacactgttcgaatcatctgaaatgagcaagaggacacagcaaagcccttggcaaagattttagcatttatttgactttacacctaacactacctctcatttttccaagtattcctggagagttttgacagtgggaagcccgttaactttaatcactcatgctactggacccctcaaacagctgttcacatttttttgagcaccatgttaaattcctagatctgatcattttgtagcttgcactgtatttgcacagtatcatttatctaatggacacgaagaagccagcatcacatagacagccagactaagattattatccaccagagttctctagagtcagtaggacaaatctgactcaatctgacatccagtcacaataggttagaatccctgtttaggttagcaaaggaagaactttctgttttgtttttttgcgtgtgtgtgtgggaccttgttgaacacattcgcattttatgagcccactttgaacatagcactacattttcaagatcatttattcatcaaacgcttagtactaggtttcatctaccatttatagaatgcttattacatgcaggaagagttttaaatgcctcatctcatttacttgttctcctcactgctgctttcagaccactgattcctcctcacacctatgaacaaagcacaagccattggctctgacacctgctacctcgcctcaaaggagtcataacccaccctctcaggcactcaccctcatccgctgatgatttctgcaccaagccccacttctattctgccatcatccctggcaacatgaacttgaaattggctgatacactacactttggcagttttattcctggaccacttcacttgcaataatctgtcctccacctacctcagcctcccactttaatagtcccacctaagacctctaattatacaatgccactaattgcataattcccaaaatctccacttccagatttccactagtctacaagactactgccacgtgggtgggtgggtaatttacatacattgctggaagatatatagatacagatacagatatagatgtagatagatatagatatagatatagatatagatatagatatagatatagatatagatatagatatagatatagatatatagatatagatgatgcagtctcactgtgttgcccaggctggtctcaaactcctggcctcaagcaattttccagccttgacctcccatgggctgggattacatgcattggctactacacctgacttgaccacctagtttttgtttcgttttgttttcttcccttcctctggtgtcccaattatttcaccttattgggaggtccaaatcattggctttatttgaactgtccaaatgccttccttatggccctctttacccagtgttggttccacagtctcacacatgcactcaattccttcaccccgcattcccttacccatgttagttcctattctccacatcctttatgcctgcacaaaacaagggaacaaagctcattttaaatatataccctcacttttcaaataggccctcatttcccttgtcagttcatttcatcacatccaaaatgacttctacacaacttttctcttcaaatctccaatatccttcccactcttcactgataactttgcttctaatttcaccaatagaagaaataggtagaaaaattcctcattccaactaccatcttcacctatgcctgtacactccacttcttcactctcctacatcatcaatttattttttctctgctggattattcataagaatcttcaaatatgctgtcaaaactaccttaaaaaattatgttccctgatcctatatccctccctagtgaccactccatgtctgcatatatctttaaggaaaaactcaaaaaaaattgtctgtctccatttcttccccttcctctctcttttgaatcaattccaaccaggcttttgtctccacctctccactgaaaccaggctgatctagcatgcccatgacctccatgttgccaaatccaatggtcatttctcagtgctcattttactcaactccgcagcagcatttcacccagctgaacatacccttctccttgaaactcttccctcccatggctcctgggacatcatattccctggtgtttctcatgtcatattgggcaatcctccttggtttactttgttggataatcctcctttcctgagataaatctggaggagcccaggactcagcctatgaccttcttctttctctcactctttagtgatcctagcaagtaccatgattttaaatacgtgatgattccctaatgtatatctacaaagctacaacctctctcctgaggtcaagaattgaatattcaaacttcctgtcaatgtctctacctgtacatctaatcgatatctcagtcttaacatatcaaaagaagaactcttgtcccccactcatacacacataaaccattttcttcctctctcgggcctctccatctcagaaatgttgccaccatcaccatttatcctgcaagaatctctttcacactccacatctgaccaatcaggaagtcacatcaagtcaactctcaaaacatattctaagtctgaccacttctcataacttccccagcttctgctccagtccagaccaccatcatttcatgtaataatatcatgactggtctccctgtctcctctcatctcatagtaagtccatcctccatggtgcagtctaagaggtcccttaaagagaatcctaccattgccccacttaatattttgcaatggcttccaattacccttaggaaaaactctaaatcccatggtctgaccactggctgcttctctgactcatcttctaccattccattctttgtatcatcgactttgcttccactgccctggcctccttgctattacttaaatacaccattcctgaccctgtcacagggcctttgcacttgctctgttctcttcctgaacactctgcctttagatgttatatggttcactccctcactttatccaggcttctactcaaatatcacctcttataaaggtcttcttggattcttctacctaaaatattccccagctaggtgtggtggctcatgcctgtaatctcagcactctgggaggccaagtcaggaggatcaattgagcctgggagttcaagaccagcctgagcaatatggcaaagccccgtctctaccaaaaatttaaaaattagccgagcatggtggcacatgcctgtagtcccagttactcgggaggttagaacgatcattcaagcccaggaggttgaggctgcatgattgccatgattgcccactgcactctggcctgggtaacagagcaagaaacttgtgagaaaaaaaaaaagaagaagaagaagaagagaaaatattcccctttagtcgctatttgtgtttcacatctttattttattggatcagtcttgcactttcagaattctcgcagataacagcagctgcctgaatccaaatctctccatacattcaccatggaagcccaaataaagccttccatccataactagggggtcagacaatactacaaacttccatgtacatataagtgataaaataaacagcataacccagcatagccaaccctagaatcggacatcacctgcatggaaaagagaagggggtagtggggacttaggagtggtagaaaacaaaaatctcttccaaaaagaaagggtcccacccaaaaagctagtaaaccaaagaaagcattcagaaaagaattaaagatgaaattttaaaagaaataaaattattaaatacattttaaaatgcaaattctttggagaaaaatcaataaaacagattacaaaatactagcaaaactacccaaggaagaaaagaatgagaaagcacaaataaataagaaacttcaaaagagaaagaaccattgaaacagcagatacgtttaaaagataatcttctactgactcaacgaaataaatttgaaaatctaaataaaagggataatttcctaaaaagatatactttcctcctacttcaccccaaaacagatagtaatagttcaattttcatagaaggaatagagaaaattacccccccccaaataaaaactaccaccacaaagaagcaccagaccaatgtgatttaatgggtgaaattctaccaaagcttcaaaggatagatcatccttatgctgcttatattgttccagagcatagaaaaagaagcataaactgctaaattattttcatgaagcagatataatactgatatctaaactttatttcataaaagattatactcaaaactatatacaaccctcacttatgaatatttacacacatataaaactaacagcaaataaaatattatttcattaaccagtgaaattttttcaggaatgagaaaatgtttccttcttagacaattcattaatgtaattcaccatttcaccagatataagaagaaaaatcatatgattatcttcagaaatactaaaagggctttcaaattccatgccactcctaacttccaaaagcattcaataaaatagaaattagcggttatttccttgtgagtatgtgtgtgcctgtgtgaattcctcagacataaagtcagcatcttaatagaaaaacaccagaggcattcaactaaggtcaggaataaggcaaggatgcccactgtctccatctaacattgtattagaagaggcattagacaatgtaatcagataagaaaaaaacaatcaaaggcatgagaattgaaagggaaataaaattataactatttttaggttatgtaaccatataacctataaaacccaagataatcaaagataaaaattttaaaaatttagtaaggtagaaagttataaaattcacatactaaaataaatagcctgcatgcaataacacagtaaccagctagaaaatataatgggagagaagattctcatatatgagtaacaacaaggacaagtttaaaaaaaaaaaaaaaaagtttctgcaactaaataagctgattcttaagttaaaaaaaaatgtaagaataggtcagaaaagagacttctgcttccaaccaagatgagtaacccacatgaaacaaacagaatatatgaacaacagttttcaaggctttggagtcaagcaatgaagaacagtgatctctgagagacaggaaccaaatgaagtaggcctatggttgcctcagcttactgcctggagagattttccagactataaaacagaaaaggggaacctaggaagagatcagtggtctctgtcagttgagaagacaaggctgggagtctagggaggccaagacaactacagttcacaggacaggttactggagaggaaacagctgcctagagaagagctccggagatagatgcggactctagcattcggctgagtactaattagtgcatatatgtgagaaaaccacccacagcgagattgggaccaccataaggaggaaacactagtcagaggtcacagtttaactttataataataatctattatttccaaaatatttattgaatcagaaaatctgaaactacgcttattgagaaagagctaagatattcccaaacattccgcattatttacgctttaaactttaccaataaaatacaaagggattcatatagtaaacaataccttgctttcttatcttgcaagatggcaggtgaaaactttaaaaggctggatactaagaagagactggaagccaagaaagctgatactagtggcaaagtgaaaaagggtaagtcaaggtgaaaaaggctaagtcaaggcgaaaaagtccaagaagaggaaactccagtgcagccgaaatcctgtcctgatcagaggaactggcagatattccctgtctactgtgtattccagaaaggccagatacaagaggaggtactcgccactaaattcaagattgaaaaggaaaaggaaaaggttcatgcaactgttacaaaaccggttggtggtgacaaggatggtggtacccaggtggttaaactctgcaaaatgcatagatattatcctaccgaagatgtgcctcgaaagctgttgagccacagcaaaaagccctcagtcagcacagaggaaactgcgaggcaacatcactcttgggaccgttctgatcatcctccctgggcaccacacaggcaagagggtggctttcctgaagcagctgggcagtggcttgttacttgtgactggatctctagttctcaatcaagttcctctgtgaggagcacaccagaaatttgtcatcaccacctccacaaaaattgatatcagcaatgtgagaatcccaaaacatctcactgataccaacctcaagaagcagcagctgcggaagcccagacacgggaaggtgagatctccaacacagaaaaagagaaatacgagattacagaacggtgcaagtttgattagaaagatgtggacttgcacattttactaaaataatcaaagctgatccatgtttgccctgacgaatagagtttatccccacaaattggtgctctaaatttcttaccaaaaacctaattaaataactgattttaaaaaaaaagaatattccttaaaaaataaaatttacttttaaaaaagtttatttctctagtcaatctctattcacttttgatgcaactacttcagtaactgaaatagttgatgacaagttaactcaatggtcaaatattcctaccgacaagtatgcctttcacatttggaaagaagtagtcacacatataattgtactctttgtccctggctgcctgccaaaagcaatcacagttcaatattacagcttctccttcacaagtaattaagaagttaatcttacttagaaaacgtaattatccagcagaccatagcaccaacttaactggttgacatgagtgaaatctcaaagacaaaggagccataccacattcaaagacaaaatcaaaattgtcttcttagctgccacatcatcactgtttggagatgtgtgaagcccatcacaacccatcagtaacggggaaccaagacatctcagcttctttaaaacaccaagaagcaatggggctgaaggacactgggcacagttaaattcctagttcgtcaggacaagagatgatgtcttaataactaaggagacttcccaagctcaaaacttcagaatattccttcactgctctgaccacaggccaggcgtgagatgtctattcacttctttttttttttttttttttttttttttttttttttttttttccgagatagggtttcactctgtcacccaggctggagcacagtggcatgatcacggctcactgcctgaacctcctgcattcaagcaatcctccctgttcagcctccagagcagctcagagtacagactaatgccatcaggtctggctcatttttgtttttgtttttggttttttgttttgagatagactctctgttgcccaggctggagtgcagtagcatgatctcggctcactgcaactccacctcccaggttcaagcgattctcctgcctcagcctcccgagtagctgggatgacaggcgcccaccaccatgcccagctaatttttgtatttttagtagagatggggtttcaccatgttggccaggctggtcttgaactcctgacctcaggtgatccagccacctcggcctcccaaaggactgggattacaggtgtgagccactgcgctcagctaatttttgtaatttttttagagatggagtctcactatgttggccaggatagactcgaactcctgggctcaagcaatccaccaccttcagcctccaaaagcattgggattacaagcataagccaccacgcccagctgtctattcacttctaataatttcctaacatcagtcgatcattagaaaaagagaagttctgcttaatttgacactggcatatcaagtgcctgctatgttatatgttaacttggaaagaatcattacctatattcatgagtgggggagccagatgtcttctagaatggatggatctcctgacaaggcacccatacctgaattatgaacgtggctgcccactctctgtggcagtcctccgtgcctaacaggctgaacacaattgaaagtcggacttttcctaatacagcagagccacggcctgcctggatataacatcttttgggaaactatattcttttcaaaagtcaacagccacttttaccaacctattctctctccaagatggctctcagagcaaattctgaaattcttaagaatactgcatacactgaaggcatttgaaattgagatggaagcagcaggccaactccaaggctatttccagtcaacccctgtaggtcttacacaataaagactttttggtggttagtataccttagaaacttgctgtgtgcacagttccattctggagaatacagagattgacaaaggcagacagcaccatttttgcccctgaaaaacatatacttcatcctaatatcctaattttaaagtgatctaactacagctgctcctgaactttagctgaataatttcaattactacaggagttgggggtagggggtttgccctaaaataacttttctatccatctacccatatcagtctctagagttttgcctcatcttctgtgcattgggattttacattatcaaaagaaaatcaacatgccccttttttaaaaaagaaaaatcccttgttgaaaaagaaattgacaattttccttttcctatgtatctcaggatgagtgactcccctagagtgacttcataggtaattgaatttcatatgaaatttaccaaataacaaaggtctgatatactctacagatcattccatatagctgaaatacctatctgcctgcctgaggcttttaaacaaaatgccacatgaagaactggcatatttagaatagggaagtattgtcctctgccaaatttgtcagcattgcccatagcagaggtggacaggaaacatttcaaataccatatatgataccttccctggtggtctagtggttaggattcggcactctcatataccatataagaggcaaacaatcaactttttcaacaactttgtagttcacatagcacaaccttattgatttttggctaaggcaatgaaagggttctgtgctcagaccagagagatagagagcagggagagagagagaggttgaacagagcactgagtccagggttacttacactgggtcacagagcaaccctagctggagggtaacaaggcatattttgattagcccatctataagccaggttctgaagacacactgaacccaggagggagtctcaaaggctactggctctttatcaaagccaactcatagctcagattctgagccttggttctaattgctagcatcccatccccccatacctgaacctttcacttgccttaccaaatccttcagtgccttcatttccttctgtcactcataaaaagaacaagctttgaagcagaaatgtttgggggaaaaacagcaacctgtaccagctataaaataaacacatctccagacctctgaataaagaaggggaaaaaaagtgtctggcagggtctctccccctttcctctctgatactagatttttatttcccacctcattcatataaaaaagataacccacagagttatgcaccaaactgtgagcaaaaatgaatacagttagggttgtggtctgctctctgttcatttggtaatttccataagcaagctcagagcactcaggtagttagttttcttttctaaagctaaggagctaatcttaagcaaataggcacttcctacttcttcaagcatttgactcaactagagacagtacataaacacagtgtttggtaatgttgtaatggtatctgataacactctagaaacacctcttaatgaatcagcagaatctacctgagttagggctgtcaccttccatattctggttaggggcccatcacccacatagttcaatgaaaggccttgaaggtattgctttaacaagctcatgatgaggacactcactagaactagagaagctattgccatgatctgaaaactgtatatgagctaggcacggtggctcttgcctataatccaacactttgggaggccaaggtgggagaatcctttgaggccaagagttcaagatcagccttagcaacagactgagaccctgtctgcacacacacaaaaaaaatatttaattaaaaaattagctagtcatagtggtgcacacctgtagttccagctacttgggtggctgaagtaggagaatagtttgagcccaggagttagaggtggcagtgagctataatcgcaccactgcactccagcctaggtgacagagtgacaccgtctctaaaaaaaaattaaaaataaaaataaaacctatatatgtatatatacaagttttttttttttaatcttaagcctaaaataagagactaaaataagaggccaaagagaatggagacacattgcaaccaaatacccccagccccagtgggatctctaaatttttcttagattattattgcctttcaggtttatgtatttctttttttgttttgtttttttagatggagtctcactctgtcgtcctgactggagtgcagtggcgcaatctcagctcactgcaacctccacctcccaggttcaagtgattctcatccctcagcctccaagtagctgggattacaggcgacaaccaccacgcccggctactttttgtatttttagtagagatggggtttcgccatgttggccaggctggtcttgaactcctgacctcaggtaatccgcccaccttggcctcccaaaattctgggattacagactggagccaccactcccagttcaggtttatgtatttcttacctttcttcttttttggctataatttaaaaaagtattaaatcttttcttctgattgaaaaatctccaatgttttataaataaacaatcatggtgtgccagctccatcgtaggacactagtgcagattataaggatgccaagtggaatgagacactgtccctgttatgtaaatctcctaggagaaacacactctgatattttcaatagttaaattctagaaaggttttctggctaagttcatatcttgtgttttctacatcctcttaaaatcttactatttaaaatataaagacaaaagagcaatctacaaaaatctatgtatatctcttttgtaacctgtgatttaatcaatttagacaactgcctttggttagatttgggtaactaagaatatgcatggagaagcaaatcctgacctaattctatcactaactaactgctgaaaccttttgctctctttccgcttttgctcctttctcccactttccataagccagtcaaagtattcaagctccacattattctagctgtagagacttctgctccagatattaatgtctataaaaatattatctcccagcaaaaccttccctgtctctcaaaagtaggaaacatttacccattccttttgtatcttctcccacttagttgtgtgtgcctcacgcaggggctatggcttatttacccagctatcctttgcacacagtataatgcaagatgcataacagctactaagcagtcaataaacattagctccatgaacttcccctccaacatttagcttaatatctctacatgctaaatgctgaatttgtactgattggctgatataaactcttaatttgccaatcattagaggaaaagcattactatcaagtttgcaccactattgtttaggctattatgtcttcaaactattatagcaaaattcaggctatgcaacaagcagaagcaaacattaatgagacagtgcacttgtgataccaaagcattcctcagccaactgtcttttactctgccttttactccctgctataatcattcagttaatatttgctaaccgatgagttgaatagtgatgcatcataaacagtctgatgacagtaccaattataaagacaagaaaggaccatgtgtttatgttcagaaaagaaactggcaaaggcagcatagtagaggggattcagctgggactgaactcagggtgcctgattatcttggctagttcgctattccacaagtgtaaagaaacctatggtgctcatccaccctagtggaaaagcatctttcctactgaaattaccttccagctgcataatgtctgaactatagggctctaaaaagagatttcaacccttcggtcaagactccctgagcacctgctgtaactcaggttctataataaacaataaaagaataagatctcagacactcacagtctagtctaaatgctggcaaacattttttgtataaagccagatagtaaatgttttaggctgtgtggtccatacagcctctgtggcaatcacttttgcatgcagagcaaaagcagcgttagaaaatatgtacactattaaatatggctatgtttgggttgtagtctgctttatatacaaaatcaggcaactgactgaatttggcccacagggcgtagtttgccaactcttggtattcaggtacatttttttaaattgcaaaacagtgagctgtatgttgatgaaagcttccccttgcatttgcataacatttcataatttatgaagctatttcatatatattagctcaaaatttaatccctcataccaaccctttaaaataggtaggtcttattatcttcattttataaataagaaaactaaggctcaaataaattaatttccttaagtcatcatataggtagagatggagctaagatttgagcttccaccttacaggcgtagattactaaatgctcaccaaaacttacttcctcttcctccagtgcacacagaccgactgcattttccagactcctttgcagttgggtgtggccatgtgattaggttctggccagtggaatttgggcattgccctttaaaacttcctcataaaaactggctaacatgatcctctgctttcttttctccttccatttggccagaggaggtactcctagggtaatcttttgggtaacatgttgacaacagcagaaccacaagacagaagcagcctgggccgctgaatcatctcttggaagagagccactcaagcaggaacacttgtattagactgggaaagcagtaagaaatgtgtattaagccactgagatagctttatctgcatattactttagctaatagagcctgtgcccaggtccagtgttgtttgcattcaactatagccaagatgcaaaggatgagtttaccaggccaatgagacagaagagatcatatttcagaaggggacattcaggcaaagcaaagagtgctttcaagaaagaagaaattgttctacatggttaaatagtaaactagcaaggtagtggaaggagaggaggcaaagataagcactgggaaagacctgtgccaacactgcggtaaaaggacttggagagaacaagagacagcaattagatctgcctctagcacactcaatctaaggaagaagaggctggaggcagggagaccacccctagagtctgatcagccccggcctcaccagagcagagctgtgagccggcaaaatattttctttatgtaccctgatttttaaataaatctgattttttccaattataaatgtaatatatgataattacaaatgtataaagaagtatgaagaagaaaataaatcacaaataatctcatactcaaagataaccagtattaatatttcagagcataaacttctgagctcattttacctttctctttagcagatatgtttaggcatgaagaaaaatggaaatgtaagataatattttcaattgactataactatcagcatcttctcatatcaatcaccatagatattcacatactattagtagccttgtgcacacagtatagatgtgctatcattttttaaaatcaattgtctactagtatatatttaggttgctccctttttcttgctattacaaaaattattgcaataaacttacttatacatttatcttcgtgcaaatgtacaagcaatttgacaggactaatttctgagccaaagagtttttctactgtcaaattgccctccagagagatggtactaattcagattcccactagtggtgtataaaagtgccaattttcccacacttttggtgacattgaatgtcatcttttttttccttttaattctttggcaatctggtaaggcaaaaacatatatatctatctcattcttttaatttttgaaaacacagttactcaagtttttagttctcttctttgtattttaaaatattctctctggtctatggatgatcctaaacatatatttattatctttaaagttacagtgtgtttaatttatacaactgggctaagtgaatagaagcagagtcatttttggatttgaaagacttagtgtgaaagaagttaacacaaataatcacatgttaattctcctcaaggggtatcaaggatggtgggtgaattagcattgtcagaattgagtagataatctatttctgcttttatgtgctctaaataacaagccaggtactcattaaaattagctaaggatttgtttaagttattgcttctttggtgtttttcacacctttatcatatgcttgacttatctttggttttggttatatactagctagggcaaagggtaaatatacaaggaagcttagagaaaaaatataagtagaaaactaatataggttgtcaaacctgagaaaaaggaaatgatgagacacagatgaggtgtgtgtgtgtgtgtgtgtgtgtgtgtgtgtgtgtgcatgtgtgtgtaagacagatactaaaatgagcaggcatgtattattaggacatatattccaaggtaacatttattaaaggcctatgtaccaagcactggacaagacttgttatccacattattttatctgatcctcacaactctttgaagtgcacagaatccatattttttaaatgaaaatgcccaaaatccatatttttaaattgtgtgccagagaaattgaccaagggattagccaaaagctcagccactattagaactttcgcttgtcttttgctataattttattccaaattccatactctcccccactgtacactaaaaaaatcctggattagaatttccagtgctctccctgacaccagtgttcctcttctctcatgtaggggtacaaagaaacaaataaatgataaagtaaaaaggggaatgggttgcatgtgagaataagggatggtcccagcaactttaataaaggaataagaaaataaattatctattgagtatatgagaaattaaattgaagggaatgtaaccttagaatagtgtcagaaaagtcaggaataaataagttcaggataaagaagtagcacaataaaataatggcatgaaaaaacacacatatttgtaaaatgaaaatatttctaaaatgaaaaataataactagaaaccacataattataaaactgattggctcaactgagaaatattatgtccagccccttaatcttaacctgctgttaaaggaacactttctccattgtgttaatattcttaataatcacatgccaacttccccaccactttttaaatgcagtaaccaaaactgaaccctttcatcaaaagagtcacgttggccaagcgcgatggcacatgcctgtaatcccagcactttgggaggctgaggggggtggatcacctgaagtcaagagttcaagaccagcctggccaacatggcgaaaccccatctctacttaaaaaaaaaaaaaaaaaaaaaaaatacaaaaattagccaggagtggtggcgtgtgcctgtaatcccagctactcaggaggctaaggcaggataattgcttgaacccaggaggcagagcttgcaatgagccaagtttgcaccactgcactccagcctgggtgacagagcaagactccatctcaaaaaaaaaaaaaaaaaaaaaaagagtcacatcacccagcaaatacaaagagaatgctagtcaggaactgctaacactatttgcagtaacaatcaacaagttgagaactttcatctgtttgttgctctctgtgaacctcatcggggcttctgccaagcctgccaatatttgcttcactttgctttgtttctgttcttaataacacttacccgagcttagaacaagaaaaagcactggacttagaaagatcccctagcccaacacaagaggtagacaactgactccaaggtctgacagttaattcaggtcaaagccagatacaatcaaccattgattcttatcttcgtgggcatgcatggggttttataaaccaaatatattctaaattgtatttctatgtaaaaaataagacgaattgagaaaactagggaaaagatgtctaaaaacagaaaggacaactgtggagagattacaacaaataggagagggtgagggttcagaggggaaaataagaaacgtgagcctaggctgggtgcggtggctcacacctgtaatcccagcactttgggaggccaaggcggacagatcacctgaggtcgggagttcaagaccagcctggccaacatggtgaaaccttgtctctactaaaaatacaaaaattagccaggtatggtggcacacgcctgtaatcctgctacttaggaagctgaggcaggagaattgcctgagcccaggagacagaggttgcagtgagccaagatcacgccactgcactcctgcctgaacctcagagagagactcagtctaaaagaaaaagaaaaagaaaagcgagactaaagagtagaatgggatggcttcattcttcatccattgtattcttcctttgtccccttgtgcataactggggacataaatggtgtaactcctttctgtttacatgtgtgtgtgcatgtatgtactacatgtactgacatctctggaaaaacacaaatccacatgccaaaatatcaaccacagttatgcccgaggagtgggcatcaccacttgctttcatccactacttcttcagaaaaaaaaaaaaaggcatacatttgtggtcaaaaacagtaagtagtaatgagagaatatgaaataagttgagaatgactatacacaaagattaaatagagaactggctaagcacatttttttaaataaaataagaaacttgaaggccaggcacaatggctcatgcctgtaatcccagcattctgggaggctaatgcaggaagatcacttcaagccaggagttcaaaaccagcatgggcaacatactgagaccccatctctaaaaaaatacaaaaattagccagacatggtggcatgcacctgtagtcccagctactcgagaggctaaggtgagaggttcatttgagcccaggaggtcaaggctacagtgagccaagattgtgccactgcactctagcttggacaacaaaatttgtatgttcttattctctcattttcttagttaattttctggccttttcatttttaaaaccatcagtgagaacataagaaaataagttagtaaataaaaggaatacaaaaatgagaaaataaggaaggtataatatcattgaaattaagattaaaacctcaaaatcagaaaaatactcatggtgtgagaggcacctgtttactaagtccaactgaagacctgtctcctgttcatactgttcatatttcaacaagtagaaataggaaggtggagatatgaaatggctcacacgatgtatagtcttcgttctcttttgttgatcacataaaagtttaatttctttatgagacctacatcaatggcgtaactcctttctgtttacatgtgtgtgtgcatgtatgtactacatgtaccaacacctctggaaagacacaaatccacatgccaaaatatcaaccatggttatgtccaaggagtgggaaaggcaagaagaaagttcattttagcatttgatataaatcaagattgcttgtttttttaaaacagtccttgggtataaccttagacattcaaaataaaacaaagaaaaaagattatcaagggcaaatgatgagctcagacataaagatgaaatgcaaagagaaattataaaagaggaatgaaattgtcctttaaagctgccttttatttcatttcttcttttctcatttgattttatttcaccatctggggaaagagggttgcctcagagccctgcttgtatattttctcaagttttatctttatacatcctccctgataaaactgaaaatattcacatggattttaaagaaaagcaagaagcaagaggtcactggattagacgaaaaccttatgtaacacacatatgcaaccatgacttattctttaaacagatcgatagaaataatcattcacctttctttagagagacagctgaagtaactctagctcactcatggtagcttctgttttgctgacaagtaattagagacagttacagatcatttgtcaaaacttcaatgggtagggttcatggccctgatctgaaccaatttctcaagcagatgacaagaccctttcccttgggctgtgtaatctatctttcatagcatttctagactctttttcccaaaataccacttttacatcacccatatactccaaaacttaccatgttctcaccttgctctttagatccagcacaaactcctcagggagatattaaaaacacggctaaccattcttaccccactgcttccctgtgccaaaccctgtgtaacctaccatactgttcccctttccatctcgcactcaggaagtatatatttgcaggcccatttattccaaggaatatcaggccaacctgtcggctggggaaaggcatatgcacaaaggaggagatgttaaatggagatgtcttcatagagacagagaaccttttacaaaaacaggcaatcgattgcttcctgcctatgtatcttaccacctctaacaaagtaataacatttctaagagagggaacagagctgcaagtccaggttccaaagtcagccagcaggattcaaatgtcagctctaccagttacagctgacctagagcaagttcttttctctctctgcacctcagattccttgcctctaaaatgaatataactatatgcacttcacagagttatgatgaagattgctagttgccaaaattagtagtaggtactcgattttttttctaatgaatttgatcccaacatttgctatagaaaactatagaatctgtccttttcctctgatgctatgttctgaagcagtaaccctaatcaaaataacttaggcggttactttgatgagcatttatatagtcacaataatgtaaatgtaagtaatcacagtaatgtgaactttgtttattgatattaaacttttaaagtcaatctatgatcaaaacataggaggagtgattctgagtatagaaaaagaatgaaaaaataattatactaagagaagttaggagggataaaagaggcaaaggtttggcaaagggagagtgatggtcactaggtagagtaatccagctggcagagcaggaaaccaaaatgtaagtgaattgttaaaactacagggataaccaatacagtaaccaaagaggacatggggcaatataagtgagctatttctcatctatcatagaagaaaatcaataattaatatcaaaagttgagaaatcaataagtggcagtgtaagtgcatcagttggagatataaaagtaacactaaaaccctacaaaaaggaaagtaaaagagttaaaagtaatttatttggaaagaggcgaagaaggctgagaaaaaactgtatttttcgttaatagttctataatattgtgtttaaatttttcaactttttaaattaacaaggcgtaacaaaaaactctattcacaataccgactaaaatcataaaaataaacctaccaggaaatgtgaacaacctacatgaagaaagctctaaatcttgactgatataatagaaggacctaagagaaaacgtaaaatatgatgaatcctactgtgttcctgaaagggggaatcaatgtcttaaagttggcagttctcctgagttaatctataaatgtaatgtaattccaaccaaaaccccaactaagtgacttctggaactagacaggcagttctaaaatttatctggaatacaaaatacatgaaaagagccaaaaatttctgactaagaacaataagggagaacttgccctcacagataattcagaaataaactaacagctctgtagaacagactaaagcacacaacattacaggtatcaccttcttcattaaatagggaaacagccatattccacaatgtgaaacaccaagaaatggccacagaccttcctgccctaatgttacatttggactgattatgcaagcaatatgacaacattcaaaccaaattcctacaacctaggaaaagttgaggaggggttctctaacttcttggagaaatcattttttgtttgccataaaagaataggatactcataattaggcacaattctgtctagtggacaagaggtcacgaccttactaagaacagaagtgttaaatttcttatcaggcaatgactttcttgtaactaatttatcccaaatacaaggcagtgactgaataacaagtgtatgcagaaaaagcagcagttatgaattctacagcagctttgatcaggggcaaaggacaccaatgtggacttgagagcctaatgttttcttatgaaagatcatcttagctaagaaacttgaataaagaccattgtttcctcaactatttactgcaacagctttctggtctccagtgctccagcctcacccgttccaccatcagtctccaaactgttgtcagagagctctttctaaaactcaaatctgattattctctccccagcttaaaaccttctgttgccttttttttttttttttttttttttttggtaataatgtctaaatttcttaacctggattaccaggtctttattataacacctggtccttgctactccttcagcttcaacccttgcttatacacctgacatcatcctcatcatatttcaaggctcagttcaaatgtcacctccagaaatcctttgctgacttctccatactcaggtaccactggaatgttcctctattacagtattactgttattacagtaatataagcatgtttgtgcactataccagaagttactacaagagagctaagttctttttattcatcttcatatccccaaccagcaccttgtagataaagcacatggtctatctctattaattgtacccattaatgattagcagttgagaattccacaagaagctctccattttcctccctaaaaaaaacagcctgtacaaaggattcaaatgacatagcatgagcaaaatcacaaatatctaaatgtagcaacttctaaaagaaaaaaatctgtatgactgagaagggtagatacagctctcatgatctgggaattggatggctcaattccagccacagatctgttacacgtcttcaagaaaattatgcagtctccctatgactattttttcttcttataaaagaatgagattgctatggtttcttcctgctcagaaatctaggactcgctcttacgttgacatctacccttccatcaggcattcgtacacagcatgcacactgctggcatgtaggctatactaggccatgggggaaattagtagcagatggtaccaaagttctaggtcaaagtgtatttactgtcatcccagaacaaatatgatttcttttcattaaagtatatgaaatatacattatccttatttgtacaactataccatcttacatatctggggtccttttctatctttcaaatgctttcagagaccagtaattcttacaacaaccttgtgaggtaagcaagaaagtagtattatctcttcttactaaaaaggaaattgaggttcagagacacaacaagatgataaaaacaccttccttacatgcctcaagcttgctcctgcttctagttttatgttgcagttcaggtccctacgtcttctcagtgttgttcagaatcactaagatgagctttagtgcattacatgaaattctaaggtaaacaacaacaataacaataatttcctaattatatacacaaatacaaaatataggagcaaacatgggctttatacttcatggtcttcctgcctccgaataaacattcctcaactttgtactccagtcaattgaagccactccactaatgttactgtttaacaatgcaactcagatttcatgatatttcagaatctatcaatttcacacactcagatatagagttgatctgcataattcaagatgttccttttaaaattgatctggaaatcagaagaaagattttttgaaaaatagtcttgctaccaactgaaatgattttaataccaagatggctagtcagtaatgaaaatttttcattcagcagaataaaatcactaagataaataatagaaaatctattaaataaaatatgaaatatttgctcaatgaaaaatctctggtaagacatctgtatgtgaaaacatctaccttgaaacaagacaccttacattcatcaactttgaaagcttatatgagtaggaaaattatatcaaatttccactatgtttaagaattaaagctctattttaaatttaaagatcatcttatgtggtaaaggtaatagaagtcactttcatcattacttccataatgtgtaaagcaagacgaccctgatagtatgctgtgcagttcaatttactcctacattctgcatacataagagtttccaaacatattataagacaaaactctaaatggaaatccttctgacaaactgcatgttaagtaagccaaatccttccctatttctgtatgaaagcttcttcccaggcttagaaaactcaggtatactcaagaaaatctcaaccatggtacaatttatgttttgaataaaaagcaaacatcaatgctggtactgggaacatggcacattaaagctgaaaccataaactagcaacaatctccagacaggctttcagatcagcattgatgggataaagttacatttgagtagacgcatatgaataacctgaaatgacagacaaatttcagtttgaaggtaactttagaagacatttcttgacatgtcatttattctgtctgaccaggaaggaataattcttataattcaagaacaatctccatagattttcaatttctaatctcctaactcatactttaagatgtttttctcatgctcctggagctgacaggctgtaagaacatgatacatggatcctgcctccattttatctgtgctaaatacttctgccattctattttatagagctaattatttttactatccctgactagttttaattgatacaaattgggaatcattctctccagattattgtagaaagttaaaatatagctttattcatcattattcaaactgaacaagacttgacaatgtttcagttaaaacctactgttcataaatgtcagacaaatgaaatttttaggcatgtctgtatcctgacttataacctaagaatacaaattattttctcactgaccattttaatataatgatatactttcagtttgccagcatgcaaattctactcttataaaagtctacatttatacgaaaaaaacacttctgcctaaacaaaaatactttgttacctcatttcatactgaaatataataaatatgttctgaagaattcaaataaatatttaacttaactaaacatgaaataaaataaatgtttaccatcttttactaggactattacacttaccttaaaattagtagtatgagtcttacctttttctggacttaagtttttatacacttcaaggtctgccattaaatttaatactattacacattattggcaagagcagtacaatttctctctaaaggcaaagccttttcctgatacacatttccaaaaagggtggggggaaaaaaggcaaagaaatccttagcagcccccagaacttggctcatgctgccctttatggcatgatgagatcttcacaattcaggctttatagtgtggagaaaataaatccatgagatatgattatagaactttgtcccaaagtgaaaagcacagccagataagcacgctggaagcatctgctcggggctgccgctattgtgggaatgcaggcgctgtggctactttgggtatgagacatgcatgcttcgtgcagcgcgttaaagccctcaaggcattatgcacatttaatgtctgggaagtgtaggtctttatccatcaaagaaaccctcctcaccttcagaggtcattgagaaacactgattaccgtgggagtgacgcagactgaatacagaaaatgaacatgcacacacagagacacagaagcacacacacagacacacactctcagaagcaaacatcactccatcggaggcaaacacaatccattaagaaataagctacgactgccctataggctacttttgtgcaagtcaggttaagtgcatattcaaagcgttgagggttttccttgtttttttgtcctgattttattcacacacaaacatagcaatgatcacagaaaagactggaatgtttccaacttagaaggaatgaggttacagtttgaaaacacttactcggtggaggctatttctcatgtttaaaaaaaaaatcacatgcctgtggacgtggacaaggtagacagcatgaatgggtctaaaaaagtcagtttttagtgaatgaaaccacacattattatagtgcaattttccctaaagtctatgtaaacattatttgcaactttattcaacttctttgaagagataggtagacagacagacacataagcagatacagtagcaatttacagtagtcttgcattgaggcattgtaactaagcctctcatcctgagtattaactctctcattccagcattccctttctaatatcgaccctattgccattttcttctcccagcttcagctgtccctcacccacctgtggcccttaggactcccagcatctcccattctgcatataccagtgtcaggccctttaggcaattcccaccagggccacccagcctagattgctaactcatcccttgattccaaggtgccaagctctatcccagatccaattcacctgtgtcccaatttgcacatcccctgccccaaattgcaaactacactatttactttcaaatactctagggaaacttggatttcaaaggtatatgtgggcacacacaattaaatacatgatgaaaatatccttcttgcaagattcaatctaccatacatacatacatcactatacaaaatagccattaagagtttaggagcctatctgcctaggttcaaagactgactctgccaccaactagctgtgagactttgggcaatttacttaaattctctgctcctccatttccttatttgtacagtgggcatagtaatagtttctacttcaaaatgttattgcagtaattaatttaatacacataaagtgcttagaatcacaattatatattattattgttttactattattaatcttgaaattctttacatcaacccaggaaaggagtggacttcattgcttaatctgaattaattagtggtccgaacacaagatggcaccccaaaatgtgacatatctgagaaatacccattcctgctaaataatccaagtatttaatactcccagataattttatacaaaaagacaatggtgttttcttaacacaaaattggtaacaccaagtaacgaatatctcgttcctttgtctgcccagaaccaaacatgcccaaaaagcaagaggcatcttgggtttatctcttgctcggtcctgaaaagaggtgaagaccaaagcactcccagctcccaagaagttttggaaaggcttccttccaaagatccccctccccactccaatctggggtcaagaaagaggaaggggacaaactttttatgtgctcactttacccactgggagtcttgctcataataagtttttcatccctctcacctcttgctcctgaagccccaggctcctccctgaaaaggctgacatgcaggattggatatggagcccaaccacacaagcacatggcaggtttattctgagtggctctggggcaccgttgagggccaagccacttacccagggggagcacatagcagcttcatagggcaggtgggcaagcttttaaaaagcagccatggcccataagtgtctgtttgaccacaaaggagcactcacagatttttgagagcctagagatatctacttattattaaatatccaattcttcagcagtagcaaataacctcctatgcagcccattcaaaagaatcataaaacttataaacacctatcctgaagttggcagagacactgaatgaataaccacatctctgaaatcactcccctgtattctcccaacagaaggtcatgtacgatgtcaaaactaggccaacagactttggggacaatggtgcttcctctgatgggtcacctcaacaaccttacagccttagaatctttaatttcttaactggaaccctcatttgaaaagtctgggccttttccagattcgttctagcatagtacttggcatacagtaggtaccttatagaccctcatcaactttctccatttttaatcattagacctaacatggaattaccttcaccaatcaggtgaaaaataaaaaacaatatttctgagttcagcttctaaatttacaatcagtgaaggactttacacctcatctgacagcatttccctcatctttcacacctgagttctacttctgatttcttaaagaaacatcataaagtgtaataggtaaaagcaatggtttccatggaagatggagaaagatgtaagccccagcctcttccttgattcactgcctggccttgggtcagttatgggtagggttgtcatataaaacaagacacccagttaaattcggatttcagagaaacaacaaataattttcagtataagtatgtcccatgatatactgtattttttcttgctaaatattttctgtatttttttcctgtatttttacttgctgtaatattcctgtattttttcttgctaaatctgacaacacaatgggggtggtggggagggctggtgctctctaaacctgtaagcctaaatatcctcccctggcaatggcagtacctacctcagagggcactgctgaagagtaaatgggtggtagaggccaagggcctagccccagtggctggaaaaataaatactccataaatagaagctaatgcagtaagtgaatggccactccaatcactggcttgatataacttcatttaaccaagtctcaatgtttaaaatgttctatacaaccctccccccacaccccaacctcaccagtcatataattctaaactgagataaactcggagtgaaaacatggtgcatatctgcccttagggctcacaagtccaatcagaaaacctactgacgcaaacctaggaaccatgtcacttaatgaaacattattataaaagctaccatttaccagacaccactatgcaaatattatcttccctaatcttcatgaaaattctgcaaggagatatattagtatccacattttaaaggtaagaaaactgagattcaagtctgagaagatgtccaagatcacacggctgtgatgaaccagaattcaaacccaagctgactccagatttgggccctttcccctggctctgtgctttaggtcctggaaaccatgtctaaagttttaggcctgatatcgaaattcctcatgtttttttcccagctagaaaatattcccacacaatgccagaagctgttagtgtctctggcatagaaacacagaaatgctttaaaaaataaataaataaataaaaatagtcggctgggcgcggtggctcacgcctgtaatcccagcacattgggaggctgaggagggcagatcacaaggtcaggagtttgagaccagcctgaccaacatggtgaaaccccatctctactaaaaatacaaaaattagccgagtgtggtggcgtgaacctgtagtcccagctactcaggaggctgaggcaggagaattgcttgaacccgggaggcagaggttgcagtgagccgagatcatgccactgcactccagcctgggtgacagagcgagattctgtctcaaaaaaaaaagtcagtaaagccatagtatcacattaacttaaagcatattcacagttttcatcacaaaatggaaagtaggggaaaagcaagtatagggtgcagcttcgccattgagagcctccagtcacacccagctaccacttcctaagacctatcccacatacaggtacctcaattaaggggaggatctcacaggaactttcatactctgctgttaagttgtacattgagagcataaactgtaacaaacttaatgaagtcatcaggcaagatgcagcaagatttgtaaaaatggttatgcttattttagtcaataatcattgctgctagaaagctaccataaggaaatcatcagaaatataaaaatctatatagaaggaagtatcctttccttaacatttgttataataattaataactctcaactgtctaattgtctaccaaaaagggaatgattgacttaaatatacattcacattttggaatactgtctaaccattaacgatgtctgtaagacattgcaattacctggagaatgtttgacatactaagtgaaaaaaggaggatacaaactaactactaattaaaggaaaaaaggagatacaaactaactactaatgttactttaaatacgtaaaatatagaatatagacatatagaataaatcctataaaaacatatgaaaaaaatgttatcagaggttatccacagctatctctaggtgttttactttcttctttatatgttactatattttgattatttagaaccagcatttatttcttttatactcagaaaaaaataacattattttttaaaagtgtagccagtttagtaacactaaacttagaaaaagaatataatctcttcccactaatataatatggaaaacttgctttgaggcttactaacatttatgaagcactttactatgttccagatactgttcctagcattgcacatgccttatttaatccttacaatgcccttttgagtagattaggtacaaccatttctctagtctcaaatgtggaacctgaggcaaaaagcacttacataacttccccaagatggcacagcaagtctgtgatagacctgggctttgaatctccacagaatgtctctagaatcagtgatcttcaccagataaggtaatacggagatcttgagtcacttattgccttcagtctctctttttttatctgaatgtctcacagaacaatgaacagagcaaccagagcttaattccttttaggaaatttcactgtgcactcaactacagaggaaacccaaaatcattgctataagttatatatcaaaatcaccaatgtagctatgcaaacacatgaaacctcaacaagaattttccaatctacatgcaaccccaaagggctagatgcagggaaactcccaagtggatggtccaggaagatgttcccaggatgagcaagcacatttcctttccataaaataggggggttttttactaccactgaggcattgtcctgtctgaacccctgcttagtcttaagctgttccagagtactctggagacaatgggcactaatctttcatcaaaatcccttgaccactcagtcatccttactcagctagctgtcctgggcaatatctggttctgaagcagagggtagcactatccattatttggcctgtgcaaatcacagaaataaaaaatgaactaactgaagggttagactttagcctctgagtgtctgctaataatctatgggacaaactggaaatatgctttcagtttttatttacaatggactcaactcactaaagatgtagtcaatgcaaactttgagttaaatgaatgagagaaggtagagatcatttatcaattcaaacaagcccagcatagttcatgcctttggcctattcatcatcagtacatttgaggaaattgctattatatgaagctcagaaagccccatcaggattgcttcagaaaattgctgcaacttttatattaaaccccaaggaacaaaatggaatgctactctgagttcatatacaaaggaaaaggcacttcacaaacaaaagtgtatgcaatgtacctaaatgctcaattaaggtagtaattacaatctcatcaatcctatgtgatgctttataaactctacaccttacgaagtcctctaggaacacataccccacatgagcctgacagcaactacaggaaggcagagaggcagaattatcattctgcatttgcaaaagaggaagctgagcctcagcagctccctatgaatgtgcccaagatcacaaaattagtcagtggaaaaactgggctttctaatccaaacacagtgctctttccccacaccaggcaaacatgcttaaaatattattgccagcaagaattgctagacaacaggataacagagtataaccaaacacttaaattgcaaacccagtgtattacaaaaattttagctgagaagagatgaagacctgtaggggagcaggtttccatccaatgcttgctgaataaatgctgagaatagcctacacaagtgttttactcagagagcaggcttattgtgaatgtttattcatcactggagagatataactctatattctaatgagacagaacatgtcctatagatcacacacacttgtcaaataaaccagtttggatctctcctgcattaaaaacctgacatgcatcagtggacagtaattgctacacatttttaagcatctgaatctcaaaacaaactgagtataacccatatttaattttgctatgttccacaggacagagatgagccactcattagcctgactgcctctttgaacgctgcctgcttgatgacttattgatctccccttcgagactcttggttttcattattttttgaaagacttgattgtttattggtcatgtcactttaaattttataggttagcataaaaatttgtaggcacatcactgtcagcttgatgaagatgtcaatataattgaaaataaaatctctcatagactcagaacttgatttcaacttgagcaatccatgaaaataaccaagacctcgtgggcaagattttatacacaggtgctataagaaacccaggagcttgcagccagggaacactaaagcacactgaactatctttggtaatgactcagaaaatgtaaaattctgattgacatttgggtgccatgaactcatatccagctataaataaaagtacccagactttgtaaatcagcatcagctatttgagcagctaccatcagtgctgatcagtgttaatcataacattaacagaggagaattaactagagataggtagtcacacgggaatctctcatggttgttgacagtgacatatattaaaacaaatatctgtcctgaggactgaagctttaattaaattctcaaaacttacttagtcatatattcaaactcccctacagtacttgggatgcactttcccctgaacagaagcccctttacctccttccttgggaggtggagctggatgactagagtggaaatgtccagaataaatcctaagtgcttgtattctccagcactccagctaaatgaggactgtttggttgtataataaccacacttggacgtacctgatatcttaatacaggatattttatcatgccttaatctgccatctctgagtctaataaaaggtaaatgatattatctgcccaggcatggcttgacttacagccaatcaaatagggattacaatacatgcattcaaataggagatacgcatggtcatcataacgcaaaccccctacccccttatccagcaatactgagccctgggacactacatatacagactggtcccataaggaaagcaaacatagagataaccataaattgggggaagcgggtagagaggagaagatgattctagattattgaacacaacagccacatctctgggaagtctcttcaggccacccaaactcaaaggcctgactaaagagagttcaaacttcgaggctgcctcagaaccaccaggtcacttcaacctgagcagaattcagggttgtttgctctgtacaaccagagactctcctgagaacaggaaacgggtctccaagggagcgggatggccataaactcctgaaggactggaaggggaatgcctcctctgaaaatctaaccctgtaatgtctgaggaagacattttattaaaaaaaaagatgacctttagagaaaggatgcccttaaatggttgaggcagggagacctcactcctctttctaaaagaaaaccaaggaaagagattgtactggctcctccggtaacaattttcaatacgttacagctcacagtactatcacaacagtctaaattcctaaactaaattactctacagaaatgaaaaatcaactcctttgtctctcccttgatgaaagagaaagtagctcttctccacaacttcagcagtacaattttacacatactaatagtttttgcagtgtctccttacctctttagcctttcttctcatattatttccccctaacagtactgatttattaattttgcattctgcctaagacaacagaaaaatagacacagaaacaaggaggaacataatgtaaattccttgagagctagaacaatgaatgtcttgctccctgatgtatctccagggcctagaacggaccagaagagtagtgagtaccaggaaggcctgagcacagaagacccacccagatccaaactcagattctggatagttttccaattgtcggaagacactgggcataaagcaagactcagatcccaaaggataacagagggactccaaaagctgggaacatgaagaaaaccagttgctcaattgtgagatacggtaagggtaagtgaggggatgatggcatgtagccttttctctacaaatcagggagaagattaaggtggcagctactaatggacagttcccttggatgaaaattatcaacttattaaaattttccaaatggccttctggttaacacttcagcctagtgatttaggaagagagagagcaactgtggtaccaagggaaggcagagctccttaggagaaaaagagaaaggacaagtcaattccaaatccagaaataatttaactcagtggaagaagagttaaggggcataaagtagttggagacgatgtgacagtcaacagataagcaatcaaaaagacttcaattcaaatcctggttctaccagtaacttaacaatccaagccaagctattttaaatctctctaagcctcagtttccccatcctcagcaatatctataataacagatgcaaaagttcctagcccagcatataagtgctttaagcaggatgagctacataatctgctggccctgtatgaaatgaaaacatggagacttttccccctcaattataaagaatttcaaaatggcaacagcaaagcattaaaccaagcacagggcccttctaagtcacaaacacacaagaggcttggctctaaccctaagaacttggtaggatttacaaaaatatttttctccatgttttttactttcctctcccaggttcatttccctgtagagaccagttgaaaaaacatctttcagaaaccaaggacattaaagggacttatgaatgttaaatttacttaagttgataattataccatggggcaaagggccatgaggtatgcaacttattctcaaattattcagaaaaaataatcgtgtgtgcgtgcatgcatgcgtgtgtgtgtatagaaagagagtgtacaagtacacaatgataaagcaaactggataaaagttaacataacataaagtcccatgtgtggttgaggggaagaagagggaaggaagtgcaaagaggggcaagactgtaatgtaagctccttacagacaggggccatttgtagtttgtcaactgtagatccccagcatagaatctaagtcaataaatatttaaagcatgaaggcaaaaagggagcaatatcccttgttcaaactagcttggggaataaggacccatggaagggacaaatgattgattgttatggcagtgcttgggaatcagcaagctgctctacttagaatgagaccaaggaatttttgaagctgtggacatgaacacacggtgtggcatggtaggtacctcacaatgcacccatattgctcagggactcagttgtcaccactttctaacagttaggttaggtttagacccaccttcagcccatcactgaacctttcccagcctcagcatcctcactgatcaaaagtgagatgttactgattcatcaatcaaatacttaccaggcatctcccatatgcaaggctctaaagtcacattccctattctctagagctctcattctagaaggggtctcagaaactggtggcattaaatattttcttgaggtccttgaagtctttcccagttctgaaaattctatacaaaaacttggggctttctatttaaaaaaatgaacatgaaccttatagtataaccactctctaaaatactcgcagtaaatgtatactctcctaaaggtgaaagtgtactagaaatgccccttgtttattaacttaaaataatctgtacacataaggcaataaaatgcttgacagcatatataataaagccttctgtcaatagtcaaattagttttggctgccaaaattcttgctccttgataagtcactcaaatagcaagaatttcaaaaatgtagcaaagctcttttgctagaaaagacattatggaagatagaaatactttaaaagcaataaatttatcaatgagagaaataatgctgaagtatagattaatgattagtattaaaataaaaacatcaaaagtattttaattttctgcttcaatagtcctcctcattcatagtcgactagcacaaaaatggtttcaaaagctaattttgttaaagaccttggaaaaaagaaaaaagaattgctccttcatgaatactaaagatgataaaataggaaaccaataacattttatcactttatataaattaatctaatttagaaataatttagtactatgatttatgcagaacttgttctctagctaagagaaaattttacattactagtatcagaaacatggtgcctacagttgctagacattaaatgtctacactgatttatataatttaggagaaatggtaagggataaggaagcaaaaatataatcagagaccaaaataagagacctatgagaatattatttcccagatgggttcttagaagctcaagcaagagtatatatgtattaaaaatggtctcaacaggctgcaagttgacatactgagactaagtatttgtctttaaaaaataaccatcctcctgtcactgactgatataattcccaaggatcggaacactattatttttctggcagatacacagggcaactgctttaaagggttagcttccacaactaaaggtcattcacctatggttttgcagagcagcaactctaaaacctttctcctaagaaatgaaaaatgtctaaacatcctttggattcacagagtcaacactactacctagtaaattaccatacagtgaaatccttactggatctaaatgctacatggattatgttacattatttgtaaagttcagcacctggctccccacagagagttaataatcatttttacctatgaagacacaaaaagaagtcagttggatgccactaggcaaggagagccctgtctcatacagccctgctgccatcaatgatgggaaaccaggacctcagccctttagcagctccaaagtgaatacttccagacttacctggccaacacacagaggccctgaaatgctttcacataaaattccttttatgtcacaatattccaatgccataaatatctagccatttttgataatcagaaaatgcagtgatttacaagatttatcccacagaaaatccacttagcatttcataatacttagttcagatcataaaggccagttgagttggaatgacagaatactggcttttagaattaacccccaggagcaagatggcagaacagaagcctacaccattcatccccactgctgggacaccaaattttaacagctatctgcacacagaaaagcaccatcacaggaaccaaaaataaggtaacagctcagccacagtggggtagagcaaaaaccaggttcttagggtccctgagtccaggcctaggcttttggacagcatttccagacccgccctgggccagaagggagtccactgccttgaagggtgggtcccaggcctgtcagcattcaccactgctgatggaagagcccttggactttaagtgaacacagacaggggcctagcagaaagcccccatggaccagtggtagcgggtggccacagagaaaggctcctctgcctgtggaaaggggagggaagagcaggaagaactttgtattgtggcctgagtgccagcttagccgctgtagaatagaacatcaggtaaattgctaaagttttttacttcaatccctggctcccagacagcatcgctggacatgcctggggccgggggggatcttgccatcctgaagggaagggcctagggcaagtcccagtcagtgccatgctggcttcaggtctcacccagcacagtcccagtggttgtgattacaggggtgcttgcatcaccaccctcccagctccccagtggctcagcaaagaaaaagagagactctatatgtttgggaaaagtaagggaaaaagaacaggagtctgcctggtaatctagaaaattcttccagatcttatctaagaccaccaaggtgataactctacgagtctgaaaaaaacacagcattattggacttgggacccaagtctcttttaatacctgaaagtctttccaagaagaacaggcacaaacaagtttagaccgtgaagactacaataaacacctaactcttcaatgcccaaacaccaaagaacatctaccagcatcagcatcatccaagaaaacatgaccttaccaaataaactaaataagccaccagggaccaattctggagaaacagagatatatgacctttcacatagagaattcaaaatggctgttttgaggaaaagtcagagaaattcaagataacacagagaaggaactcagaattctatcagatatactttaaaagaaggttgaaataattaaaaagaaccagcagaaattctagagttgaaaaatacagttgacgtgatgaagaatcttttaatagcagaattgatcaagcagaagaaaggattagtgagcttaaagacaggctatttgaaaacacatagtcagaggagaaaaacagaaaaaagaataacaagcaatgaagcacacctataggatctaaaaaatagcctcaaaagggcaaatctaaaagttattggccttaaagaggaagtagagagacagaagtagaaagtttattcaaagagataatatcagagaaattcctaaacctaggaaaagatatcaacattcaagtacaagaaggttaaggaacacaaagcagatttaacccaaataagactatctcaaagcatttaataatcaaactcccaaaggtcaaggatgaagaaaggatcctaaaagcagcaagagaaaaaaaagaataaaaaaaaaaaaaagaaaagaacatacaatgcagcgccaatacgtcttgcagcagacttttcagtgggaaccttacaagccaggagagagtagcatgacatatttaaagtgttgacagaaaaaacttttaccttagaattaactttgccactagctggttgctatcaatatgtaccagtcacttaccttctcatctataaaaggagagtggttttactcagaggtttataattcacaaaaagggtaaggaataacagattattctgaaatataatgaaagctaaggactttgttcaaaggaagaggatgcacaaatgtacatgcatatctacatagagtatctagcataatgtttgcaaaaatttcataagtgtcctgaagcctggctatgggttttgctcagaatcccttaatcagagggctcccctagtccttgctattatagatcagggtattacgtatatccttgactatatcttcatatgttttagacacagagattcaaatttttaagcccattgtacaaagaaaattacctgccaattcatagccctcatgtttcctccttgggaatctgagtatcaggatactgctgggggtcttggtcatcagctgtgctccttacacacaagtttccaacctctcaatgctttgtatgatgaaaaacagttctcttctccctcacacccatcctttttccatgtgctccttggagaataggacaaattcctcactccagaggactaatacccaagcccggtggtctcctaaagcaatgctgctcatacttaatcatctgaggaccttgttaaaatgcagattctggctcagaagttccctggtggggctgagagtctgcatttttaacaagctcccagggaccactccagtggacaccaactcttagccctcacccctagttcctcagccccctccccacactcagcctaagggcaactcacactgtgtctctagaagttctctagtagcctttgaagaaagggtgttacagctcttttaaaacacaaacccaccccctcagcagctttaaaagaaacaagtttgtgtaatgcattgctgtgtcacaatagtggaaaaaccctggatttgagagtctgacaaacctaggtttgaactccataatctaacaatgtgacttgtggcaaattgtgatttctgtgagtttcatctgtaaaatagtcttgttgagagacttaaaagaggtaatgctactccaaagacaaccttgacttagcatcaacctaacatttcctaatgatccctcaagaatattctaacatagagtccaccaattcctcccgacaaggtctaaactcagttatagcaacaaccgtctcaaattcctctttgtgttccccttaagatcctatatgcaaagccggagatattgtgcaaaacaagagcaatctgagaaggcaaggtttcttcttcacaactctgagacttctaggaataacacagagaacctgagcatcagttttctcacatgtagcgtaacagaggtagagcagatatctacagggactgacacagcttgccttccacaacaaaatgcacaggggtctctaagtctctggataccacttagttttccaaagtagacaaataaacacaattctagttaatatttaaggttgcatctgatatactccaaatgatggcattgttctctcaattcctgcatttcatatttctttctgtgccaattcttcaaattatcctactgtgaactgtgtagttctcatcatagattaatcaaaacaaaacactattaatatgttctttgttatctgttgttaaggaccttcccaaagtatttctacttatcatcagaagaccgtgtacaacattgtgaggtcaattagtgctcaaagaatcgcttgaacccaggaggtggaggttgcagtgagccaagattgcaccactgcactccaacctggcaacagagcgagactctgtctaaaaaaaaaaaaaaattagtgctcaaaggtatatctttgtatcatgatatcatgtatcaatatatctgttgatatattggtagtaaagttaaggcaaatcacattttaaggacactaagaaagcctattaaaggaaatatgaaataaatttgttacaaaaaaggaaaataaccatatgaaggtcagcatatcacttcccccttcctctctgcaaatagtctataaagtcaagattttcatgtaccacttttgcccaaactagtgtacaattatatgctgtattaaatcagtaaactcatacctgattttgtgtactgatcaaatcaatactttagtcaaccaacaacttcaatgcagtgatttttatccctcccatgtcatcaaaatcacctgaagatagataaatatacagataaagaatgaatgaatgaatggatggatggatggatggatggatggaaacatctgggtcccatgttccagagatgatttacctgggcttgggttgagtccaaccatcattgtttttgttttgttttgttttgttttaacttggtagctgggcacttaccacagcaacatcttgttccgtactgttgcctgcttcttgggaataccttgcttttcctactctctcccgtagctgcctgtggttatcacagcaaggattctctgagcctcattctcctcattagcgaaatgaggataatattagtccctccaatcattagcaatttttttttttttgagatgagtctcgctctgtcgcccaggctagagtgcagtggcgccatctccgctcactgcaagctccgccttcctggttcacgccattctcctgcctcagcctcctcagaatagctgggatctcctgcctcagagtagctgggactacaggcgcacgctgccacgcccggctaagtttttgtatttttagtagagacggggtttcaccgtgttaaccaggatggtctcgatctcctgacctcgtgatctgcccgcctcggcctcccaaagtgctgggattacaggcgtgcgcccggcctaatcatcagcattttttaaaaagcaccctagcagattcaaatgtataaccagatatgagaatcactacttagtcaatggtttttaaatcactttaagaaagcacagacttgccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaagcacagacttaaaacacattattgagattatagactatttttcccatctttactcttttctatgctttccaaattttctacagtgaacctgtgttgctatcatcagaaaaaataaagtgaaaaaatatttttaaagaaaaacagcagcggctggatgtggtggctcatgcctgtaatcccaacactttgggaggccaaggagggtggatcacctggggtcatgagttcgagaccagcctggtcaacatggtgaaaccccgtctcaactaaaaatacaaaaattaaccaggcatggtggtgtgcacctgtaatcccagctccttgagaggctgaggcaggggaatcacttgaacccgggaggcagaggttgcagtaagccaagatggggccatcgcactccagcctgggcctcaggagcgaaactctgtcttaaaaaaaaaagaaagaaagaaaagaaaagaaaaacagcagctacaaattcccaagcatagatgattcttctatattttcctgcttaatttatattcaaatactgtatttctatccatgtccttcttttttaatgctcccccttccctgcccttcaagattcagtataaaatagactatcatcacagaaaataaccattatcaaattcatgaattcaatagttctgttgagaaaatatgtattggtcatattgtaggtgggttttcaacccaccaaaatctaattggctgcccactagaatcacatgaagagttctaacaatttccccataccctggccacaccccagaccaaaaaatcagagcctctgagctgggacccaggaaatagtttggttttatttttgtttttgttttatccccaggtgattccaatgcacagccaaggctgggaaccattgatttaaagcattaattacttacaagtctccacatctagagatgataagcttctacttagcttaaaaacacaataccgtgaaattctcacattggcacaattttaaagaatggtcatttgtagaaatgcattgatgttcaatttcaggttggcagggagtaaaactacgacactaaacaataaatgtgttccctgttcttcttttaattgagcataagccaccatcctttacatttcaataggagaaattctaaaaacacttatacgtcagtcacatatgctgacaaacagacaaaaacattttcacagattctatatttatcctacccagagaggtgtttacttctcagagtgatcttgctacctataagtcaggaatggactctcatagtgcctgagattcttagaggaaaggcctaggtgctgaccatttttcttgtttgtgaagctgaaataaaagtgcatcttcttaacttttaaagaagtcctatgctgtttgattattctcctcatgtaccccaaccccaggcctcttttcttcctctcttactgagaaagctagtgcttttttttttttttttttaatgcaggtctattctgtgctctctgcagtaagaattaccccacagacaacacttacttctggactggagattttcagacacaagcagcagagaattttaatagtatgcaaacaactgcaattaaacagctttactaatagtgctattttaaagagagaaaccttcagttttaaagtcagataaaatacatatgtatgtataaccaacatggaaagtctacaatgaactcaaaaagccttttgaaattactttaagaaattattttaaagaaatggttttgtccttgcccatttcaaggcattatgcatttgtaatatacagtcttttctaaggcacacttggattctcattggtcttcttttccttcttcatctcagcaaggatggtttatgagtattttttttctgggtttcctaaggcaaaattctgagtaaaggcaagaagagagtttacagtcagagaactgatgcatttcacagcacaaagattaaaaatcaaactcaacagagagtgcaaaaatagtgaaaccgctcttatctcccctattaaataaaatatagaaattcattcagcaatattttattgagcacctactatatgcaacgcattgcactgtgtgctgcagatagaagtcagaacagtctctgctctcctggaccttgggttggagagacagaaatgaaagtagtaatcacacaattaattgttttattacagtaatgataacacaatgaagcagcaaaatgaagcagcaatgcacagtgaccggagatcataaaacaggacctgacctggtctgagtagtcagaaaaggcttctcctttgagaggacttttactctgggattgaaaggatgtgttcgaagttggctaagtgaagaagcagtgagttttgtgggcaaggaatgcaaacgtcagtgtttctggggtgcaaagagaagggaaagggtgagataaggttggcaaggcagatgggtaccagggcaggaaggaattctgctccacacatcttgagtctgaggacctggagagcatctgtggagccatcaggtaggcagatggacatctgagtattcggcatagagggaaggtcaaagccatgaacacacttttggagttagcatagacatgggaactgaagccgtgggagtaggtgaagctgctccacactaggctagaggctttaaattaaaaatctgaatattcctttgaaaccaacaatttactcttgaaataaccccaaacatatttgctgaaaggaatgagccctaagaaaatataaaacatgtcacagatctctatggggatgacttcatccacgtggtaagaagggacaaactgcagtttttcaactttcttttgatagataggagattggagggtttcatgattacaaacacaatcactaattattactggatccaaggaaaaaaatctagatcttttgcataactaaattaaacaattatgttgccctagaagaaccctgaatctactcatggaaagatttttcatcctcccatcaatttctgtgcatacattagaaacagagtgggaaagacaattgggaaaatgagagagcagaggaaaactaattgtaattatggaaatgcagcttcaagaacaaaggcttaaatttgtaacacaggtctaaggggaaataattctcagaagtaaccacttaaaacatgaaaggtctgcaaatctgaaggaaaaaatgacggtttattatacacattatttcttctttctaattaattagaaaattaccaattccaattgccaattagaaaattggtattcccaagcataaaggaataaaacaatcaagggcctttctgcctggctggactctcaatggccacaggtttatgagaaagagttggagaatctcatggaaaaagccatccaaggctttcacttggcagcaataggcttgtttcagaaaattgaaagctaaagcttcaaagaatgaacactgtcacttctcatccacctgggcttcccatacatccagatctccaatttgccatttaaagagcaccttttcatcccctccatcgttgcagaagataaatgaccttgcatagaaagcatgacagagagatcacagtgggttcagttactcagaaaaatcccttcattgaattagattcccgatgaggaatagaggctgatacacctcaacatggatttttatacatacagatcattgcttgggtctgatcaatccagctacataatgctgcaaaaagcaaacagaataaagaacaccagtagctttagggaaattaagtcgccctaatctaaaatgttagtgaacaaggacctgcctagagtgactctaggagtccaaggagagctgtcagtggttggggggccgggattccatccatcaaaatcacattacctgagccgctgttaggcgtataatatcgtcaatgcccagggtggcagagatggcactctgaggagtgaaactggaggaaacacccctcacccccagaaagaagcaggggaagagctacaaaagaatgactgaagagattgcttaagttggtaacataggggagcagcccctacagtgtgagaagagactgtcatcagcaggtctgagaagagcaaggggcaacttcacaccccattccatctttcaagtcctttcagtctgtagagctccacatgaagaaatacggagagaagagaaagggcaggagccagacagttgccccagtgtcctcaggggcacaggaagctgtgctctagccagaggaaactgacagcagagaaggcatgaggctgaagcaagatggcaggtcctctcaggagggtccttggtaacagagggagccaggataaaactgagaatctacagaagatggaagcagagggagtctggatcacctcaccgctgctgacatacaacagggacatgtgagacaaaaagcctttgctctctcttctttgtaccaaaatctgtggaacagggccttgaattctccttcaaggggaaggagtatagcagagacaaaggaactcccaccctcaaccaccaacagccaggccagcgggtaagagggcttaatgaatttgagattaaaattttaaaatggactggacacttaatagccaaaattagccagaaagtaatagaacctatccaagatgctacaatgggacaaagtattttctgaagcattcactgaagcatatatgctacactaagttgagaatgctcaataaaccagttacaaatggaatgctcatcataaagaccaaaaaaatgaaagaactttagattttaaaatataaataaatagcattcactgagaggctttcattgagaattttttgtatctccaagacatcaaagaagagtatatgttcccaaaaggtcatagaacaagtatatttcataccagctcacattaaaggttttttcctttgtgttctaaactagacataaatatcctcttttgtaaggcctgaatggatggctatgatttccctcagacaggggaagaagaaaaggagataaatcaatgtggtcagttaactcacagcaaattctccaattagcctgtgtttaaaagtagggtgagtaggggaggtagacaatctcgcatttcttaaaattttagtgcttagaaacttagaggtcattttccataaatgccagcattttgctgatatggaaaacttagtcccaaagagaacaactcacccagagtaactcagccagtgggaacccctacaaagtgtcacacctgggtcaggccatgcttccctctgtctaaatcttcaccacctgcaagatacacctgaacatcataggcctgaaaggatacctgccctgatgctttctgctttggtggccatcaatgggaggtagagagccttttgggtggggccaataaaagaaatctacctggcaacgctgcttccagaattagttctattataatttataaaacttaaatgaatgaaatatattttctcccttaaggcctatcttctttttttttttttttaactcttcctctcaatttgtctttgaaatttttccctggtcctctctaataatttaatgataatatttttaatcttttatcttttttttttttgagacagttttgctcttgttgcccaggctggagtgcagtggcgccatctcggctcactgcaacctccacctcccaggttcaaacgactctcttgcctcagcctcccaagtagctgggattacaggcatccactcccacacccagctaattttttgtatttttaatagagacagggtttcgccatgttggccaggctggtctcaaactcctgacctcaggtgatccacctgcctcggcctcccaaagtgctgggattacaggcgtgaaccactgcgcccagcctgatacttttaatcttaatgatgttcatgaaatcttgattgtcattgcaataataggaattctatgtgcacaggtattttctggacctagaaaaggagacttataaagttatggctggaaaagctaggctttgattcagtaaagaaatgctactctaacataaaatctagtgatgccccacaaacctaaagcaggcaggctgccaaagtctaataaactggctgaaatcaattggaaccctaattcacttttgcataatttcattctccttgcatattttccagtcaggatctggaattcttctcttttcttccagtgcagatggaactccagtgagggagagcttttcactcttcatttttgaatataatcacatttgtcctgaaagcttgtgtgtcagtcctagatattggtctctccatggtcaggagaaacctgtgaccattcacacacacacacacacacacacacaccactacctctctcccctaaagggaaatgcagcattttgccagtgcaacactaactacaaagtttacagtccaaaaagaaatcttatcttctcttcaatgccatcttgccagcctttcattctcatacccccggcctgaagaacacttccatctatcatacacctatcttgatgtttgactacacagagacctcacaccttgctgctataagggaactttacaatctggcaaaatcctcacctgaaagacagggaaactgagggccccagaagtgacatgaggctacacaagttagttgttaaacttggattagaactagtcttcaggatcccgtttcagcctactttccattacaaactagcagtcaagtttctaccctcacatcaccaactaggtctgtggccaggaaggggaggctggataaaaagtaatcctttaattaattaactaagtcaattagttttattaaaatgtagttctgaggcaaagtaaaagtattaacatatatataaggcaacttcttgaaaaggcatactgcataaatatttaataagagaattacccttaattttatccctagatagtaaaagatactcctaattcagtccaaaatgtttctagtttagatttgtaatggttattccgaaatattcatttaacaacatgatggcaacaaaaacaaattttcccataagaagttgagatgataacctaataacttacaggaaagcaattaatactttttccaatagtacaattataactagcagtatgtgaagacaaacattaagtcacttagtaaggagctcaaatgtttggaaaggcttatgtgcataagaaattgcatgtgcatattaattgcaaatacactcattattggttaagaatcaagactgcatcccaggtcagaaaaaaaaatactgcaattcactgaaagcaggagaaacagctgaaggtataggcaattttcaaatcaggataaatcatgaaggtataagccattaagacagggttcataccgcaccaaacattctttgctcaagatttttttctattgcaaacatatcagaagaataaaagtcaagtaggggaagatcccagagattagcttctctgataggtgcaaattcctttgggtttttcctaaaaatccaggcaaaagacagacaagagggaaatacaaaaattcatcattcctaacaaggtttctctcatcgctggacatagtagtcaattcaaccagttcatttccgttaagcactatttcccaacctttccagatatttcattcctgcctctgaaatgtgaagatgaaatagtaggtagataaaaggccggacataagcagactcttaacagtaggtttaacagtctctttctctttgggttctgggattgtgggtaatattctaaattgtttccaatgagaatataccacctctataatcagaaaatgaggctatgaatatggtttatgaactgtgaaactacacaaatgttacatttttatttttgctgctattgaccattttagagttctcattttaacatagctcttttatcctggcaacactgctgaagtttgtctgtagaaagagaccctggctggcataatttatacatccaagtctgcttattccaaaagtctattattctgcacgggaaatggttcttttccatttatggaagaagttttgtttctttttgttttggttgattttgttatgtaaggagagttatcaacaaaaacaaggagaagccaaagtgaataagcaaaagtgtggtcagtaaatgttcaagaagcccaagagaaatctgacatttcctactcaacatgtcctgtccctttcttttctcagaaatgttctgaaatcctctacaaagacattaccactagagctcccttggtttaaaatatcccaagacttctcacaattcttccttaagtcaagtaagttcctatgttaacagattcattttcagcagaggtagaagaagagcaaaaggcatctttctttcctgaattacaatatatcctgaggcaaggaaatccaaaatgatattttacactatcagaaatatataaagctattgctgtattataaatgaatagaatcattgttctaatcggagttgattcttttaatcttgggaggatttaatatctctaaatcctttcgaaagagtaattcttgaatgtaagaagtaaccaattcatattttaagtgttatactgcccccttgtgtatcttgtgtttagtgaaaagggagctcagacaatacagtaattgtaattctcagaaatacttcagtggaatctgagtttagaactagaaacagcctcaaaaatcattgagaccagcatgctcatttcacagaaaagagaactgagttcctgaaagattacgtaacttgtccaagaccgtacactgctagtcaacaacagagcaaatactgttatatagaacttaagcctcagaatgttaattttttttttaattaaaacggagatggcagcctgaaagaagaaaaaacagtgaggtgttggaattaggcagatcaggatttgaattttaggtcaccattttacaatctccacaagctttagttaccccattcataaaatgggttgaataatagctatagcaaagtccttgaaaggattccgtatgacaatgttaatggtcatcaagcccttagcataagtatctgcaatatagtaataaactaattggtaatacgactataaaaatacatagaaaaaattttaaatgattatagcctttgagatctctgaataaaggcattctaaaataatgaaaataataatgagtttaaggcacttaaatctaaattctttaaaaactggcacaaaataaagcttgaaaaaataaacctagttcttctaactcccgtgatttttctattatcatatttactattttttaatacgaataaatttgcaacagaacaatacataaatcaaacactgcatgagagataaagcaatgaacaggacccttggctgaggctagagaaaagcaacgcagaacctcagtgccacagggtcaagtcgccattcccacgcctcctctgctaagggcacttcaccactggaatgtcaagagaaccaacctggaaaggtggaggcagaaattttcatgctgacattgctaatacctaattagttacatcaacttgggcagttatttcatctctgtttctctttcttcatctgtaaaatgaaatcactctctactttacaagggcttttagtgaggttgtataatgaacgttgaaaaaacactataaacaccaaagtgcttaataaagtaaggttaaatttgttatcttaaacttagtttaaagcaataataaacattaagtctgtcatcaaattggggaagacttcagaacaatcttagaaaggtgaaagcagcttagattataggattctgttaaagagcactccactccccctgaaatctctctgttccctctacaattccacaggcctctgatagagattactccaaaaattctggcaccacataagtctttggcttttaaatcagtttcaccctggggtatcttgacagcaggattgacagagcttatccctgactgtataccacaaaacaaacagataccagcagggtaaaggcaatttgtcttagtttgccatgaaaatgactaatattgattactctctgattcacagctgcagtcctccaccctgatagtaacggtttagtgctgcaaactcttctgttctgttgttatatgggacataatatatagataagtctgaaagccctaaaggacagcaataaaagtgggtggacttctcttcaataagtgtctaaagcaggtggccacaagcaccctctaacatctcaatttggaaggccatgctatgctggtaataagcattgactggtgatccacaaatattaactgaacaattatatggccctcacccaaaataattacaaacatcagaaagggatattactggagttgacagtgtggtagaagaggaaaggcactggtaccaactaccctacgaaatagaaagagataacactattatagtcgttgaggtggggcccattccttacaagtggagatagtaagtgcaatgggacttcttgggtaattattcataaacaagttaactcaagctcttggttccatccaacaattataccatatttgcatctagagtgctagaataaaagtcctgtcagaaacaaaataaaagatccaactacataaatacaagagacagcttaccatgaaacacactgttgtccaccagaaaatgcctgcggtactgcacacagttccttttttcca

SEQ ID NO: 1377 - DNA, 239644 bp, Homo sapiens
gggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacggtgagccctgggactgcccactcggtcccgctgcagcccggactcccaggctcgcaggcgcccgcgaggggcaggggccggcaggctgcaatccttgcatcccagcttattaacttcctgactctctggaacctccttgcctcagggtctaactgtggttcacttcttgctctatttttgtgactgttcagccctcgagacgcagtcccccctcccccgcaactttgagatgggtgagagggcatactgccacctggaagagcctgagggtggaggggtggtgcccagggaacgcctcccttttctctgtcctccgtccttgctttctcaacccaggccttaggtgttgttccagcctggccaggactgggccactagcttaggtagaggcatttaaaagatatatatatatgtttatatatatatattttaaatgtatattatatatattatatataaaatatatatatgtatataaaatcaattcagttactcagtcccttggtttcttcttacatacagaaattgtgtgtatgtgtgtgtgtgtgtgtgtgtgtatatatccacacacatatatatatgtgtggatatatatacgcgcatatatatgcatatatatgtgcgcatatatatatatatgcatatatatatatgcacacatatatatgcatatatatatgcatatatgtatatatgtcccttggtttcttcttacctacagaattctgagtaattgaactgattttcccaaggtcacagaacaggtccttcctagagatgtgaaagaattcagactttctacttgagcttagtactgagcttgtcctgggctatgctgccacttagccaaggaggtgaaggggatgagaggaggaagccataggaagggcatgtagcaaactcctcatagtatgactgttgcatgatttttaccatttctgcaagtttcatgtaatgtctctcatcagaatatcagatccagtgtctctcttcagaatatcaggaaactgtagggaaacatgtattgcttccttgtctaataacttctcatgtgcatgctagagctgacatttttggaagtgtgtcttgtggataagaatgaacagttattgagtgcttaccagggtcaggtgctgtgtgtatgtttcatcatctcatttaagggttaggacaaccttaaaaggttagtaaagtttttattcccattttgcagttaggttaatggagtcttgagacagtttgaccaagattacacaggtaagttagtggtagctccaaagctccagctttggaatctaattgatcagattccagagcttccattctaaacaatgtactaagatgcgtgtagatataatttacttggagggcgtcccagtattgtgaaacagtaggtaccataaaggttaatagtaggtgtttttttttttttttccaccaccaagatgagccctcaattctgtcttcaaagcaaattctgtcttcaaagcaaagaaattttggtctaatacttgagaaatagtccaactttccatagttgtaaacttactaaaatctaagtaaaatgatatcatgttatcatgatatatatcatgatatatataaacttgttcttattttaaaaataatacaaacatattaacagataatttggataatggataaaaagtaaaaaaaaaaaaaaaaaatctgccgggcgcagtggctcacgtctgtaatcccagcactttgggaggcggaggcaggcggatcaccaggtcaagagatcgagaccatcctggccaacatggtgaaacccggtctctaccaaaaatacaaaaattagctgggcgtggcagcgcatgcctgtagtcccagctactcgggaggctgagggaggagaatcgcttgaacctgggaggcagaggttgcagtgagctgatatcgtgccactgcactccagcctggtgacagagcaagactctgtctcaaaaaaaccccaaaaaaccaaaaaacaaaaatcaccacccactgcagtaaatattgctaacattttgggtgtatccttacaggtatttccttttagtttcgtattttccatacttttagttttaatacaaatacaacttatttagtcggaagaattatcctacaattcactggagtttttataaccttcttgagaatttagaagaactgttccatggagtagagatgctacaagtcttttacaagttaaattcttgaccccggaatcagattgtcctaagtttgatcttgccttggctgtctataactttggagttactacttatcctctgtaagcctcagtttctttatatgtaaggggttaataataatacctacttcagaaggttgttgtgagggctacataaaacaatgtctataatatacttaacactgtttgacaactgagaatcaagcattcagtcaataagtggaacctttaaataattaccattatgtttttgttgttaaaattttgcaattttgtaaataatgcagatacaagcatttcatgcatatgggttttatgtatctgagattatttctttaggatagagtcctgaatactttaatggattttaagtgcatagttcaaatttatacccatttataccccataatatgtataatagtgtgagtattggatattaatgctaaaattaggtgtgttcatgtacactcttggatattttgtgctaactgtactttgttttaatttttgtttcatttctgttgaggaatattttcccatgtttttgttaaattgatttatttttacttaagaattgaatattagatgtatttacatatttttaaaagtatactcagtatttttcctatcaatactatctacgattattgcatagctgctcttttccaggtgttgtgttagacatcagtttataatcctcacagtaaccttgtgaactagacaatattatgctcattttaaagatgagaaaattgaggctcagaaatgttagtacttacccaagtctggtaagtagcagagccagagtttgaatcctgatgtgtcttactccaaagcctcccacactacttatatactaagattttgtctgttaaaaaatattgaagaacatactaactttctgcttttcacatgtcctgcaaatacttttcactcttttattttggttgttttgacatataaaaggtactgcttaaaaggaggtagtcagattagactctgagttggtgacacttatgctgctttatgctggcatgtttgctccctttattacactgtgttgttctctgagaacagttcatcctggcttctccatgcccctgattcttgggcattgtatggatgtgagtttgtttattcagtcattctctgcatttttattttctcctggatgccatactctctgctagctgctaaggatgtgatcatggacctgtcggagggtaatctgaaccttcgttttggacacttggtatcccctatctgccaggaaattcaaactttttgtagttttttcatccaggatttggctatacacaaggaggtcatccatatactggagtatactcccatttcttaattaattgcagacccctcagattcctctctaaggcccaggcaaagcaatgggggctatcctgaaaaccctgagggagaactgtccaagtgtattattgtttttctctggcattaggattttcccattcaaaggcaaaaaggtattgggattctggggccagaggaatggaaaatgaagcatcttctaggtctaggactgagaaccatttagcatcccttggcacctgagccaggagggtatatggatctgccaccaatgggtggacctaccagtgggtcttaagagcccaggggtaagtaataccttagctgtggatgcttggcctttccttgcttccagcttaattgggtattgtttttgattgggaaaataaatagctaggggtctttaagctgtattttggctggcactgctgttttagccttccttggttttccagtataccatgccagtgtgttaacctgtttattaatgtggtctgggacagtgtctgtatttttgactattagcaatttcaccagatgatgcttaaattgtagtagtgcccctattttaaccataatatctctttttaacagggggcctgggcagcttgatactactagaaattactgttggaagatttgtttctcaatttgacaaatcaaaggaggaataaaggatcttacttgtggctttccttccattcccataatggtcgtggactgggaggaaagttttcctacataagtagtaaggaaagaaactgaatttgtattgaaaagaaactgaatttgggtgcccatgacgtccagagttacctgggggctcctcagtagtaattacgatgttcctgaacaggggcagtgaggaagaccctgggtcgcttcagtcttcatctaatttctcttttgcactgctagagttttgccttattgaaccccttggtgggagcagggccagtcaatcttccagtgccaggggttgtaactgatgctctcgcatttttggcaggggactggcaggggcttaatatagtcctttatccaattctcgtttttcttgcatttgaagcaagagtctttgttgtgcagattatcagaggcaagccaaatcaaccaaattccaagtggctggtgtgctccatcaattcctgcaggcctgaaataggtagcctaggaattccaaataaatagaacacatgatgacttgttggaaattcgcaggaaacaaaataactattctcagaaccaaataaaagccttccactagaaactaaaaaatgtctatggttttatatatatgcatacacaagtaaaacccaaaggagaacaaatagcaaacaaatgaaaattagaagcaaaaacaaatagacaggaaaccatctctaaatttttcctacttagtctacccggggggctacagtgttacccagagccccccagaaaaccacataatgaatattttattcctgatacacaactcaatatccttaattccaccagtatcaccatacatactgtgcaatgaagaaattcactctaggcacatgaccagtaagtactccagtgccagcttgtttagtaaagttatacttaagtcatgtgaacttgaaaattgcttagacttatttacttaatttatgagcgctcctttaattataagccaatctgatagacacaacatataacagtaagtgtacatacaaataaacacatctagacatgtatacacaaacacaaatgaagatccaatagctttttaccttggaactctagccatgagatagcaatataagtccactggttttactgtttgacccaatgggtaatccagtgaaggctgtgaaccaaaatttcaggtcaagcagtttccatggtagtttgatttttaaaggccaaacctccccagactccaaacactggggccaaacagcaccaaaggagaacaccacatgctaaccaggccaaccctacttagaacagcagcacaaaagcctggatacatgcacctccatcccaccttcccattcaacagcaaactccagaattccaagcaatactgggccaaacagtattgcaaaagaatatcaagtttactgaatccttatttcccattactatatcaaacacacacaaacaatgactgcagcacagtccaactgctgcagcaacaaacaagccccaagagtgtccagactgtcccattgtcacctgtgagagaaaattccaaggaggcctttgtgctagacctcagaacctctgccgagggcgtcccctttggagaggttcaggtctggagttggattccccggggtgttcccctttgggatccaatcttagagtgtcagacgtctctgaccttagttaggcatgggtgctgctttgtatgttttccctccagaggtgatggcgtactatgaaatttgttttgtccctggatgaaagcctcaacttctagcatacttatgatttgataagaccatgctttcccttgcttcccgttccactagagtgttagccatgaactttaatgataggaaccggaggtgggtgcatttcttttgtccttagcaagtcagatagaataggagaaaggtcaaaactcctaagagacatcattgtttgccattactggttaacctataggataatttggcataagaaccctgtaggagaatttaacataagaaaacaaagtttaagtcacctgaaacgtgtgaattcaccctggatgagctgccatggccaactgcaacacacgtaaggatcatggactatagctggaaaagatagaaaagagtcctctccttccccctcctggtatgggcagctatcccccttggccttcaggtaacactggaaagtggccctggccagttgcccacaattatcagggagctactaggaaatggccactgaaagactgaaaaagaaaaaaaggaaaggactcaggcctctcacccaaactgggcggtggtggtcaggtgcttccacatagaaaactcttggtttcactggagtgtggccccggccagaaacctgcagttgcctctgtgcttaggcattgtgcgctgaagggcccaagttggaaagggaaaagagaaaaaagcattcccctgtatggagcagagaggaaaacgagaagaaaaataaatctccaattttgggcttacctcctggctggctttccaaaatacgttactggtggaggatgtccaggttcttggcattttgaacaaagaattggacaaaaggcacaaagaaaacaaggaaaaaatgaagcaacaaaagccgagatttattgaaaatgaaaaatgcactccacagggtgggagccggctggagcaagtggctgaagattgcaggttacagaattgtctggggttggtcactttccgcaaccaatcagaagctgaagttacaaatttacaccctatgcaaatgtctaattggtcatagaaagcaaccattcagaggctgaagtgaagttacaaagttatactcctatgcaaatgaagacttggcccatgactagcctgattggttgtgggaggggatcaatcaaaggtacttcgaattttttcatctgccacgcagaaaaggggcaggagggttgcaaagggagtggcttctggtccttttgttacttgggcatgggaagttggggttggggttttccttttgatttagttctaggaagtcagcatgagttggccttaggttccctgcctccagaccctattctgcctcaaaggaaagaaatggcaagctctggaatagaatatagtagtgctagattttttttttttttttaattaaatacagggtctcactctcttgtctaggctggagtgcagtggctcaatcatggctcactgcagtctctacttcccaggctcaggtgatcctcatactcagcctccagggtagctgggactacaggcatgcaccaccatgcctggctaattttttgtagtttttgtagagacagggtttcaccatgttgcccaggctggttttgaactcctgggctcaagcagtcctcttgctttggcctcccgaagtgctgggataaaaggcatgagccaccacgcctggctagtgatgctagatttaagctatattttggaagtaggatttgataggttggatgtgaaggatgaaaaaaaggaagacattgtgaagatacctcactggtttgtggcacgggaacctgggtggagggtagtgccgtttgctaagatggaaaagattagttttgggagccgacacaagaattcagtttgtgcttgttgaaaagctcaagaaactcaagtggagaactgatgactgttggatataaaagtcaggagttcagaggagaggcctggctgggttggagataaccatttgggagtcaccaacatataaagggggttttaaaaccacttagagattgagtagaggaactagcttaaaggaagggaagcaccattgtttcttgacagaagttaccaggtgccctgagatggggcaacccagggactctagacccagtctcttcaactttacagttttgttcctgtcacttttgttgtctttagttgacccttcctcatcctctgccaataccatttacttcctttcttatcatggatatgtgatacacactggtaccttacaaaggcaattgcctttatggatctttcatttcattttttttaagagaaggggtcttgctatgttgcccaggctgaagtgcagtggctattcacagccacaatcatcatgtagtacaaccctgaactctcctgggctcaagtgatcctcctgcctcagcctcttgagtagttgggactatcgtcacgtactactgtgcctggcccatttacattttaatacaaaatgttctgtccctgacatttgggttctccctcagtcttattttatgaagtagatgctggctaactcttagtagagtttagaataagatagaggtacatacctggtcaatagaaagggattcctggagaatagggtatctggatggagggtagaggttttgttggggaaaacaggtagtttcttagtatcctgttatttcatgatgtgaattagtgccagattgtttcattgacatcattcatcatacttcaccaggcatatactgattgtcacttgtgtgttacgcactgcgataaatgctggggtttctttttttttttttgagacagagtctcgctctgtcacccaggctggagtgcagtggcgcgatcttggcccactgcaggctctgcctcccagattctcaccattctcctgcctcagcctcccaagtagctggaactacaggcgcctgccaccacgcctggctaattttttgtatttttagtagagacggagttttaccgtgttagcaaggatggtctcaatctcctgacctcatgatccacccccctcggcctcccaatgctggagtttctaaggaatatgaggatgtgctgtaacacacaggtctatatcaataactaggcagtacagaggaaagccagtgccgaacgtattggcacaaccttcactttctgcaagtagtccctaattttctgtatcatagctgtatatttttatgtgtttgggtctaagctataaatccactcactgaccgtgtgctctgctcttggccttatttatttctggagattgctgacatttgcccttttcctcagatgctctatccctgtgggaggcttctctttccctttaacactgctgcatactgcatagttattaaagacctaccccatcagactgttgatgcaataacacctctcatttgcccccctcctgcagtttgtctttgaatgtgacattggtaggtcttttttcttagacatttctttctctttaagttgttggttaatatttttcttttagtttccttaaacgtttattgaaatagtgtttgcatgtgttcattcattcattcaacaaatatttatttagcacctattacatgtcaggccctgttgtgagcactgaagacacagctctgatcaaaagcatttaaggataccagtcctcttggagcttatgttccattatggtctttacattctgcctatatgtcacctcattttttcagcagtgctgatgacctgcatattcatgattctttacttagtacaatttcaattaaacaactcaatgccagccacagagccctgttttaacaataggcaaccattaacttgcatccttgatatagaagaaagtgtgctgctgtattttgttgttgtttgttttgctatacctttttatcttgaaaaagaattaccagtctggttttaaaatgtagcagtcatttattagtactgtgtgattgcataattaggtaactgtgcttaataaatttttagtgatgtatatagattattttttaacagtcttaccagcagtacagctttggttagcacatgctataagtaggtttatcttactatggcagacataagcatagtctatgaatagtctttgatgtaacctctaggagaataaataactctaaggaaaatatatattaaaaaaaattacctgtgaataacttgtgatttcttcttgccttgtccacaaatcatgctgtaactttaaaaaagaaatgaaaagtaaatgctgctccattaaaatttgtaatttaaaacttagaaaagtatctggtagaatagcaattaatccaaaaccctaaaattttgaatctgtttgaaaaactattcaggagtgaaagtttaggtattcacatggaaataattacctttaaatacccttactggtaaattattttatacaagacgaatagattctttgtggttatcagacaataattgaaatgtttactttgtatgatttttattattaaagtctttgcttcctccctactaataacttgctgagcatcagtgcaataagatatcatgtcattcagtattaatctgaatgttcagcagacttgaaataaatagcaacttagatatttagacattttgttgggaataggcccccaaatctggccataaactggccccaaaactggccataaagagaatctctgcagcactgtgacatgttcttgatgaccatgacacccacgctgcaaagttgtgggtttacggggatgagggcaaggaacacctggcccacccagggcggaaaaccgcttaaaggcattcttaaaccacaaacaatagcatgagcgatctgtgccttaaggacatgctcctgctgcagatagctagcccagcccatccctttgtttcctgtaaggaatacttttagttaatctataatctatagaaacaatgcttatcactggcttgctgtcaataaatatgtgggtaaatctctgttcgaggctctcagctctgaaggctgtgagacccctgatttcccactccacaactctatatttctgtgtgtgtgtgtctttaattcctctaacaccgctgggttagtgtctccccaaccaagctggtgtcagtacatttttattctggctaggttcttagctatggaaatcctcatagacaagtcaagatcttactttatgaaatgtatgcaataggagagtcagtgggatgtcactgtgattgggaaaaatgtttacccaagactattatcttctgaagctgggcaccaatatatacttgaagaatatttataaaatcgagaaggatttaaggaaagtacaggcctacctcggacatattgtgggtttggctccagaccactacaataaaatgaatgttgcaatatagtgaatattacaataaagtgagtcacacaaatgtattggtttcccagtgcatattaacatgtttacattgtactgtagtctagtaagtgtgcaatagcattatatctaaaagatcaatgtacatactttaattaagaaatactttatcgataaaaattgccaacaatcatctgaaactttggcaagtcataatctttttgctggtggagggtcttgccttgatgttgatagctactgactgatcagggtagtggttgctgaaggttgtggtggctgtggcaacttcattaaaaaaaaaaaagacaacaatgaagtttgctgcattgatagaatcttcctttcatgacagatttctctgtagcatgagatgccgtttgatagcattttaccacagtagaacttttttcagaattgaaatcaattctcccaaaccctgccacttctttatcagctaagtttgtgtaatattgtaagtcctttgttgtcatttcacagtgttcatggcatcttcattagcaatggatttcatctcaaggatccacttttttttttgaattcatagaaagtaatagattccatctcaaggctccactttctttgagttcttcaggttgcatacgtaaagagcaactcctcatccattgaagttttatcatgagattgtagcaattcagtcacatcttcaggctgcacttctagttctcttgctatttctaccacgtctgcagttatgttcttctctgaagttttgaatccctcaaagtcatccatgaggctgggcatggtggctcacgcgtgtagtcctaccactttgggaggccaaggctggcggatcatctgagctaaggagtttgagaccagcctgggcagcatgtgagacctgggctctactaaaaatacaaaaaaattagcaggcatgctagcgcatgcctgtaatccctggggtggctgtggtgtgagaattggttgatcctgggaggtggaggttgcaaaaaaaataaaatgaacgaatgaatgaatgaataaatgaagtcatccatgagggttgaaatcaatttatttcaaactcctataaatgttgacttcttttttactgttttttgagacagagtctcactctgtcacgcaggctggagtgcagtggcataatcttggctggctgcaacctctacctcctgggttcaagtgattcttgtgccttagcctcctgagtagctgggattacaggtgtgcaccaccatactgggctaattttttgtatttttggtagaggatggggtttcgccatgttagccaggctggtctcgaactcctggcctcaagtgatccgcaccccccttggcctcacaaagtgctgggatttcaagtgtgagccatcacgcctggccaatgttgacattttgaaatttcatgaaccatgaacattctaaatggcatctagaatagtccttcccagaagattttcaatttactttgcccagatccatcagagtaatcatttatggcagatatagctttacaaaatgtatttcttaaataataagacttgaaagtagaaattattccttgatctgtgaggcacagaattgatgtattagcaggcatgaaaacaatgttaatcttttttttcctattttttttttcattatactttaagttctagggtacatgtacacaacgtgcaggtttgatacataggtatgtgccatgttgttttgctgcacccatcgactcatcatttacattaggtatttcttctaatgctatccctcccccagcttcccaatccccgacaggccctggtgtgtgatgttccccgccctgtgtccaagtgatctcattgttcatttcccacttatgagtgagaacatgtggtgtttggttttctgtccttgtgatagtttgctgagaatgatggtttccagcttcatccatgtccctgcaaaggacatgaactcatcattttgtatggctgcatagtattccatggtgtatatgtgccacattttcttaatctagtctatcattgatagacatttgggttggttccaagtctttgctattgtgaatagtgccacaataaacatacatgtgcatgtgtctttatagtagcatgatttataatcctttggatatatacccagtaatgggattgttgggtcaaatggtaattctagttctagatccttgaggaatctccacactgttttccacaatggttgaaccaatttacactcccaccaagagtgtaaaagtgttcctatttctccacatcctctccagcatctgttgtttcttgactttttaatgattgccattctaaatggtgtgagatggtatctcattgtgattttgatttgcatttctctgatgaccggtgatgataagcattttctcatgtgtctgttggctgcatagatgtcttgttttgagcagtatctgttcatattctttgcccactttttgatgggtttgtttgtctttttcttgtaaatttgtttgagttctttgtagattctggatattagccctttgtcagatgggtagattgcgaaaattttctcccattctgtaggttgcccgttcactctgatgatagtttattttgccgtgcagaagctctttagtttaattagatcccctttgtctattttgtcttttgttgccattgcttttgatgttttagtcatgaagtccttgcctatacctatgtcctgaatggtattgcctaggttttcttctagggattttatggttttaggtctaacatttaagtctttaatccatcttgagttaatttttgtataaggtgtaaggaagggatccagtttcagctttctacatatggctagccagttttcccagcaccatttattaaatagggaatcctttccccatttcttatttttgtcaggtttattaaagatcagatggttgtagatttgtggcattatttttgaggcctctgttctgttccattgatctatatctctgttttggtaccagtaccatgctgttttggttactgtagccttgtagtatagtttgaagtcaggtagtgtgatacctttagctttgttctttttgtttaggattatcttggctatgtgtgctcttttttggttccatatgaactttaaagtagttttttccaattctgtgaagaaagtcattggtagcttgatggggatggcactgaatctataagttactttggacagtatggccattttcacaaacagattcttcttatccatgagcatggaatattcttccatttgtttgtgtcctcttttattttgttgagcagtggtttgtagttctccttgaagaggtccttcacattccttgtaaattggattcctaggtattttattttgtttgtagcaattgtgaatgggagttcactcatgatttggctctctgttaatggtgtataggaatgcttgtgatttttgcacattgattttgtatcttgaaactttgcagaatttgcttatcagcttaaggagattttgggctgagacgatggggttttctaaatatacaataatctcatctgcaaacagggacaattttacttcctcttttcctaattgaaaaccctttatttgtttctcttgcctgattgcggctagaacttccaacactatgttgaataggagtggtgagagagggcatccttgtctcgtgccagttttcaaagggaatgcttccagtttttgccaatttagtatgatatcggctgtgggtttgtcataaatagctcttattattttgagatatgttccatcaatacctagtttattgagagtttttagcatgaagggctgttgaattttgtcgaaggccttttctgcatctattgagataatcatgtggtttttgtcattggttctgtttatgtgatggattacgtttattgatttgcatatgttgaaccagccttgcatcccagggatgaagttgacttgatcgtggtggataagattttttatgtgctgctggatttggtttgccagtattttactgagaatttttgcattgatgttcatcagggatattagtctaaaattctcttcttttgttgtgtctgtcaggctttggtatcaggatgatgttagcctcataaaatgagttagggaggattccttctttttctattgattggaatagttccagaaggtgtcgggggaacccacccccaatattttaacgtaggttctttctgttttccataagtgtcatctggctgagaaataaagagaaagagtacaaagtgaggaattttacagctgggccgccgggggtgacatcccatattggtaggaccatgatgcccacctgaggctcaaaccaacaagttttttattaagggtttcaaaattggagggggtttaaaacagggagtaggtacaaagatcacatgcttcaaagggcaaaaagcagagcaaagatcacatgcttctgacctaacaggacaaaaggcaaaacagaactactgataagggtctatcttcagctttgcacatattgtcttgataaacatcttaaacaacagaaaacagggtttgagagcagagaaccagtctgaccacaaatttaccagcttggagtttttccccaccctaataagcctgagggtactgcaggagaccagggcgtatctcagtccttatctcaaccacataagacagacgctcccagagcggatgtttataggccttccccccctcccccccggcccccccaggaatgcattcctttccctgggtattaatattaatattccttgctaggaaaagaatttagcaatatctctcctacttgcatgtccgtttataggctctctgcaagaagaaaaatatggctctttttgcctgaccccacaggcagtcagaccttatggttgtcttcccttgttccctaaaaattgctgttattctgttgtttttcaaggtgcactgatttcatattgttcaaacacacatgttttacaatcaatttgtacagttaacacaattatcacagtggtcctgaggtgatgtacatcctcagcttacgaagataacagaattaagagattaaagtaaaacaggtgtaagaaattataaaagtattatttgggaactgttaaatgtccatgaaattttcacgatttatgttcctctgtcatggctccagccagtccctccatttgggatccctgacttcctgcaagaagaaggaatggtaccagcaactctttgtatctctggtagaattcagctgtgaatccatctggtcctggactttttttggttggtaggctattaattattgcctcaatttcagagcctgttattgttctattcagagattcaacttcttcctggtttagtcttgggagggtgtatgtgtccaggaatttatccatttcttctagattttctagtttatttgcatagaggtgtttatagtattctctgatggtagtttgtatttctgtgggattggtggtgatatctcctttatcattttttattgcatctatttgattcttctctgttttcttctttattaatctttctagtggtctatcaattttgttgatcttttcaaaaaaccagctcctggattcattgatttttttgaacggtttttttgtctctatctctttcagttctgctctgatcttagttatttcttgccttctgctagcttttgaatttatttgctcttgcttctctagttcttttaattgtgatgttagggtgtcaattttagatctttcctgttttctcttgtgggcatttagagctataaatttccctctccacactgctttaaatgtgtcccagagattctggtacgttgtgtctttgctctcattgatttcaaagaacttctttatttctgccttcttttccttatttacccagtagtcattcaggagcaggttgttcagtttccatgtagttgtgcggttttgagtgagtttcttaatcctgagttctaatttgattgcactgcggtttgagagacagtttgttgttatttctgttcttttacatttgctgaaaagtgctttacttccagttatgtggtcaattttagaataagtgtgatgtagtgctgagaagaatgtgtattctgttgatttggggtggagagttctgtagatgtctattaggtccacttggtgcagagctgagttcaggtcctggatatccttgttaaccttgtttctcgttgttctgtctaatattgacattggagtgttaaagtctcccaatattattgtatgggagtctctttgtaggtctctaaggacttgctttatgaatctgggtgctcctgtattgggtgcatatatttaggatagttagctcttctttttgaattgatccctttaccattatgtaatggccttctttgtctcttttgatctgtggaaaacaacgttaatcttatacatctccgtcagagcgcttgggtgaccaaggcgcattgtcaatgagcagtaatattttgaaaggaatctttttttttcctgagcagtaggtttcaacagtgggcttaaaatattcaggaaaccctgatataaatagatgtgctatcattcagggtttgttgtttcattgaaagagaacaggcagagtggatttagcataattctcaagggtgctaggactttcagaatggtgaatgaacattggcttcaacttcaaatcaccagctacattagccccttacaaaagagtccacctgtcctttgaagccaggcattgacttctctttagctatgaaaatccaagatagcatcttccaatagaagctgttttgtctccattgaaaatcttttgtttagtatagccaccttcatcaatgatcttagtgagatcttctggataatttactgcagcttctccatcagcactttatgcttcactttgccgttttatgtactgagatggcttctcttcttaaacctcatgaaccaagctctgctatcttcagatttttcttcggcagcttcctcacctctgtcagctttcatagaattgaaaagagttaggaacttgccctggattaggctttgacttaagggaatgtcgtgtgtgatttggttttctattcagaccactaaaattttcttcatatcagcaataaggctattttgctttcttatcatttgtgtgcttactggaataacagtttacattttcttcaagaacttttcctttgcattcacaactaggctatttggtgcaagaagcctagctttcagactctctggactttcagcatgccttccgtacttagcttagtcatttctaacttacgatttaaagtgagagatatgcagctcctcctttcacttgaaaacttagagatcactgtaggtctaattttcatattattatgtctcagggaatagggaagcctgaagaaagggagagataaaggagaatgactggtcagtggatcagtgagaacacatacaacatttattgaggttactaatgtaattgtcttggggtgccatggcagaatgtcagaaggctgtggcaccccaagacactataacctcaaagatcattgatcagagatcatgataacagatgtaatagtaatgaaaaagtttgaaatattgtgagaattatgaaaatgtgattctgatgctgatagacttgctagatacagggttgctacaaagtttccatttgtaaaaattgcaatatctgtagggcaaaataaagtgaagcacagtaagacaaagtatgcctgtatctattaagtgttatagccctagcctgaagaaaaataaatttttaagtaatcatggacatgtggtatgattgtatatcttttgccataagtgatataaaataatatttgagtaaattcgtattatctccaccaaatataagagtagaaacaggctatgattgtgggcacagagggcagaggacgtatctgactggggattgccaagacctgaaccctgggcattcagtactgttgaaaggatcagagagacattagatgccagagtaggcagaacgtcagaagtctggagtatcggtggataatggaaggaggaaagatgtcatatgtcagaacctgctgtggagcaatgccaggctagggaagaaaatgggtctccaggaaaaggacaagtgaccaatgtcccatggtcagacagttgaaggcaacagcagtagctgttgtgacccacactgggaattagatcttgactgttgggacacactaggctaatgaatagcatggaggttaggtgggcagtgatcagggtaagcaacaggtatcgaaatgatttgttatcagcatgctgtgggttaaggcgactaccagcgtgtagatcaggcactaggataaagagtgggcctttcgatcgggagatttaggctgaagccgttctgtgctctgaattgtaattttgcagaggagttgacttaaagttttgggatgactgtgggcattgggcagcacctgagcttgaatcgaagctctaatgtcatgatgtttctgaattctaacatttagaactttatcaaatgaagctttcctataccattcagaagagtactaaggtgaagatagaaggacatggacagagtccagaacctaacaatgaatagctaatatttattcagcactcactgtgtcaggtactgttctgagtgtattacatgtactgcttcatttattcctcctaaaaaatccatttagggaatggacactggctcacagatattctatttaagtaataagacaataagaaggactaaatatgatgtggttaggcataagattatggtatgttccaaactccagcagttccgggtaccaaagtttatctttacccttccttattgttttatggtccatgaccatttgctgttgacgtatttagcacatgccactggtcatgcacattccttatggcttaggttcctaacacctgtctgtgcttcttcccagaccactcactttgacgggtctccctttctgactttccataggtcttattgtctacacgcatttagtcacttggttatattccttcttcctgttttatacttttacaaaaaattgtttaatatgggtaaattttgccccattaacaagcttctccaggtctgtattgcttttgtatcttatagtattattgtaaataattcagcaatttgcataatatctttctttgtaccttgattttagtcaagttgtaattaactgttaagaaactggttgtttttatgtattttacaacacacgaaatgattttttttttgattttcacagggcaaactcagaaaatgaatcttttccagtctgtaacaagtgccttggataactcattggccaaagatcctactgcaggtaaccctgatatgtgcctgaattgtggtagctgtgttaattccagaattgaagatttgcttaaaatatttatgtggagctcaatggttaacattgtatctacctgacattttcaaaggtatgattggggctaaataatcaaattgcaatattagtccacttattaccagttagttctcatgtatatttaacatcaagtcagctttctcttacagtgtgtgtggtcctgatattgtattaataacttctggattaaaacctgctgtgtactcctgtttctttggcacatagaagaaaacaaaataccttttcattcagctatttatttataaaatgaagacttgattttatgcttccctttggaatacattgtcattcaacttgtaatatgttttggaaataattgtaatatttatatataattttataagtatcttaatcttcatcttattaaatcattgatacaaaaccaattgttcttccactgtatgttttcaaatttgattggctttacttcatatatgtatatacatatatatttaacatatatctatatatacagtttatatatgtgtgtgtgtgcatatatgttgactatacattgggcttccaccttccacctgataatctgtagttttaaggttaaatgaaaaacaggttattttttagggagaagtgggagctggactaaaggatgattagatcttgatttgttttgaatgctacttgcggatgattgaactagagaagtaaattcaaacatagagaagggtgagttttttcttggggtcgataaaaactggttaggtacgtttatgagactagcattcagctctatgaataccccttattttaaagctcctgccaatttccacctacaccattctttgccttgcttactgtgtccttcgtgcttgcctcctttctgcttcacacagtctaaatccctttcctatttgtgactgttcccttagcttggaatgctcttctgatggcttacttactgtatgctgtgtctcaggaaaaaccacaggcctggaagtctggagcatgagtcatagttctgcctctagctttctgacttggccagtcaatttaccacttctctggtctcgttttcttcatggataaaacaaatgagattctagatcagtggttctttctcaactggggatgatcttagtctccactcccacaactctgtttacatttaacaatgtaagtgaagacactttttgttgtctcaactgtgtgtgtgtgtgtgtgtgtgtgtgtgtgtgtgtggtaactgtcatccagtgggtagagaccagggttgctgctatgtatctacagtgcacaggacagaccctcacaacaaaagaatcatctagtctaaaatgtcaataatgtagaagttgagaaaccttgatcgagatctatggtccatttatcttttgtgatttaaaatgtaaacatttaaattacttatttctcattgttagtattatttagagattattaaataaaatgtattatttaaatactgtttttcagtaatatttggtgaagatgttgcctttggtggagtctttagatgcactgttggcttgcgagacaaatatggtaagtaaatacctatatgaatagtattctgatagaacttttactaaaagatcttaaaaatacaaaatatgcctactaaattttttgtcatatccccattgtatggatgaattccttttcatttccaacgccacccgcagaatcctttggcctatattttctcaaatgtcttctagtatccctctgatctagttcatattacacatacagtgtaaatgattccaaaataattgtcattaaatgtatattatttattgtgtcattcttctgtccaagaacctttggtgttttattgctagctgcctgagccaatttcaattccattgcctccagttggagattctgcctgttgggtctttattagcaaactttatcttttcgggaagagagagagagagagagggagagggatttagtttttaaggaactggctcatgtgagtttagttttaaggaactggctggcaagtccatagggcaaactggttgacttgaaactcaggcagggtttctgttttagccttgaggctgaatttctttttgctcgggaacctgcagtcttttctcttaaggccttaaattgattgtatgaagcctacccacattataaaaggtaatctgctttattcaaaatctactgatttaaacgctaatcacatctaaaaaataccttcacaacaacttctacacctgtgtttgaccaaatattaataattgggtgccatagcctggtcaagttgacatataatgaaccatcacattatccttcttacatgttttatcccagctgatgtctttaattggcatgtgattgatttctgcccattgcttttattaatttcatttgactcagttaaaataatcagaatgcattttggtccatctttgaattcccactcttctgacttgcagtgtaaggaatgtgttttgacctcctattgttagggatacctttgaaatgcttttgacattttattttttgtcttagtcttacctgatttagaattcagcaaagcagttcacgtgagggctggcaggagctgatatctccctctcttctttcctttggcattgctctatattgcttgtgtattcatacggggcaagaggagtgagggtctttaaaatttttttttaaattgttgtctctttttctgttccactctttctgaggttatgttatacttaaatccaagaacccatacatgttccatctcacttattgggaacttccagcttagtcttttcttttccatttatagcaggttgagtttctggatccagtccgtctgctttctcctacttctaatacctgcttagagcttgaggtagttgggcaaaagattatttttcctgatcatttagactcctgctacaaacttttagatctttaataaacagttaaaaatctttacacatttgatttcaaaagtaatgcatatacattgtagaaaatttggaaaatatagaaaagcataaagaaaataaaaattgctcatgttttcagagataacttggagataaccactgtacacgtcttggtatatatacttctagactgtatttgaatatgtttgtatatattaactaatatttcaaacacagaattatacttctgtaactgagtcttctctgtatccagtataactatgctgtggagcagtgtctagacctcacaattccatcttgcctgactcagtgtagtagcatgccatgtgctttctgaatagctaatatttattcaactcactgcgtcaggtactgttctgagtgtattacatgtactgcttcatttattcctcccaaaaaatctaggggtttgtgtaggctgttgagtcctctgctgcctgtctgcccaggttctcatccataacactctgcttaccccttctgtctggggcattttatcgatgccatctgctgctcatacactggtgactcctgaatttctgtctctagttcagacttccgttctgagcttcagatctgtgtattcagtttctactgcacatcttcacctcagtgttccacagtcacttcaaactcagcatttccacacctaaggctgctacatgcacccagcaaatatatgcctcctagtgcatttcctattttggtgaatatatcaccatccatttagttacctaagccagacactggggaaattctaagtgtcttccttctttctagttccccacatccagtgaagttgtataattatatctaatctggcccctcctttccattcttactgccctgatacttaagatctttcatttttctctgcctgcagagttttatttcttttcttagcagtcaccactcctttagtcttaccctccctccaatccattccctatcttgttgccagtgtgatgattttaacatgcatatttcttagcaggacatacaaaatacttttttttttttttgagatggagtctcgctctatcgcccaggctggagtgcagtggtgcgatcttggctcactgcagcctctgcttcctgggttcaagtgattctcctgcctcagcctcctgagtagctgggactacagccgcataccaccatgccctgctaatttttgtatttttagtagagatggaatttcactgtgttggtcaggctggtctcaaactcctgaccttgtgatccacctgcctcggcctccctaagtgctgggattacaggcatgagccactgcgcctggctaccaaagactttgagaactacttaggtagctacctgacctcatctgcttttatttttattttatttattttatctattttttagtttttactctacagacctaggaacttgagctttttaaaatttttattaaaactaatgttgagttactggttgtttctcttaagccccctgttgttttttcttctctcttcctttgcacttgctatctgggtctctctaccctgtctgattacctggtagactcctatttcttcttcagaagattcccctgtgaaactcttccggaccctccaagcagactcaggcagttctttatcactattcacgctgcaccttttaaatcttgaaagttgtactgtaatccataactcccaccagaaagttgtcaaaggcagcagatctttaagctgttccacagaatggatccctaggacctaatattgtatcaggcagtatttatgaagtgcgtgctgttgagtgaatttaccctttgctctcacttagacagtgtcctactgtctcaggaaggggatttccctctctcacattaattatttaggttggtctgattttattttccttaaaaaataggttaaaatggggagaaactaactcttaacttgaaaaagtccagtgctcttagagggtacctgcaaatttatgtttcctgtcatggcaggaggctgagctaactaatggctaagtaactcttttagctttattgtcagcagctgctgtgaatttttacaatagttttagggcagtgaagttacactttattaatttcaggttgaggatgttgatcaagatgaaaaattaaatcgctgatactttctaatgagagtaagtgagcttctgttttcagaagtgaagaataaaggaaagggtgaagagaaatatattaaaatacatttttcttgcatatttaaaaagtaacatatacttaaaaaattatctgcccttttgaatatagggcaggaatttttagctatacagaagcataactgtctgcttaggatttttaaaggataatttgtatttaaaataactaaaagattatgttgatatagttcaatataacaatcaagtcacactgcattaaatgacatagcaaagaaaacccttgtgccagatcagttcgctttctggggagtgctgaatgttgagtgggaaaggatcaagtcagcaggtggcagcctaccctttgaaatgagaacatccctgttggcattgtgccagcacttgaactgctgcaaagcattttatattccatcagaaggcggaatttgaaggattgtgggttactgacatacgttgtaaagctgaatactacttgatatgacaaagaaggaattgcataattagaggcaatgctataagaaaaggaagagaggcatagagcattttgtattccagacgatccagatgagtgtggatttagtaccactaaactgcttctcttccttgtcctttgatagaacaaaatagtatgagtgctttgaaaattagaagaaagaaaatagtatgtcctcatcaacattgcattccaaatggcagctttaaccactgtacgtaatgagatgtattgattaggagcaacagctggacctctggggaagcagggagtgggagagggcagttaaaggtagttgatttgtagggtatgtgtgattttatgttgaatgccacacatgctttctttctttcttttttttttaagacagagtcttgctctgtcacccaggctggagtgcagtaatgcgatcacggctcactgtaacctctctctcccaggttcaagcaattctcctgcctcagcctcccaagtagctgggactacaggtgcccaccaccacacctggctaatttttgtatttttagtagagacggggtttcatcatgttggctaggctggtctcgaactcctgacctcaggtgatctgcctcccttggcctcccaaagtgctgggattacaggcgtgagccactgtgcctggtgtcacacatgctttcattcatataagtaatgagacagattcctcatggcatataaaaaatccattcgtattgtcattctctgagagagagagaaagagaaagagtgtatgtgtgtgtgtgtgttattaaaataagattttggtgtgtcaggtttaaggtatgtttgtaacattattctatactgatataacttgcctggttgtggttcttagtgtatatttggcccacttattggaggaaatttaggtgaggaaaggaatagctgaggacctcctgaattagtctacaggcctaaacatgtgccttttcatgggacttgatgtttttccattactgtatccattcctttacaccacaggtgtggcctgtcatagcagcttgggaaaactaatataaccacttacttgttttcttatgtaaacatcactgaaattgtataaccagatactttaatacactgaagtcaggttggaaaactaggacaggcatgcggtgaaggcaagtttttgtctataatatatcaatatttgggagttgactttgggcctcagtatcctcatcagtaaattgaagggaaaggactaggtggtcctctgggattcttccagagcatacatttaggtaagctttatggttttatttgtttttaaaaagaggaacacagttttttcatgctttgattccctttacatttagaggtttttttgaatatagttgttatagcattttggaaccatggggtaccttaggcatttaatttaattttttcttaagatgtcccttttccagcgttttgttttattttatttatttatttatttatttatttgagttggagtctcactctgtcacccaggctggagtgcagtggcgagatctcagctcactgcaacttccattccccaggttcaagtgattcttgtgcctcagcctctgagtagctgggataataggcatacaccactatgcctggctgatttttgtatttttagtagagatggggtttcatcatgttggccaggctggtctcgacctcctgacctcaagtgatccgccagccttggcctcccaaagtgctgggattataggtgtgagccaccacacttggctgcttttccagcataagttttaaatttaggggtgttagcaaaatctttgctctcttatatattttttgtgaattatgaaattaatgtctttaacagagaaagtgatcttccattatatgttcttgttgcaaagaacgggttatttgggtgatactcatactcttggatttagtgtcagggttccattgtagaatggcaatctgtgagatgggggtttggtttctgggttgttgaaactaattttatggaagaaaaaaacaggataaaattcaggaaaattccttagggaaattgaatatgtagaggatttatttcccctattgaagtatacatatttatgacatacaagcagattgaataccagatatagattgtgagatgtctaacaggaatttggagtgaaaacaggtattaataagttggtgtaaatctggtttcctaatatatttattaaaaatatttttaaaggattgttagtagctttaaattgctcttgatattacaaagttcttttgttttccaaaggtgcacatgttggcagaactagatgaacatgtttaatatgcctttttttccccacagtgcttttttcacaaacattaatttatttctaaaaattatggtcaaatatatataacatttactgttttaaccatttttacagttcagtgttattaagtacattcacgttgtggtgcaattattaccaccatccatcaccagaacttttttcatcttacaaaactgaaacactataaccatctaacaataactccccattttctctccaacagtccctggcaagaacccattctactttctatctctatgaatttgactgttccttatgtgagtggaatcatttagtatttgtccttttgtgactgccttattcatttataataatgtcctcaaggtttattgatgtttcagcatgtgtcaaagtttcctccctttttaaggctgcataatattgtgttgtatgcatatactacattttgtttatccattcatttgttgatggatgtttgggttgcttctgccttttgcctattgtgtcctaagactgctataaatactgatgtgcaaatatttggtagtgtcactgcttttttaattcagaagaacaaagttggaggactcacagttctttttttcaaaacttactgcaaagctgtagttatcaaaacggtgtgacagtggcaaaaagacaaacattgatgaatggaatagaatagagaacccagaaataaacccttgaatatctagtcattaatttttgacaatgatgccaataccattcaacaggggaaaggacagtcttttcaacaaatgatgctgggaaaactggatattcacatgcaaaagaatgaatttggacctttatttaacaccatatacaaaaatgaactcaaaatagatcacagacttaaatgtaaaactataaaactcttagaagaaaatgtaggggaaaagcttcgtgaaattggatttgataatgactttttaaatatggctctaaaggtataggcaacaataaaaatagataaattggactgcatcgaaattaaaaatatgtactttgaaggacactattaacagggaaaaaaggcagttcacagaatgggagaaaatacttgcaaatcatgtatcagataagagattaatatccagaatatatggagaacttctaaaactctacaaaaaaaaccccaatcaattaaaaaaataagcaaaggacttgcatagacatttctcccaaattgataatttatatataaattaccagtatataaattaccagtgaaaagatgctcaacatcatcaattattaggaaatgcaagtcagtatcccagtggaataccacttcgtactcattaggatggctgttatcaagaaaacaggaaataacaagtgttgctgaggatgaaattggaatcattgtgcattgttggtgggaatgtaaagcgacacagccacagtggaaaacagtacggtagttcctcaaaaaattagaatttccatatgatgcagcaatatgcctttctttttatctcatttaaaaaatccagctgaatgagttagcatagaaaatggaatggaaatattgatgcatgcttcatttactttagtttttcttatttattactttgatgaccttttgtgatttttccaaataaggattttagacactactaaaattagaatgggtacaaacggtcactgtattttactttctctaatttataacactgacctctcagaactttagttctatatgacgtggatatagactagataagaatttctcagcctgtcagcactatttatttatttctctatttatttgtttaagagtcagggtcttgctctatttcctatactggagtgtggtggtacaatcatacttcactgcagccttgaactcttgggctcaagcagtccttccgcctctcacagtattctcactgttggcttgttgaccagtggcttaacaaataccatttaagaaaataagatatttaatatattttgtaggatatcagagctggggagaaatggagggtatatctagtctagtggttttcaactgctggtgattttggcaatgtctagagatatttttggttgtcataccttggggggtaccactagaatctggtggatggagacctagaatgctgctaaacatgcacagggcagccccaccaaataactgtccgtaccaaaatgtcaatactgttgaagctggctgggcatgatggcttacagttgtaatcctagtgctttgggaggccaaggtgggaggattgcttgaggccaagagtttgagaccagcctgggcaacatagcaagatgaccccacccctacaaaaaattaaaaaaaaaaaatagctgagcagggtggcacacagctgtagtccacctgctttggaggctgaagcaggagagcccaggagtttgaggctgcagtgagctgtgatcataccactgcagtctagcctgggtgatagaaggagacccagactctaaaaaaaatagtgcagcaaggctgagagactctgatctatttccatgtaatgtggacactgaaattctgagaggtggagttgctcagtggcaagtggtctagggctcacgcttcctaaaacccagttctaggatttttgtactatatatttttccctcatttataaatgaacagctaatttatgtaaaaacataaaaataaggaattctttttttttattattattatactttaagttttagggtacatatgcacaatgtgcaggttagttacatatgtatacatgtgcaatgctggtacactgcacccactaactcgtcatctagcattaggtatatctcccaatgctattcctcccccgtcccccaaccccacaacagtccccagagtgtgatgttccccgtcctgtgtccatgtgttctcattgttcaattcccacctatgagtgagaatatgtggtgtttggttttttgttcttgcgatagtttactgagaatgatgatttccagtttcatccatgtccctacaaaggacatgaactcatcattttttatggctgcatagtattccttggtgtatatgtgccccattttcttaatccagtctatcattgttggacatttgggttggttccaagtctttgctattgtgaatagtgctgcatgtgtgtgaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccagcaacagtgtaaaagtgttcctatttctccacatcctctccagcacctgttgtttcctgactttttaatgattgccattctaactgctgtgagatgatatctcattgtggttttgatttgcatttctctgatggccggtgatggtgagcattttttcatgtggtttttggctgcataaatgtcttcttctgagaagtgtctgttcatgtccttcgcccactttttgatggggttgtttgtctttttcttgtaaatttgtttgagttcattgtagattctggatattagccctttgtcagatgagtaagttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcttgaatggtacttcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatgtctctgttttgggaccagtaccatgctgttttggttactgtagccttgtagtatagtttgaagtcaggtagtgtgatgcctccagctttgttcttttggcttaggattgacttggcgatgtgggctcttttttggttccatatgaactttaaagtcattttttccaattctgtgaagaaagtcattggtagcttgatggggatggcattgaatctataaattaccttgggcagtatggccattttcacgatattgattcttcctatccatgagcatgaaatgttcttccatttgtttgtattctcttttatttcattgagcagtggtttgtagttctccttgaagaggtccttcacttcccttgtaaggtggattcctaagtattttattctctttgaagcaattgtgaatgggagttcactcatgatttggctctctgtttgtcttttattggtgtataagaatgcttgtgatttttgtacattgattttgtatcctgagactttgctgaagttgcttatcagcttaaggagattttgggctgagacaatggggtttctagatatacaatcatgtaatctgcaaacagggacaatttgacttcctcttttcctaattgaataccttttatttccttctcctgcctaattgccctggccagaacttccaacactatgttgaacaggagtggtgagagaggacatccctgtcttgtgccagttttcaaagggaatgcttccagtttttgtccattcagtatgatattggctgtgggtttgtcatcgatagctcttattattttgagatacgtcccatgaataccgaatttattgtgagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgtcagtatttttttgaggatttttgcatcaatgttcatcaaggatattggtctaaaattctcttttttggttgtgtctctgcctggctttggtatcaggatgttgctggcctcataaaatgagttagagaggattccctctttttctattgattggaatagtttcagaaggaatggtaccagttcctccttgtacctctggtagaattcggctgtgaatccatctggtcctggactctttttggttgataagctgttgattattgccacaatttcagctcctgttattggtctattcagagattcaacttcttcctggtttagtcttgggagagtgtacgtgtccaggaatttatccatttcttctagattttctagtttatttgcgtagaggtgtttgtagtaatctctgacggtagtttgtatttctgtgggatcggtggtgatatcccctttatcatttttaatgcgtctattcgattcttctctcttttcttctttattagtcttgctagcggtctatcaattttgttgatcctttcaaaaaaccagctcctggattcattaattaaaaacccttcaaaaataaggaattctaatgaaacaaaggtcatgggttttgattagtcatgaaataagaggctagcgatcagaaacctatattaaaaagtttgaaaaaaatctatttttgtgattctcttgtgaacgagattttctgagtgcattaggttgttctggggttggagctacttctgtaaccattgttttcaatttaattgattacacaataaatgttagagctaccaacaggtgttctctttgacattttaagtatcagtcagaatgtaatgaccttaagccagtttttctcaatcttatttgacaatggcatgcttttaaaaatgttcaaatgtgagcaccaataggggcttggaagataggcttggattaaagtgaacaaggaaaaatgggattatagataattattgtcagaaagtataaaattgattcatgtatcttttaagcatcacaagaattagaaaatgagaccatgtgtattttattaagaacaatatgtattagaaaagtaaaagatctttgttttatattttcattatcaaatatgacatccacatcctcaagccacacatccacgtaatatgaaagatgttgctaaattagtttcccaaacctgattcttagtcttctgaaaattctcttctagactggtgcctttaacagggggaggaacccagacatttttttcccttcagtatttagaatttcttgaatgagtacaccctagatattttaattgttttatttttgacagctcagtttctaatttttgcacatcaagaccagtgaattttcatttcttatgtatttggagttgcttgttttttgattcagatataatttttggattacaagcctgttcttttgctttaaacttcccatttcaaccatagatcttgaggaaatctatgtacgtagttgaaatttattttattgagtaataagtgttagattataaaatcaaataaaatacaaatatatattgaaattttaagagagtttaacatataatgttatccactaaaaagatgaattatgttaatcctaatatgagttataaatactgtctatctattattgctcaggttgaatgtcaggtaatgtgtgacttgctgccattcctaggtatagctgacccatacgtaaaggtagagtagaacatagaactattaagtactatagctatatatttagcacttttctttcagatctaataataccttttagaaggccataggagtccctttgggacacaggaatgggaataaaaacatataaaaataatacaaagttggggatttttacacatttgaaaaatacagtagtgcttactctgactctctctattcatgcttttgattaccatgctgcaatattggctgtgttgggggaggaggagtattgaaaaacattttgcttttgtgtttctttgacctaactttaagactattaagtttatttatcttttgtcagagtcatttttcttttctaaagaaaaaccacatgcagtgaaggaattaaaaatgggcctgctgccactgctattttggagattcttagattagcttagatcagtccagttatgaaaaaatttttttctctttcaaacagtgccgcatattccttgatttcaatttctcagaagtctgggagattatcagtgtaacatttctaccaaatttctcaaaattaaaaagaaatccagtgaagagtatcaataaatacagacaatttagattcctaaaattatcagggctgaaaaaggatcagtataacaattttatggagcagttcagattggtcaatatctggggatgcttggattctcccatcctgttttgttcatcttaaaacagatcacaaagtccgttaaatttcaactgctcctctttctaggagttgcatgtgtgatagccatagcagctgtatggcaacttcacgttgacactgtgctcagacattgagttgatattgtcacttacctgaagtcacttaactgtctcaggaagtttgaatctaaatgtgtaggttattacacagcaatacattctgtgcctctaattctgtcttggaaatccactgttatcacctttaatgcagttataaagtcacataatcataaagttcactaggaaaagttattttccagtcagactaggaggagccaataaaaacagctctacgtggaggacagtattaatgtcatttgccagatatttgttgagtgagactgcctatgcaaaagtcatagagaattagagcacagtgctttgttttctgttcccatttaacatagatgagatttctcagttgctttgattggcagagttgatgaaggatcagttaggtaaaggttggcaaatgtcatgtgctaagaaatcacttgtgaagcttgttggacaaaaagttttcagtttcctggtgagcagctacacccaaaggcggctttagcagtgaaatgcttgaccttctcttgtggcatcctgccatccttcccctctagatcctctggccaccagccagaagtggtggcatctagccaatcataaattagtcagaggattcttattctgtaatactggctcttggaaactctagtatctttagtaataaggaatttcttctccgtttctgggcatgctgttcatttaacccatcttttctgttttctggtctttgccagcttggagtctagcagaaacaaagaaacttgtttctaagccaaaaggaaacacacaaacctagtagtatatccttaatcaatatcctatagacaatgaatttgagcatttctttctttaaaaaagtggatgttcctcaaaactcaaaaggaaactcaaaatcacttcaggaacatcttaattctgtattcaacggcagaaatacagcatattaaatggcataagcccactggatttattcagatctaaattaagcattgataggatggacctgaaaaggaaaacttatcgtgttcttaacaaattcataagtccagtaaggcaacttaggtatttgcatgaagaaggcactttttcttttgtcaaataaagattctgcaaagtttctgtccaagaactttttagcttttatagtatacaatatgtcagagaaagttacaactctgattacaatgcataactgtttatatgaaaagagaaagtttgatatcttgacatacatttaatgcactagttgtgttctctgtaatgactgaattcatcctgcagtttgatgaaggtgaatcgggaggggaacctggatcttgggaacttccaacctacccagcctcttctgatatctcttagacacttgtaagcagaatttgagccaaatagtctcaatgaagcattcccttcattcatttctggccagattaacttaattcacgctcatttctagctcaccctctttctttcttaaagcatgaagtagaaggtagttcatggctcagcttaaactcccattacattgaaagatttcagtaaagtaaaatttcagtaaaatttgttcccaattttaccagtctgagtgatcctaagctgcacagtattcattttactaagggagcaacagccaagttactgcacagtcttccactgtttaaattgtcttgtagcagtatagtgccactgctgttgttttttccatcccacgtttcattttccctagaatatctccatgttccagggaagtacaggatcagagaataggcagcgttctttctgagagttgtacgtagttacataacgtatcaggattttcttgttcagttttatctttgtagatccccttctgctattgtttgtgtctgttttggtttctaatttctgccaaactgctaagggatttgatccaactgttagcatttgatgtgttttttcccttccagatcacatggactctatctttctgttgtgaatctctcttgtggaggctttagcagttagttgggcagggtcttgccttgcctgtcctcttctttattgtgcacagccatgagtggactgttgtccatcctctggagcatacacacaaaagcctgtgttgatggtgcagtaacaacatatggatcagtggtccttgcctttgctaacattgtggtatcaggagtgcttgaggggactttcccccaaaccacctcatccatacatcaaatctaagtaaaaacaatgggcttgctatgaacatgtaagtttaacacaagcccactggcttttgtttccaactagaatggttctttaagctgctcttatagatattttggagcttctgctgcctggcaactcaactctgtcagtttcatttagttgggtcagttttatagtttctgcagaactggaagctggccatttaaaatagccttggttccactgacacatgtgatgtgattgctggaccaactgttcacaagttgtgaagagattacaagacagtagtgggctgaaatatgctcagtagagaaaggctggtgttgactgataccattaccacattgaccagtgggtacaggaagtaggtagttactgttgaagtataataaacaccaccaggctttgtctaggctaaggcacttctttagtatgccctgggatctcttgggttattttcctggttacagagaccaatttattagctctaagagcttgttggagatgccatcctaggaaggtagatgccttccagttgtgtgtatgtgtgtatatatgtggaataaatatttgaaatgggtttcagacagctacaacactgtttgcttcacagcactgcttccctaccttgcccatatgctgcaatactgacatgccagtctcaccccagagattaggagttactggtatggaatgtggccagggtgttggaggtttaaaaggtccccaagtgattcaaatgtgcggccaagtttgagaactactgctctggaaggtactaaaattttaaagatgtggtccctgcctttaaggaaatcatagtatacataggccaaagcaaaattacatggaagtaaaataacagtgtaagaatgaaataacaatataaaatgataaaaataacgcctggtaacttcgtttcttttatttaggctagaatttaaatgacagaattaaattgtgcattgagagttttgatagaaaatggcaactgagacttctggaaaaagaagcaattgaacataggcatctacttttgttcctcccaaaaccccactaaaatatcaagggatcttcttttgtcaaggcctaaatccgcagggatggggagaatgggactggagacaacctgaagaaaatgttggaagctggaaggtaaaggacttaggaggcttggaaaaacagaatctggagtgagcagtggggcagccaagaaccagcctggtttacattaaagaattgcccaaaggcttaggaattggcaacatcaagtacttctgggaatagggatgaatggagtggggctttagaatagggagaattggttgaaaatctttttaagagcccctcagatctctagcttccctctaccacctggaagaatctggaggttaattctccaaggagaatgtattaataaaatacatctagagagaaggaaggctgggaaatgtagtctttgttctgtgtggacatgtgctcagctaaagctctggggttctgttactgcgggagaaggggagaataaatactgggggacaattagcagttggcactatgcttacatacacacatacttgctacattaatataataatattgataatgatattgatggtgataatagtagcagcaaagtcttagagtgctttttacatgcccagcactgttcttagaactttacatatattaactcacttaattctcaacaatcctgtaaagttagttctattcttatcccactttgcagatacagaaactaatgtacaaagaggtaaaataacttccccaggtttcacaactgaaaccaggcctgagacctcatctttctgtgattaaacctgacattgtgattaagtttgaagaaactgattgctaattaatgttgttcattgtattggttttgtgttctctttgaagaaaatagtagtgatatatgtgctcaataaatataaggagttattgctatttttataaaattatatgtttgtacaaattcaagttgcattagattacaaataatttaacctttgatgtctattaactttttatgtttaaaaaaggttcatacattttgaagacaatcagagaaggtggtaagttgagtgattaaattgtaatttaaaacataactgtggtcacagtgtagagaagctgagactaaaagcagggagacgggggtgagatgatgcctgagtccaggcgttgtgaccttcggtgtgcgtcagaggcccctggaatgcttcttagatcatagaatgctggatttcaccctcaagatttctgatttagtaggtttgagatggggcccaacaatctttactgctaagaagtttccagaagcagcagctgctgcaggtctgagaaccacagcacctatctgagaggtaatgagagtctaaattgtggtagtggagggaagggataggtgatgaggcatcagtcagggagaattgacaggattgtgattctttgaagttgaggtgaatggagaggcaaggatccagagcagtggtgaggggttacacattgaatgaaattcctgttggttgttacaattaggaggccattggtacttgctgacctcaataaaagcaattttcatggaaaagtagggtcagacatagattagaaaactgagattttgaggagataggttaaatcctgtaatatattgtagaatacatttagatttctttagttctgaaatgcttgattatactctgtatcccagcttattttagcaggccatctgatactgaccaaactaatgcttccattgtcttcatgatactttctggctttccactcaccttttgcttaaaagtggtcctgacatttttaagaagtgtccatatctactttatttcaagtgaaagtcatccttctgcatatatgcttattagtttcagatcagtgtagaaacctttctgcttgcattttcttctgtatggtgacttttgagctctttctcttagatcctgcttttgggtcctcaaaacagctcagatttaagacgtcagagctgtcaagctctgctggttttactttggggtttctttcactattgttcccattgccactatcatagttcatgctcccagtacttttgatctgaatgattatagcaattatcatgagtctttgttctcactctccttcctagtcttatttaatttaaaaatatctgtgagattgattttccaaaataaagctctgatcataacacttctttgcttaaaatcttctcagtgtttaatagtaaagtccaaataagcaatggggaaacaattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaagcctaggcattaccattcaggacataggcatggacaaggacttcatgtctaaaacaccaaaatcaatggcaacaaaaaaccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaaagaactcaaacaaatttacaagaaaaagacaaacaaccccatcaaaaagtgggcgaaggacatgaacagacacttctcaaaagaagacatttatgcagccaaaaacacatgaaagaatgctcaccatcactggccatcagaggaatgcaaatcaaaaccacagtgagataccatctcacaccagttagaatggcaatcattaaaaagtcaggaaacaacaggtgctggagaggatgtggagaaatagaacacttttatactgttgctgggaccgtaaactggttcaaccattgtggaagacagtgtggcgattcctcagggacctagaactagaaataccatttgacccagccatcccattactgggtatatacccaaaggactataaatcatgctgctataaagacacatgcacacatatgtttattcacacacatgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcactcataggtgggaattgaacaatgagaacacatggacacaggaaggggaacattacactctggggactgttatgggatggggggaggggggagggatagcattaggagatatacctaatgctaaatgacgagttaatgggtgcagcataccagcatggcacatatatacatatgtaactaacctgcacattgtgcacatgtaccctaaaacttaaagcataataataataaaaaaaaatagtaaagtccagttttcatagcttagtataagacttttgtttctagcttcaagttttttcccccatattcttggctgcacccacactacccaccagttgtccccagtcttctctgcctgtctgccttccttatgctgctctgtccctcagaaggccctctctttccacttcaaatccaacctctattctggaccctgctcatcttcttatagcccttgctatctagaattccttttaactattgtctatttccatctagtactgtacctgtaactcagtatacttattttcaaccatgtatttacttatatataatattcaccttcttgtctcccacgatgcccataatagtgccaaacacaaagattggttgaatgaatgaagaatgggaaaccagctaggatatagtgcaaataaaggaaataaaatgatgattcatttaactgatacagtaaatatattgcatatcagtgaatgatgtctaatggaattttctaaagctaatatgagtgacagtaggaacctcttttaagtatagtcaatcaagtttgtcatcttttttttttttttttttttttgtgagatggagccttgctctgtcatccaggctggagtgcagtggtgcgatcttggctcactacaacctctgctttctgggttcaagtgattctcctgcctcagcctcccaagtagctgggattacaggcgtgcaccaccacacacagctaattgttgtatttttagtagagatggagtttcaccatgttggccacactggtctttttctcctgacctcaggtgaccagcctgccttagcctcccaaagtgctaggattacaggcgtgagccaccacacccagcctcatcttttttgattgttcagaaatcttttttatttaacttcttagcttttaattgagtcctagatatttcagtgagctgaatactgtccttaatatatgtgaaatgtcactgttatattatgccatttttaataagcttgttaagcatcacttggatgatacatgtgcatatatgtgtacttattcacacatgaattcacatgtattttacctaagattaatatgggccaactgtgttttctatacaatggaatattattagatggactaatggattcactagcctgattaatgatctgtaccagttaatttctgcgttttgatacatcttattgatgtgttttctgattctatttttatttactcattggagtgtgaactagaaaaatactatacacaagtaattagattgtagaagtgatgtgtaagatttgtttgttataattgattttagatgcagaaacatttagagctagcataagaaaagttgatgtaagttatgaaaattagaaaacatttcagatttagaatataatgatattatttaatttttaaaactaactttttttttttttgtttttttgtttttggccaaacattaatcatttggggcttttaaactgtattgcatttgggaccgcctgtatgtgggcctttagttagttccagtagcagtgagactcagatattttgaaagaacaatatcagatatagttagtgaatattgcttattttcaggttaaaactgattcttcattctcttgagctttcttttattaataggtcctcagtttggacttagaattcatttaatgtcaaccttctcttgtttacaaaggggaaagctcatttatttttcatgctttgtcatattgttccctttgtttctgagaaaagggcaccagcctatttagatagagcagtttaggctatttataaagctaggcaggttaattgaaattgacagcttggtaatgtcctccttggtgaatgacgcacaagggttttagatgatgttggcatgctgttttcacttatagtcaggaatcagctggaggaatttgtgtgctttgagctctggtgttgacgtaggtactgggtacagatatgttttaggaaacatctcatttccatataaatgaaggaagattaaaaagaaaaatttcaatggcttgcccttaaattgaagctggtatcacaaggatgatgataatacttcttttgattttctggaaaaacagctttggttgtattcaagcactgtggagtcgttacaggtttattcagaaatatttttgtattctttttttttttaatctgtttattcagcatcagctatgtgtacattaatttgaaaaactacatttttattgtgtattcctccaaactccaactttaatctcttaggttttagattgctccatttaagaaatttgtacaggtacataaataaacttgattttaataaaagatagaagactgaaatagtttttctttcttacatgacaagactgttattctttcttttttaaggacatagtaaatatcagtttgcctgaaatgagtttttgtgtttttctcttcaagtgtcacttaaaggagaggctaacaagcttaaatagtcacttaaatgagagtttaatttaagcttaactggttatgtagtcatattccctgacacccaaacatttaggtcataatcatttgtttcattcatgacagggtgatttccaaagtacagacattttatctcagaatcacattgagcatgcacggaagcaaattttagcttacataaagttaagaaacactagtagttgatttattattagttgtaatatatcttctatgggcccatagccttatcaaaactagcactgacaattcctgaagatatctggggctcttggcatggtgagttggtcctgtacttccaggttcatgctggtacctttgtggatcatcatgtctgtcatatggaccttagtcaaatgttatggcaaacagcacacagcatatagctcagggacccttgagggggctagtgtagagtgagggcttttaagtggaggcttgcttgaaaagaactgtgatctcttaggatcagttgcccctcatttccaagcagtgcttggagggctttgggcccccttggttgggttcaatccttgacctgtgtagtctgtaagttgctgtagatacacagctgcagcagtaacattgttctttaatccaggagttgcctttgatcttcagcccttcattctcactcttggggtctcttttttgcagaaggtgagccgtggccaggcttcctgtttatagcctccctctgttcagtggtaaacctcaggatttttggatgaagatctttggatgtgtgcctccttggtgcccattcatggtcttgctaatggaacaggatttgggttcatagttttgaattgcctgtcacagccccgctgtcatggctgaacttccttccccaccccacccttcatcccagatagagagataatgcttattgttgagtgattcaaggtactgtagacatcttccagctggagtggatagagtttgaggatagtggatagagtttgaggatgagcacagtacatgcctagtgagatcttccagctgatggtctgggatccttaaagaccatgcaacgtcctcagtacttctcagtgccaattgtcaggggatttttggctgccacgtgcctctcaactaacaactattaagtcctgttggttctatagtgtttctcaaattctttcttcttcttattttcctcaacactatcctgataatagcattatacatcttataaaatgctttatggtttgcagagcacttgaatgtgctttatcttatttgatcctcagatcagctctgattgatagccaggttagttatttttatcctgattttgtggatgaggaaactgaagcacaatccaacaccacacaactggtaaatggtggaaccagatttaaacccatgtatcgtgatgccagagcccatgcttttaagcactgtagtaacttgcttatatacaccaaactttctatctttatctcccactactgtttttaatcctcttatacttcagccttcttggtttgcttcccaactcagagtttgcccttatttcctgcctttggtcacactttaccttctacctgtgcctgtcgaaattctgcccattcttcagtgcctaattcagtgtcttctttttcataaaactttgtatgagtcctccaagcccaaaagaattcccctctcctctaatagcattttatttgtatgtcattttcttacatcataattatatttgacttatcgcattgtaagttgcgtgaggacagatggtgttttatttatccctttatcatttgtagcaactaactacagtgctttgtacatggtcaagtacatatgaaacaaattatatcaagtgatattttttactgggtcagaatcagagcctctggtggtggcaagaggtgatttgagagagcttgatactatctcttacaacatctatctaataagattaggaaggtatatttgagagactattatcttcagtttgctccccctcctaggacacaactaattcattaaagatcttatctaagttgtgacaaacagcactttgttcatcttaagataatttcattccaatgttccatatttttagtagtctctaatctagtaattgataatagtaattgaatttcttggcaaacaaaagaagacctaaattttaggtatcaaaattatttttattttatactttaagatttcttttataatgtattaaaaagtaaaagtacttttaaaaatttgtgcccaacttcaagagcattttaatttttttgataactatgataattcagataatttgttgaactataagattgatatagtaagtttgaaatttcacttgaatctgaactgattcgagggcttctatctatttaattgtttcctttccccatacccatttctttaataagtggattatgtaaaaacagcttggcaccttgttaccagtaacatcttagttttacccacaagtttggagattttacactccctttttgagatagaaacatgtataaatttccacagagtaatagtggaacagtgttaacagtgctatcttgatatgcaatttattattaaatcaaagtttgaagtagccctttttaaaaggactttaaaaacatattcctgattaaggaagttttcctgatcatttttattcctgttttcttaacatgctttttattttatttcattgttggtagctaggtcatgcactgtgacagttttatagtagctatcttatttgcataggtttttggagaacatatgatggaattttaggacattgtcctcaaagacttattacattcagattagctatttaaaactgttttgtatttgtggctgtggtgccagataacaaggtctaatttaatatattttagcatttgtgacttgagtagtttgcaagagacaatgtaggaaataaatttctctagtagaaagaaagggaagcaattgttgattcgggtatcaagctgccagttactggctattgactttgggctaaccacttaagtaacaattcgatttccttatttgaagactatggggttagtgggaaggttttcaatagcactaggattttgtcattttgtaattagtttttctatgtgctcttttcatacccaaccatagtttttacagatcattgaattatcacattgattctatcacattaattcttttgttcttaatttacttaaagaacacgtttttaccccttgtgggattactggtaaatataacattgaatttctttttttccccaatagatgcaatataggaatgtacttatattctccttaatttagaaattcattttaaaataaaagattaatttacctcataataatgcaaagttgtttttttttttttttttaggttttctttttttgagtgcttggttgtttggagcttagttgtttttttggtgggatgcgtgagagatttctaaaatagtgcttttaaacatttgccacagctccatggatagtttgttttaaaaaatactttcccccccaacttagtcttaagtagaatttttcttctaaaattgaacagtggagtcaattattttatttgtccaccttctccctgcctggggtactgtttctttaactggtgttaaccaaccctctgtgtccatgaatgtattctgagagttctcacattttctatgagatttaaaatttggggttttactgtcaacgataatcttgagaaggtaatataagctttttctgggtcatctgaatcatttgccatgcaactagatactaccacatggtaaaattagtgttggtgtttattattgtgttcatggtaatgtgaaggccaactacttcatattatctgaagtgtatgaggctttcactgagattcaaataacaaacagtgctaggagcatccctgcttgccacacccaaaagaacctgcattatagagataacattcaagttgtaggcagaagaaagattacattttttaatagagcaacttgtaacaatcattagaagtaagtgtatcagtaagtacaaaaagaattttctatacttgcttctagtgataattgaataaggcacacatataatgcagaattcaatatggctgtgataccaaccatatctttaagtgacttccttaaattagtgttcaaggactgcttgttagtggttttgtttggaacgaggtctgattatccttaactggttaaggaagccatgaggttatcagtactgttgtgtacagtgcatttaggtgaataggtattcttttcattagaatgattaaagtaaaaacaaaaacagaaagagattaaatatattatcaaactcaaagctttgttggtgttgacatttcagcagaaaaccgttgttcattatgccatattttttactgttaatttgaatttaattggttaggtagttacttttgtatttaatttataaatttgttttggctttgtctttttatcagggtaataaatgctaagttttgttttgtatgtattaaaataacatattaaaagtggtttaagttggcattaggagtgtaagaacacatttttcccttaaaagttgtatatctagtacttggtttgagaaacctcagtctatgatactgaacattattgtatcataatcatgatagctaaccttcaactagatgttttctatttcattttctatgggttgcttaaaattgtgacttttctccttttctgtcattaaaaaaattaatttctctaatacatggctacctaaaatcatgacataatccactgatctgtgtgtgggtagttgcatattcaaaatattgttatctggcctgatttttagtttctgtgatttttgactgtcatttctattttaatattactattttgggttcatttttcattcattcatacattgaacaaatgtttttaaaattccactatgtacaagggattgttctaggcactggagattattgggtgagaatttttttttttttttttttttttgagatggagttttgctcttgttgccaaggctggaatgcaatggcacgatcttggctcaccgcaacctccgcctcccaggttcaagcagttctcctgcctcagcctccgaagtagctgggattacaggcatgtgccaccacacctggctaatttttttttgtatttttttttttttaaatagagacagggtttctccatgttggtcaggctggtcttgaactcctgacctcaggtgatccgcccacctcggcctcccaaagtgctgggattacaggtgtgagccactgcgcccggccaagaatctttatatttgggtgggcctatagtctctcttcactgtcagattttctaattgtttaaatgaaaaatttcatgtttatattacatagtacatatctatttcaactaaactaaatctgtcttgctgacatatctagatatcttagtacttggtgttaccacgtcatgattgccatagacataaatgtctctttagtccaaaatgatgggtcttttaagcttgttcattcaaacgatattactgaaagactggtaaattcaagaggttgtagtaggcactattggactactgatgaaatgaatgagacagtctgtgttcttagcagaggagcttagaaattttaatccagtcactgaacccttgaaactaatttgggctttgctgtgtgttgacattgttgtatctatacccagaattgcagactcattgattacagaggggcttttgcatttaataaacattcattcagtaagcatttactaagcacatacatttgtttctggttgatttttatcttctttaatttgtctcttagccattacgatgacccagatatcttgccttggagtgttcagaataatagggtagaatctgtaggacaaggttcacaaacagctatttctaaacaatgcttcttggaggtaacaatttgaagaatattgttgtaggataattataattataggtaaacttcctaaatctggaaaccttggaacctgtcatattctagaaccataaaaatagtgctgctttaaagcaaaagcagaattagatagagggagatgtccagaagagatgcaagaccaatgacagccttggccaaccctgtgggatctgtgcaatcagaatgactcttttgccaactagttgtccctagttgggctgaaatgaccaggcctttgtactctcacactgatcaatcagtggatgggagatgccaagcatgacctcagtctaggaagttcactgcagataaaacagaccctaaagggtgtgatagctgaagtgctgatatctgtcagccaacagatttcttagtaaccaaggcaacatggtgggtgatcttcacaaatgggtgatctgggcttcatgcatcatagtgttcaccctaggcagtaaactgtgacgattaccttgatgacaggattgcttattcagtgttctttttcattttctacctctggatcatgagtagcctaatttacgatgctaatatgtggtggattaggtgtgagtaaggggaacaccattttccctttactactttcaacttaggtgttaatatttggtaactctaataataaggtgactataacccttggtttacccaggttagtcctgtttgcctagaaatacccagtttaagcctgttgaaaatcagttagcttaggagaaatacctaatgtaaatgatgagttaatgggtgcagcacaccagcatggcacatgtatacatatgtaacaaacctgcacattgtgcacatgtaccctagaacttaaagtataaaaaaacccaaaaaaacaacaaaaaaactatcttctcaactagtacagagactagattaaaaaaaaatcagttagcatctaacatctgttaattatttttagtaactcctcacagtctcagaagtatcccagtttgtatcccaatacaagataaactgtattgtcattctacttagtaattttttaaatttgcgtgcatattcattatttaagcatttttctggcctgtctaatgaatagaatgttctgttttccattttttaagaggcagaaatggtcttctggattagctttgtatttttgctttagttgaccctaaaacaaatgcgttttatctttatcaaatttttcatcatcaagctttaatatattgtgaaatcacaacatattctatcaagtatactatgactgaaattactggatgtattatttatttctgtctcccactgttacaattgtgtctataatgacttttatttccctggtttattttgtagcttagtcacaaatatttatgttcttatttatctttctgctcagagactgggacctgagctgtttccctgatggagtcaatcattttccagaaggatattccgacctattcaaatctaggtcctgaggaaacacaacttgcttagaaatagacagttttaaatctgcttttacagaaatcttttacagaaatccataatggaaagaagaaatttaattttatcccagatagatttaataacttgcagatctactttgttcatagataaactctaaaactaattaaagcttctgaaaaatgtctagggacagaagaaacagattcttagtgattcctttaacctatcaggaggtaataggctgtcaccttaagtcatgctttttcgttttcttttttttttctcattctgtctcccaggctgcaatgcagtggtgtgatcttggctcactgcagcctctgcctcctgggttcaagcgattctcctgcctcagcctcccaagtagctgggtttacaggcatgcaccaccacacctggcagattttttgtatttttagtagagatggggttttgccatgttggccaggctggtttcgaactcctggcctcaagtgatccgcccacctcagcctctcgaagtgctgggattacaggcctgaaccatcacaccggcttctttttcttaattgtttctctgccctcttttccctatttttctggtctatagttgtggctgaatgttagatagggaatagggttcactggtggactcaattttacccatttctaattgcttagcaagaggagtcacctgctgattttaatatgaagtttagtattgtgtaatggacaatatctttaacagatggtgtactgccagtgatgtagaacttcttaatcatgctccctttacaaaagaagaacactattagaaagcgatggtatgattttatacttgatcttcaacaagtgagaaattgataagtcaaatatacagtcagccatctggcattccacacatgttttcattgacttgggagatcatggagttatacaaagcaggagtagcacaatataagaaaatggcatgttatagaaatatttatttcttttattttagttatctatactattgatcagcaacaagtttatcagaaattttcattttattcagctatctgagtttagaaagaagtaattcagatggtatttacttttttttgcccaatcaaagctgctaggcattgaggaactgtttcagagtgggcatagttttttccttcacatgaggtcaaagccactaaccactgaattaaacatttgctgagcttggtttgcagcactttgattgatatagattccttcttgcaacttctttgagcctccgaaacttactgtgtcattatagaccccaactgcctttaaaagataggaatttcaacatcctacaatttagtcatcatttggatgaatgacttaaattattatatattttaggaatattaattttttatactacctgagctaagctgtgtgaaattattatcttatgacatacacactatttaatatattgaatttcagaaagttggttccaaatatcaaatagctgagtagaaagtagaaaaagacaatccagttgctgagaatggggcagaaaaaaaaaatgtgatttctaaatccaaagaaactagctccccttatctaatttatcctttcaaactaaaaatatgttaaatgctgtcagtgtgccgggtaagtaagtgctaagcactgacactccccctccttgtccttatggacctcaggctgatcctctttgttcccagcctggctcactgtcactctctccagcattcctgtcagtgtccacatggatggtcttttcaatattctggcttctcagcttcttatccttttcttctctggtgatcttatcctccatcctacatcagcttttcattcttacagccatactcttgtcattagcaataacagtggtctctgcataatctcagtttgaagcatcctcaactctgattagcattttgaatctcactgtagctcactgcttctagtacctccattccaacaatcttttgaccttattgattcttaaaagccacggattttaccaccttgttgctgtctttcatttccctgattacctttctttcttttacatccagtttaaatttcatgtcaatatttgcttggcaaaatctaattctagttaaatccatctctctgtgtaaatcctgagctgaatgtcactggagcaaaacatgccatgatgcaactggtctttaagttcaaggctgggaagttccggggcactcatgttgcctgccatcatgctgcatgttccgggtccattcggtcttccattctcccagatgactatttcatacttttttccccctcctcaaaacagcttctcccatccttattgttaggtaataatttagttttgcattttactgaaaggatagatgccactaataagaacttggataagctcttatcactgcatatatccatgtaccaccatcaatgcccatatgccttctttcctcctgcactctgaaagaatgtaagggttcctatcaacccctccacagtagatcccttcttctcttgtcaccttttcaaagacacggttccagttattattccttctctccattttattaattttctcaaaataatcagtgttctcttctctactgatcattcccatcagcctgcaaatatgctgttattttttccatcttaaaaacctgtcttgctgggtgcagtggctcacgcctgtaatcccagcactttgggaggctggggcgggtggatcacctgaggtcaggagtttgagacaagcctggccaacatggtgaaaccccatctctacgaaaaatacaaaaattagctgggcgtggtcgtgggcgcctgtaatcccagctactcgggaggctgaggaaggagaatcacttgaacccaggaggtagaggttgcagtgagtggagattgtgccactgcattccagccgggtgacagagcgagactacatctcaaaacaaaaaaacccaaaactctcttgaccccatattcccctctagtgactgctccctttctcttctcttctctctctctcttttttttttaagacagaatttcactctgttgcccagggtggagtgcagtggtgccatctcagctcactgcagccttgacctcctgggttcaaatgatcctcccaccttagcctcctgagtagctgggactacaggcacgtgccaccacacccggctaatgtttttattgtattttttgtagagatggggttttgctgtagggtcttgaactcctgggctcaagtgattctccgaaagtggtgggattacaggtgtgagccatagcgcctggcttcttctctcttttatagcaccgtttctccatataattgtcactactcattgtcttcaatttctctgcttctattctctattctcacttgaagtcactgcaattaagctttttttttttttttctcttctctcctactttgcagaaacggtcatgttaaggtcaccaatgataaaatcctcagtcctcatctcactttttaatagcagtatagacacaagttaatcactcttttcttggaaacacttccttttgggacaacacattctcctcctggttttcctccaaactctggcttgttttccttctcaacttggctgatttatgtctcacctgcttgtcttgttaacattggagtatccaggctacaatcttagatctcttcttttctctctatttaaatttactaggtaatcttatcccatcccttgttattaaatgctgtctttatgctgaagacttccaacttatatccaacagtctaattgatagctctacctgaatatctgagggcatctcaaagtaaacatctccaaacctgagctgctgatctctcacccaacatgcttcttcacagttttccctttctcagttactgggaactctgtccttcaggttacccaggccaaaagactttgaatcatccttagtattgctgtgactcatactgcacatccatttcatcagcaaatccttttagctctatctttagagtatatccagagtctcacaccatttctccaccttctctgctattatgcattgttatctcttactgggattattgcagtagcagataatcaatcttgctgtgtccacccttgctattgacaggctattcaccaaatacgagtcagaaggatcctgttgaaatgcagctcagagaatggcatgaccgtactcaagaacttcctgtttttctcactcacctgctctctgactcgctctcacagtaaaagagggtttacaatgtcctccagggccctgcttgatcatctacccattccatcctgtaactccttgactttatctcctactactctttcttttactctagaccaggcaatctggactccttgcccttcctctgatatattaaacattttcttaccccatggtttttgtacttgatggtcgctctgcccagaatatttattctctcagatatatgcatggtacacatcctcatttatttaaaccctttgcttaactgtcacctctcagtggggtcttcccaatgtccttaaaaatcatagtagtttccctccctccatcacctactcccctggttcatcatctaacaaactaaatatttccttcatttattttgtttttattgcatttcttgtgactagaatgtaaacattcatgaggaatgttttcgttttgtttgctgctgttaggaaagtgtctgtataatattaagtagtttaaaaacatttgttgaataaatgtatgaattattatagtcttttcagtgttataatttttctattacacataagaaatggagccttagagtgtttagtaatccgtggaggtaacacttaaacccaggtctttcttggctcatagtgcagtcactcatgtattttttcatctatcaggacacttacagggtactacaggaactttacattggatgaattgcattataagatagaggaagtcatcaatattgtgtgtcttatttgtgctcttctcctcaatcagtatctgggagaaaatagaaaccgatttttaacagttcatgttgaagcactttttgctacatcatagaaacttgtcagagagacttgttaaactatttcctcaaatcaaacatgttttggggtaagagagttctgagaaactcacttttttctgctttctattggcaacaaggctatatttcttaccgagatgaaaaatatctaaatcccatgaactagcaaggaatcaataagaatgctgctagtttggttaaggtggttcaggtattccagggctgtgaattccatgggagacagctggaatttacgttcattttctaccactgagtttttggttcactggaatcatagattttcaaagattatcaagctactcacagtcaaatagggaattgatgaggaatagaggtcacaatttcagaagatagtcacagatcatgatgagtatgaatcatgctttcagtttttgcagctgcttatagcctggcaaactacaggatgtgtctggtcggcatttcccaacacctgccccatgtttcgttcatattcaaaggaaatgattaagctaaaagtgaattctatatatgaaaaagaactggtatccttggattatggaagtgaaatatgaataccaggtttctcccaaaacatttggttacatggccagactgtggctattgtctttgtccacccagaatcctgaaattataatttctaatgaaattctggcatgagctgagaggtggtgaaacgtcaagtgagaattgaattatacgctaataaaattgtacctagtggttcgaatggatcgtctaaagggtttatcaaacttctctaatttgaagggtctcaaactccaaaatctgcctccttgttggtgggcacagctcttttaactgggagagattatttgctgctgggcttttggagtgtcctgtgggcacaagtgttggcaaggatttgatcagtttttgcacagattttggggctcctccatgctgtgcccttcttttagggatttagtctctcaattttcaaccactggtagccacagactattttctgacacctcagatcaaccagactgagtctatttgtttgaattttagctgtcctgactcatagactggggagtccttttgcaggacaaggcttatgaacgtcatggtcatccactgggcttaatttctttcaagagtcaagactccagtttatgcctacttttggcccttcaatgcctttaaatagttgtttgttttattttgcccagagtttataatcattaaatgtggaaaggatagtctgaaaaacgcaactctgacattacgttcagaacctcaataagatattttgtatagttttttcattattattcaatttaaaataccactttctaattttcattatagtttcttctttgagctgtgagttacttagctatttattaaaaaaaatttctagccaggcccggtagctcatgcctgtaatcccagcaccgtgggaggtcgaggcgggtggatcacctgaggtcaggagttcgagaccagcctggccaacatggtgaaaccccgtctttcctaaaaatacaaaaattagctgggtgtagtggtgggcgcctataatcccagctactcgggtggctgaggcaggagaatggcttgaactcaggagtcagaggttgcagtgagctgagattgcgccattgcactctagcctgggtgacaagagcaaaactccatctcaaaaaaaaaaaaaattctaacataagaattttttgaatgatctttttattgatttctaacttaattacactatggtcagagaatatatgtaattttcatcttttaaaatttgttgagattggatttgtagtccagtatatggtcaattgatgtcagtgttttctgtttaattgaaaaggatttgtattctttgcttctgggtgcagtgtcctttgtatgtcagttaggccatgtttgttgaacatgtttaaatcatctctatttttcacactccctccttttttttggtatgccttttttgtcagttattaagactagtacattaaaaaatcatctcccactatgtggtgattttgtccatttgtccttttagttgtgttgcttttttccatttatttggagcccattgttagataagtatagatttagaattatttatttcttgtgaattgaaccctttaacagtatgcgttttccctctttatctctggtatgtttttttcctgaaagtctactttgcctgctattaatatagtgacatcaactttcttttggttaggttttttattgtctattttttccttcttttttcttttttttaacaacctttctctgtctttagagtttgtgtttcctttcaaatagttgggttttcctttcttttaaattagtgtgacagtttttattttcattgaaacattagattacttacaattaatacaattattaattggatttaaataattcaccttactatttttttttaatagagacaggttttcactatgttggccaggttggtgttgaactcctggtctcaagtaatcctcttgccttggcctcccaaactgctaggattacaggtgtgagccaccgtggctagccatactctttattttctgtttcctctacctgttctatacttctccatcccattattagtttactgaatttttaaatgtattatgcatgacattactctcatttgccacattaacctttttttcttttctattttaaggaaaagatagagtttttaataccccattgtgtgaacaaggaattgttggatttggaatcggaattgcggtcactggagctactgccattgcggaaattcagtttgcagattatattttccctgcatttgatcaggtaagtgaatgaacatttctaaggttgttcattcattgaaatattcaagtattgccgctacccttccacccacccttacctgcattctaaacattttattatccttttactaatgtattacaattataattttgttatgagcatatatttaaagatctaatagaatagtttaagcagatagattgggattgggtgaagtggctcacatctgcaatcccagcactttgggaggccagggtgggaggatcacttgaggccaagagttcaacaccatcctgggcaacataatgataatgagaacccatatctacaaaaactacaaaaattagcccagtgtggtggcacatacctgtcatcccagttactctggtggctgaggcaggaggataacttaaaccaggagtccaaggctacaatgaactgtgatcgcagcactgcactccctgggtgacagaatgagaccctttctcaaaaagaaaagaagagagaaagaaagaaagagcgagagagaggggagagggaagaagggagaggggagagaggagaggagagaggaagggaaagacaagaccctgtctcaaaaagaaagaagggaagggagggagggagggaaggaagaaaaggaagagagggagggagggagggagggagggagtgatgggatcctgtctcaagaaagaaaggaaaggagggagggaaaagctcattgtgctatgggaaaggaaggaaggaagggagggagggaggaaggaaggaagggaaagactcattgtgccatgggaaaggaaggaagaaaggaaggaaggagggagggagggagggagggacgagaccctgtcttaagaaagaaaggaagggagggaaagacttattgtgctatgggaaagaaaggcaggcaggcaggaaggaaggaaggaagagggggagggaggcagggagggagggaaagactcattgtgccttgggaagggaaggaaggaagggagggagggaggaagaacggaaggagattggaagggaaggactcattgtgccatgccccgtctttctttctgaccctcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtatgttcatttatgtactttatttgatttctatttgatgtttccattttgattcattctatttaatatctatgcttatctagaggaaagaaaacaaacaggattcttggaatttatgtgaacttaactgtatttaagaaggggaggttagcagttcttttaagtatgctatccaatgcccagttttacagcaagttctttttgaaggaggactggttttataaactctggcattgattaattttatagacttcaaagaataagaccaagaacatagttggtttacctcccctctctttcaaagctttatatttctttctaacttaagtctttctcacttaactgatgatggggtgattttaataaatcttttgtttagtctgtatttacctcaaagtcacagggataacacttttgcttttaatgtatttcttacttgttaaaaagactaagagaagactgttacctagattttttttttctgtttaaagttaggtaatacttgctcaaccaattaattttgaagcatctcctttttataacctgtctttcacaaaagcttaggtcttttgatggtaaaaatattttgagttttttatgtcttaattttttgtattatcttttctgtttctgtttactgaataagcttttcaggggatcattgtagaaacccatagatgtgtgaatccagagatgtatatttgttttttgaccacatgaattgattgtgagcatgtgtctatgttttattctttttttcttatttgttttttctaccagatcaaagttataagcttatcttagttgagtagatgttgcctgatttttgaatgtgagctagaagttgtagactgggaaagaagccatgtgcgaggcaagttatttttgtgcttgagctaaacattaattcacatttaatatttataacattatattgtttttaagaacagatcttttctgtctgtcccctgccttctcttttcctccttcattttctttcttcctcttcctttttcctttttttttcagctgaaatgaaaatatacttaaagtacaaaaggctaatatgaagaaagcagatgaagggaacttaaaaagtaggaacataagataaagacattgtgtgatatggttattaatgtgttcagaggtccagaacagaaaataaaattttttatacagaaaatagtgacatttttgctgctcttttatttttaaaataaaacccttcaataaaaatggcataaaaatggctttgaaagccaaatatagtttgcctcagggaatcttaagtctttgtggtaagttcaggtttattttaataactcttcctatataatatttgtctttaaacaattataatcatttaaaattagacaaagtttgtgatttaagtcaacattagatagaagttaagagcttgagctttggtatcagtgggaattgggtgagactctttgatcaagcaagtcgtgtgaccttaggcaagctacttgttctctctaaacctcagtgtctatttctaaaatgaggaacattataatagctacctagtggggttgctatgaacagatgaattaattcacagagtgcttggccaagtttacacgtgtacttcctactgtcattatcatcttccttgtcatcaccctcattctcgagaaggtcctggagccctttcctgtgagtggaagtgtggactatccacacttttgtttttgctttgctatataactggacactatggtgcctggactgtaaaactcagtggactaatttttcacttatgaaatgaagaccatattttttttcatgggaaaagaagattttgacatgttaaaactggagaagagagttgcatgtactttgaaagtagaaacagattattagtagaagagatttcttcatagataaacacaggtagatattaacaatattacagttttttgctttgatgaatgatctttgcatattctttttattttttttatataggcaagtttagcttcttaagagtagtatcttagttaacagaacatggtagacatctgataaatatctgttgaataagaggcatttttatttttatataatatgtaaacttaataagtgataattaggcttaaaataaatagccaatatctatttttaattagtaacaattgattatttaaatatcagcccttcttagcagcgagtttactgggatatatttttactaaaattgtcttaaaaaaatctgtttttgcaggtggttatacccagaagccctttccaggccaaaggacttcttttgtcatgcatagaggataaaaatccttgtatattttttgaacctaaaatactttacagggcagcaggtaaagattttctttattttatatttgtgaatatctttatatactttgttttttatagctctaaaagttatatcttttttttctatatggttgatttatattttccttgtagaaagaatcttgatttttttggtatttagtttgtcctcaggtgtaaattttatgtttgggaaaaattcatctagccattttatattttgattgtggaaacaaagaggaaatctgaagtggtagcaacaataaagggactatgtttaaccacatagtaggtgcttagtaaatatggattgaacagaaaagtaaatgagctcattttactaaatagtatatgtttccttttaactaaagtgaccataaaggtcttccttcatttaaatcaggatacctttgactgtgaaggaggtgctgttaacaattatgctgtgctgtcaggtctatgctgggatgactgtgtaaagcaaactaaggtgtttggtcatcctctttttagctcaaaatcctgattttataaacatacatctgtgactgctaatttcttcactgtaatggaaattttaaatagcaaatgatttttttctgtctaaagcattttaatcactcctggaagcttcttcctcactcttcacaatggatccattctccctatgccaaaaacagccactttctgattgccatcagattaggtgtacatgtgtttgggcttcatataaatccatgcacactgcatatgttcttttgtgtttgctttcttttactcaacctaatgcttttgagattcattcatgtttttgcttgtatcagtagtttattcacttttctttgctgagtagtagtccattgtatgaatatctgttgttcatttctattacaataatattacaattttgtacaatattagaacatttctacttagtaaggaacatggtcattatattggatgaatattcactgttcatttctattacaataatatcttacaactgtacaatattagaacattactactaaataatgaacattgtcattacatcatacgaatattcattgttcattgatagtattattactactaagtaataataatttttcttgttattcttatttttctaagtattctagttactaaggaaagtagcttggccctcttcatcaaggtaattttttgtgaatagtattagcatattgcaactatgtttctggagccagcctgccaataaatgcttcttggctgtggggaaaagaacacccaaaaatctgaggcgtgtacagtattgtttaataagtagcatttcattgtatgaatagatcacaattaattcatggcccatgcaactgggcttctgtttcaatgtatccattcctctgtgatgagtttttcaaagtggatgtgtcattttacactttcattggagatttttcagagttcctgttgctcttaagtttaaaaacagattttaaattgactctagatttatatggactctattatagtctgtatcccattatgtaataaaaatgaatgtaagaatttaaaattttgaagtgaataggaaaatatcaatgatatattgtgaatagctttttgatgaaaaggatttctaatactttggatatcctgtggctattatagttataatgccagccagctgttatagccaatcagtaaagaaattttgcagtatttaataaatggcaactgagtaagaaagatttgaaaaagtaatatttactttgctgcaaattttgaaaccagaattggtcaggcaaatacatttacaggattctagctaagagaatgcacttgaaaaatttgtcctaggcttggccctgggagagattatgaaagaccctgatgaggttcagtattcaaaaggtttccagaaatttccccatgcttgatcatgtatcatttcaaggattctaactctgaatcccttcttgactcccaggggctcaatagaggtcacagtgatattggctctttcatagctagaaagcttctctgcagaagaaattaggataggaaaaaagggctaaccaccaaagtcttcatattagtcttctctagatggttgtctaagttgttctctgggccagcagaataatcatcactgctagcttattagaaatgaaaattgtcagtttttatccaagacttgcagcattagaacctctgggagcagagcccagctctctttgtgttagtagccctatagattattctgatccatgctcaagtttgcgaaacactgcctgaggtcagttctgaaacaatagctgatgttgcctgtgtccatttatcttattttattcttagttcttatatagagaggatgcttttgacctatggttttcttagatttgacctctggttcagtatcactatgactatattttggtttctacttttcctttttttttttttttggatcttctgaccctgattctgtaattttctagccctgtgtctcagatgtactttacactggtggtgtaaactccaaacatacagttgtttggaatgatataaaaggaatggtgcattgtgattcagcatttgattgaggaggcctctggaagacattctgtattgaaggaatcaaagagacagttaaaagaaggtgctttacattcatttcaaagaccagagcagcctgacaatttctaagtggtagtatacttgcagtatccataagtaaaaatttaatagattgactttttcccctacatcccttctttttaaatttcttgtgtacatttgggaatagttaaaattgaatggatgaaaacacaaaattgtacatttaaagttttttagaagagttcatattgggactcataatggttcatggatggactaataaatatggatgtagaattattataaatactggctgacatttatataaaaataattgggagttaattgggagctacatttttacataatggtccattaggttaattatgcagtactatcgttcctcagtatactcaggggatttgttccagcccctctaccccaataccaaaatccagagcatactcaagtcccatggctggcctgtggaacgtgcatgtacaaaaagttggccctccatatatgtgcctttcataggccatgaatggtatattttccacccacatttagttgaaaaaaatttgcgtataagtggacccctccagttcaaactgtgttgttcaaaggttaactgtaatcttaaccaaatggaacatagtcaagtataagtaaggatacaaaaagaggtaagtgaatgccaaagctgggctttttccctaaagttatcttccaggtcctggacacattgatcttctgctttgatgattctatagggcactgaggatgggagataaagtacagagctcactttaggtagagactttgctaggagcccttgattaaagcctgtgggaccacatctgcagtgtgaggtgcaaactttggaatagtctaaggtaatatttacaaaatctatgcatttaagaccttgtattttatttatggaatggtatcttaaacacataaatacatttatgaattatgtaattccataaagttagatatgttaagttatgctaatataaggcctcaagtaatatggaaatttatttatctctaatataaatgtctaagttggcagtccagggctagtgtgatagttcctcagtcatcaaggtaccgggcctcttctctctggttactgtgctgtcttcaacatgtagttttcagttcctggtcctaggtagctgcaccagctcccaatgccacatatgtatttcagctaccaggaagggaggaggaggaaaggaaggtattctccttctctttaaagaataacttgaagattgcacacattaaatttcgcttcccacgggtcacatctaatcatatggccatgaccacacctaaccacagaagaggctgagaaagctagtctttggcttaagtgcctaactaaaaatgttattattacacaatgacaggaaatggatattgagggacaactaccagtctctaccacaattacttgcatggtttccaaaagaagctataaattttaaggagggaagagatctgtttgaaataattcagctgtttaccctttgactcatagtccacttctaggaatccattttggagatacattggcaaaaatttgaagaaaatgttactggtcattgcagtgccctttaaacgaacaagaactggaaacaacacatttgcccatcactagaggattttaggttagttgaataagctaagctccatccatctgatgggttacactgcattgtttaaaggaaggagacagatctctttatattgtggtaatagtcagggtttgattggagaccaaaactagaagaagcaaaactgaaagatataagaaatatattctaagcatctgaccatttgcagctgtaaaaactagttaaacagtttaagaaagattgttgcttctgtgtttgatgctataacctgaagtccacggggaagactgtgaggaaaggaagatggaaataaagtaggggggaacaagaacaaaatagaacttgctacagtggattggaacttaggtccatctctcaccacctccaaggcttagtgtaggaaaaacgttggctgctaggagaccgggtaggcggctgtttgaatagcctgtttatatgatatcatggagaaggcctggattagcagaaggaaatgggttagaaatttttttagattatatgaaatatttggtgtctaaatgaatttaaggaggggaaaggagaaggaggtgttaagagtaagtgtagaataagattttcttttctggtattaatggaggaatagtagattagataacctgaaataaatggtgtgtgattgtgtgtgtgctgattttaaatatatactgagctggcatgaaaattagaacgctgcagagttcaaaagcaaagtggagctcagaattctgggaggtaagtgaatgccaaagctggctttttccttatagtcatcttccaggtcctggacacatttaacttttctttgatgattccatgggggcactgaggacaggagataaagtacagagctcactttaggtagagactttgctaggagcccttgattaaagcctgtgggacccattcacagtgtgaggtgcaaaggtggcaggatggaaacttacctgtcttgctctatcctcttggagaagaaaaaaaaaatctcttctgagagtttttatcacaagatgaaccttacacaggattacaatttgagtatgtgctagtagtgcggtctgaaagcacttaagcagataattaaaagtgattctgtgtggatggtgtccatgaaaactgttggaaggaaacaaaatcctctctggagtcacttcaacttaggttagcaacaacccagatactcccacagataaagctccgagtaaaagatagaatccctttgagcggaaacaagaaaaggaagctataaacccatgtagactttaaatattaaaactattttataagaaatgcaaaatgaaggccacgtgtggtagctcatgcctgtgatcctagcactttgggaggctgaggtgggaggatcgcttgagcccaggagtttgagaccagcctgggcaatatggtaaaaccctgtctctacacaaaaaatgcaaaatgtagccaggtgtcatggcatgcgcctgtggtcctagctacttggaaagctgaggtgggaggatcacctgcgcctggggaggctgaggctgcagtgagccatggtggcaccactgcattctagcctggatgacagtgagaccttgtctcaaaaaaaaaaaaaaaaaaaaaaaaaaaaaagcaaaacatgggtttcatattaaaaaaaaggagacacttgagaatacaagaaggtgacaagcaaagttgaagaaaaacaacagaaggtttaaaaagaaaaatataataaaaatctccaatggtttaagcccagaaatttataaacagataacgggggaattgataaactggaagataaaaccaaagcaataaccagaatataatctagagagataaagagaaaggaaagagaggttgaatgtagagggatactgagaaggtctaaatacatctaaggaaacaaacatgagtgtttttcctaataatatttatcagcaaaattttgctgataaaaaagtgattccctggcatatttttgccattttgcctcatcagaactaaaccagtgcagtaggaaatatttcagggaagcatcaactactgcctgcttttccctcctgtagtactatcaaggtagagatgttattttctcaagtctggagtagtagtccatatataatctctaaaataaagtaggtaaaggatactaggtaaagggttccttaggaagctaaaggtaggcatcaacaagttaacttgtcaactttaaaaacaatttacctgtagtgtataattttaatctgtatccatatcatttatattactaaatcctgtttaagaatgattcacttacagaggtaaatgcaaggcttttgcttatggttgctgggcagagctctcactcactggttaacctgggcacctctgggtttcttcttttccttgtagaacatactctttccatgcttactgcccttatcttacccaatgtggttctgaaggggctgacagtcatctcatctgacctgcatgatctcaggacatggccatgtgcctctatctcagccattctgatttcttttctggtattttctacgtggagtcagagtttaactttctatgggtggtttgcctgggatgatgggagactggggctccaaattactcttactcctttaatcttcctttgattagtaagcttctttcacatctctccatttaatctcattttaagtttaacatactttgagtttcagtctcctgtagatgttactaataggtaattttgacgaatacataatcttggctagagaagagatgcctcttttaagatgaaaatatccttcgttaatagcacaataaactgcagctgtcatgatttaacacagatacttcttttgtcttaataggtgaagtaggaaccccctctatttactcataatcatatttcataaggttgctgagaggatttaagtgagattatccatgtgtgtacctgcctagtctttaagtaccattagaacacttatgtgctagacgctgggctatcttgtgtagacatggggactatgtcatttaattctcacaaccagcatatcaggtaaattctgtcattattgccattttatagatgaggaacctaaggattagggaaattagacaacttgcccaaagtcacacaaccaggattgggcatgtttggcacagatggtgacttttaagaaacttgctcaagctcacagaaataatgagcgatggatttaagttttaaaccaagacattttgacaccagaggctgccgtctttctaatactaccctattttgcatcccacctaattattattgaatggaggacataaatgaaatataacttcctccagtgtcctagtttcatgtcaggaaatagctgtctagtttttaaaagtttcccacataattaaaatgatcttattttttattttttcgagacagggtctccctctgttacccaggatggagtgcagttgtgtgatcacagctcatggcatcctcaagctcctgggctcaggtgattctcccatctcagcctttgaagcagctgggaccacaggcatgtgccaccatgccttgctaattttcgtatttctcaatttttttgagtttttgagaaactcaatttttgagtttctccatgttgcccaggctgataaaatgatctactttttaactgaatggaaatatatacagttggcgctttttatctgtgggttccagagccataagtttaaccaaccatagattgaaaatatttgaaaaaataattacactgaacatgtacaggccttttttcttgtcattattctctaaacaatacagtatagcagccatttacatagaatttacattgtattaggcattataagtaatctagatatgattttaaggataagggaggttgtgcataggttctatgcaaatcctgtgccatttagatcagggttctgagcagctatggatttttgtatcttcaagaagtcctgaaccaaacccccatgcataccaagggatgactgcactattcatagccatgacttaaggtagtacatccctatgtagtatatagtccaaggtttgaatatatatatattgcattaatttctccattggcataggattaatttgcttctttgaaagttataaaaactacatgtcacagtctggtctggttacaggtagggggtttgggaacctttgcaccttgtaatcattagtcattaagggacctagtcatatgtccccagatagaggcaaaggcagctgggaaatgtagtcttcctgcatttgggcaagaagagatgaggtcgtttggcccctgtgcagcattgtgccagtcacagttcctgttgatctctctgactccatcatttctgggcctgatctctctgactccatcatttctgggcctgtgctcataaactgctctctgtgcaaacctctgggctgtggtgactctcccacatgtccagcctttagaaatgatttctttcaattcaaccattaactttataaatcgtacagatgaaaataagtcatatattctttatgcagcaattttcttgaattttatttctccttattttgaatatgcaatcaatatatataaaactttaggtttcctgaacatagaaggagaaagtaacctaataatattttcgatttcctgattatttattgtaattatgacatttgagtgcaatgaatctttttagaaatggagaaggatgtttagaaaaggtagataaggcagaaaaatccagctggtgtaaaaaatgtacaaaatagtgatgattcaaaaagagtgagtcagtgtgacattatcacatataggcatcttgtgaagaagatattctttaatgtcttttggttttacttaattgaatgacacatgacatcagtgatattgaattaaatatgattttcatctgtgattcttctagtgggaaatcaagacagactaaaagactaaaatccttgtattgtttgtcttgtttctaggatttctggataatccaaaaatacgtaaaaataggacataatgatattgaggaacttttttagcagatgtactaattgtgtatgaattcatatattttgaagagacgaacattatttaaagtagctttttaatggtagaagacttaaaatattttttgccaagtatcagtgtacgtaaagagagaaattaatattttgtattttacattaagcagattaatttgtgcgggttagtatatttaatgctaggtacactcacaagagtaagttggatccattagtgggagaaattgaattcatttgttagatttttaaattagtttctaaattgaaataatacacataatttaaaaagtcaaatgatagcttctaataaaaaatagcagttccttaccttacccttcaccaaatccaagcatctttccccacaggcaacaactttcaactcttttagttgaaagagttgaactccagactttaagaaatgcattttatttataaatcatccagtcttaggtattctgtcctagcaaaacgaagtggactaagacaattaggtttgctaaatgtcagctggatccttaactacagtgaggtagttctgataccctcttgagtttatttaatttcttctttttaaattaaaaatgtatacaactgctgaaaatcagataattttattttgttgtacacaatattataattaaggcattggtttacaatggcttaccttattttcttaaaaatatttatttttctcattataaaggtaacacatactctgactgtcagccatcgatgcttaacaggccactcctgaaactcagtggctaagtcaacaatgttctttatatagctcatctgcaggtcagcatttaggccggtcacagctcagcaattctggtcttgtctaggcttcctcataggtctatagtcagttgtaggtcaggtgtgggttggatttgctgattttagttgggctatttcaccagttgtggctgataggctttggtctatctgtccctttatcaccctgcgggctggctcaagcttgttcacctggtggaagcagaggttgtaaggcccttgaagcataggcttggagttgacatactgtcacttctgccatagtatgttggccaaaataagtcacaaagtcagcccaagttgaagaggaggacaaatagacaccatctcttcatgggaaaagatgcctactcatattgcagaagggtgtgaatacagggagatttggattctgtctattgcttaatcttttatatatgtttgtactgaaaagtacaaacaaagataaaaggaactcataagtccatcctctaactactgttgactttttgttttatatactgtaagactgttttatctatacttttaaacgtatattattaatttatttcagtttccatttgattacaagtcatgtttgtttatttcatatttcttctatgaagtggtcaagtagatttctattttgttcttaaaatcgcatggtagcatttcttgtaaatctacagttccagatatctaaagccggcaggacttcagctaataggcaattattctattttgtgatgagaaggccctgacttagtattgagtagcaggaagaatcaaaaggtgttcagtcaactgacagtgcaattgcctttgaatttgtttgtatatcttctgtgactgagttaataaactgaactattcatggaataggacccagtgggattttcttatgctatggtatatttttaatattattcacttttcaggctaagtttgaccgtaagcagatatctatttttgatcattagctttaaggtatttacattctcaatgactaagcttaagctatgtggtagagtgatttatttttgttcctgaataaaattttaataccatgagtcatgtgttttctttgtaaaaagttccagcatcacagaactatatagcataatatagtgaaagttcccttttcctactggctcactttgaactcctttccttaagcctttttctgtgcttttatatttacatacatatgtgaatatatagaatacatttacttccatgtaaacagattttgtatgtgtaacataaaaatattgtattataaacattgttttgtaacttgctttgcaaattattttctatccatttagtcaagtatgtgagtgtataaaatgtacacacacaaataatacaaataagagcatgttacaaatattgtataacttgctttttttaccaatatatttttgatatatttctgtatctattcacataggcttagctggtttttatattcataaaaccgtattcattttatagtcataaaatttcttcacatgtaccttcacatgtatcctttccctattatggaacaacgaattgtttctaaattctggttattttaaaaaatgttgaagaaaacatctctgcttgtatatatatgtgtatgtagaagaagaaaattacgcttgtgttctttattgtaaatattctacaacctgtatctcttaatccctttcttgctttctctaagccccatatattcaatttagccctgagtaatgcatgattgacgaagccagatgctgtgtgtctaaacagcagttaatgaaaaactatggaaggatagggaatcattaccacaggtactgtggggcggcaagactcaataaagtaactgttactaaaatctaaaaatgaaaacaggaaatatttgtcagacatttaacttggcaattgtaagagtgaaaaccttgtgtttttattcacttgtgtatcagaatttgccgttttttaattaagagttattttttaagagcaattttagattcacagcaaaattgagagatagacatggagattttccacatacccactgacctcaaacaagcatagccttccccattgccaacatccccatcagagttgtacattttttacaattgatgacctatgttaacacattgtcatcactcaaagtccatggtttacatcagtgttcactcttagtgttgtaccttctgtgggttgtatgatgacatgtatctaccactataatatcttgcagagtatttccactgtcctagaaattttctgtgcttcatctgtttgtctcccctcacttcaacccctggcaaacactgatagctttattgtatccatagttttatcttttccagaatgtcatataattggaattatgcagtatgaaaccttttcagattggcttccttcacttagtactatgtatttaagattcctccatgtcttttcatggcttgataactcatttctatttaatgctgaataatactccattgtttggaagtaacacagtttatttattcattcacctgcagaaaggtatcttggttgcttctaagttttgacagttatgaataaagttgctgtaaacatccatgtgcaggttttggtgtgcaaataagtttcaacttattcatctggtagtaattgttttataaatttgggagctccagtgttagatgcatattatttaggattgtgatattttcctgttggagtagtccttttatcattatgtaatatccccctttgactttttaaattgttgttgctttaaagtctgttttgtctgagaatacctactcctgctagctttggtttccatttgcatgaaatatctttctccatccctttaccttaagtttatgtgagtccttaggtgttaagtgagtctcttgaagacagacagtagatacttggttggtagatttttatttattctgtatctcttaagtggagcgtttaagccatatacatttaacattagcattgagatgtgaggtactgttttattcatcatgttgttgcctgaataccttttttttaaagttgtctttttttaataggccttgtgagatttatactttatagggaggttctattttggtatatttcaaggttttgtttcaagatttagaactccttttagaagttcttgtagtgctagcttggtagtggagaattctttcagcatttgtttatctgaaaaagactttatctctcctctatttatgaaggttagttttgcggcatacaaaattcttggctgataattattttatttaaggaggctaaagataggaccctaatccctcttggcttgtagggtttctgctgagaaatctgctgttaatctgagaggttttcctttataggttacctgatgcttttgcctcacaactctgaagattctttcctttgtcttgactttagataacttgatgaccacgtgcctaggagatgatctttttgcaataaatttcccaggtgttctttgagctttttgtatttgaatgtctagatctctagcaaggacagggaagtttttctctattatcccctctaataagttttctgaactttcagatttttcttcttcctcaggaacaccaattattcttaggtttggtcgtttaacataatcccaaatttcttggaggctttgttcatttttctttgtctttcggttaatttgtaagccttgtctttgagctctgaagttctttcttctacttgttatagtctattgttgaaactttgcagtgtattttttatttctcttagtgtgtctttcatttccagaacttgtgactgttttttctttatgatatttatttctctgtataccttttcatccatatcctgcactgtttttttttaaattttctttaagttgtttttctaccttttctggtacctccttgagtaccttaataatcaaccttctgaattccttatctggcaatcagggatttttttcttcgtttgaatctattgttggagagcgagtgtgatcttttgggggtgttacagaaccttgttttgccatattaccataattgcttttctggttccttctcattttggtagtgtttcagtggaaagaactggaactcaagggctgctgttcagattcttttgtcctgtgggctgatcccttgatgtgatgttctccccttcacctggagatgggacttcctgagagagctggactgcagttcttgttattgtctttcttgctttagccactcagcggggctgctgggctctgggctgatgctggggaatgtctgcaaagagtcctgtgaggtgatatgtcttcatatctcctagctgtggatgccagcacctgctccagtataggtggcaagggagttaagtgtactctatgatagtccttggttgtcgttttgtttagtgtgctggttttttcgaatgctggttatgccagcagtgaagttgttatgtggacagacttagaacctctggttagtcaggatgttgtagatggtagaattagctgttttctccttttttggagcagggttattctgttatgtcttgagttggttggcctctacccaggaggtggtgcttttaaaagagtgccagctgtggtagtagaagggggatacaagtttgttctttgttggccaggatgagtacttgggttcttcaggcaatggatggggctttagagttctcaagggtttatgtattttggctcaggctaccagggtgggtagtgaaaaaccatgaggtgggggcaggcctaggcaggtctgagctcagactctccttgagcagggcttgccgaggccactgtgggtgatgttccggggcattacagctgcctctgctgtgtcatactggtcgccagggaaggggggaaagccggcagtgacaggcctcacctagcttccacgcagccagcaaggccaatctcactcctgccatgccccaccaacagcacacgtttatattcaggcagctggggagagcggatagatcttgccccagactacaagccttcctgctgagaaaacaagcagggctctcaggccttgcccttttccgtctgcctgcaccatcagctgtggcttctgtgcttgtatctgcaagttatatgtgcacttcccatttgccccctggactctgctcaggaaaatttgtactcagttgaacgtattatgaagttcagctagaagcttctttcatcctatggcccctccctaattccactggctgccttccccaaggacccctgtgagataagtcagggatggctttctctggtttgagccgggaactgggagtgcctacagggcgcttcccgctccttcttctactttgatatttcacttggctgcctaaatccattttaacttcagatgagattaaattcttctcctgtgatctggatttttaggttccccagtggggatgtctgttcagaggcagacttttcccccactcacactttgggaacttacagtttttcagctgtctcatggagtttgcagtgtcaagctacttctttcaaagtaagtagcctgtgaattcttttggttttcctggtaggttcctgtggtggttcttggaggaaaagtttacagtgtgagtctccacacactgttctgtctgtccaaatgggagctacatgttagtcctgtcttgtatctaccattttctccatgttggtaatttagatctttgtatttcctctagcttttaaaattttagtagtataaaattttctttgcagtatcatttgattaaatgtgttaatacatgtatttggaatcatgcctgacacatagtaaatgcttaatacattttaatggtgttattaaaagttgttgctattattatcatataaaaatctcctatgatttattttaatattaacacttaaacctaagcttttatttagaatgttgggggcatgagaactaattagaagaagtattctaactcagtagagagggtaggggtaagggtctgtaaaacattagcaagtggggtcagctgatatttagccagtttcagagttagtctaaaactaccaacagagtaaacaggcaacctatagaaggggagaaaatatttgcaaactatgcatctaacaaaggtctaatatacagaatctgaggaacttgaacaaacttacaacccaaaaacaaccccaagcaaaaaagtgggcaaaggacatgaacagacacttttcagaagaaagacaatcatgtagccaacaagcatacgagaaaatgctcaacatcacccatcattagagaaatgcaaatcaaaaccacagtgagataccatctcacaccagtcagaatagctattattaaaaagtcagaaattaagagatgctggtgaagttgtggagaaaagggaacatttatacactgctggtggaaatgtcaactggtttagccattgtggaaagcagttttgtgttttctcaaagaacttaaaaaagaattaccattcaacccagcaatcccattattgaatatatgcccaaaggaatatgagtcattctaccataaagacacatgcacgtttatgttcactgcagcactattcacaatagcaaagacgtaaaatcaacctaaatgcccatcaatgatagactgggtaaagaaaatgtagtatatatacaccatggaaaactctacaggcataaaaaagaatgagatatgtcctttgcaggacatatctggaggccattatccatagcaaaacattatccactatagctggaggccattatccttagcaaactaacacatgaacacaaaaccaaataccacatgttctcacttataagtggaaggtaaacattgagtacacacagaaaagagaacaacagacactggggatctacctgagggtggagggtggaaggagggtgaggatcagaataatacctatcactgaggttggtggatcgcttgagccaagggtttgagaccagcctgggcaacatggtgagacccccgtctctacaaaaaaaatacaaaatttagccaggtgtggtggtgtactcccatagtgccagattcttgcgaggttgagatgggaagatcactcgagcctgggaggtggaggttgcaagtgagccgagattgcaccactgcactccagcctgggcgatagggtgacaccctgtcttaaaaaaccctccaaaaccccaaaacccaaaaaacaaactaccaatcgcttactatgcttattacctgggtgatgaaataatttgtataccaagcccccctgacatgcaatttacctatatggcaaacctgcacatgtacccttgaacataaaataaaaataaaaataaaaaaaggttttctgaaaagagaggaattgtttttgcagtttagtagccattgatggggtggttcagatttagcaagagaggtggatagaaacagttgctgggtctgtggtcatatgagggccactgtggtacatttttagtctttctgagactcttacagattatttagaattatttacaacatattctaacatatttgggagtgtattttatcattttaaatcaagccataatcttccactttttgactacaggccattcctaatgtgtttctcagaatgtgtgcaaagtcaaatatctggaagtcaaatatttacttacatttaataaatagatttctttaccaagagagctaaaataaaattctatttaaacttcaccttttatacacggttgtcagtaatatagtttccaacattttatatatacctttaatttttttctttttgaattgatcagttcaagtgacttaaatgcactgagcatccagctgaggttaaaaatttactgtgtgcaacatagcaaataatttctcacttgacccttacttattctctttggtgataagagtgttttcacttttctgttttttacttataaagtattaagggcaaataagaattctaataatatagaaacattgctatacaggcagtgacattaacaatgcccaaactgaacacttgactagcagaaagggtgttgagcttccattcttacagctagcttatcttcagaatttcaaatttagaataaaaggcatataataagccctttaggagttttcatctacactatatatataactgtgtgttgagcataagttgaaaatatgaaaatttaggtctgcccatacttagaggcagataggtagaaaacactaaactcttaaggccattaggtatttagtaatttttatgtacagttactttttaaagctagaaataaagttgtaggcttataaaaattacagttgagaaaattttctcagtaatatatattttagaacatttattaattttattaataccctttcagcatctctcagtgttgaacttgaatttatgaattctagctaatttatatatctttagcactgaatatagctagggtatgaagtgattaatattggactacaaataatagtttctggctatgtaaataaacttggagttcttcattttttgtagtattaatgcatgatttaatatgaaggaatttatgttcaagaaaaatacagatttctaatggaggagtgatatatagtaatgcactgaggcagatggtggatgataagtatgtatagatcacacctgctttatggaatgtaaagcttgattcgtgtgtaaaaaattaatttgagaaaatggtagggaatggctgggagtctgtgagagaattctagatttaacactttgattagtctcaggaaaaacagccattatataatcttaggttatattttctatttttaaacaaatatggcaagcataacacctccctttttaaaatacacagtttttgcaatttttcaagacttagggaaaggatcaagcttgatatatgtttatatttaatacttctgaaacccattttgggcagatttctatctactataacagtggttatgagcttggaccgctgagtggccacactatctataaccgagttctttaatatgtctttgcctgttttctcatctgtagcattgggataaatctagtagcagtcacattgagttgtaaggataaaaggtgatactttaaaggtgcttaaacgtgcctaatatgttgaaagggctcactaaatattagcttttctcattattgttaatatattggagttttatttcataaaaggtgaccttttcatctaagtgctatttataatttaaatctctgttaggtctttgttagttgtctgtcatcctcacacttgcccttctgtgttttcttctgtaattcatgggttggaagcaagtaaactgtattttcctcacccctttgctagctgagtttcattagagggtgggaggaaggtagaaaggacgccactgaggtttttgaggcacctttggtagtggcagttgaggagacttcgctgtgttgcagtgaccgttgttccacagtgtagatggcagcgatgttggtggcagggcatttaatagggatgggtctgctcagcagcagccaatggtggttccagcactgatagtggctcctgtgggctgttgggtccagctcagagatggtagcagcttcctgatccctggtttgcattgtttaaccatttgttactctagcccttccaaagtctttgtaacagattccctgaattaaattaaatttttctggagaggttgccctcgagaagagggtgctcatcaataaaatcaacagttgtcatttaatgttagatatgcaataaggaattttgcagtctaataaatatagcatgtattccccgtatatctttcttacctgaaaataattgtgttttgtcagtgtgtcccagtgactttttctgtctcctctgcatttaggaagtcagtggacacagctagtgcttggtgtctagggggaattgttgctcctcatgggtaatattggatttatgaaaactgagggacttacattaccaaaagcatgatgtgaaaaatatattaaatatatactaatatttcaatgatttaaagtcatctacccaatagaagccactatatttcattgattctaagctaccccttccccccctcatgttttaatatctctggtattggattgtgacttaaaaacagtagcatgttgcagtcatctcatccagtggccagtagttgctgttatctgcttatgtgccaatataaaaatcataatacagcttagaataaaattccagagacaccagagaaggtgtctcttttgacaagttgaagactcttttgacaaggagatgctaaatggttgtggtgaggtagaagggtggggaagtgggaaatcacagtagtttaacaacccttggaagcaggagtctaaagtaggctgtgcctaattactgagctagcttgagagcttagcatcaatctttcaattttttaatgaattcatttaaaaaagtgctgcatcactgatgtgcttggtgacacagaaaatgagattctctggagaaatgtggacactgatatatgtcaaagagtgagggagaagaattacatttggatttcttcatgaattttaggaattgattaaaccaacttattttgcttatgttttgtttttatgtctgtgtcagtgtgatagataataaaaacccatatctaattaagtcttttttctttcaataagaataaaataaaagttctaaaaagtgtatcagtttaattagcagttttttttctaatggttcatacaataatgatgccctttattgaaatatttttttctatctctgtataattctttttgttaggtaatattttttcccttttaaactctatgtgctgatgtagaatggctttaaaatatcgcccttttattcagtgttcaattttttttttgcgccagttttccaatttaccttgtaaaattgacaccctatgaacaaagtttattctatatgtgtagctccttgctatagaaaatgcattggaaaatatttaccaaaggaattcaaatatattaaacatgaaagacaaacaattgccagtaaaactggtgataggagaacttttgctacactattaaatgctgcataccagagagtacagtatacaaacaaacaaaaaaccctaagggtaattgcaaagattgaacaagttgtgttataaatgtggccaaattttaatgtgttgtgtgttaaatatactgatgcatattatggaatatcagtctcatcaaagcttctttttttgtttacattaaatgagacagggaaatgtaatgaagttaatttggaaattttataagaaatatgaaggtgccttatcatatcattacttttgtgatttatatttgccaacttttttttttttttgaaatggagtcttgctctgttgcccaggctggagtgcagtggtgtgatctcagctcactgcaacctccatctcccaggttcaagtgattcttatgcctcagtctcccgagtagctgggattacaggcacgtgccaccatgcctggctaatttttttctatttttagtagatattggatttcaccatattgcccaggctggtctcgaactcctgaccccaaggtgatctgcccatctcggtctccaaaagtgctgggattacagacatgacccactgcacccagcaaatatttggcaactattttgaaaagattcctaatttatctcattatgcaaaagaactggaaatgtgagacttaccagttaattaattattgaagaaaaaaattagactgcatttgagtttaagtgggtccaagactttctgtttcaagttaatattgctgttcatttaaaaataacaggtgatttttttttaattttcagtgttactcagtgataataagaaaacattatcctctgaaacaataacagtataaaacatttacgaccttaaaatcatgttttatatgtacaagtatctcagtttaagaagtctcctggccaggcgtgatggctcacgcctgtaatcccagcactttgggaggccgaggctgacgaatcacctgaggtcaggagttcaaggccagcctggccaacatggcaaaaccctgtatctactaaaaaataaaaaaactagctgggtgtggtggcgggcacctgtaatcccagctactcaggaggctgagacaggagaattgcatgaacccaggaggtggagattgcagtgagccgggactgtgccactgcactctagcctgggcaacagagcgagactctgtctcaaaaaaaaaaaaaaaaaaagtctcctggttacatgaaagatattagctgattatgacttgatatatttagactgttgattggtcattggttttcatttagtggtcaagagtgtctagcaaaatgctgactggcatatgcagacactgaatttacatcttcacatattcatgtctctcaatattcagaactcagttaaatttatccaggaagataaggaggtcataaatagaataccaaatgtggttttgcttcttttacagttagagagctttgttaatatcctcattttcttcatttgtactagcatttccaaacagaatttgtttcacaaggaagtatcaatgtatagtgtctctgtcaggccttgcattaagcccagtttctcatagtcggttttcaatgacatttctaatttggtatactttctgttatatcacaacttattttcccagccatctaagggagacttgttaaggtgggtcaacctcatttttgtttttgattttaatattaaaaattttgttaaaatttttatttcgaaatagttcaaacaaaaagattgcaaaaatagtatgaagaattcatatgtacctttcactcagcattcccccatgttaacctcatacataaccacggtaatattgatcaataccaggacattagcatggatacaatactattaactgctctgttcacttaattccaatttcgttaattgccccactaatgtcctttctttggactgagattctatccagagtctatttatcgttctttctccttagtttcctttattctggggaagacagttcctttgtcttttttgtctgtcatggtcgccacatttggtcagctcttttgtagactgctcctcaaattggatttgtctgatgtttcctcatgattaaactcaagttatgtctttttggcaagaatattatagaagtgatacaagtgacagagtgtccatttcagtgcatcatatgagatgatgtttacttgtttttactcttctgttatgaatatgtaccccactgctaagaatgccagcttttagcctttgtgcagctaattatatttatttttcaagatttgcctttttaaaatggttttctttatttgctgcacttcatttgatctctcacttctttgccttccttttgccataatactcagtaaaaccttgtcatgcttatggcttgaaagtctatattgtgttgtgggagcctcacccactgttgctcccaggagtcctctctggtttattcccttgggacactgagacttattataccaatttattttgtccaaacatgctctcaataatcactgtgggttaagtactaccaaaggttggcacttaattattattttatttattgaaagttaattttatcttctaattagatggtatcttcttgccagcgtggacaattctacagattttttttttgattacttggagacagaaacaaatatttttaatagtatcttgatttagtctttctaatatagactgttaatctttagatttttcgataatttaaggtgaagggggaggaaaagattgggtacaactgtgtttagggaataatttaaaagtgattactagaagaaagtgcacttagttttcttgttcatatattctttcttatctctagcatcagtgctaaaagtaacagttggtatagaagtgaaaattgtcaaaaaaagactgattaataacctcaaagctgaaaggagattactaattcagaaaatgacagttgtaatatagaaatccaatattagtttatagttgattatcagttttatacagaaaataatagtgaaaagaataactctttttttagccttaatgactctgtcattgaattacttcaaattgtgatgatattttcttcctaagagctgattaatttaatgtgttcacactttgttccaataatggtcctaagattacaggtggaatactgggacacaaaaataacacaatattttgtcagagatgaccaaactcattagatacagagacaaagccagaattgggtttctggttgggtagatttacgcccctcctacctttccccattagactgaattttaacaaaccagacaggctttctcaggtatggagacttcaaatatgctgctgtaatcagacagcatgagctaacatattttaggaatatacttgacttcattttaaatagagaacatttatgttttctcactatttcatgtgtaatgcaatatgaataaagccctatccgagtttcatgtttgtggggaaactagcattactgcagattagtgacagggcagagaaatgaccttattatctctgtaatggtaatagtgtgcttcacagggaaacttgtgttgttaagagtgagttgttattttgttgcagatgctttctgcacaagttattaatatattgaatcagaaggattggaaagtgctatctagggacttaggaatataatttataagtttcagtattcacctttacttgaaatatgtaaatctgattttgtagatgtatacacaagcataaacatggtttcacgcttgtgtataccttttctttctttatggaatatactctctatttttcttgtgtcaagtacctctgtctctaagacccacagcagttgtatcctccgtgatgaaacctatccctgtaaccgagttgttgcttccctttagattcccagagcaatttgttcccattgctatattatgattttatttgttggcttataaatctatttccatctttgtaactcacagttgagcgtgtgcttctcaatggcaattcagtttttcaattcatattccagcatcttgcatgatgcctgcatatattgagtatgcagcaactattcaatgaaaaatgtatattaaacttggtatatatatatattatttacacacctcacctcttccaaaaatgtgtttaagatggattataagctatatagcaaattagaagaaaactgggagaaaaaaggaggaggatgggaaatagaatggggccaaggatgagcaaattcacagcatgaatctctaagtgaatgtgtagtatgaatgagtgcttttgcatgtacacggaagtgtatatgtggaaacttacaatatacattaaaaaaatctatcctgtttgatatttgcatttttacaattttggccttgaaaagatttcttatttttctgagttgttcattttgtcactatttatctgatgctgaagtgtttctctgaggaatgcttattagtcctaagattctaatgtaatcagcgtgtggtgaaatagagcggtgtcagttagtcccacttctgtgaaaataggaatctgtaatatgactctgtgtggtgctctttagcttctgaagattcgtgctctaactcctgtcacctgctctcttctagaaagcacatagccgtggggtaggaatgcaacaaagctaacttggaataataaccttttcctggaataaatatgttttaaattaaatttaactaagaagtatctatgaattctagcttctctcaggtgacttgtttgccaaatttaaataaatggacatattaaaattaattcttattctcctgttctcaggataatgtttaagcaaatctaagaggaggtttttttttcttattgtaagtatggtgtttttaaaatagagaataaaactttgtttgctttgttattccttagttaattgttaaaataatgaggccttattatttggggtaatttatttaagacaatagagcaattaattgctcattggcaacctgacaaaggaaatgggccaagatgccaacccatttcttgtggtctgccagcccttagaattgtgtgttccagggatttgctaatcaccagctggtaactgatttacaaggctggaaagacaggaggactcttgaatcatggccacttacaagtaagatggaatgtgtactggctttaagccttgtctactggcattcagatgttgctgccaggggaaagacttgatgatggcaaagagcctgtgtgctatctttggtgcatttttccgatgtcatcagcattgttcttgaccctcactttggtttaacaattaagacctgctaagtagaatatactacttcagtgatatgtgtgtgcctctctgtctatttgtccacccgcccgtccattgatctatccatctgttcatccatccatccatccatccatccatccatccatccatccatccgtctatgcatctatccatgcaatgaatactggggttaagccatcaatgaatgggctagaattaacctctgaaagcattgtttacaattggggctggcaatctttttctgtaaacgaacagatggtaaatattttaggtttgcagaccatactgtctttgttggaactagtcagttctgctgttgtagggtagaaacagccgtagacactgtgtaaatcaatggcatggttgtgagccaacgaaatgctgtttacaaaaaaatcaacttgcagctatagttagcccacccctcatttagacagtggaagtatccgactcaacatagtttgggagctacacaaaaacttttaaagaagtgtatgaatgcttataagttttctaacactgctttatgttccaggtttgttagcttaattattgtctattttgggatttatctaaaaaagtagttttatagattttactgttttttatttaaacatattaatcatttaaatgatattaagctctcactgacactgattatataaatgtcattggattggaaatctacaaaaaaacaaggaataaaattcaccactctatcacccataaagcacccattacatttaatagtttttacttataaacatgattttaaaaactactttgacatggaaatatggtcaagtatattgatgagtgaaaaaaatgcagattgtagaagagttctgaacagtgtgtacaatgtgattctatttgtgaaaagaaaaaatattatatatgcgtacactaacatacggtaaatatctgaatagatatggaatcagttcttagttttcaagcaaatgaaatcaactctccaatataagcggaagaaatttattgaaggataataaattactcacagatttctggagtccttgagaatcaggtttagaggccatatatctagaagcaataccccaaataactggttctgcaaagaggccctggcaactgtcagtctgaatccttgatactactaagcctagatgccggatttgcctccactgttagcagtattccagaatgaattctagacagttactgctcttctgtgtcatcagcttccaattcagagtctgctgtgggtgcattggattgccagagcccaagttttgtgccctggctgcagaggaaccttagcggggaagaatgtggaactcacttctgtagtggacaaagggccctgcctcctaaggtaggggatttaccaaatgtaggaagaggattcagaatcttggatgccagaaagagtgagagccgtccacagcagactcctgggaaattgttaacattggttacttctggacggtggagttggaagggctaactgggagccttccagagggaggcttttactttaattttattcttctgtcctttttgaatatacatatataataaaaaagtccatggggaaaatgaacaaaagggaacaacagttttttccagcatttccactgatagtattttcgcataagaactcaagaatggctaggcgcgatggctcacgcctgtaatcccagcactttgggagcctcggggggcagatcacctgaggttaggagttcaagatcagcctggacaacatgttgaaaccctgtttctattaaaattacaaaaattagcagagcgtggtggtgcgtgcctgtaatcccagctacttgagagtctgaaaatcacttgaacccaggaggcagaggttgcagtgagctataagattgtgccactccactccagcctgggcgacagagtgagactctgtctcaaaaaaaaaaaaaaaaaaaaaaaaaaggccgggcacatgcctgtaatcccagcattttgggaggccaaggtgggtggatcatttgaggtcaggagttcaagaccagcctggccaacatggtgaaaccccatctctactaaaaatacaaaatttagcctggcagtagtggtgtgcacctgtaatcccagctacttgggaggctgaggcaggagaatcacttgagcctgggaggcagaggttgcagatcacaccactgcactccagcctgggtgacagagtgagaccctgtctcaaaaaaaaaaaaaaaaaaaaaaaaaagaactaaagaaggcttctcagcataactgggcagttttatcaacttcgtactcaattttattttgaaattcagtttataattttctcccagattcagtcatctctatataacttggttgggcagagaagttcataaaatggttttctctcagataccagtggcttccttttggcttggtagagctgatttagtttatctttttgaggtctacagtattcagctttgaaaagtaaggtgttgtcagtgactctgattgatgaagtgttcatagatctaaggtgaaaaaatacaatctactttaaaatttttggccctactattttttccaaacccccataaatttgctactttctagaaaattgatctgagaacttaattcagtttaataaagttttatcacatgtaataacaatttttaagaacaattttagatttacagaaaaagtatgaacatagtacaaagttcttagataccacacacagggtttgccttattaacatcttacatacatgtaggatacaattattatagttaataaaccaatattgatacattcttattgactaatgttccttctttattacgatttctttagtttctaaagtttatttttttgttccaagatagctgatatgttttatacatttatattgcatttattcatctgtgcagtaatgtcatggagccatatcataaatgctatttctgttttaagtaatacagaatttagagaaacaaaaaataaaataaagctttgctacagtgagcttcttaaattattttatgcacaagtgtcacctcagaaaaaatgtccttttttttttttcctgttctgtatttagcggaagaagtccctatagaaccatacaacatcccactgtcccaggccgaagtcatacaggaagggagtgatgttactctagttgcctggggcactcaggtgagtagcattgatcccaactgttaaaacctacgttgtgcttggaagctctcattttaaatcctgatacatgaaaaattgaaaacgatgttttctttatatctcagattaagtctggtgctactgatgctaatttcttttttccctcaactttattggtgtgtaattgacaaatgaaattatatatcttcaaggtatatatgtgatgatttgatatatgcatacattgtgaaatgattgccataatcaaattaattaatggatccatcaccacacatagttactattttgtgtgtgggggtgggggcgaggacacttcagatctattattttccctagtcactgctgtatattagatcctgagaacttcctcatcttataactgaaagtctgtggtacggatttctgagtgaaggtgaggtgtctatatatattaaaatgtatatgcatgtggtggccataaatatattacaacaatgtattaattagaaacacatatcttttggaatacatgtatacccatgttactttcgctgcaaatggctataatctttttcatcacatttcctgccatctctcatcattactttgctgctcacgtggacccatccactggtcaagcctcaaaattccatatcttcctttttttccagtgaccctctctgctgatccacttcattttccccccgacttgctgtcactttgctctacctcccaactttttctctggccacgaactcctatctcttctacttttctctctccttcttttacagatatggtcagttttaatttttctgtataaaggaaatccttattttaggaaatttagggcaatgcaatataaagaagataacaaaaatagttttcaatatcacaagctcctactctcctttccttttgatttttggcatggagagctagagtccttatggtttctcaccttcagtggggtaactctgctgcttggcgagttgtatcccattgatattgtccttggtgggtgtggcaaacctttttgctatccttctgtccactttttgatccacatctctgtggtcagctcatgaccttacttctctttttaatagggaggttagagtgtattaggtattaattcagataacttgctcttcctcttgcttctaattctttccttcttccctttgtcttgaagaagaggtgtctggtttacttagcaacctctgcaaatcagtttcagactgcgttccattttaccttctccaggactgtagtctattagctagtccatctctctcctgcatcttcagttttccatttcttgttgctcttatttaaaaagtatgtttctcttcactatttaaagattcctttctccttaaatacgattatgtctccctccttttaacactgaacttgaacaactgttttctagtgtctgtatttaatttcttaaattcattatatttttgtagctgtgagttctattcccactaatttactgtttttgtcaacattactgatcttctagttgtttaaattcagctcttattcctgctatggtatgtgatactggctgctatccctatgaaatcttttcctcttaagtttctgcaatacactgtctcctggttttctttctagctctttaaccgttctttttatctcctttttttctttccttccctccatttttccctccctccctccctctctttcttccttcctctcctcttggtccattttttccttaaatgttggtgatttttaccctttacttctccctctacatgctttctacgtatttgtatgacttcatttaccttctacatgccatctttgtaatcagtatctgtggtactgacttctctctctaagcacctctttccatctgttttctagacatctatacttgttattttcgcagaatatgggcttcaacatatttaaaacaaatttataaattctccatgcagatcagttcctgagactttaaatactgtctctaatagtgacatcagcattcaactagtttttgaggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccctgaaacctttggccaaatatgttgtatatttgcaaataattcttttgaaattgtgagctatgtgagcattttcaattgatttaaaacttttaaatttgcagcatgaaagaaagttgtataaacagcttcatgctcaaggaaacaaatcactatagaatttatttttcctcctgtagtttcctttgtttaaaatattacaaaatggggtcctttatgcagtcaccttgggttgaattgtgtgagtcatagagcatatcaaggatgccgaaggcacctgtgtttttgacttcttattagttatggttcagtaagctaggtttaatttagtcaggtaaattaagtgatttggctgaattttcatttatcttctctccaaaagtaatggggatggattttttaaaaacataactctgtatatagtcttaatactgtggattacagtctaagggttatgtggagattctggctcctctaatttacagtttctatctaagtagcctcatgacctttggcctgattacattggtcttgtttttactattaagatttacatagccagttccctcttaagaatatagtttagctctcatttacctctttatatccagtatctttcacaccaatgccaagataatttaagaagcatctattttcatattgatacaaagaaggttaagcactctgtttgtaatagtcttatcaattaagtctagctacatgtaaattatatgtacctagtcttaatagataagtacaatagatatatgtacgattaatagatagatgtacaattacatgtaaaattgtaggaaacaatgacatgtattattttttcttgatatactgctatagtatagggcattttatatttaccacttttaagagctttggcattttcatagcttttacaggctctttcttgggttagttacatgaaaataacctgcagatactactgtaaaagtatagcctaggatgtttttaggtgaagagtgttttataatttagtagaagatgtaagatttgttatagtaaatgtttgtgaagactcacttgacaccatctaaacacttgacatgcttacaaatgatcccgagccattctatttgtagttgctgtaattaagagcaatatttcagattgagttattcatagcttcatgaaaataacgctttttgcaggcattttcaaatcaagtcagacaccgggttttctttcaaatagccagacgttccaaattatagttaaactagagttgtcttcttgtttgcaacatatatccaccacttatcctggggtttgtatttttagtgtagatggtgcttttgtatggggatatgatgttttatgatggcgcagtgcggagggcattcacatatggtcagggcaagcacttttagaactttatttacgtatctatctatatatatataaataataccttaaacattcaaaaagcatttgtagcagcttattgtaaagcacaagtatactaatacttcattttggcaaccgtggaagcaaagagagtagagttaggggcagaaagaagggtgaagttgtttatatttacatcgatagcagtttgcttttgcatcactgtgttaaatctgttggtcgcatctttgtctgatcctagaatgcagatccattttccttagggctctatcctactgggaaagatgaaagaggagacaagcgatctctactgaatgagaaagtgatgcatcagacctctgacttattagcgtcattattttgttttgttttgggatgctttcatccggttgtgacagtgaaagccagcttcttgattgctttgggtctatttgagactctcttcgttgctgatgatggtacctctcctgttttcttttgatgtatcaaaagaggtaaaattttgatacttagctttttcctgctaggatttagagatgattttaaagaagagggccctataaccaaatatttatatggaaaatgagggttttttttcccccagagtgaagcttttttaattcatcttgatgaattctatagtaaccaaaatttatattataatctcttttaattagctgtgttttatcagttgtttttgtcttatgactcattagatcgctgagttttattcgttgtgtgtcaactaaaccccaatatatatcttttggaacgcctgatcaagaaaagaaagcatattaaaggcaaaaacgattcgttgaacacacattatcatactctatacactaaaatgcctctgggacacttgaggaattcatacttcttgcttaatccttgatacatggtttggaagttataaaccaaaataaatatttgctcggggatagagaaaggagcagagtctttgactgttgctcaagggagttaaaaaattagagacttaaatggtcctagaaaccacagctagtttttccactcaattctgaacttgatattaaaaagctaagctggagacttctgaaaagcacagtagaaaattcttgagttttgaagtgcttaagagacagagacctaccctgtgccatgggtgtgtgtgtgtgtgtgtgtgtgtgtgtgtgtgtgtgtgtgtgtaggtggattggcttaagagaatcagctgtgtgagttcaaagccctgaaatgagtggcatgttgacaccgatgacctatagctgctttttagttggctacacttgctatttggtctcaaccaggtgtgtagaatccaggtatatagaactcatattttgtggggctgtagtgacaaaattgaaattttgaggggatttaaacacatacttgaccttttatttgccaaattctaaaggtgtgaatggtgaaaggtaagtagaaaatatctggaaagtgaagctatcacttggtaatgaagtgacaaagacccatcatactctcaattgaaagccatggagagttaggtcttacaattagaggcaaaccagatgtagaccaggtcatctcaaacccacaatacagcctctacccctttgaattttttattgaattatgtacttttactctatctgcgcagcagagccaaggagtcaatcctctcattatctggaacttctataaaccagcattcaataaaaaactaagtagatgaagagacaggagtatttgatcaataacaaaggggaaagaaacaataaaaagcagaagcacagctgatccagatattggagttagcagacaagaacatcttgattgttatgcttaggaacatagagaaaataaggaacaaaagaggtaagagggtggagaattaccctagaaagtttgtgtgtgtgtgtgtgtgtgtgtgtgtacatgtatgtatatggatcaagtaaactttgtggagccatcagagaaatatatatctgacaataagaactcaatgaataggcttataacatatcggactcagtagatgatagcaataatgaactggaaggctagttaatagaaaatgtccaaattgaagcacaagtcagaaaagaggataaaacacatttgggatctggtcaaaagatctgtcttatatacaatttgaattccagaaaaagaagagagagaaaatctctaacagtatctaaaaaaaaattctcatgaagatttcagaacatcattacacaagctttgttaacttttaagattatattcaaagaaaaccacacctgtatgcacaatggcataacatcttaaattgctgactgtgctagcctacaattctatattcagtgaaaatatcttttaaaaattaagatgaaataaaaatagtttaggcaaacagatattgagagaatttatcactagcaggctctcactaaaagaaggtactgcaagggagctccctttggcagaaggaaaatgattctaaaagaaaatatggaggagagcatacactatagcttagtattgattatccgaaacagtagtcataattttctgtgaaagtttaagtttagtgaagtttaagttaaatatatggaattgaaatgtaagacaataaaaacacaaaagctagggggtcttacatggagttaaaatattctgttgttctaggattattatgaagtgtaatgttctggttaggttataatcaaggatacaagttataatctccagtgtaacaactgaaataacagggaatgaatgcatatctagcaagttaataagagaactataaattaataaaaatatttggttaatccaaaataaataagtatgaaaaatggatgggtcaatagataacagatgataagatgatataaacccaaatatagaagtaattaaattaaatacaaaaagattaaataaacctagtaaaagtctaagatcctcagacttcatgaaaaacaactaccaccaccatgtgtagcttaaaaaaggcatactttaaatataaggacatcaaaatgttgaaaatgaaaggatggaaaaagaaagctggtgtagatacactaatttcaaataaagcattaaggcaaaaaggactactagaagtgaaaaggagcatttcattatgccaaagggaccagtccaccttaaatatatcataatcctaagtctatttcatccttaataacatagtttgaaaataaataaagccataaactaaacaaagaaaacacagaactcagaagaggtatgaacatattcacagttacagcaggagactttaagacatccctcttaaatcttgcttaatcaagcagacaaaatctcgtgaagtgtatagaagatctgaacaaagcaatttgtaaagttgtcctaattgtgcaccaaactatcaatagaatatgtagcatttgtcaaaattggccaaatgctggggcataaatataaccttaaaaaattccaaaagcttggagtcattgagattatgttctctaacaatagtggaattcagttagaaatcaagtgaaagaaaaggacaactagaaaagcctcgacttcctacaaattaagtaccttactctaaataaccgtggattacagaagaaactcaaaaattagaaaagaaactggactgaatgttaatgaagatagaatatatcaaaagtttcaagaaccagcttaagccatgctcagaggaaactttatagctgtaaatatataaatttaggaaataggaataagaattaaaaaaattaatgatctgaatttccatctccagaaagaaaatcaaacctagagaaagtagaagaaatgaagtaattaagagcagaaattactgaaattgaatctgtagagaaatttaataaagtaaaatttagatctttgaagagattaatgtaattgataaacttttaactaatggaaaaaatagggtagaaacaaaggacaaatatttgtttgtatgatgaagagcccacagacaatggtaagacaaagaggatgttatgaataattttacaaataagttttgagtaaagttgacaattttctggaaaaatataagtcattcaacattgatacaagaggaattagaaaatctgaatagtcatgatctattaaaaaattaaatttaatgttattaactctcatacagagaaaaccccaggcctaaatggctttattggtgaattctctaaaatgtagtccttatgcaaacccttacggagagtggaatcaaagagaaaactttcaaattctttttataaggccagcataatcttaatatcaaacgtatttaggacagtataagaaaggaaaattatagacagcttttaaaataaatgtagagcacataatgttcataaatattcacaaagcagttgatacaattcctcatgttaacagaaaacaggaagaaaaacctgactaccttggtagtgcaagagaagtatttattaaaattcaatatttattcatgattaaaatttcatagcaacctagaaatggaagataattatcttactctggtgaagattagttgcaaaatgcctgcagcaaaaattataattcctagtgaaattttgacagctttcctcttgatattaggactgtctagggaaaaatttcgtgatacgtatgtcagaactttacacagaaaatcacagaatattatttaggaaaattaaaggcccataaactgaagcatatagcatgttagtggattgtaaggccaagaagagccagagcaatcttgaagaagaacaaaactggaggacttaattatcaaatgttgagatgtgttattagtgctgtagtaattataacattatataggtataaaaatacacaaatagaccaatggaataaaataagagtctagaaacagacctgctggttatctgattcaggacaaaggtgactttgcaattttgagaggaagaggtagttttctcaatagaggatgttgattcatttgggtactatgaaaaataattatattaactcttaccacacaagcatcagttacagctgagttgcagatctaattgtgaaaggaaaaaataatgctcttgggagaaagcataggtgaatatgttcatgtgatcttgtgcactaataaaacactaacgttaaaaaagggctgataacattgtgcttcattacatttaagaaaatttattcatcaaaagggtgccaataagagagtaaacaggtaattacagatttggagaaactcaaggaaacttatatctggaaatataaagtacttacacaatcaaaaagaaaagaccaatatccaatagaaatatgggtaacagtcttgaaaaggtacactaagtgttggcaataatgtggagcaattcaactctcatagactattgttggtaacataaatttgtacaaccattttggaaaattgtttggcagtatctacctgaaccctataacctagcaattccaatcctgtatgtgtatatgtgaagaaatatacaaaaaaaaaaaaaaaaaaaccagaagcgttcataggaacattacttctagtagccccacactgtaaactgccgaagtactcatcaactagagaatggatcaataataagtataatattgttcagcgatgagaataaatgaactaaaaatgtaatggaataatgtatattcatctcataaacacaaagaagccagactcaagtaagtacatactgaatgatttattttatatagaggtaaaaaatagacaaaactaattgatgatgttagaagtcaggctagtgattatcatgagagtggttaataattggaagagtgtgtaagggctatgagttgctggtaacagtttcttgttctgagtgctgattattcaggttaaatttttgaaaactgagccgaacactcatttggtgcaccttttttgtatatatgttaaacttgaacaaaatttttaaaaaagaaataaaaagaagcactatcttctgtttaattcatttcctttacttcacattgtagtgagcccttttatggactcagggagagagagccttggtgtccttagccaggaagattttccttttatcatgcagctctgtccacacccttcgttcagtttctccctgcaactcagctcagctgtcatgctgatgtgaaacaggagctcataagtagggctgttctctctcaagccttcccaggagtaagaacagtggttagggttatgggctttaatggactttcctgctgacatgcagaccacattcaaaatgagttaaaaagtgagctgccgtgttaacaaaacagtggccaggccgaatagctgttgaggtgctgtcaagcttgaaaggaagatttttcttaaataaggagaaattcagagaaggtgccttcaaaaataagaacttgattttggcaggagaataaacaaaaggctttgaaagaaactcagattctcaagcatcgttgtcatttaatctagaatcaactacataacaacactgcaaaaaaagaactgaagcacaatcatttacaaggtctaggtgattttcacatatctatagagaagaaaaaactgacacttataattctgacatgtttaaactttacctgaagattaaattatgctaattattaaaatgtataagaatttgcctttataccgtacagtctttttaatttatctttttctggtgtgtcctgcctcccagattaaattccaaagcatatcctgctggctttgcctacataatatgtccaaaatctgaccactgcttgatcctgctgcagactactagcatttctctcctgggttttggccatagccacctaacaactgtcttgcgcttctgacctttccttgccataggcagagttgatacttttaatctgagtcatatcatgttccttctagtttcaaaaagcctcagtgatttcccattgagagagaagtcaaattccttaccatggcctacaagaatttacctgatttcatcgctttccacctcctaccacccatccaccctttagaaaatgttctttctccagcaagccccttcattcactctgttattctatcaggggaacctgcccccaacatttcaacatagattctttctattttccataagtgttggctggctgagaaataaagagaaagagtacaaagagaggacttttacagctgggccaccgggggtgacatcacatatcagtaggactgtgatgcccacctgagcctcaaatcagcaagttttttatttattaagggcttcaaaaggggagggggtgtaaaacagggagtagatacaaagatcacatgcttcaaaaggcaaaaagcagaactactaataagggtctaacaaagagcacatgcttctgagggaacaggacaaagggaaaaagcagaaccactgacaagggtccaacaaagatcacaaggcaaagggcaaaagcagaactactgataagggtctatgttcagcagtgcacctgttgtcttgataagcatcttaaacaacagaaaacggggttcaagagcagagaaccggtctgaccacaaatttaccagggcggagtttttccccaccctgataagcctgagggtactgcaggagaccagggcgtatctcagtccttatctcaactgcataagacagacattcccagagtggctgttttagaccttcccccaggaatgcattcctttcccagggtattaatattaatattccttaaaagaatttagcgatatctctcctacttgcatgtccatttataggctctctgcaagaagaaaaatgtggctctttttgcccgaccccgcaggtggtcagaccttatggttgtcttcccttgttccctaaaaatcactgttattctgttccttttcaggtgccctgatttcatattgttcaaacacacatgttttacaatcaatttatacagttaacataattatcagagtggtcctgaggtgacatatatcctcagtttacgaagataacaggattaagagattaaagtaaagacaggtgtaagaaattataaaagtattatttgggaactgataaatgtccatgaaatcttcacaatttatgttcctgtgccacagctccagctggcccctccattcgggttccctgacttcctgcaacatcattctgttaggcactactcaaataccattaaggccttccttgaccagcttatgtgatactgaatcctatcaagacttcctttcaccttttccttctttcctcttctctgtagtgattagcatgagctaaaatgttacgtactcttgttatttacattgttgatctttcttccaagttctgtgacagcagaaatttttgtcttttggttcaaaaattcccagtacctgcaacaatgactgtgataggattggtgctcaataaatacttgctgaaaagtaataaatattagcaagagaaagtttaacaatgctatgaaaactgttgtaatattaaaatgttttcaatttggtgcttcttcttggtgctcataaaaaagtttaaaaagtaactttagaacagtattctatgaataaatacattagtttattctaaattgaaatatttatttaaaagttttaagttttgctttgaccttgcatttgacttttcttaatggttgtctatgtttcataatggcatatagaaattatttatttgaattcttattagaataggaacaatttatctactttgaaaggcaaagtgaaattgactgtacagtaaacttcagttattcttaatttctaagacatgagttttatggataattacattttctgaatagatgggagttactatttgtatagcagcttttaaaactgggtctgtcctgaatttcgtagccatcacagccactgtgcactgctttagatgagggttcttctctgttcaaatacaccctgttacaagatactgtctcccagtcttccctccccctcactctctgcccaaagcaatctcctacctttttgaagttcttgggaagtgtttttttttgtttttttttttttaattttaacaaaattagaaaatgatagagaaaatatcttcatttctgttccctccatttttctctccagctctttttcctgctttccctttcttttctcttttaaacataggttatgtagtagaagatgaagacatactcatagaaatgaatagttgttctttgggtacatattgggcatctctagtctcaagatattttaggggtagtctatcataggagcaggataaggccttaggggaaaggagctagaagtaattcagctgtggcatgagggagtgacagtagctgggagggagggctcagtgttcttagatttagcattctttcctcccatcctttcaccccaattatttccattcttgctatagaagacttcactgggggaactggataatagcaggacaggcactaaggctggcagagttagtgggaatggagacgatcagggagcagaggtcttcagcaaaaaaggaaagggaaattgtagagctggaatggggaaggagtcaaaccttagtaattggatgaaggaccaagtttgtttactctttgcatttgcacctgggtgttaatcaccaagtatttgtgaatggtgcagaagatgttctgaagacccatagattaaattggaaatttaattctgatttgttagactgaatagctttaaactggttttatggagaagttgaagaatttgtctatagagaatctctaatatttaagtattgccagttaaaatatacattttaaaaattggttacttgaacttaagtgaataattccgtgactgaatactagctattttgtttgaggctgtgtctgtttgaggggagcagagggggacagaaagtgagttaatgaaatcaagaacattctcaaacagttgaggggttgggatggaaagggagctagtaactacctataaccactagaggcctctcttaggccaagtttcatggttaataccactaggtttccacagcggggcctggctctgccattgtaaattaaacatatgttataattctgaataaatagtatgacagtagttttattctagggcattattataatgtaacctaaatggtttagcttatatatcagaataactgatgatctcgtgaattgaaaacaacaaattagaattattttctctcttctttttctctaaacctttagttaaaaatgtaatcaaagactattgctaggtaaaattatatgtcttcttgaccgtacaaggatatatgggtttaaaattattcttgttacatgttgtgtttaattgttgagagtagtttatatttctgagggtagactataataaagtcattttaagtcatatgttaaaaattatgtgtatttctttcatgcttataataagcctctaatataaaaaaaaactaagaaatgattcaaagatctgttagacttaaatgcttttccttaggcatagggaaaaatggtctcattttgtgtgagtttggaattattttggatatggtttgaccttgcagagaaaacaggtagggcggtgccctcctctcagatgagaatagtttgtttctctgttccaaaacaggatggctgacaatttgaaagttggtccctcctgccaagtcattcttcctgtaggattttctttgtcatgatcacaactagttagttgttgtactaattggaacaagttctaggctgttggatgctatattgggatgtggctactacattgattgtcctgcctgacagcccttggccacttcctttaagtcccatgagggcagggaattttgtgtattatgttcattgctatatctgcaagagtcctgaagagtttagaatatagtagatgctcagtaaatatttgttgaaccatctgaaaaataacgtggcatttggtttttcagtgaaagaaattaaagaactggtaaatcctctaggaagaaaatacactgagattatcagtcatgccatggggtctatttttattatgatttacattttaggtacattttaaagaagattaaaataataactatgggttctgacctaatgttatatatatatactttttgtttttttgagacggagtctcgccgtgccaccagtctggagtgcagtggcacgatctccacactgcaatctccgcctctggggttcaagccattctcctgcctcagcctcctgagtagctggaactacaggcgtgcaccaccatgcccgtctaattttttgtattttagtacagacagggtttcaccatgttggccaggatggtcttgatctcctgacctcgtgatccgcctacctcggcctcccaaagtgctgggattacagacgtgagccaccgtgcccggccaatgtatcttacataataggacttagttcctggtaaatggtaaattaaaaaagttaaaactacatatgttatgcatgtttccttttgtattcaaacagttcttctaattagacatcagtgtcattattttatagggaagaaaactgaggtttggggaaggtggagcagcttacagccagtgggggacagcactggcttcaacccaggttgctggataataaaaattgtcacttgagagttttgctgatcaaatgcttctaaatgtcagcttagaacatattttatcatatgtcaggaattttctttcacatttgcccacctttataatataaagatatgtgttttacaggtgggcaaatgtgacctgtatacaccttgtaaatcacactaccatattttctttcatttagcattttttttccttccacatggaactggagaaagcaagattaaattatataattatattgttccatttcacatcccacctgatgtgtttttggtgtcctcttatacacttaaattatttgagtttgactcaagttttcattttgtttaaactgtttgctttcactgttacgaatagcagtgaaaagaaagaaatccgttacctcatttcataatgaaaaaagattataggtacattatgttcttagtttaacattttaggtgtaatacaagaaatctaaatgtgttgactttctgttctttctttgatggcgtttaactctctcccattaaactggtgctttttttacgaaattgtatttattctgtaatcgttaagaatttcttatcttttctattataacaccctggctttgcagtgctgagcagtgataatttaacttaaaaatttattgaaactgtgatgtacaaaggtttaacaaaaggatattacttttctagtttattccaaaactggggccagctatggtggctcactcctgtaatcctagcactgagcctgaggcgggtggatcacttgaggtcaggagtttgagaccagcctgaccaacatggtgaaaccccacctctactaaaaatacaaaaattgctgggcatggtggctggcacctataatcccagctactcgggaggctggggcagagaaactcttgaacccgggaggcagaggttgcagtgagccgagactgtgccattgtactccagcctgggcagcaagagtgaaattccatctcaaaaagaaaaaagaaaaaaacaaaacaaaactggggctactcttaccagccatgaatagtcaatctttccaaacacgtactttctgtgctttcatttttttcttctaggaacttggtttgtttctttacgtgtttatattttcttttatgtgtttaattaagttatatagtttcttacataactatttcacatctcaagtttatcttttaatattctatatttggcattgtgatcatatcattacagttttttctgtatttccctttcctttttcttttttgaatgtggcagaagagatttaaaaattcaagcaatccattaacatagcactaaaacacacagtacaatggagcttataatgcaaagtatcatcttccttccctgcccctactccctaaacacagccacttttaaccatttctgtattttattcttctgaaggccacttccatatctctagcaatacattgcacagatatttctgctataatggagtatatacatttctgcagagtaaattggattctccatgcatgctcactaaaaataacagggtttatggaaagaaaaagtgcgtgtagcaaaccacttaaaacagcttggtaactagagcgaagaagggtttttaaccagagtcaggaaggattgagcctgttgatttatggagttcagggcaaatgcatcaaagttggggagaaagatgtaataaacacttctaaatcagagcagatgggccagcctgagccaagagacatagtgcatggtactatatttctctgaggcttgagtcagcgctgtggctctgctttgcgttttgctttgttcctaagtggcataaaacaatgtgctggggcagattgtacatatgccaacacgactaggttggttgccgccacttctcactggaaacacatttcatacttgtgccaggaaaatggacttttccttgctcagtccattccctcatgtgtttcactgctgagttaggttttgtcggtggagcctgggtcacatctttatcttggctataatggaggctggaaaacatagtttttttatattctaccttgggaaagtggaattcataattaggagaactatcaaaatgtggagaatatgttaaaaagttttagatttttcaggaatcagaagcctaccacacgcacatgcactcatgcacacacatgcatataggtgtatacacgcacacgtatgtgtgtgtttcaatgtctgtaacttttgatttataaattttaacataatttattcaccactatgacacataacagtttagtgggcttgcattccctgctgtcttcatctcatatttcctcagttttgagttatgatattacctgtattttattttttctactgattacctctttattgtaatttattttaatttctatatcttactccattaactttgcttagaatcttttgacctctcactatgtaagaagatgatgttaatgccctctactcctatatccactgttctttcctcccttccaattcccattttctgtcagctgattatttttacattgccaagactgagaacattacattgttttataaccgaaatgaaataattaaacccttgattttaaaagttgaaaagcagtacacactgttaatattattatgataacaaatatttttcaccactgttgggggtaagattttatttttcacttgaggtccagtgcttggtctttgggaccctaaaaggagattctcttggcatctagatcaaatggtttgccttttaaattagtgcattaactgttcaatgtcttgccacattctgaatgtttcatatttgggctgtggcattcttttagatccttttggattttttagttttaattacctttcattttctctttgaaaaatcaagacaagcctttaaaatatcttgaagatcactcatattcttttttggaatttactctttttttttttttctttttttggagacagggtcttgctcttgtcacgcaggctggagtgcatggtgtgatctcagctcactgcaacctctgcctcctgggttcaagctattctcctgcctcagactcccaagtagctgggattgcaggcatgcaccacgatgcaccactaattttgtattttttagtagagacgggatttcaccatgttggtcagtctggtctcaaactcctgacttcgggtgatccacacacctcggcctcccaaagtgctggaattacaggcataagccaccgcacccagggtactcttagttctctaatttccttttccagtcttgactacccttctctatacctgctgcacaacaatcaccagggatgtttctccacttcactcttaaaggcaccatttcctgggtcctgcgatttgctcttccatggttatctttctcattttgttggagtacattcataattaactttttaaagcaaagggcatattgggtgcaggaggttttctgacacttgtgttaggtaaaatgtttttatttggactcaacatttgcttgatatttggctgcgtatagtattctaggttcacagtaacttttacttaggactttgaagataatgcttcattatatactagtgtcacattggggtagaaaattttgatgccaccctgattcttattcttttatacatgatctctctgtgtgtttgtttttctggaagcttttgtgattttttgatacattttatactgaaatattacaggtgtgaatctaaatatgagtctgtttgactcatcttgttttgcctctcatgactttcctctgggaatggcctacatatttaaggataattatattctttcttttttttgtatattttcttttcaaaaaactcttagcagttgtatgatagacctgctaggttgattctgtttctcatttcttctctcctagtttttgtcctgttgtgtttttacagtgttttgcatatttcctttattgtatcatttaattttttttgaatatttcaatctcatcaatcaaaatttcccccttgtactcagttatttttgtatcatgctatttgttttttttttttttttgtcatgtattttccttcagttgttacgggtatatacatttttttcaagttatgttctatagattatctctgtttctttagtagtgttttttttttttttttttggtcatagttcttttcttcatttgtgattgttgattattctggatacctgactggtgcagctttcctttatgtctctttcttctctaggcttttccactatggaaaaagttgcatagatctgtgcacatggatgagacattgctttagggtaaatgaatgagaagttcatccttaggcagaaggggttgccactaggttagcaaatgggatactcttgattcttggacatcagtgctcataggataagcctgtctttgtaggcaatttgaatgctttttatcagagactagctctttttcttttctttttctttttttttttttttttgagatggagttttgctcttgtcactcaggctggagtgcagtggcaaaatctctactcactgcaatctccacctcttgggttcaagcaattctcctgcctcagcctcccaagtagctgggattacaggtgcccacgaccatgcctggctactttttgtatttttagtagagacagggtttcaccatgttggtcaggatggtctctaactcctcaccttgtgatctacctgccttggcctcccaaagtgctgggattacaggtgtgagccaccgcacctggctatttgcctgattatctctggcatcatgctttttatttgggttttatttgggggaagtggagcaattgatacaactgtgttatttaattctgttgtttttattctcaattcttatactcacctctctacctgctcatgagctcatcttctctctgggagattagctgtttcttccactgtacctccatttatctccgcattggcttcctctactctttgtttatattttcatcacacacccacaaaagacttgttcagtctctcttgtctaataatcactaccccttcccgactttgttgtttttgctgttacaggtttttccttttgtattcatgtcctgtcttgagagaaaagggacatgaaagcgtatactcagtctgtcatcttgaactggaaagttttctctattgcattttcttattttttaataggcagcataatttgtgtatcttagtctgtgtactgtcatttcaccaaaatcttatttattctaatagtttctttattggttttctgagattttctaggtgggtaatcatattctgtaagtaaaacctattttcatctcttcttttctaatctatattcttattttttctcatttgtctagaacgactgaatgatgatgaatgaaaaaaatgatagcagacattaaatgtgatatttataaggcccaatttgaacttattgaattattaagtagaaaattgaaagtatcaacttcattgtatagatttctggcttactgagaaatgtatcagcaattttctgcataattagtgtttttgagtaaaagaatttggcacttacagccaaataccgagtatcttatatgtttctttttccaatagccacaattcagaattgggcttcctaaaacagtgtatccttccaatggcgtttcctaattttattattattttttaaaacgttttattttattttagattcagggggtacacatgcgtgtttgttacctgggtacattgtgtactgttagggattgggcttctagtgtatgtacccattacccaaatactgaacattgtacccagtgggtaatttttcaaccctttccccactctcaggctccctcctttcggagtccccagtgtctattatttccatctttgtgtctgtgtgtacctattgtttagctcctacttataagtcagaacatccagtatttgattttctgttactgagttagttcacttaaaagtttacctaattttatatgacaaagctggcaaatcactgttgggcaacatgattaatgttattgcaataagtcagttaaaaacaagtcatttaattggcagctatgaatcttcaactctaaagccaataaagatccagtgaaacaacgattactagaaagatacctgcatttgaaaaatatgcccctcctgattgacagctaaagaaagactcattgcaaaaacagactcattgctttttcctctgtcccttctttccctggatggatctaagatctgataagtctttcaacactgagtttacaggtttttttcttcatggagctgttcctgatctttttttcccattgtcttttaagtctgccttggagttgtcttcttagtgttcccgtggcattttccatccatctgtttcagagtagatatcccttagtgttgtaatttttaatatccttatctatttctctctaagagattgggtttcttggaatctcagttttttaggatgtggctaagaatcgtgaagtaggtagaagacttctaagcagcttgaggtgctaccataaacccatgtataaaagcacatacatttagtctataagagtggctactaggcccttaatcatatcccatcaactgttactttacatagaattctaacaaactttttacttagtttcttagcccacattagattggaagcaacacattagaagatggggaaaagttatgttgatgaaggtagggatgttggcaagatctaaagatgatatattgatagcctgaaaataagataactgatgggaaaagaaaaatctgttaaaagtacaaaagaatatagttttaaaaatcacagccattcatattcatttaatatagaaacaaggtaaacatctaccttgatagcatagtattataattgatgttccaaattatatctatcattgtgaagagattaatttctgttctatatgctgtgtttgaaatacaatattattgcttaaggtatgagtggggtgaactctcaaatgtgttgaataactcagccccctacagtgctagataaatgagttcttgttggtttctttctaaaagctgcagggtactggtgctttgcttctaatcattaattttcctttggttacattcacattaataataatgtcattaagtcatcttctgttagggcatttttctataaatttctaatttcttatgtcagttttggaaaataataaaatgacccctttctcttggctcttactattttttctttaattattttaatcatggaactacttatgaatttttctggtagaagccttagtataccattaattctgatactattttgcattaactctttgtgatattttctagacattgctttagctggattggtgggcaggaaaaaaggaggcgattaatcctccatttctgtagattgagattttgaggtgtgacagatacgatatgtagtaacagtactgcaaatccctgtgctggggcttgaaactattaatcttgttgtgaatcatatgagacatgtttcgtatgtctctccgtgtggttaaactcttccaggggagcttgggctggtggtgccaaagggtggagggggattgactaatctgttaaatagccttttatctgtgagtctagtttctcattagtatttctgaccagaagaatagatggttggaaatgtggacttttgtttttaattagtccctctagggatgagaggcttatttggaagaatggaattttaaggaagcctgacaacctcagtttccatgtgattgaaaatgtttggcagctgaaaaatgtttcacaattatgagttagagccagattttccactggctaagctgttctttgggagttagatacagggtaactcatatttccactttcaggtctcagtggctccgtttagggtgctgttcatgggactctaatgctccttccttcccaatggcccagaaggctcccatgaggtttattcttctatcatgtataataaactgatgaaataaccatatttcatctcatatttatgcattttaatcaggttggttgatgtttaccacagacatatgtctacaagcatttcattatctataaaagagagatttttttctttccttttttttttaaaacaaggtctcactgtgttgcacaggccgcagtacaatggcacaatctcagctcactgcaacctctgcctcccaggctcaagtgatcccccgacttcagccttctgagtagctggtactataggtgcacaccaccacacccagctaattttgtatttttcttttgtagagacgggctttcgccatgttgcctaggctggtcttgaactcctgagctcaagcaatctgcccacctcagcctcccaagttaagtgctgggattacaggagtgagccactgtgccagacccccaaaaagatattttcttcctcttttatactaccataaaattataatgctactgtattgccacagttttacaactgagtcagttttgcccaagatcctttgatctagccaaagttttgaagtagccaaaagtgcacagactttggaagccacgcagttcatctccctgtgcacttcaaggtgacaccctgacagatggttgctgagcacccactggatttttcccataaagtgaggcaaccagttcttttgttgtgcggttctagttgttacagttttccattgttgaactgaaatttgcctttctctaacttccacctattgattcttattcttccctcttgtatgtaacttgcctttgaatattcgaagacagcctcctcatagtcctcttatatctaggttaagcattccatccgttcctttcaggtgttatttaaatctcctggtttgcagatgcaccactattctgactaccattttttggacatagtctttatctctgatggcctttaacttaaaatggcattaaaatggtcctttagatatggcttgagtagctgaatgcctagtagagctgttttcctagaaggagatatatactttctatacttctgttttggaatacctgaaaagatagtttcttggcattggatatgttaagcagatgcacatatgttagggatgttgtagacaaaaagtgaataaaaagtatgttgggagggtggtgtccttacaagaataaatttaaatggctgttaatttttaacagcactattatgaaatatcaactataaaatatagggcatattacagtatataatgttggtaataatgtctgagtgaatattcttttcttagaaggtcacttaggtgcttttgttttttgaacaattcctgaataaacttgttagagtactttgtatctgtgaaagattgcatcccttgtcaaaaactttcaatttcacaaaaattccatcaacattttcccttcacagcaacatgatagtgctttaattttctcaatgtttggccacattgttaacttatttttttccccacttttcttcattctgctccttcctttgaggcagtgtttacttgttctttatagagttaacatttggtgcaatacaactagattgttagaaacttttaaaaaccctactcagtattgttattagcattgttttgtccattaccaaccattcacctgtttcctttcctaggataatgttaactgtgctttattagatgctctcagatatttaccaatgacatttttgtaaatggaatattgtttactcttaatcctaaagtttactcttaatccttaatcctttggaatgtctgttgaccttactgtaaatttaaggctgtataactgatagatttcagcaaattatggcagtgagagttttgatggtatctattttatgtcaagtaattcttcagtgactatgttaacatttcactgcattgtgtagagtcttattttgtttttccatgaggtaatttttaaaactacagggctattgagagatatttagtccagtaatacattccatataggggcattcaacgagaagattcttgtgttacaaggaaaggatgttaaaaaaccagaatctctcagtaaattgtggtctgtaacaattccatccctggggaagggcggcgcattgaaacttccatgactattaatcttgagagagagcatgcattgtcttgttggactgaagcctctagccatcttatcaagccagagctacaaaagtaggataactttgcatccctttttggcccactggtgaaaatgaaaatggtaggagtggatggacaatagattaggttctttgacaagtaagtgttgagtgacagtcatgaatatttcccatttcttgattttaccaattgtgtctctaaattcactcaccagaaatatacaataagaagctgaattttcttggattacttaacttgttttagtgaatgggtgagaaaggtttccagctgtagctgtcaggtttttttctgcagcaggcgcctgccttcagcgtttttgaggataacacgatacactctttcttcttttgctaccattaagcatattatgctgccttttgtaggcaggccaccaggctataagtcggactccgtagtctggttatgagctctgaggcatggagagggatctctggccctggcttttctactggttgctggatgaccttgggcaagtgagtcaacctcttctttatcttctttccactttgtaaaactgagactttctttttttctctagtcttaaaaaaaagtttgcaaccattaaatataaagggtaaacaagagtttcttgagtaagttaacacctctctggatactttagttaatatagataggattacttcttggattactacagtaaattaaacaaaatactctacatgcatttaacatgtattacagattgtctatattaaataaaagatgtaagtcgtgtctaatttgtagaagttatttcagtttcttttggaggaaagcaatgtagttatttatgttgtccctgtaagttgtattacagcattagagaacttctggggacactgaagaattgtttagtcacttaaacccttaaactccctttagggagtccagttgattcatgtggaccctccaaattatctcgtttcccaaattttaaaattgcattgggattatttcatctctttagggcttttttacttttcaatttaattttgctatgttttaaaaaaactagtggatgaattatgctcactctgaaaagtatttgggttccagtttacataaatttaattccagttttgtgtcccagaagtatgctatgtctttaaaattcagttagctcattaacactccagttctcatatttgagtgccctataaatctgtatacttgagtaacctgagctgcaatctgaagttaataatacaatctgttcttaggtatgtgaccgtaaaattccttaaagggagtcctgtgtttatgaatctgaaagtgttgagcttgaggtaacagtggggctaacatcttatgtgagggtttaaaaattataataatctactaatggtagagatgttttctaataagagtaattctgtgactcattttagttcccttgctttttattcctgtgagccatagaaagaacccactgtagggggttagaaatattttttcttatgattgtgggatgaaagagtggttgctttttccaaccaccatatgtggtgattaggcttttcagaatgacattggggtacacactgagcatacagcaacagtcttccaaataacttataataaataaagtatgtaagacgtttcccccagccagatgtaatcttcaatagtagaggaataaatttaaagtgacttcccacaggaaaatttgggaaatgcctggatggaccaagaaggcagtcatgctgttagaaataagcaaactcctttcctcctttcaggtgagaatatatgatggttcatttaaattttgtttttgtgatttctgggatttcttagaaaatgcatggataaaaccaaaaaactccagtgaactaaaagtctatttgaactgtttgaaccttgctttgcatttttgcttccaatattcaaaaacatttaagcagatggtactcagataagtgtggggacatctccctgagtgtgtagtaacagatctaatttttgtaaattgaattgtactttacatctaatagagacagcaccagttcctggggattcttgaaaggtggcaatctaaatcacctttattttctgagcttcctctcaggtgcctaaaacagcagcttcagaatttctgtgaggatgaatatgggtgttgaagtgggagatagctagagaacttgtcttgaaatggcattttgtttttcacagacagtgctttgagatgggttttatgtttatttaggtgggcttggggtggggggttttgtgatagccagcctttggtgcttgtactactctcaaaccatacccgagccacatgtgcaggcatgtgtgtagagacttgaggtgtactgacccaacttgtcaccagcctgggctctcagaaggtttcagaagtttgttcttctctctgctcgatgggagttaaaaagtatagcagtggagagatccagtgtgagggcctggacttccaaccttccagggagagctgggcttgggagactaagaactcctcaggtatgcctgaacatgcccagtagtctatagcaaggactggccactgaaacacaacagaagacatcctgccaaactagcatctcctgaaggcattctcgttaaaactgtgtattccttccattgtttttttcatttaacagatactcagtgagcaccttctgggaccatgtgttctagaaatggagaacaaagtaaacagagtagaaaatattttgccctcttggagcttagacactattgcaggaggcaatcagtaaacagatatactaatacatatttaagtcagatcccaataaattttatgaagaaaaatgaagcagcttacagaaatagcagagtgaagggaagggctatgatagatggttagatgatagttgtcactgaccactgctctcaggtggtgccttttgagcagacacttggtatctgagaagaagagttggcagcatgatagcatgtgcaaaaggcctgaggcaggaatatgtttgtcctattggaggaacagcaataagcttggtgtggttgtagtcgggtaagcaaagattgtaagagatgaagtcatggaagtaaccagtggaacaaaatagggatgtccattcttatcattagtaatcaacattatgctggagagtctaaataattagactagaaaattgaagagttgttattaaaaaaaaagaaaaagtaaaattatttgtattttagtgaacatgagtttatgcttttgaaatctagaagactttcactaaataatttagaatcaatgaaataattgagagaagaagcttgaaatacaatgactgtttataaaatctataggttttcctcatattattagtaagaaatagccagaaatggaaaatgacaaagatatcctatttataattgaaactataaaatactttagaataaattttacaagaaagaaagacagtggatacataaagaaaagaataaaatcttaggaaggctgttaaaatcagactaaaatatactgtgttcttaggtattcttaaacagtagcacataacaccatttaatacaaccccaatttgaattccaaaggggtttttaggttgttttttttttttttttttttttttttttttgagacggagtctcactctttcgcccaagctggactgcagtggcgctatcccggctcactgcaagctccgcctcttgggttcatgccattctcctgcctcagcctcccgagtagctgggattacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcctggccaggtttttttaaactacctaaaaatatttaaaactatatataaaaaatacatgccccaaatagccaagaaaaaaacagtgaagaagattttctattgcctgaaattaaaatttactgcagtgccatgtaaacaagctatggctgggatttgacatatggaacagggggttagcaattttttttctataaagagccagatagtaaatattttcaactttgtgggctatatggtctgtcttaattattcaactctgcccttaaagcagtgttttagtccattttgtgttgctgtagcagaatgccactgactgggtagtttacaaagcatgagatttatttcttacggttctggaggctaggatgtctaaggttgaggtgcctgcatctggcaaggaccttcttgctgtgccatgatgaaggaaaagagagcacgtgcaagagagagaaggaagggggccaaattcctcctttttcaagaacccactcgtgataaagtcattctgtagtgacatgagggctctgtcatgagagcttcattcatgagggctttgtctaataacctcttaacagtcccaccaaacactattgcactgagaattaagtttccaacacatgaactccagaggacacattcaaaccaatgcaagcgcagaagcagttgtaagtaataaataaatcagtggatgtgactggatctcttcattgccagtggttggccaattcatgatgtagatcttaaaacaaaatagtgctcagaaatagataatatatggcaagagtgctatttcaagtcacttgggaaggatagtttactgaataaatggtgctgacagtttatgtaaattctacttaattatacatacttaatgtatgatgctttaaatataaaaaccaaatagtaaaacaatagaaaaaaatttaagagaatattgttataacctagtgttgaagcaaagtttttaaacaaggcagaaaatatagaagctataaagaaagtatagatatttggctacataaaaaaggaatgttattatgtattataaacatttataaacaaaaataaacaaaaataaaaatggtattctgtgaaaaatatttgcaacacatataacagaaaaagggctattttctttacatccagtgtgcctctagaaatgacctagtaaaaacagggcaaagaacagtttctgaaaagaaaagccaagtgggcaatgactgtaggaaaagatgctcagtatcatagaagctgtaaccttttgtaaaatgggatagtaatagtacccacctcttagtgctgttggaaggattaaatcaaatcatacaaataaagtataagaaagtggttggggccaggcgcagtggcttatgcctgtaatcccaacactttgggaggccgaagcaggcggattatgaggtcaggagtttgagaccagcctgaccaacatggtgaaaccccgtctctactaaagatacaaaaattagccgggcctggtggcacgcacctgtagtcccagctacttgggaggctgaggcaggagaattgcttgaacccagcgggcagaggttgcaatgagccgagattgcgccactgcactccagccagggtcacagggcgagagtctgtctggaaatcactgtactgctgcaaactttctaaaaacagagtacatgtagttcactgccttttccaataaaccttttaaaatttattctgttttttcaacttagcgtcattacagcataatcttttggtgtaggttataataccaaaatgctttcagagaattaaagtatagggatatttcctacagcatccctggattttggatatatcctacctgcttattatagtggctcttttctcctttactggtagactgtcacctgtcacttccctgtgctggctgtttagtctaatgcactatagcactttctttaaccctttttttttttaatctctacttctgattgggaaaccagagagctaaaatcgatcaagatcaaccatagaactgttaacagagagaggaaagtaggcattctttacaattaataaactaattatgattttgtagtagatctattttataaatctaaatatgtatcagtatttttccaaacatctcatcttttttcagagaaatttactgtggggctcctttgaatagtagaatcccccttttcagttatatacatacatgtttatattctctctatagcacatatacatttgtatatgtatgtgtatatatatactgtatatatactacatgtattaaattctccttatggtatggttactatgtaaatcacctgtaaataaaattattttataaatataaatataaatgtaaatatttaatatatttaatattatattaaagagatatgtatgttctatatagagatatgatatatgttatagatataacatctatatctgtgttatatatgtatgagagtgtgtgtatgtgtgtttgtgcgttctctttctttatggcaagcatattaaaaaaataacagaaatccaagacaaaaattgcttgagtcttttaatcaagccattatcttcattttcattcatgtcactatgtgaatgcataatttgcatagtaatatgtaggaatatcatgagtagattttaatactttatattttcatttaatgcttttctgctgtcttttgtttttaaagttgtttcttcctttctctcagtactccctgtgcacaattgacatgtccaatactcatgcttaatatgcttgtttttatattttcaggtatgaaagacttttttggacttaatcattgtttccattttggcaccatttttgtccttatctcattaacatagtaagcctaaaatgtcctaattccaggaacggataaaaattccattccattttatattcaaaggtttggatttctaccttaatccatttcttaaagtggctaatgatttttattaccctagttgtctctagggcagtagcctttctcaaatcattttagtataactttacaaaatgaatgctgtaaatatactatgaaaccttcttgagatcattcccaactaagaatcaaaattagtgacttatctaaacattcacattcttttatatgttgggaaagttcacatcattgctcttatctgcctctaaattctttctctctggatcgatagtttcctgctggttttcagaatcaagtgcttcttatttttctgaaccttattaatcttaattaggcctccctggctctggggattatttagaatttcttcaggtaaaggtcacacctatttgtagttcttaatctttgcattttatctactttgcgtgtcaaatgttcaatgaaatggagctctactgtagggactcaatttgttagactgagtactctttcacgatcatctacatacatcaggttttattcagagacttctaaaaggagctatgatttttagtttctgaaattccaaaccccaataagccaaacagaacataaataaaaatagtcgtatagagcagcacttcccaacctttttggcaccagggactggtttcatagaagacagtttttccacagactggaagacaatttttccacagactggaggggtgggaaatggtttcgagatgaaactgttctacctcagatcaccaggcattagattctcataaggagcgtgcaccctagatccctcgcatgcacagttcacaatagtgtttgcacttctatgagaatcgaatgccactgctgctgctctgacaggaggcagagctcaggcagtaatgctcccttgcctgctgctcacctcctgctgagtggccaggttcctaacagggcagggaccatactggtccatggcctgggggttggggacccctggtataatggatgtagtatcagtcaccacagtctcctgccttattattccatgaagaaaccaagaaaatagttttaaaagaagattgcgactatttagtttagaacaatgtgctaggtagagacttaactttttcttggctattatcacagatagaataggaatgtttatgtgctcagctggaggggtggcagtttatatttgtatataaatatagattgggataaaggttttgaacttaataataaatggtgtcttaagcttacatgttttagttttcagagcagattatactaacagcagtaacaatagctatgctgagaagaatgcggagaaagaggaatgctcatacattgttgatgggaacataaattagtacagctattatgggaagcagtatggagactcccagaaaactaaaaatagaactgccatgcgacccagcaatcccactgctggctgtgtatactaaaaaaaagaaatcaacttatggaagagatatctctgctcccatgtgtgttgcagcacaattcataatagccaagatatggaatcaacctaagggctcatcagtggatgaatgaatgaatgaagacaatgttttatatatatatatattagactattattcagccatagaaaagaatgaaatcctgtcatttgcagtaacatggccggaaagtcaggccgaggaagacaaatacatgttctcattcatatgtgagagctggaaaaatgatcttatggagctagtgagcagaatagtggtaaccagagtcagcaaatagtagggggagtggagaatgaagagaggttggttaatgggtatcaaaatacagttagaagaaataagttctagtgtccagtaacacagtagggtgactctagttaacaagaatttattgtatatttcaaaatagctagaagatctacaatgttcctaacacaaggaaatgatcagtgtttgagatgatagatgtcccagttaccctgatttgatcagtatgcactgtatgcatgtatccaaatagcatatgtgccccataaatatgtacaactgttatgtgtcaataaaaaacaaacaaaaatagctatttcttctaatatcaggcattggtcaaacaaatatacttgcttctttttataacctcataacctaaagggatagttgctgttaatcatttccattttacttttgaggaaacatgtatttagacaagttaagtaactaacctttggataatcactgaaaacatagaagccagctcccagaataatatcttctacaaagtagaagagattatttttgaattagtgtctgagctgggactaaaaatctaggttaatctgatattaaacccatgttcttgatctttgaggtacatttcttctcacttgattgccacattaattatgtccaaaggccagtggcacttaggttctatagaaatatttgtgtggaataaaaattgtgttctaccaattctccttgcagttgcttgtgtagtggataggataatttaaaatcatggcctggttcttgaacaatcttattttgtcatctttgagttttatgaacagcagatggcaacaggacaatggtcagtcagcttgactgagcagtgaaactttgttcagtgagcaccggcactgggaacaactggtcagtcatatcattcagatgggaatggctctcattagctttgaaactcagatattaatgactaattgccagtaagatcaggcaatgctggtcaaccaggcaacttaacctgtgctccatgtggaaaggctgcttttgcagccttttaagtttggttgtaaaatgtaaaattaatttttcaatctcaagtttattcagaattctattaaaaacaattgttctttagccattttggtatgctgttattctttaataaaatatcagactgtgaattattgcctcttctctttaactttgtgttgctgtgttcccaaagtactttatccatataatgaatgcattacatatattatggttatttgattacatgcatattcccagcttaaccaaggactgtttgaaggcagggctgttttatacaattttgtatttaacaggtaatagacttttaggtgatcagtcaatgttgaactaatttgtactgtaaaatgaaagtccactgtttggctctgttgttcataatgtaaatattcatttacttaaatttaactgaacctatagtttagctggaaaagtgaaaattttatctaagaaaataaatgtaagtttaggtttctgaggctgtctattgtttacatgggtaaaaagctaaagccctcactgtacagctatttcaaatgtttaacatatatttactcatttattccttacattagcagaggtagttacattgaaaatactgagtcattgagaggttgagtaactggccccaagacacatactaacaagggttgagctgggatttgaacccaggcagtccaattccagagtctgtgctcttaaccaatattctatgcagcctcatttatctgttatgtgtatgtatgtaagtcaatatgtacagagagattgaaagagactttatcttatattttatagtgaatgttattatcacttcttggaaaaatacagaattttgcagaggaatgtatagttttctaaggtcaactttcaacgtcaagtaaaataatttaaaaaaattttcatgtagatatactttgagagacatttagatgcagtggaatgggtttggaaaaggaccaacaaaagaataaggaaatataaatcatgctattgtagaagacattgtaaacatttcattctgagagaattttataagggaactgcaagtgtttttcagatatttgaaggtagaaattgagagagtttggctttgttctttatagttttggtggacaaaattaaagtctttggtagatgctttagagcaataggattttacaccatttaaggaggaaatttttgcatggaaggtggccttaggaaataatgagcatttttctatcaggatgcttagatagaggctgaaaacagggatgtcactgaggataatcaagcattcggctgattgagtaactgaactaggtgatcacatttaagttaccttctaaacctgcaacttaaagattctaataacttagaagggattctgttttattaatttactatgtaggtgatttctagtgaaacttatgatcattaataccagtggttgcgaaaaaataatgcctgttacagaattattcataataagctcatggaaattcactcatcatacttagtgtttattatgtgtcagataccttgttaagcactttatcatttattacctttttactcttcacagtaaacttctggagtgagaactattattgtcttctagatgagaggttcagaagtgcccatgttcacattaaccagtaagttggcatggccagagcttgaacccgaggctttctgactccaaaacctatatgcctaactactgcacaacctttcaactttctagttcagatcagaaattgaaaatcaaggtaattaacatgacaaggttctcagaatatgatacttttgttatttacataagtagaaaaggttcaggccatccctatcagctggagcagactgctataaaaaaaaggaagaatgaaatagaagaattagggaaaggaaagagagcaaggatgttgtgtaggaactatttcatgtctagttgaaatgtgttataaaacttaaataggttttttaaagttctgttttgggtggcataaatttataaagcaaaattccttcctccctccttcgcttccttccttccaaagagtattgaggagattttaatcttttttaaatttttattttattttttgagagtctcgctctgtcacccaggctggagttcagtggcgtgatcttggcttatagcaacctccgcctcctgggttcaagcagttctcctgcctcagcctcctgagtagctggggctacaggcgcatgccaccacacccggctagtttttgtattttttagtatagactgggttttgccatgttggctaggcttgtcttgaactcctgacctcaggtcatctgctggccttggcctcccaaagtgctgggattacaggcgtgagccatcctgcccagccttatctttaaattattcagtaaacaacagtcaaaagaaaaatcttagccacattaagttaatagagttcagttgagcaaataacaactcgtgaatctggcagcctcggaaaccagagtaggctcagagactctccagcgcagccaagtggtggaagattttgttttttcactctttttattttatttttatttatttatatattttttattttttattatactttaagttctacggtacatgtgcacaacatgcaagtttgttacatatgtatacatgtaccatgctggtgtgctgcacccattaactcgtcatttacattaggtgtatctcctaatgctatccctcccccctcctcccatcccatgacaggccccagtgtgtgatgttccccaccctgtgtccaagtattctcattgttcaattcccacctatgagtgagaacatgtggtgtttagtttgctgtccttgtgatagtttgctcagaatgatggtttccagcttcatccatggccctgcaaaggacatgaactcatccttttttatggctgcatagtattccatagtgtatatgtgccacattttcttagtccattctatcattgatagacatttgggttggttccaagtctttgctattgtgaataatgctgcaatgaacatacgtgtgcatgtgtctttatagtagaatgatttataatcctttggatatatacccagtaatgagatcgctaggtcagatggtatttctagttctagatctttgagaaatcaccacactgtcttctacaatggttgaactagtttacactcccaccaacagtgtaaaagtgttcctatttctccacatcctctcaagcacctgttgtttcctgactttttaatgatcaccattctaactggtgtgagatgatatctcaatgtggttttgatttgcatttctctgatggccagtgatgatgagcatttttttcatgtgtctgttgactgcataaatgtcttcttttgagaagtgtctgttcatatccttcgcccactttttgatggggttgtttgattttttcttgtaaatttttttaagttctttgtagattctggatattagccctttgtcagatgagtagattgcaaaatttttctcccattctgtaggttgcctattcactctgatggtagtctcctttgctgtgcagaagctctttagtttaattagatcccatttgacaattttggcttttgttaccattgcttttggtgttttagtcatgaagtccttgcccatgcctacgtcctgaatagtattgcctaggttttcttctagggtttttatggttttaggtctaacatttaagtctttaattcctcttgaattaatttttgtgtaagatgtaaggaagggatccagtttcagctttctacgtatggctagccagttttcccagcaccatttattaaatagggaatcctttccccatttcttgtttatgtcaggtttgtcaaagatcagatggttgtagatgtgtggtgttacttctgagggctctgttctgttccattggtctatatctctgttttggtaccagtaccatgctgttttggttgctgtagccttgtagtatagtttgaagtcaggtagcatgatgcctccagctttgttctttttgcttagaattgtcttgggaatgtgggctcttttttggttccatatgaagtttaaagtagattttttccaatgctgtgaagaaagtcattgtcagcttgatggggatggcattgaatcatgaagaaagtcattgtcagcttgatggggatggcattgaatctataaattaccttgggcagtatggccattttcacgatattgattcctcctatccatgagcatggaatgttcttccatttgtttgtgtattcttttattttgttgagcagtggtttgtagttctccttgaagagttctcctcttcaaggagaatacaactcacatgccttgtaagttggattcctaggtattttattctctttgaagcaattgtgaatgggagttcactcatgatttggctctctgtttgtctgttattggtgtataggaatgcttgtgatttttgcacattgatttttgtatcggactttactgaagttgcttatcagcttaaggagattttgggctgagacgatggggttttctaaatatacaatcatgtcatctgcaaacagggacaatttgacttcctcatttcctaattgaataccctttatttctttctcttgcctgattgccctggccagaacttccaaccctgtgttgaataggagtggtgagagagggcatccctgtcttgtgccagtttttaaagggaatgcttccagtttttgcccatttagtatgatattggcctgtcttgctaggttggggaagttctcctggataatatcctgaagagtgttttccagcttggttcctttctccccgtcactttcaggtacaccaatcagacatagatttggtcttttcacatagtcccatatttcttagaggcttttttcgtttctttttactcttttttctctaaacttctcttctcacttcacttcattcatctgatcttcaatcactgatacccttcttccacttgatcgaatcggccactgaagcttgtgcatgtgtcacgttgttctcatgtcatggttttcatctccatcaggtcatttaaggtcttctctatgctgtttattttagttagccatttgtctaatcttttttcaaggttttagcttccttgcgatggattcgaacatcctcctttagctcagagaagtttgttattactgatcttctgaagcctacttctgtcaactcgtcaaagtcattctccatccagctttgttccgttgctggtgaggagctgcgatcctttgaaggagaagaggcactctgatttttagaattttcagctcttctgctctggtttctccccatctttgtggttttatctacctttcgtctttgatgatggtgacctacagatggagttttggtatgagttgtcctttttgttgatgttgctgctgttcctttgtgcttgttggttttccttctaacagtcaggaccctcagctgcaggtctgttggagtttgctggaggtccactccagaccctgtttgcctgggcatcaccagcggagggtgcagagcagcaaatattgcagaacagcaattttttatacatatttctttatgtatataggcaatatttctggtaaattcctgggaatgaaacttctcattcctacattatcagcattttgaactttagtaggtattgtcaaatgattttacagtagttgtaccatttacacgctcaccagcagtatgtgagatgtcctgttgtgatcaatctgattgtgtgaaatggtatcctactgggtttaaatttgcctttctgtaattgctaatgaggttgaacatcttgtctgtaaatttgcttccacttttctattgggggaaaatttttcttactgatttgtggatttctttttattatttggctaagaaacctttatgagttatatatacattgcaagtatcctttctcagtctgtggcttgtgttttcactcttttaatgttgtcttttgatgcacggaagttttaaatttttctgtggtcaaatttattcatcttttcatttatggattctactttctccgtctcacttaaatccttccttatcacaagatcatgaagatattttaaaatattttgaatagttttaaagttttacctttcaaacttaggtctctagtcacctttaatcatacttgatatatttagggtgatttaaggtaagagctctgttttatttttgaccctacactctgcatcttttaacagtatccactgttcatgtacacgtggatttgttcatgggctgtccattttatgtttctttgtgtctttttagagccttacaatacctctctatcttaacaatatagctttataataaatttgaatatctgatagggcaaatctcccgaacttgctcttcttcagttatttttggtggggtgggagcagggaggagaggtgatatttttagtccttttattttctttaggaatttgaagattaattgttaagtgacacacacacatacacatacacatgtacacacacacacacacagttcacatttttatgggaattgcatttaatttatagataatttgaggaatgtgacatcatggcaatattgattattcctttccatgaatattggattgtctttatttattcaagccttcctgtattcttaattaatctttgcatcatggggaggagtgtggtgctggctgttaaccagggtggggactattgactaacatctttgctacatctggggtataatagtccactggtactggggcatcaggctaaatagatgagaacagataaagtataaaaattgggtaggtttccagagacccaaatctgtttgggttaaaggcaaatctgtagtttgagtgttcagattgccatcagtaggctggtttggcaggcagagaaggttgacatctctcgatcgggcaaaggattctatctctcaattggggttaatcgggaaacgactcaggcatagagcatcaggactctatagtcatatctcagccacagactaactggacagtatggccagaatctagtcactgaaagactggacaataggataaaacaaggtacagagagacaaagtaaaagggagtaccacctggtactgagactagaagtacagggatatcaagagaatgctactgagccagctcattcccaggcaaaggcttattatgtttcattcttcagcaccagcacaaaggctggaatatcagtggagataaacccaaaggtaggagagtcccaatcagggggaagagggaaggagtggggagccctatggttcctgacatgctttgctccctgatgaggtaatagaaagctgaagcagtatatagctgatataagaagattcaatgtagatagaaagaatatcttaaactaatgtctggataaaactatattaaattaagtattgtttgacaacagctaagaattaatgagaaaagtccttaaatatctctctctctatattttttgagtgagggtatcactctgtcatccagactggagtgcagtggtgtgatctcagtgcactgaagccttgacctccagagctcaagcagtcttcccacctcagcctcccgagtaactgggaccacaggtgtgcacttctgtgcccagctaatttttgtttacctttttgtagggatagtgtctcatggtgttgcccaaactggtcttgaactcctgagctcaagtgattttccttcttcagcctcccaaagtgctgggattatagatatgagccactgtgcctggccaagtatttacatttaaagaaatctcactttaaaagtgtttctgtgtaagtgtagagcttagaattgtgaaggctatatttatgtttgtctatttcaataaataatttatctaaagatgaatcaacagctcacttacctttttatttcagtaaactgaaaataagaagccacaagctctcaaagtacctaagacaaaatacactatttcttgagggctgatctataatcctgagtctataaaatcatagaagaagccactgggtttttaatgttaggaaactgattgggaaacatgttaagtattgatgtgtaggaaagactgaggtgtttgatgacagatgaaagtgaagaaaggctggtgaagcaggagatggaagggcacagtctggggactgtgtgtgtgtgtgtgcatgtatgtgtgtacacacgtgcgcatgtaggtggatgtcttaaaccacagcacaacctgactagaagtgtatgttgttgtagaagtaataactaggcaatgaatggtttcaaaaacatgttagaaatttaagtttccttttgaggtaatattccatagagattctaaaagaggttgctcataaatcaaattgtgaggagctccaacttaattataagaaaaaaataacacagttaaaattacccttaaagtaattagcataatttttttgttttgttgttatttaaataaagaacagaactgttgttgccctgagggaaaaatggataacaggcagtttgctcatgtggcttatactttatgtatgtgtgcatctattgtaatagtaacagataatgtcttctaatagctcatggaagaaattagtttcttttcgagcaaaatggtagccttgtggaagctgacaaaagtcatattataatgatttttggctcaataaagtaatgatagcttggaaaaagtaaaggagtacggcagcagaagaaagatgactgtaacaaaacaaattatttgaacaaaagataactgtttctttaattggattctcatggaatattggtttaaaatatgctgaccaaaggcagtatctggaagacaggaacttaggatttctgaatcatagttctcctagcttggattgaattcaattcaacaaacttttgttgagcatctactctggagccaggtggcctgagtgtggttcttggttctactattctacctctctatcagtttcctcatctataaaacagagatataatagtagtctttatcttctgtgattttttttttaggataaacagaattttaatgtatgtaaagtacttagaacactgtttgccacttttgcacacacagaaagtcaactgaattagagaccggaaactgaaaggtgcttatactgtcttagtgggagagacagataagaaacccaacaatttcagtagtattttctgataataccaataacatgtttatcaaaaggttgctatgggaacccaggaattgaagaaaaaacgaccttagggggatagttttctggaataaaattcaaaaaaggctttcaataggaaaaaaaaaatcccccaaaagctcaggaaacaaaaagtagacaaagtgagaggctggaacacattcatttgtagctttttgagcttccttccttgctggacctaacactacatctggtcaccttttagatacttggtaaaaacacgatagagatcattttaagttctgatactattttcatgtgtactctcagtcacagcatctagttgagactaatggaattagaataaccagaatagcaaactactattccaaagtgtagtgctctgtgctgttagacaaaatattgacttctgggttgagttagaacaccacgaaggagcagcacttttatgtcatggcccttcttttctactctctgtcaatttgaatgaagcagaagagaggcaagtattatccagttagaaataaaagagagggccgggcacggtggttcatgtctgcaatcccagcacgttgggaggccgaggcaggtggatcacttaagcttaggaatgcgagaccagcctgggcaatatgatgaaacaccatcactacaaaaaaatacaaaaattagccaaacatggtggtatgtgcctgtggtccagctactcgggaggctgctgtgggaggatcacttgagcctggaagggggaggttgcagtaatctgagatgactcccctgcactccaatgtgtgtgacagagtgagaccctatctcactaaataaataaatggatgaatgagagaaagacattttaaaccaatatgttaagaatcacactttaggataaccttgatattgtaataatttatgattctctaacctgtgaaaattgtaaattgttaagcaataaagagaaaatacacttgtggatatgcagaaatgtgagtttctcagtgcatgggaagcattgagagaaggaaggtgtccatccagtctgtggtcccctggtcgtccctcgcctcccctatgtatcttgtcttgcttaggttttgacctttgtcttcatgttatcctgcattgctatacaacaattggggcatcttgtggttgaagttttaaggtaaaatgaaaccatggttactccttgctgtttcattggctggccctgcagttcttcatgcttactagcccccttcctgccattgctactacaaaagccctccagacctcctttggtgggaggagacatgagaatgtttttttatctcactgacatcctactgaaatcagggaaagacagggcagtgtaaagctttcagctcattctaacctggcagacttcttcaccattgcagctgtatgctgtctacccaacactggcttacagaatccaaaatggctctcccagagggcttcagaagctgggcagaagctcctaatgtttgtggagacacccccttagtctttctgaatgttttaccatcttaccaccccatcttctgtccagccccatgctgacacacacttgtacacacttgcacacacacatacacacatacatagacaaactcacacattcccccacccctctcccccaacatacagacacaccttcaagggcccagacaatgtttaatctctagttagacactttggtccttatttcatcctagaaggcaatcaaacttatatttcttttctttgagccagggaaactgctttaatattctccttttgccatatctatgagtaactttcatataagctctcaattctacagttctgcatggtccaagcaaagtccttttggaccatcaaaacaaaaccgtttctctctcaagctcttagagaatgtgggttgcaaaacaattgcttctgcaaagctaatttttaaattgctatttggaaaattataactgaacaataatgcctttgtccttggctgtatctgtctgtctctcaaagccaaagctttcagctttgctgggtaaagcaacaagattagtaagaataaaaataaatcacataatatttcaaaaatattatcctgttaaatcttattacctagacctgagttatttcacacaagaagaatactcaatcagctacatccttaaggttgtcataacaaatcaggctgatttccacacatatttataaccggaattattagtttttcaaagatatgttacaggtgagctaacattagatgtagaagggaaacttttgatcaaagtttaaattctgattcctcttgttcacttggatgtctttacgattcatttaaactttccaaaatcttatttctaaaacaggcataacaattcactatgacaatgcagcatattgtctgtacttttggatgctttctggaaggttgtcagcagccaactaaattcattattagagacttacagtgaagggaaatggttcttgaggtgacccctgttcagtccagaaatagcagctctttatttaggtaattaccattgtgaattgctgctaatggccacgttagtggaagtctatgttgtgatgaggaccactttaacattggggtggttttgattctttctgctacttaacattcagaatgatccatagctgaagcttagttactattaaaaatctacagtgttttgccagtgggaattccaattattattgcctggtaattaaaagacctgcttgcctcagagtttttgaaagaacaaaataatacatgtgattgtttcaaacttcaactctatttgaatgttaggtggttgttattaatttttactaactctcttactgtactctttttctcccttatctagttttcctgctctcttttcaatgctttgggaaattcatcttcataaagcttgatttttaattgaagcaaatttttctcagagtcagcaccacagtgtccaaggtcatctgttgtcttagcatcttttccactgtttaatctgtgtcttaaggcttctttggttctttttggatctgtgattgtttctgttttctgaacatgggatatagttccagatacactgcttttttatactgaactacattctgcgttgcttggttttgttttactttgcttttctctagtattttttgagcttagggtttatttttatcatttataaattggtttgaaaaaagattaattcactcagtgttcaacatttgaatcaagtgacaattatgtgcaaaatacagtggtattgctgggatatggtatgagcccagaatgcccaggcttctggcttgactacaggatcagtggtgctgtcattcaccagggctgggactgctggaggtagagctgaagtggaagggagagttggggcagaatgagtggatgatggacaattgctgttagctttgcatgtgggaaagtttaaggtatccagtggctggtgtggtaccttagagaggctctcactccaagtggcagatctaggtatcattagtataaatacagtaattgaagccaagggagtgaatgaaagagaatggagatgaattctctgttgaatgatcaccagacttgccatgtttttctatagatagataccctggttggaagtttgtgtgtgtgtgtgtatgtgtgtgtgtgtgtgtgtgtgtgtgtatgtgtattgtgtgtgtgcatcccagaatagccatagtggtgtggaggtgtgtatgtcttcagtgtatttggtaggcttcctggaaactacagttttaaaaatgattgacaaccataggctggaacttcttaaccatgttaacatgaatttatagtttgtttattgtggggctgttctgtgcattgtaggatgtttagcagcattcctgatttctacctactagatgctaataagttcctcccacccaatcctcatccccagttgtggtgaccaaaaatgtctttaagcattgctaaatgttccttgggctagataatgccacctgaataagttcttctctgaatttatttacagcattttgggaggagccacattaacttttatgttccagaatgcttgaaaaacacattcatgtctgcagttatcctgactgatatttaggaagcagtttactcctccatcctggaggatcaattgagtaattttaccattaaaaaaaaaatcatttgctgcacataaaagtacagatagctgctagatgcaaattaaattttgttttactttatatgtgtatgatatataaatgaaaaggggtgaccaggacatgttgtactccaaatagtgaaatagcctgtagttatgactcagtcatttcaaaggaattgctgtcacttctttatgtgtcaaatacattttaaggcagaccatcccaaagagtactcttggggtggaggtaagagggtggagtccaagtgcggtgaacatgaattttgtaatagtgatttgaatgtaaaaagttttaaaagagctagtgcttaatatttttaaacttcatttataaattccttaaagcaaaagaatataaaagtaacttaattacctgccatggaagctaaattaacttacaccttgaaaacctcctcttaaaataactcagattttaaagagtcatttgtaaggtaagttgtggcattgttgtaagcacctgcctgtatgtgtgttgctctgaaataatgctattatttattctattatagaatgtagattctgtgaggggaagggttttgcccattttcttcacttttctttctccacctcccacacttccttcatgttacagtacacagtggtgtagagtgtgggctgggttgcagcctcagagagtagttagtatcctgttttagttggctctccttcttctctgacctctgccggcctccccaacagccactgccaccacctcacagccaatattcttgatattctggttgaggagataactgaagcctaggagtttagatcagggtggtatcacttctcacagatgaatctttacttctggcatttactcctaactctcaaaaaattgtggtattaaatattttatatgactcctagaattgtggctgtaaagtcccagcctctgtctcaatcttctgtcaaatgaaggaagaagaaaaagatgaattctagcttttgcaacatgtattcagtccacgctcagaggccaattcctaccttcccaaaccgtgatcacagcccttgattgacagaaatgggagggaaaagggagagggagagaagagaagaggtttttcatcttgaagacaggaagagtcatatctggagagctgaggaaggtgggaggcctcctctgtgtacttctgttgtcacttgattggaatgactaaggacattttgaaaccagaaactgcattttatcactgaatgcagaattgggtttaggatcatccaggcttatacaacatagggggaagatggagtgactatcctgtggtaagaatgaatccatcttataagagtccatggcacagtggatatacagcatgcttatctaagcttaattactggttccatgtatgtacttcggcaagtcacttaacctctctagtcctaaccccacatctgtgaagtccacttagggttatgaagatttaatgtaattatgatataaagtgcttagtagttatagaagcaattgctatggtttaaatggtgaataaacagattgtttattggctcaggaattatgtgataactatttaagaattgtacttctggttgtcccgggagattaggattcttgtttggcttcactactgactagatagtattaatagttaagtcatttaactttgtagaccctggtttccttttattcacaactgttgaagttgaggatctttcatttggtaagcttgggaattctattttgttttgctgtttaaaaacctaggcctcttgttgttaacaatacctctattaactaatttgagttctgactcatctgctagatctaaatagccgtgggaatgtgaagcttttcacaaataatgctatgatttttcagataagtttttgctctccatgcaaatggagcaaattacttaattgacattttacaattaggtattaaagcatcctgttcaaggttggaggacagtataaacttatttaaaatgtctagtgaacacagtctgtcacagggatatgggaaaaaggcaaaattgtattaagatattatttgtaagcaagtgctcttcatttccaagcagtctgtccctgaagggggtgtaaatcatgtgtctgttctgtgcttagaattcatcccttctgccatatgtttattgtataaaccaagaagatcatgtattatcaagagacaacttctactcccggcctaaactttcaaatattattcatactctgttctcataaaaaattattcttagggtctgaaagaccatcattttcttttaggtatttctgtttgtgtatggtatttgcagcaaccaacatcaacagctggtttgttctctcatttttcaaggtaatggtagggatttaagttattaagaatcaaatctaacacacaaaaatactttgaacatgagctgtgtacaaattttttattgagttattaacctattggacattgctgctgctgtggggactttatcacatacatttaaaaactaatataaacaaatggagaatatgagttgacacagaagaaaggctcaattttatgccaaagtaatagctagcactatagcatgcttactgtaggcattacgttgagagctttgtgtgcattatttcatttaagcatcccaactttactacttggttgggtgttattacttcatcatttttataggcgaagaagctgtctcagacaggttaagtaagttgcccatgttcacacaactagtgagcagaagtgctaggggttgaatccaagccacctgattgcaaagtctatgctgaagttgcattttaaagtaacagaaatttccttcatacaacactggacttatttttttctatcaaatgatgtggcaaattgagagatttctggagaaattcaggcccaaacaatgttatcgctcagatcattcagatcattttcaacattagcatttaatgaataagactgtgtcttgaaccaaacatatttataaaagaattagaggaaggtaacttaattctccattcactggtgtcttagttgtaaaaccacattttgtcaaggttattggtcataagttattttaatagcttttccaaacttaattttctgaagttaataaaatgctgagaaaaacttagattatgtttaaaagcattgagtgaactaaaacctaagtaaagctatttactttgcatacatatggccaccatctaagatggttacttatccttgaaaggataatgtttaaaataatatttaaaataatctaaacctaatttcttaacattgaaatttttacaaagtatagttatgtataaatctgatactatcttactacaagagatactaaatgagtaacataaatattaagcataaaagatttaattggactgttacaacctactctcacacagtttaaacaaaagtcagttaaataggttgtttgtaaagttctgtatagtctagatttctttcttcttccttctctttcttcaccccctcctcctctcagcatcataatgattatcatcatccccatcaccactgttatcataatcatcatggctatcttttacattgttttcctcacaacatctgcatcagtaatttaattgtaagcaacagaaattaaggagcagtttatttagaaagatatcttgtagtttttagtttgaggacaacctgaagaatgaggccttgtagagctgtgccaagacaggctgctaggcttaagatggggaacagatgtcagcagatattcatcacttagggctaaggtcagttggttgagctttggggcagagagaccagtctagtcctgtaacaccagcgtgccatgcagaggtaaatttttgtgtgtgcaaagacctacaaacatctgggaagtaccttagaagaggaggaaacagcagatctagagaggaaggttgcaggaagcagtagatggtcttttcaggtttcaccatttaggcaaatgagtttttggaccttgtgcacacatgctgtttaatcatgcgtcgggctttctggagagagttttatttataattcttgggctatgtatccattccttggtcaagggaatgtggtactctttgattgactctttgattgataagataacattttatcttactaggaaagcataaacttccaaaggaaaaattacgtaaaggagaagacatggatgatagggaaaaaagcaacatatcatgtcatatcactttaccatgcatagaaatcataaataaaaatatttttcctttgatatagtagtcacaggagatcttttgccccccaaagtcatagctatatttatagtgtttttctgaatattatatagttttttaatgaatcttggtaaaagaagattttttaaccataacttgtttttaatcctataggagaggataataagttttagcttttataggccactaatttttttcatggcttttgtattttaaataagttattattaaaatagaaattaaaaaaatctacagaacttgaattaagttaattaattaagcagcatttcataataaattctgtgctgaaataattatgatcattactttattacaaaataactatctagaatgttgtatcagtattagtgtttatgttttatcgaggcatgtgcaatgtgcctcaggtgtcatcaaggatgggcatcgaatcactgtttcccttttcataatcaactcccaaaaggtgaaaatttcccctctggcttcctagtatcctaatatattattaatttatttactttattattttattattatttactttatttctattttatcctgattgtatctcttaaggtacatattcttcttttttcacatgtcatagttttttaataagattgtttttgagaatttaaatgttttccctctaaattctatattatgaagtgtgattgtaatgtgagtgatttttaaagttgtctgtacactaatttttaaagataattccagcagcctgggtgcgatggctcatgcctgtaatcctagcactttgagaggccgaagcaggaggattgcttgagccctggggttcaagaccagcccaggcaacatagtgagaccccatctctacaaaaataaaaataaaaaaattaaccaggttgatgaagtccacctttggtcccatctactctgtaggttgaggctggaaaattacttgagcccaggagttcgaggttacaatgagctgtgttcacaccactgcactccaggcagactgacagagtaaaatcctgtctcttaaaaaaacacaacacaataaaacaaaaccaaaaactacaagacaaagaaggctaaggaatgccagaaatccccagaaactgagagaatcatagatgatttccctctcagagtctctgataaggaaacaactctgttgacagcttgattttggacttttggcctcctgaactgtgagagaacacatttctgttatcttcagccagatagacagacagacagacagacagataaaattatctctctgtttgtaacaaaaagatcattccccctcaaattccccaaagtgtgtgaaacaacagcttcattgttagaacaatgctttctttgggtgttttgaagaggagtgttcattgtttaaaatgagtctgattacattgtcaccacatgttatatctgctttttctatatactttagaaaatatcttctggattgtatactccttgaagacagagctgaagtcttagttgtattggttttataccttattgtacttttgctaacagtgcattgcacctccataaactgtaatatggaaaagagataagtaccataattatttatgaggactgtaatatacagattgctgttaatattttcaaaacctattagatgtaggaatgtttctactgtttttcaaaaatgagtcatcaatgaaagacttttcataattcattcctttgtttctattgatagtggcttctatttttctccgtttaagaccattttgatattaaattctcaaatacttccatttacaaaaaataaaaggacaaaaattcatcaacacctgtgaaaagaagggaaaaaaaagaaaaaaattcggatcaccgctaacagctgattactaaggaacctgctcttaccgaacagcatgcagtgggagaaactaatgtggagaaaataatcagttttccttgttatagggatcatacaaccagaaggattttaccactgtcttacaacatacagggatgcaagccatggatttgggtccatgtgtttagagaacaatggaaatttagtttcccaaattggaatttcctctggactatatcttagcctcctgagcataaagaatatacctaatataaaatgtgtttaatgtttcttattttgttactagagaaaatatgaaggacataaagatgtcagatgtactatcctagtcactaaagttctttttgaacaactgataagtcaaaaagccagcagtagaaatttgactactggttcctggtggcctgactgtaccattagcgaagtgatttgtgccctgaggctatttacctttggttatttccccccaaaggctgaaagttctacaatatgcttgtctctgaattgagaaactgttcatttctctttggatcgtcaaagtagttgcaaataataaacttaagtcaataaaatgcagagttagaaagaaaatgatccatgttatttaacttcctctcttaatgtcacatttatatgtattggcatgtttctttgtatatacacagtaatgcatcacttaacgacaggagtacattctgagaaacatgttgttaggcaattttgttgtgcaaatattacagagtgtacttacatgaatctagaacctagatagcctactatacacctaggctatatggtatagcctactgctcctagactataaacctgtgcggcatgttgctgtactgaatattgtaggcagttgtaacacaatggtaagtatttgtgtatcaaaacatatctaaacatagaaaaggtacagtcaaaatacggtttataatcttatgaggctactatggtacatgtggtccactgttgaccaaaatttagttatgggcatgactgtatatacacacacatatataaagttgtttgactaaggaaaatatccaaattcataaaatcatccatttttataaagctttttttatactttcattttttatttggaaagttaacagtctcaggtagttcttctttggttcagttgcatagcacttctctctgtgctggtgaaatctagtaactccttattaggctaagctaaatatactctggttgacatcttatgttggcttagctgtttagtcaggaggtataattgttaataatatttagccataataaatgaagttgtctcacagtatgtattttaaaaaatggcaacatatggttcaaaacagagactcctaattagacaattattgagcaacaggaaaggatgttttcaaatttgtatacttatggttgtactctaaaatctagtagtttcctgatgcagttttatagttttctatcattagttacacataccatatccacattattaagaataaatttgctcactggagttacagcttctttaatattatttatgtgagacttctttaaaaagggaagaaataataatgtttagcctttcaacaagttagtctattgagtagctgctatgcactgatgccctgaagcacagcagtgaaaaaacagtctgtcctgtcatagggcttctagtctgatattgggctgattcaccacttttggtttaaaatcctagtttctcttgtctttaatatctgtctgtctctcttcatctttctttttctgtgaatacacacatgctatgtgtgtatatgtatctatacacacacacacacacacttatattgtgtatgtgtatatatacatatatttttaattaaagatatataattcatatatattccttaaagatacatatatatatatatatatgaatatatattctaataaataatgtaacagtataagtatcttgtttgggataatacatattatgtgttaggcttcttcagagagacagaatcaaaaggagatagatagatgagaggggatttattaaggggttcgttttatgtgcttatcgaggctgagaagtcctgcgacaggctgtctgtaagctagagattctgggatgctggtagagaggctcagactaagtctaaaggcctcagaaccggagaagacaatagcgttactctgagaacccagggcgagggagtagggaggcggttctggtgtaagtcccggagtccaaagggctggagcctagagttgttgcccaaggattggagaggaaggatatatcccagcccagcaaatagacgggcacatttaccttttctccttttttccttcggactcccagcagattggatggtgcctgactgcaataaggacagatcttcaagttaacacctcaacttaactatttgacacctcaaattaaccatcacaacatatatatatatatttattataaaaatctataaatcaggacatgaattgtttatatataagaataatacatagtttaagaattttaattctgcctttaaatacgctgtactatgtatcctcagtttcccacttaatgttctggttctgtattatgtctgccatattaatttttatcatagaattttgcttctgtgttgtttaaaacaaaacaaaacacagtgattgacaaggcactgtttctgctgaaaagttcagaagcattcaaagatcactgacaggttctgttttcacctgttcctcatcagcttttcatggttcaggtgcctgaggagaaacggtcatcaagctgagtcagagattcacattttcaggggtttgaaggggcaatgggttgagacactcccctttctgtttagaaggtaccagaggaaatattcaacaaaattttgttattcttccttaaaaagcatcaaccttataaacatcttttcatcactggcctgtagttctgttgaataaaatgttctaaagcagcaaacactgggtctgatgcattgggattaaaggtaaggatcaggggagcagcccaagggggcaggatgcccagatggctctgaggctcccccaggcaccgggagagtgagtacctgccttttcccagccccaggttgctgatgtgggggctagtatctaagcagtgatcctgatgaggggagtagacaatgcaaggtgtgtacatgtattccttgatgtattatttgatgagagttagtaaaaaaaaaaaaagcatccattttagcagcactcatgcattctatcactgatgctcaagttaacaacatgaagacataaattatagttttcacctttacactataactcttggggttataattttcttccagactcccccccagttctttctttcaagctgtagttagaatgtaggtcttatgcttcaagttactgtttgctactttatttgcaaatgttttttcctcaatatgaggccattgctgtaagatgtcctggcatggggagtggtatcatattgttgtttctaaaagtggtcctgaaacagttcagtattgaaggcagtgtagatatacttaatattaatctccctacttgattttgttaaaaaacctgacctttgacattttctagattagatattggactctttgatggttgcagcttattgagaatttggagatttgtcttgaatgcctttcttcagccattcctccctccccactgtcttgctcactgatcagcagcttgctgctgctccaggccagctgcaatattatggtttcagtgtcactgatgcagtcagttgtgttccgatttcagaattacggttggcagtcccagggtaaagtgatacgctttggcatcataaagtagtaggaccggggagcaataacattgaaagctatgtcaagattccaccctcatggaggtttcctggttacatttgaggctatggtttaaaatacatgaacttcacatagtataggtaaaatgtgtgaaaagggtgcatttataaatacaaccacacatatttataggtcatacaattttatagtagatgtgagaaatggtcatttttctttgagacagatttataaatgatttcttaagttatttgggtctccaggtagccaaaagaataatgataccctaacatgtttcttttaatttattggaaataacgatgacattaatcatcatcagaactaaaggaatactgtaaagtagattcaaaaacaccaatttatatgcttaataaaaattaatttatgatgagtaaagccaaaaacccaattctgaattttatttttgaatgtagttaagatgcaccaagtgaaggtggagatgtaggtaacctctgggaccatgacagtagtgatgatgaggagataaatatccacaactccaaccccacaccatgactctatgaaaagaacttcctatcttatcctcatcatttaggtctttggattttccagcccctattttgtattggtcctgaattaaacctggttactttcatggtatcacctttattttcttcctttgctttaaaacattggttgtggcttttttacttcctcttcatacctgttgatatactggttctagacaccactctcaccgctagttgcctggcccagctgccaatactgatggccaaaataagcaatttagtaaaaactggtggtaatggtgggtgtgtgtgtgtgtgtggggtaataaaatacaatcttaccatttatcttttatgtaatgttttgagaaaactgtattttgggtaacttactaaaacttcttttagtcagtaaaactgcatctcatccattgcggatgttcttggtacaagatttctcctatgagggactacaaattattgggtctcttgaaactggaaacagactctcactcttccagtagtatataaacacactggagggctcctggtaagggccctaggagtgcttcagaagtacggtacatcaccaagtacaatatggggaagagcttcagagccatagaatcctttttcctgcatatttaaaattccaaatgccataattacccatttatgatgtcattttggaacatatagcaagactactgaatgcttaaatttacacattatcttgactagttcattgtttttctgggttttagaaacacgtggtgaagatatggctcaaatttcttttgaaccactgggtctgctttgctaaatgtaactttacaacaaaatggatgtttatactggtaaatatccacaagatatttgggaaggccggaatggaagtctgcctgattcggtgtataattttgtgggcaaagataacataacagaaagtgcatcttgatatttggaaaaaaaagatcattttgccaaagatgtttccttaaagtataggttgcaaactcttggacagaatctggcctggggagacatgttttgcttggctttcatagtattcaaaaagaataaaaaggaaatgagtttggccccctaagtcagagactgtgttctctggttgtccacaccaccttccactgcttattaccttagttattcccattacttcttgaggtcatgagatatttgtttcgtgactcttgctaaatgaaagctctttgcagtctgtgatttgtgtacctcatcctttaagttgttgtcacactgggaagatgaacctccttttcttcctttttctttttattcttggcttcttttccaattcgggcaatagcaggcctcaagtggactttgggaaaggacaaatggaaggataggaggaaagcacgtccatgctctccagcagtggtccttggctgtcagaagggatggagacaaccaggggaaagcatcctcactgccagtctgtggccaggggaggagggggaaagaaaacttgttactcaacttgccttcctgtctgcttgcttcttgtccctgtatttttcagacatttgcagctgaggccaatttatccctactcattcactcagcaaatagttttgaggtctgctgaatgtggagcatcataccctgagagtggtaggcagtaggggaagataccacgagaatacacgaatccaccactatcatgggtcttcatttcacgagtgtggttttagcttacttatgagactttcacgtttcatctgtatcctttcttacccagccttattatctccctagaattattattcttatttcttaaaggttagctcttcggttgagagtacacagtggttgcttaacactttcttctggatgttaagtagattattcttagagacctgcttttcttttgagtgatcaggataattttcagcattttttttcagtaggctctattagctttagtctatgttttgcttcctttactaatctttgaatagggcagtatcagtttgtacaggctcatttgcccataaccagaaggtggggttcgctttgattctgctctcaatttgtttgctgtgggaatctcctcaggtttccacccaaagggtagagcgtgcagttcccatcttgatctctggtgtagaagctctgctgtacaggtaaggtcttctcctgtgctgccagctttccacttgtttttctgccactgagctagggtcacacactgaagggcctgcagagattagacagatgaaacaaaattagtgaagcagtatgcaacctatggtagctgtggaagggatttaaaggcagtatttctaaagtgctttgtccttttaagtggaatttgcccatgaccaaatatggtatttgggtatttagtatgatgccctggctctaaaacagtgtttcttaaatttttctgaatttttttgaccgtggtaacacacaaacacacacgcacacacatatgactattttaaaccagaagtccagtattttacatcttttggagtcctctgagaatcaactctcagaactgagattccttatttcagggatttgaacatttagtagcttttggcaaatatattcccaaaatatttctcaaaagacttaatggcagtttacatggcctttggcaatgtaaggaagattttaactatattcctttgtcagaatttaaatttaaattactttgtgacattaatgggtgaaatgccactttgtccttacttttaaacttatttttaaaaattaatggagcaatagaacattttctttgtttagcagtggtattttctcttttataataactattttattcatagacaatatagcaaagtgatcaactttttatgatgaggtgagccaagcacaaaatcttcttggatcactccttaaaaaaataaaatactgtcattcacaacctaagctattgtaagtatatctcacttcttctggtataatagacagaaacatgttactgttatagtccttgtcaatgaaagcattgcagaataaagaattgtaaatcaaataggaatggattgttgatatttttgtgcattatgaggaaagaaaattactcagctctttccctgaacaaaaggatttaaacctagataaaaattgatttttaaatattaaattgtatttctggagaactattattattgtatcttctcactaatatcctattagcaataatgtaatttttgaccttaagatttttgtgcctctgttgtgccactgctctccattgggcgtgacagagcgagaccttgtctcaaaacaaacaaatgaataaaacacaataaatttctcctctgtattcctaccttctctattaagtaatcaatgaatatgttacggaaaaatagtactatttctgctaaagaattcttttcctgaatccatttgtcacattaataacttagatacataattaaaaccctcttatcttggttttaatgaaagcacgtaagttatatattttgtttttctctgtgccatcttagttatatacactacaaaagatatgtgtaatttttgctgaaatatcctttgagttttactccagcacttttttgagtcatacccaaaaacccaaaagattttaagccttgcccatgtattatgaactacacataatttttgcttcacaatgggccaaaaattcatttattccagcagaattggaccaagttttagaaaataggaccatttatccatggtgatacagaagtgtagcagtgtttatacttttgatcattccttagggaagcatgaccttggtagacaaccagctggcttcagggaaaattgtacccttgatacgtgcttaaaacagcagtgtaaaatgtaactggctgacaatcttggttttggttagggtcactttcttcttattcacggtatgctgggagtacaagggatgatgtcagtttctaccctttagaactgttatgatggccagacatagtatttccctctgttgtcaacacttgagaaaaatttgccaagtggggacttacgaattgaaaagcagaggatattagtaattgttgttttaagaagagaaaaattcatttttcaattttttttagaaaagaacaaaggagttgaaatttaaaattctagaaaaacttgtttctaacaaaaataaattgatttttaataccagtatcatgcctttccttgttacttatcacttaaaataatctttaaattaatttctttctttcttgggtatgctttgccctagggcattgtggcaacatatatagtacaaccctttagggacctgagttaactcgtctttgcttccccagtattagcacatgtggttcaagaaattgttttaatatgaactgatgacctttggaatttatacaacattaaaagttaattgagagattgtatgtaataaataagatgatgaaagtgatttcctggtttgtactaatataatgttcaaattttcttatttggcattatttatctcctaattactggcacaatatggagcaaagctatgaggctcagaggttttctagtgtgtaacttgtctcttttgtttctgtagcagtgaattataggtgctgttaccatgtataagttttctctaagattctggttagctgatttaccgttgaagatttttcaggagaggagtgctgtcatggataagcagtctggcagaggatgtgtgacattgatgatgtcaggaaaatttttccctgtgtctctttcagaatggaggatggtgaggaaaccagaacgtgatgctttttaagaaaagaggacatggtaaacaattgagatttgattatatatttttccatatggaatatcatattctgaaaagattttctttccaatcctcaaagggaccagtttaagaaattagatgtattaagcacctttgaaacactatatcaacaacaaaacataaaacagggggattaaaaaatggagaaaggactcaaatagacatttgtccaagaaagatatgccagtggccattaagcacctggaaattgcttaacaccactaattattagggaaatacaaatcacaatcacaatgagataccacctcgttcccattgggatggctactgtcaaaactacagaaaataagtgttggtacagatgtggagaaattgcatctcttgtgcactgttggtgggaatgtaaaatggtatagcctctgtggaaattactatgactatttctgaaaatattaaacaattatggcatgacccagcaattccacttctgggtatatatacaaaagaagtgaaagcagggactcaaacagatatttgtacacctatgctcattgcagcagtactcacagtagccagaaggtaaaaggaacttaagcatccattgatagatgaatgtataaacaaaatgtgatatatacatacagtgggatattactgtttcaaaggagggaaattttgacacatgatacagcatagatgaaccttgaaaacattatgcaacgtgaaataaggcagtcacaagatgacaaatattgtatgaacccatttatataaggttcctaaaccagtcagattcatagagacagaaagtagaatgacaccaagggcttggaagaagagggaatgaggagttattgtttaatggctacagagttttgctagggaagatagataaggactagagacggatggtcgtgatggttgtgtaataatgtgaatgtacttaatgccacagaactgtacaattaaaaatgattaaaaggggaaaacaaaactatctttatggaatttttcagtcagcttgtaattataacctgaatgctaaacttggaacaatataataggtattaacaccatggtaacaacacttgaatgaaggtaaactgctggaattaataaatgataaatatagtggaatgataatgacagtggtctttatggttggttcaggttctaaatttgccaaatactgtgcagtaactcttgaactctcacttttttatttattagaagagcataagcatatttacagtaaggctttagttatgtggtacttccaaatgcctcctgccattgccaactccaaagaaaaatcctggaagagccaggaagggtcttctaaggacagaaggtgtggaagatgcagcaccctgattgtgtctcaaaagtacaacttggctttgtagtagaccttttcaacagttttctaaaattctatgacatggaagtcaacagtattaatagccaaatcacatgttacaatttcttttcttcatagaaacagattgagttgagatggagattaggaataagtttatgaaaatgtttttaaaaactgatggaaaagagtgaagatacaaaaacaacctgacaagcagctacttcaatctttgaaatattgttttggcagaaataattatgttgctacctacaggtggttatgctttgtttgatgtttaagctgacagggaaatggggcaaaaaacttttgaaagcatttatttactatttacccatgtttaactacatctctaataaatgtcctctagtccagtacaatacctttgccgccattgtgaccttttttcagtaggaacgggaagcttgtgttcagtactaactcagtgtttgtgtatttgttaccatcatgcatgtttaaaaaggtacacagaagcatgtattgtactgcgaactcgttattctaaaacaagtctggaataggaaaaaataggtggagagagttggcccagggcagtcctctattacaattagaacgattagagcttaggttataggacttctctttcagcatcctaataacattactggtcccctctaagatatgaaagacatcagagacttccagtcttgaagagttattcatgtaaattactgtgtctgtgtgctttttggggggatcaatataagcaacatttattgagcggccacatatacaatgtattaggtattctagttaggtacagaatatttgttagttctgaattccatgctcttgaatgatttggagtgctgaaggagatagtatagagaccaccaccaccccccgcccatgaaaaaaaattcctcaaaacaaagaaacaaagatacttaggtccttttctaagctgtttatcttttactaatatacaaagggcataatttgctcaatgtaatatctatttgccatgtgctgtgttcttcagtaggcattgtaagtaagagtttctgtcttcaaacttgtaatttagagtgaggttggaggattagacatatctatacagtgctgtgctatgaggtaaattgtgtgtcttcctaagagagagagttgaagcagagtgtgctgccttcaccttattactgtacttgattcttgcccttgtaacctggttttaggtttcatataatattttgcattgtcagctccctgaaattctactgggaaatggttacgagtacatagacaatctgacaagaaaaaggaggaaaggtaccatggggtttaatataagggaaagcccagctggttgcggggaccagggagaaagagttgtatgagatgggtcttgagggagggatagaatgtctgccagtgtggggaaggaagtctgaggtggaaaaccatcaatcacattcagagttgtgaggggactgacatgcctggagcatagagggactattagaaagcaagttggaaaggtaaggtcgattaactgacaggaacatgtttatctgaaatattttgaagtagctttcagaaagatgtccacttttaattttgcaaaagcagttttcttaggttcttcagtatttcagttctgattatacaaatcattgaggaaaaaatgaaccagtgaggatgtacaaaaatttcccaaatgttttatttctttgtcaacattatttgcttatttttcagctcttcatgtaattgtctttgtgctctgcttgttcccttttgtactttttccacacgggtgataaagccctgacaatttagtttttcttggtttacactttcctacaatactaaaatatgtgtaaccccctcactaacatctttgccaaaatggagttttcaagacattctctgaagctcaggactgtttttttgttgttgtttagcattggcatttctccagcggaatactagccagtggtccagtcatgtgtggaggaggtcatgctgattaacaaattactaggcatatattaatatgtttgctaacctgtgattaattgtgaggtttttctggctaacttgttacatgcacttggctacaaaacaagaaaacgtctcaaaaaatgtatctaattcagttgcgttgatatttgaagttcatcaaaattctatccttaatgattctaaattgtataaataatatgttcttgattaatgaagtatacgtgctatgattttaccattagttgtacttatatgtatgcattacatatatgaggttctcttgatttcagaaggaactgatacagaccagctttggtgtttcttttgctttttattagctttatattcggatagaaaatattaaaagggctataaattgcctatccaaaatattgcttttttttaaccttatcagcaggcagaatagttgctgtacttggtgtaggtaaggttcagttgtctgtaagaaaacaatcttgctatagattttgaggaagaaataaaataaaaaatacagatagatgataaatgttttgcttttcaaatgtcgatgttgtactttcaggaatatggaagctttatggtttgcctatctgtatcagttctcctagaataacaacttaacagttttcctggttggattgtgttaaaatctttaaaggctatattcactaaaacatatgtctaatgtttgggcagccaaagtctgtgcaatcattttaacagagtataacttagcagctctcttattaccacaaatatcttattgttaaaactacattaaaataccatcaatttggaacatgctacttcataattaaatcattctgggatgtgatcaagtatatacttctgaactaccttaaaaatggattgtgctaagaatgcaatagcataaataaatttaaagagaacatgcataataaagttaaacgatttgttttaatggagtttttatctagttaacttttcttgagtgtctacaatgttcagagcactgtgctagacattctgcattggttaatttatggtcattcataaagacgtttgggtagaaagaaaatgggtaatggggaaaagtcatagagtggccaaacaagaaacaagtttagggttccagcagaacagggatgccttgatatatctgcctttggcaatgccgtgtgtacggagctgggattctgattgctcctattgtgatagtatgccactaatgctctgttggacggaatgactaactgaagtggtgagaaaactgcgagcctttcaggactgtttttaatgcttttttgacaaatcttttagaacaaatcttttgttcctttgcagggaacaaagtccttttgttttatggtagaggagttattcagggtcctgatcttcaattggcttagctttccctgatgccatttgtcacccgtaactcattggtgctccatctgccatagcccggaatccaggaacagtactcggtggtaaaaagttggagaagtagatacttgcaaatccagccttacgtgatctttcctggctttgataggttcagctttcatcctgaaaagttgtttaaacacttttaatttgtttcaagtgatgaaatgaatttatctcagaagaaaatttaaaaactttaaaatttattttatttggaagaaaatattttttaaatgattattagcattgtatctacaattatttatcttaaaaaggtaaatggccatctccattgaaacatactgcattaatttttactaaggacatcaaaatgctaaatatggttaggggaatttcttgacagttacatattattttgcctagatatgtgaacattaaaagcctattaaaggggacaaaaatatgtactttaatcagaatatctaattaaaatagacagaatagaaagaaataacattctcttgttttgtagatttataatgatctcattttcactatactaacattgttaataatttccaaagtagtatagaaaagcagtcttcaggaattttatcaagttaaaattgtgaatgataaaaagcatataacaaatttctactatacctcacaaaatgattgaactgttttcagacagttcagtatatgctaattgagtgtgactgaaagtatcagtcttctaaatttttgcattttcagaattttgacataatacattttaatacttttagacattggcaatgatttttaagaagcaaaaatgaatcataagtgctttccaaattaagtgaagtaattgtaaaatactcagctcagagcctagcacatagcaatttttgtgacaatcattgtttatgattgtgattgttacttctgactcctctcttcttgctgcactatttttgttccatttgtttgtagacaagtggcaatttccacaaactcaaagtgtgattacttttattgtatttttcctctagttcttggtgttttagaaatttctggaattatttccatatctgtcagcctaactcctcatctgagagcacacaatttttgtaatgcacatacagaggtgttgaagaacttgaacttgtctgatgccagtagtttattgctcattttgtcaagtatctaacggctttgagggccaagtgatgagctggatatggtcctgacctggagcagatcacacagagtgggatgggaagactggctccctgcgttgttagtgtgcctgtttgctgctggagtttggatctcaggattcctttgtttctgaagctagtcctaagatatcacaaaaacattattatgttttttgagaagattataactacaaaataacatgtatttttaaatgtttggcactaattcaagggctttccctttatttttatttattttagacttactagaatactttcagtgatctaaacatacataaagcaaaaagtaaaagtctctttcctacacttccttcactgcattgctcgggagaaactatttttgatattttggagtgaaagtttctggactgtttatacatgttggctcgatgtacatgttgaaaagataagttgcttggtgtgctcactgctgtggtggttgttttttacaaaatataagattatatcgtcctgcaacttactcattttaccagttaatttgtcatggctgtctttacatgtccttagtctttttcatggctgcataatactctactatgttgatgcatattggtctatttagtcattcctctgctgaggagtgctcagaagggctccaaattttatctgcttacaaatcatgttgaatcaacctcaaatgttggaagcttttgtccttggtcatctgtgcttgatttcaccatccactctgtggccatctgcataggctataggatacataggccacctgccctggttgcttgtttgctttcagggattattctaaaggttgtcatttgattttggataggcctgagctcagacaaaaaggaacaatttggttgtgtagggttttagggtaccagcatttttatagaagtttcttatttctacctgctcaaaatttaagatgcaccagatagcttggatggattttggctgtcatccttagatacttttatgttggccaagttctgagtttcagagctataagagtggtctgattcggaggttgcagtgagccgacatggtgccactgcactccagcctgagcaacagagtgagactccatctcaaaaaaaaacaaaaaaagaatgatctgattgtcaaatcttttttttttcattgtttattcttaaagtcaggacatcttttagaaaacactttgaaaatacatatgttgttttgtgattgtggaatatttttgtctttttatatttttgtacaggtacattgaaatttaatttgtgactcttacaaatggcataattaatcacagtcatagaaagccaaatacaaatatcctaaggttagcgtttcactggggtttgagtggtattcattaaggtgttcataaaattttatgttctaaagtcactatttacctagtagatatggtaacttatttttgtcatggctactggctatatctgagagtttaacatatgctagctgaaactgctgcatactttttaaattctgaactataattgcctagaatgaatgaaatcttttatttcaatagatatttttgcttgaaagatttcattttatatttatgaaatagtaacagattttattaaaggtgatgttaaattgttagaaatctaaagacaaaactgccatttctctttggtactatgataatttttcaacatattttaagcaataacctgctgttgattttaatagttttacctgccaacacagctggcatcctgctatgatatcattgctatacttttttatttaatattttacagagtgtatcatgcacagtgtggacaaccacattgaacaactattgagaatacgtactcattgtttgtgacattttacccttaaaatagagtgtggtcatcaaccagattttagagcacattaacgaaggaggtttacttttgcagggatttcttactgccaaatttttcctttgctatagctttcacatactgtttttgtgttttccttttccataaaacagtatttcttaaggccattgttatttatgtgcaaacaaatgaataaaaaaaactttcgctctttaacatgaagaaaaatattaacattgaaatatgaaatacagcaattcagtttataacacaaacgtatcttacaataatgggtatgcatttttaattgcatatatggaattacaaatctcatttttcttttctactgggattacaaaccatattgaaaaaaattttacagttcaaaaatcagatgactgacctgtcgaaagcgagttgtaacttattggcatacaattgaattactgatttttacactatttattgaatgtatataatttacttttattactgatttaaaactaccatcatatatataaaatagatattctttttaacatcaggtttttcttttctctttcagtctgtgatcaaaacagggcgactgctaatcagtcacgaggctcccttgacaggcggctttgcatcggaaatcagctctacagttcaggtagagtaatttttggaactgatttcaatgcttgtgcaattccacatgccaattccagaagaaaataaattacttatcacaatatgtgaaagcatacactttatggaaatgtagtgcatgctttcatatactgtgataagtaaattttttttcattttttattctgaccacactttctgtttgttagttaatgatctaattaattttctagaacagatatcttaaaatattgaaagctgaaaaattttttatgggaagaaagtttggaatgagtctactaaattaactttgcttgtatttgctacgttaacagaaagaaaaatctttttaatttgaatctgttcccattccctgtttatatgacttgaggttatggaattggttgattgtggaattgatcttagattttcacagcattcacgttctaaaaatgaatctctcaaaagtcaataatttaaatttaataagtaattttgaaaattatttattttagttattcaaattatgctatggtattggaaatgctttagaattgtttaaaaacctatgtttttttaaaaaaaatgctcattaagatgccacatatcaggaaaaaattttatacacctctttctggcaagttttacctaaaacctgtattcaaatttatatcatagacatatataagataatttaaggtagtttcattcttcctaatttttaaattgaaaattaagtagccatattttaaatggaaggtgcatgtcttttaaattcagaatatcttcgcagtttgcaaacactttacttctctttactggtgtgaagatgctttaattgttaaaatatatgaatagggaattcctttaagagtatatggcttactacattgttatagaattatgatatatggataatggtaagtttttatttttagatgtttaattagtaaacaatgatttttaccaatgaaatatcttaagtgctaattgcaaaattaaaatatttgtaaattagatgaacccaatttaaacataaatgttttaaaaactagatcaaagtaatccataattatagtcaaaaacgaaattatttttacaatttatatgtagtcactgatagtaagaaaagcaaatatttgagttttgtagatttattgttttcctagttactatatcaattaaaatttaaaatgtactgattattattatataacatgagtacctagtatttattgtgtattttatacattgagtagcataatacaaagattagggcaatcatttcaagccagaggcaaaactggaaaaagaaactggattttctgacttatagttaatatatagtctactaaaccatttgaaaggatagtgactgttgctaattgaaactttgacagccttgttgtgttttgttcactgcttattgatatctcaaaagtttcaattgcatataattaaaaaaggaaaacaagtagaacatagttggaattagatactataactcctcttgtgaagtttgctttctgtaagtgtgcttttaaagtttgatctctgtaagttattggtagactgcaatttaatacaacatttttttagattggaatagaattagaaagataatctaatccagtgtctcttggtcttaaataatatgtggtcttatgttaatggaaaaatgtctctcaggccccaagaatacattagtgaatcctagtttgagaagtagtatattaagaattaaacatagtcactataactaacataaaatatcataaacataatatcaaaataagatcctgaaattatgtgataattgtcagttgcaaaaattgtcaatgagagtatcagaatataatcgtatttatataataatatgaagacaccaaaacaaagcatcttgtagcactctcagactcccaggaatgtgttcatagatcctcaggtgtccctagtctatattttgagaaatattgatctaaaccaactgcattctttttacagatgagtgtcatccagagtgtttgtgacttacccattttataaagacagtggaatatctgggattagacaggagtcttgaataaatgtaaagtgtgtgcacatgcactcttaattcaaaatcccctgccttccacgaggaagataatagaagttttggacccgttatacaatgttctgttgttcatggcaaaattattcaccagctaaccacagaatgacttgagacaatagtgtaatatttgatggaggaattatatttaatattttggataatttgagtttggatttattaatatgagaaatttgaaaggtacacagtgtttttgcttaattcagattttatttgcacaaatagaaagtatagaaaatgaattttagtaaaatttagtgagcatgatatccataaatgtttgcctgttatggcttttatctactgataaagaagattagaaaaaaaactagacacttgaaaaattttttttcattgataattttcccatataattttgagtaatctgagtaataaaatatacctttcagtaactctttcatgcagatattcaactatgcaatatcctgtattgagcttcctctctatggaaagccttgttccatattataagtgaaacctgtatcaaattaccagtgccttgggttgtttaaactgagatcacctaagtttgaggtacaactgctttcaccacttagcatgattcatatttctctatttcttttttggggtatattttttaaggttaaaaaagataaaacagggttaagatattgaaagccaactttctgggacagcagagaaaatgtacacggacaactctttcattgttatctgggaaaagatgttttaaatcgtggatgagaatgatgtataaatttgagtacttttgattaaaatatgaagttattgttggttcaacaaatgcaagttttatgtcaaaggaaatgaaaacaatgtttgctccacaggcgatttttgatagaagatatctggtagctttttaaaagctcatggttaatcctacaaaattgcttttaaaatattttaagagaatgagtattaatagtaaagttattgtttttaaatacattaaaatctgaaaacacctgaaaatatgaactatgctgttttattcaaaagtttaagttactacctatattaaaataaaaaatattgaagagaatacagcactatggagagtattcttttaagtttataattggtatttttagatagaaaaattatgctatataaaattaaatatcaaataaaggaacatttttataagaagtggtattggcattactatttaaagcttattttagtatacagatcaaatatgaaagaaatgaatataagatggagtcataatttatttacaaaactctagtttatagcagatggctctttcatcgtgcaaggaattcagtgcccacatcttaggtttgtttcattcctgctacttttttttttataagcctatttattttaccattttacagaaatttattgttaacagtcttagtttgaaataatggtaaactcacagaagtgattagaagactattttatattgattagacataatttttaaacttatttatttaaagtttcttcataaaacatatatatagagagaaataaatgattacaaaaataaaaaacagtgcatctaatttacgaagtgctttatatttctattggatttaatttggaaattaactggaaggcagagcaagctgaggtctggtatatttggccccactctggggaagatttcttggtcagttatttaaagcttcactctctcttcttatcttacattcccatctgttctcactttagggtatgggaactttttcattcttttcttttacttgacacatactataacttaaaatgcttcttttagggagtcatgaattgtgcaccgtaatttgtggaaaagtgcaatgactatagagtttagataattcattgttctttttattgtgtattttaagcaaagattttattgtttcagaaaattatatgaatgaattttatttgatgcttgtatgcttcagctttatgtaaccccaggtttttttaagaaagcctttagtgtgtaaaagtgttaacctcatctattttaatatcacccaaattaatttatatattctagaatgtaatgttcaacatagctattatttatttaaatattaagaccaaatagtttatggtattttggctggtttaaatagagtaaatttttttaaggattgtaaatcagcctttattattaatttccaacacacctgcataatgaaaaaacaaatcctgagtctgataagagttgtgtgataattttttttaaagttattgtttatttctcctgctttggattcagtgcttaaaaagagtgccagaaattttagggatgtggttggcttaagatttgagttttttttttttttttttaaatcacatggaagcaataagtctgcaataaagagtccaattggagaggatggtaagtttccataccattgttacatcctttctgtgcggtctcttttcttagcataagaactcagaaactgtggataccaacatatattttttaagattatcagattctaatagttcaaaggatttttatagggcctatacaagtcattatgtaaaagaaaacttttaataactttcaagttaaaggaatttttgcttttttcagtgtttcatgttagaatagtttatggagaaggattttttcttataaacttattactactaaatttccaagcactttgtttaaagatatcaatctgaaaagaggggaaaagatcctatagggtcttgaatttttaccattctggaaaacatgtttcattaaaattgccgtgctggtaaattgtcatcagagaaaactatcagattagtaatttgatgagtagtttactgcaattttataatctcagttaacaaaaaatttaccagtgatacaaaacctttcctaatagcaacagataaaacaatcaggagaagtatacttctgtactaaaagatggagccagagcatcagaaaaacagtttaatgtggagtgtttggatataggatggcattttaaaactgtagtttcttcctgaagcctgtttagtattctgtaaacagcttctgtgaccacagataggaaccaaagtctaaatcactctggggatatattgtggattgggctgcttcattactgtttgtagttaaatccatgttatactctgttggttcttctccttgccctaaccacacctggtctgcttccatgtcatcttctcctttgcttgtttagtttccacctccaaccctttccccattcttttttttgagagggagtctcgctctgtcgcccaggctggagtgcagtggcgcaatctcagctcactgcaacctccgcctgccgggttcaagcaattccctgcctcagcctcctgagtagctgggattacaggcacctgccaccctgcccagctaatgtttgtatttttagtaggcacgaggtttcaccatcttggccaggctggtcttgaactcctgaccttgtgatccaccgacctcggcctcccaaagtgcctttccccattctttcctgggacgtctcaaccatttgcatggttactcttgaaaccttcaaatttgaaactttcaaggtttgacctgttgagctttagacccaaaattccaacattatgcttattttggtagagataaaacatttgtgtaataaaatgattatctggaaaaatttgaatgtgaaacaatgagaaaaggtaggcatatgcacatggttatttgctagtttatggaaatcagcttatataaaaatgaactctatttctcttcaactttttctggaccttttaaactgtctcctttttgtttgtttgtttgttttttgttttgttttgtttttttgagacagagtcttgctctggctccatcacccaggctggagtgcagtggtgcgatctcggctcactgcaacctctgcctcccgggttcaagtgattctcctgcctcagcctcccaagtagctgtaattacaggtacctgctgccacgcccatctaattttttgtatttctagtagagacaggggtttcaccatgttggtcaggctggtctcgaactcctgacctcaagtgatcctcctgcctcttccttccaaagtgctgggattacaggcgtgagccgccagacccatcctaaactgtctccttatctttgtctccagctgttcacctctcgtctaattactatgtattattttcttaaaacacacatcaaatttcgtccattgtctgtttgaaagcatccaatggatcctcattgggtctagcaaaaaaatctttatgtcggcattcaagatcctgatctactcaaaccagtcttccagtgttatttctcacatccctttttgactccagtatgcagatcacactggcctactggctatttcctgaatgataagtatttcttataaccatcctttattaagtattctggggatagccttaatatgggcatttcatccaagaattggtgtccttgttttagagacacttagagtttattagaagtcgatgataaacaggtagttatagtacatgttagaatggaatattcagagaactataggattataaaatacgtgctcatttaacccatatgtggcagctaagttaactcatgaaggataagtatgaacttggtagtgaaggtaggtgggtatttcaggcagaatgaactatatgaataaggaattaggcaaaggatttgctattgaaggaattaaagtggttttgtgtgtttaaagactagcatgtgaggctgtagcgtaaggtaagcgttgacaagtaggtaagaattagatcctgaagaatcttaaatattaaggaatttgtttttatgtggaggaaatagatatgacagagtaaagccagctcacatagatgtaacttccagttttctcatgtaatatatataaaatatactttatggagttcttggcaaatagaaagtagtaggagctgaaaatattactataattatttaaggcaaaagaatataagtgaagaattttaagcaggagattaatatagatttaaaagttagaaaaactcctaggtagttgtgtagaggatacactggggaggagtgagagaggaagtgatggagaattgctaaaaagctagtcacagactgcaaaacaacattttggtcaacaatggaccacatagaagatgttggtcccatgagatcatagtggagcataaatagaaacctaataatatggtgcttgatgtgggcattgcagatcaagtatgggaaatgattgatatttaatgctgcttctgggatatttggttttccatgtgaaaaaatatgtatataaataaaaatatatatcatctaggtttgtgaaagtatagtctgtgatgtttgcacaaccacaaaattgcttaatgcgtttctcaaaatgtattcctgtccttgtgactcattactgtatgtgattaaactaggtgagatttgacggtcttctaaaccaaggacatgggagtaggttagagaaaggtgaatttttcagatagtaggagagagaatctgaatgaaagacttgctgactcacaggagtggggtggggattgaagtggatgagggagaggcagacagaagtcaagaataaagcatagcttggtttctaggttggatgatttttgaatagaggtgcagtttcactgagatggggaatatcattgaagaacaggtgtatgcgtgtgtgtgtgtgtgtgtgtgtataaggtaatgagtacattttagatttgtatctgaaatggggatgaaaatgtgtttctggagctcaggagagaatctaaggtgtaggaaatgggtaaggattcattctcttatactgatatactggtggctgagttcatgggtatagatagggtcacataggaagagataatcttaagaagggaaagtttctgaagaagaagctgcctgggttgaagaagaagccacaccaacatttaagagaaagaaaggaagttatgaagcagagtgagagggagtggcttcagaaaaggaagggagtaggagagagccattacatgagacaagtgcagaagagtttgacaatagcatatatggccaagaatattaaatgcttccagaatttaagacagctaaagactaatggtcctaccttgcatgtagcaactggaagacactggtgactgatgaaaacagaagggtggccaggaagccagacaacatttagactggtgagtgagtaagtagtgaagacttgaaccgatgaatatagactaccatttcaagaaacttgactttcaaggaaaggagaggaatgaagtagttagagctaggtttgatctcttaatgctattcacttggcatagaatgccatttatttcctcaatttgcagtcctccctggcagcctgcctgtcttctccctctcctccctgcccctctccctgtcctcattctctcccttcccctccaaaccatctagcagtcggtttttaaacatctatcaaacctgacctcttttttccattttcctaataaactctaaatgaacttagaaaaaaaaaagaaaaccactaaatctaaaaggaaaaggtagaaaatagcttatattgggatgggcaagacatttttaatcagaaaattaaaaggcagcagactcaatcatactgttacagagaaatatatttgcataaaatggaaatttttgtatggcaaaaacaagcatgattttaaaaacaatgacaaatgagaatatgttgtaacacatgacagagaactaacgtgtactctgttaagcattcttaaatgtcaatacggaaattaatagggcctttatttaaagggtcagaaacagattagttttataactatagccagcaaacatgaaaaaatatgccacttactattgataaaatgctaattttaaaaatgtaatatcgtttgttacttataagagtgggactgcttaaaaatgaattttattttctgctgagatgatgtagaatgtgaatgtattaatagaaattgattcacgtttccaggatatcatattgagaatgtgtatcgagactcttcaaagtgtagatttcctttgattcaagaattctaggaatcctcacttaggagttaaacacaaaaatatgtattcatctcagtgttgttcgttcgataggaaaatatcggacacattattaatgacaacaacaggaatatattttaataagttatgatttgtccacttgatgaatgttatggatttatcaaaatcattaaaagagtagttgataacattgtaatatttgcatgaataaaatagtaaatgaaaactcacctgtatgcaaacctacaggtactttacttgctcaatgttgtgaaaagaaaaaagaaaaaaactttatatatacatacatctaggcataggaaaagaaacttgcactataagtcttttattgatttgtattttctaattgtttcttcatttttatgtacatacatgtcacttttttaataattaaaagctttattatatgtagatgtttctctcacatgacatggttattcttttaaatcttcctagttgttttaaattaaaaaacccattttgcttataaagttgttttgcaaagatttcatattacttattttgacataattcctttatcatgtacatttgagttttgggatttaccattcatagtgatggtggttacttactcagaattgtcatgtgggatgattttaaaaccaatgccacctcaccgcataagatttggtttttctgcaggttagtgtctgtcttctacatgtatggcatattttgattcattgctcttattacagaagtgaaagcagcattgtattggggtattcagattatttaatttttctgtattaatcagtaatgatactgaaactgacattactagcatgtaattgatactaacattgggttcactgcttattttccatccctctttttggtattgaatttatcatgaattgtcatcattctttttgaagtctttctggatttaagccagtcagaaaaaagatcatatttcatctccctgagtaataagtgccccagtttctctcatgcaattcttggtatttctgtagtcataagtagtcccccttgaattcaaaggtgcattcataccaagctcctctactctttctctgttgtcaccccagtaagctaaggaagacatttatatttacatatttaccaatgaagtttcgtagactgaatggactattaattagtaaaatagattctctgaaggaaagcattactttatttaaaaagttaatggtgatttctatgacttggtccctttttgttgttttttaataccttaaaagttgtagtttccattcattgcattgatccttgaaaatatggctgtatcttcaaagaaaattatagtggatttaaaatattttcttatttggtatgaaatgattgtatttcagtatgtatattttaaaatgtacagccttatcttcaaaattttctaactacaataaggttatttaaaattttatacatgaaagacagcagataatgtatccataacctggctgattctcttggccaccttgtacaacattttaggcaaaaatgaagacacatattcaatttgccaagaaatgttagccatgttttgtcagcattgtattcacaatcagtaacaggatgggtctgcctcctggagacagaactaaatttctcattttgtcatgccctttgtaggcaataatgttggtgatgttgatagctcattttggtttggtaatttagggtaattaaacttacagatcaactcagtttgtgttttgttatgagggccattatctattttcatgaatgagttcacagctcactaaaatatagtcgagtttaaaatagacattaaaatagagattcactactgctgatgcattttctcctcaatttgaagttaaacacttgtgaaaattaagacaagttaaaatcagcacttactgcaaaaacaagaatttgaaaatgaaggttaaaagcagaaatcatctagttgataattgttttgatttttcaaatctatcaatattaatgtgagtctttaagatatctgaaaatttccatttgattggaaaatgttggatgtttgatcattttctttcaagttaacttaaaaagtgactttatttttgcttcttgattcatttgaagagacataacttttttgttttaatcctttagaggatcagataatgacatttgctgtttaagacagtttatatttcagatggcacaaagagtctatttgtctttatcaaaattattagctgaaaaggatataattcatgactgttctttaaaggggatctaaatatttatgtttttaaaaatgccttaaggtgactaacatttctaaacctatatttgtatcatccacatttgtaattgtgccattgcttaaaacaagtcctcattgtgtcctgtcttttgacaggattagtttgctctcttaattgtaacacattttcatttcttttctggattgatttaaattctgggcttcaaaaagcagtagcataaaatagtcaccatgcctgtattattagctgctttcagaaccactcagacaatgttttctctgagatggcttgtatttttaagtgttgcatttttcttcttgttctgctagtcttttttctaatagcaatggttaactctaatttatattagcagttaaaaaaactgaaacttaatcttgccttttcagctcattactgaagaatctcctgcctctgcactctgacacaaaatttatactttattttttaaccatgaacttttctgggcatagagttctacctaagtgtacatagctgaacaacttgagtgtattttgtgagtaatattccaacatcgcacaattctaaattttattaaaaccagcttttctgtggcagtcccaatacacagttcaagtacattaaaataatgaagtactgcataaatgttgataaaatagtcttctaatatgatggaatgcctaattatgtattctgttatcaatttacctaataaattaaatgcagtttcaattttaataaaacccgtgtactttataaaaataggacctttactaacctatatctatactgagtcatgggagcaacagtagcatgggtaaatccttctggtagtaagcatggatactcttatatctgttcagagaaccacagtatcttttctcctttctgcctgccctcttgctgctctttctgcctttaaaaaacaaacaaacaaacaactttccgggcagtgtcctccatgccagtcttgtgaacatgtggacctttgcagcaaaactataatattttttgtcaccatgggtaaactaagcattattttgggtagtttgtgcttatgaaggctttctccatcctagtagactaaaatagaagtatcctgtaatattagatgaaagtaagggaatgaggtttgatgtaggcaaatctttttttcctcccttggggttgatcaaagatgatactcattaaaaatactatgaaattgcttaataccattcgaaaagcatttgtaaagtggatcttctgtcagtataagggataagtgtgtctctgtgtgtgtgtgtatatgtgtgtgtgtagtaagagatgttgattctccctacattaacttttcaacctgaagaatatatgaattaactttttaaattgatacttttttaaacagtgtaattaaatgaggtgtgatatatgaattttctgcttatgctgttaattttctccaaggatatcatagctaactgtagctttactgttgctactagaagatatttgggcgatcagcacaatacataattaagaaagagattcttcaaatataaactaaggaaaaaaacaagtgggaattaggaaaaacatttaaaaacaatttctccttagagtaaacccaattttaatttttctttttagaacaaatgtcttattttgaaatgctggttaggctatttgaagagatttgctaagtacttaaacattcatttgtatgacttttcttactacttgccttgttactcaaaattgggacaaaatattttgtttattgatgaagacacatttagttaataatataaagcagcattatctttaacatcaacttcacattatatgttaaaagatttctttagaaccagaggcttggctcactgactaccagctattgaattattttccttagggacaaactcttagccttaagttaatgtcttctgagagggtagaattccttattatacacatatggataattgctttgagttaacggggaggatagatgggcttctcaggtactggttcattgaaagttttttgcctttcaactatgaaaccagcagtacagcatttttaaattgataagtgtttcatagacagagtctgaagccctgtgttattaatgaaggttttcattagtaaaagtttatttttttgtgtcacagaagtagagtatgattacttatatttatctttttatgacatatacaaggcaagcatttaagggtgattttattacatttgcattgttgttcatcagtctttggtcatctgtctatcaagtagagctggcatctatattacaataattttctttcaaaaagaaatgttcagaaatatacagtaagtgaccatagtttcagcttctatgtcaggccaaagggaggtgaactggtggggagtgagtagattagacccacttgttgttgatccaactgttaaaaacattgttctctttcccaccaagttcctaaattcttatttacttgcctaaacaggaagcttgcatagagtcagagagatcccaagctggtaatggaataatgatgaccatatactttgtcttctgtagtgggacaacagacataaagtgaggttgtttgatgtaaaccaggatgttcacttacatagttttcatgctacttaatgggaatatgtcagccaccatagtatgcaattaaaatttaagagattagtgataatggagttaggactatatagcaatttttctaaatcaaatttaggcctcttaatgtctgagaactttaaaaaagatcaagaatataaatgctattccttggttcagtgatttttttttttaatgtaatgttgatacaggatttttgctcttttagctcagctaggtccaggttcttgtctcccaaccaggaaaaattaggcgtgcagacaccagagagtgagtggaacagaatttattaagcaaaaggaaagttctcagcaaagagatgggtcctgtaaagcaggttcctggttgttcccttccagttttgaatacaagggcttttatataaaagcttgatggagctggattccctgtttgtataaggtgggaattcctggtggctccaccccattccccctggacgcatgtgggcacttagtctgctgagggcatgtttagacaagccccctgtgcacgttcccttatctgcacaaaacatgggtcagaggtttgcctgggacccttcccttactttctgcctaaagcaagctggttaactcctttcaatgtcaaagaaaaatttgaggtttctttgccagtagctactgcttcttgttcacttctataatttattcttagttagtgacaaactactcgagaatcattgaatgacttacaatttgttgtgttggaaattaaataatcctcagtagttcgataatatcaatgattcctaaataacttaaaagctttttttttccaaattgggtgttagtagttagtattacgcacaaaatgaagataaaatataattatatgatttagtatgccttttactttttagctgctcgagtaagtgaaaaaatgatcctttctattaataacaacttttaaagttttacaagcatggtgttttcaaataattgctaaaggggcaaattacactgttatttaatagtgaattaaggatctagggagaattgttaagcatttattatttcagtaaacttcactttcattaaatcatattgttaaaggcctgaaattctataaaaatttgtttaatggcatactgacatgttgttattcatcaaccttagggtctacgtttttgaaaaatatgatgagaaaagcccatttggcaagatcaggatctcatagaaaacagggatttagaagcaaataaatatgacattaaatatacttgaaatgtatatttaaaataaggacatgacttcctaaagaaactggaataatgagtatttgccaactgtgtagatacccctcccctgagtgatcttctgttcataaaataatgctgcaatatgtgattgcctaagccgactgtactttgtcttaaggtttttaaactaacttgtattataattaaagttagtcatatatgtatatataaatatataccatatatatgtgtatttttttttcttaaatactgtgaaaatgcccagccttttcagatattactctgagagttaagggttgattttcattgcctggtctttgttcatgtgtggaatggctgagtaagtaacacatagtattgggaagcttaggggcagggatggaggggtagggagcattaatggttaagtgagcattttgtttaaggggacagagcatatctgtgtgtatataaatagatgtcacattttaaaattctagtaaacacagagctgttttctcaaaacatagatttgctaagccctcattgagggattattgaatggccaattcatgtatatctagaacttactcatatatttccttgctttttgtgaggaaagagtagttcttctaattgttctttttatggttctggtaaggcattttagacagtatggttgcatataaaatttcattgcagaatctaaaatgcgagctaaaaatagccattttaaaattgattccatgagtactttacgggttatacatagtacattgttgaacttctcccttctttgaaatagtgagactgccaagtatatcaggagatgaagtgattatcaaactgcactgattaatagcaaaaagatcaaaggagacataaggttaagatggctgactagatgcagccaggaagtgcagctcccactgagagagaccaaattttagagtaaaccactgtaatctgggcagatcttcggagagaaaatgctcagattgggttgagaggcaatgttaaaatgaagggtgaagagtaaggaagctggcagccctgtgctgggtacctgaataccagggctagttcccagccccgaatggctcttgggaaaggggtgaatgaggaactgagggaaagctcactctcaccgccagcctctgggatcctagatcctagttacagaactccgtgtctcccctggatgtgtgagctgacaggggcatctccctggggagcaggcagagacaggccgttggacagcatggagcccaaaagttttcgtgcactggggagctccagcagagagcagccatagagctgctctgtggggagggctcttcatccctttctgggaggtgtggaccccagctgaccttcaagctaggagagagtgaaaccagcttccctgtgggactagagcacatctattctgcaaggcttcctgcctgctggccccacccagggtcacgcttagccaccctgtaggagtgagtgcacagcacagcccctgcagcacagcctgagtatgttgctctacctgagtactttcctagtgacttggaagcacattggatcctcccagtacagctggaatgccaacctaatccacaggctgtcccagtgcccccagggctgcttcatgcagcattttgggagtaagtagccaagatctgtggccagcactcaagtcaggtagaagggggcaagatcttcaggttactgggctggggtgggaggggagcagggtatgcctacctccacagagttgatccagagatagtgaggcatatcttcctcctgcagcccctgatcaagaaggccccagagcctgaaacacctaacaaaagaaacatgggcacagcatcagtgactggaaggaggctcccccaaggcccaggagcagacctggtgagggggccatgtctctcccccgcccactgcggagcatgcctgggaacatgaggaagaacgaaagagcctcatggtggggtattaacttacctaattaatggccattactcctaagcaccatctaatggattgcattgagactacagcaccaaaaatttatcccactactatatgctcctttgaaatccagcacaagaatttgttaccagaaagtggtcccaattcagaccccaagagagggtttttggatctcttgcaagaaagaattcaagatgagtccataaattgaaaaagcaagtttattaagaaagtaaaggaataaaagaataaaagaatggctactccatagacagagcagccccaagggctggtggttgcccatttttatagttatttcttgattatatgctaaacaagggatggattatttatgcctcccctttttagaacacataggggtaacttgttgacattgtatggcacttgtaaactgtcatggtgctggtgagagtgtagcagtcaggatgacctgaggtcactctcattgccatcttggttttggtgggtcttagccagcttctttactgcagcctgtataatcagcaaggtctttataatctgtaccttgtgccaacctcctatctcatcctgtgaattggaatgcctaactgtctgggaatgcagtccagtaggtctcagccttattttacccagcctttattcaagatggagttgctctggttcaaacgcctttgacatttctcccctcccttaaaagaacccttaatcttaagggttacagagggatgaagatcaatcttctgtaacttcttgatgctgaaaagaagcgatgacattcctctctaattgtcagggtgtcttgcattcagggtagagaggagctcagtcagaaatcatcggtatgtcaagggccatttataattcttgagttctgacagaatgtgatatctggaatattaataagtatttaagaaaacattcagtaagactattctgcattcctgcacaaagagtacaacagcaatatatttcacaatggtaaagcaagatcagcaaaattatcccaagtaaactaaataagaaggttttccatgaactcggcaactgctggaaccaagctgatatggggttactagctgattccactatgtgtccagaattagaatattgatctaatttctacattatccatcccttttgtttttttttctgagtagcagccagagatcactggttggttcacaggagtaagcagggttagtctaaattgtaggaaaaacctcaaaaataactgatgagactagaatttaataacaagtgtaccacagttcttgaaacataatttttttcgtctcttcagttttatatttttactaaagacatagtggtaagaccaagttgttttattatacttggcctatttgtataaagtgcagcaagaataattatttttcacataagctgtttttaaattggctttgatggaactctgttccatgaaaggaatcttagataagacttcttaaaagctgagccctgccatgggtttgtaccctcaaggacctaggagttgggtaaattcccctccttttatggtctgaagataacttggggctcctgggcctgtcatacagtgacattttgttacttaccacaggtcaggaaccctgtacaggaactgtgtagacaaggtatgaggccagttttcccaagggtcttttattggctctataagttaagtttgattcctcaaaggaaagcacaccatttcagttaaagccttggtgtattagtctattctcacactgctgataaagacatacctgatattgggtaatttataaaggaaaggggtttagttgactcacagttccacatggctggagagacctcacaatcatgatggaagagcaggggaggtcttacaaggcagcaagcaaaagagaacatgtgtagggaaactcctctttataaaaccatcagatcgcgtgagacttattcactgtcacgtgaacagcctggggaagacccatccccatgattcagttacctcccaccgggtccctcccatgacgtgggaattatggaacctacaattcaagatgagatttgagtgggggcacagccaaaccatatcattccaccccagcccctcccaaataccatgtcctcacatttcaaaaccaatcatcccttcccagcagccccccaaagtcttaactcatttcagcattaactaaaaagtccacagtccaaagtctcatccaagacaaggcaagtcccttacacctgtgagcctgtaaaatcaaaagcaagttagttacttcctagatacagtggagctacaggcattgagtaaatacactcgttccaaacagaagttggccaaaacagaagggctacaatgcccatacaagactgaaatctagcgaggcagtcaaatcttaaagctccaaaatgatcttctttgactccatgtctcacatccaggtcaggctaatgcaagaggtgggttcccatggtcttgggcagagctgcccctgtggctttgcagggtacagcccctctcctggccactttctcaggctggcattgagtgtctgtggcttttccaggtgcacagtggaagctgtcagtatatctaccattttggggtcgagaggacggtggccctcttcgcacgctccactagggagcaccccagtggggactctgtatggggactcccatgttacattttccttccacactgacctagcacagtttctcccggagggttctacctctgcagcacacctctgcctggacatccagatatttccacacatcctctgaaatctaagcctaggttcccaaactgcaattcttgatgtttctgcacctgcaggcttaacactacgtggaagctgccatggcttgaggcttgcaccctctaaagccacagcccaagctgtgccttggccccttttagccacagctggagtggctagaatgcagggcatcaagtccctagactgcacacagcaggggctggcctggcccaggaaaccattttttgctcctaggcctctaggcctgtgatggaaggggccaccgtgaaggtctctgacatgccctggagacattttcccattgtcttggtggttaacattgggctccttattattcaaatttctgcagctggcttgaatttctccccaggaaatgggtttttcttttctattgcattgtcagtctgcaaattttccaaacttttatgctctgtttcccttttaaaactgaatgcttttaacagcacccaagtcacctcttgaatgctttgctgcttagaaatttcttccaccagataccctaaatcatctccctcatgttcaaaattccacaaatctctagggcaggagcaaaataccaccagtctccttgtataacaagagtaacgtttacaccatttcccaacaagttcttcatctctatctgagaccacctcagcctggaccttattgtccatatcactatccgcattttggtcaaagccattcaacaagtctctaggaagtttcaaactttcccacattttcctgtcttcttctgagccctccaaactgttccaacctctgcctattacccaattccaaagtcagttccacattttcacatagcatctcactttactggtgttacaggaagtcagggaccccgaatggagggaccggctggagctgcggcagaggaacataaattgtgaagatttcatggacatttatcggttctcaaataatacttttataatttcttatgcctatctttactttaatctcttaatcctgttatcttcataagctgaggatatacttcacctcaggaccatggtgataattgtgttaactgtacaaattgattgtaaaacatgtgtttgaacaatatgaaatcagtgcaccttgaaaaagaacagaataacagtgacttttagggaacaagggaagacaaccgttaggtctgaccgcctgtggggttggacaaaaagagccatatttttcttcttgcagagagcctataaaccgatgtgcaagtaggagacatatcgctaaattattttcctagcaaggaatatttatatcaatgccctgggaaaggaatgcattcctgggggaggtctataaacgaccactctgggagtgtctgtcttatgtgcttgagataaggactgagatacaccctggtctcctgcagtaccctcagacttattagggtggggaagaactccgctctggtaaatttgtggtcagaccggttctctgctctcaaaccctgttttctgttgtttaagatgtttatcaagacaacacatgcatcactgaacatagacccttatcagtagttctccttttgccctttggcttgtgacctttattggacccttatcagtggttctgctttttccttttgtcctgttccctcagaagcatgtgatctttgttctgctttttgccttttaaagcctgtgatctttgtacctactcccagttttacaccccctccccttttgaaacccttaataaaacacttgctggtttgaggctcaggtgggcatcacagtcctaccgatatgtgatgtcacccccagcagcccagctgtaaaattcctctctttatactgtctctctttatttctcagctggccagaacttatggaaaatagaaagaactacattgatatattgggggtgggttccctcgatatactggtatcaatttactgtattagtgtgttctcatacttccgataaagacatacctgaaactgggtaatttataaggataaaggatataatggacttacacttccacatggctggggaggcctcataatcatggcagaagacaaaggaggagcaaagtcacatctcgtgtggtggcagacaagagagagtgtgtacaggggatctcccctttataaaaccgtcagatctcatgatacttactcactatcacagaacagcatggaaaagacatgcccccatgattcacttacctcccaccggatctctcccatgacatatgggaattatgggagctacagttcaagatgagatttgagtggtgacacagccaaatcgtattacttggtaaaataaccagtttctccaattgtgtcctgttaccagaaaaaaaaaaaaaaaagattcttattgcacttacactaataagtatattgtcataagttaagaatactcacaactagtttgcaaatttggagaaagtaggtagaaacaaatacgctccaaattttgttcaggggaactcctctttataaaaccatcagatcttgtgagacttattcactatcatgtgaatggtccagggaagacccacccccatgattcagttacctcccaccggatccctcctatgacacgtgggaattatggaacctacagttcaagatgagatttgagtgggggcacagccaaaccagtaatgtaaaatacaggagtatactttactcaattgttaaaagctattaatacctcaaaagtttccttgatgctgcaaaacaaaacaaaggatcagcaatgtttgaagcaaagtcaacaagattactttagtgttctattagttcagttcatgcagttaactcctgttctgcttgatatttatgaacatttcacctgtctatgagagtcctgaaagttttttacctctattctaatgttacaatcaccatagttatcagaaacctgcatttaagtgcacctgtcaaagtcttatagctgattataaaccaccttttgaagaggattaaaacaagacaacaattgtctgtgaatgataaaatgtcttaggaaaaaaccacagtcaaaaacacaattgacaaggaaatttggttacctctgtggcatacagtgattttatgtagccattataattattaataacatacagttattcatattggaattgtaggagtttcccataagtttggaacacatatgaaacatatttatacaaatacagtccaaagacaacatcactcctgtatgattttaatatatcaaataagccaaattttacctttacattagtgtgctattattgataaaccaaatttttaataaaaccttataaacaaatctgtttaaccttaattaatttgaccataaggtaatagtctcataaaccttttataaccctttacatttttttttaatgagcagatcagtgctatgaaaaacctgttgtgcttttattccaatgtttaatttatggaaaaactgaatgatgcccttttaactttagccaatatgttcacacacagaatctcttttacaattaatttttcacaaaccttccacaactggcttaaaccttcagctttattttatctaacttaaaacaattatttaaccttttaatcttagggaaaaaaatcctcattcccctgccttcttataatcttttaccaaaaaacacatttcactttctttacacagcttgcatgtaaaactgtttttagtagtctcaattatgtgttatagcgttaactcttagtgacttttacttttgatgaaaaccttggtaagagattttaattaggtactaggtgtggagtctaggacaatggacagaagtgcagataagggcgactgtttccagcatagcaagggggcatggctttccacatgtcccaggtcttatgtaatacacaatgatccaatgtaggtaaattgaacagttttccaaagtcaaagaagcagtttatgaccctaaactacttagaaaacctaatatctgacctgcctaatttggaccaaatgtttaaattttgaagatatctttattttgtcaataatttttgaaactgccttcatttccaaaagattactaaagtcatatgaagtaaatgacattacacattttacttttctgacaaactatttgatttaagcacttactatttttaaactaatcaaagttttttcatatataaacatcgcacacacacacaccatgtacaaatacatagagagacagaaggtccagtagttgtaagatttttcatttccagtttttaagtttctctttaaagcatgccttttccagggtctaataagcagacacagctggaaagcaaaactgatttccaaaaattaagggtcccatttttattaccagatcctggatctcaaaaagatggaattaaccagcctcccatgggaatcttacctctcagtggagagtgaggacatttccataacttgtaggtggccaagaccatgtttctctgatccatacttgcagagatgagtatctcccataactgccattagctagccccaaaagtatatttcctacctagttattacataccaaagctctctcataatgtgaagcaatttctgatgcccccagtgtcaaaaatgtcacacaatgcagtgcaaaacagaacagagccttaaattttgagagggatttatccacttccaattcctgggcttttatgagaaaaacagaggattttttttttcccccaaaatagggtctgtgctgcctcctctgtttttttcaaggagtcccaggctgttagagcttgaatatatgcttttaattaagctgatgtttaactatagcactctttaaaaaatgcccttttaaatttctttctttttttttcctagacagagtctcactctgtcaccctggctggagtgcagtgacacaatctctgctcactgcaacctctgcctcctgtgttcaagtgattctcataccttagcctctcaagtagctgggattacatgcatgtaccaccatgcctggctaactttagtatttgtggtagagacagggttttgccatgttggccaggctggtcacacctggcctcaagtgatccacttgcctcggcctcccaaaatgctgggattacaggcattagccaccatgcctgccccttttaaatttcttattacctgattttagccataccaagtggccaatatgtctggcttttgggctttaccaaatgtaacctccaagtgctcagagaatggaaaaattcaagttttgtggaggagaggagaattaacaaatggtaaaggtagaacagatatcaaatcagaaaggactcattccctaagccaggccaccattgtgatgatggagaccaaaagaaagtactgccacatggttacaggttcatgttcccaaggacatttctcaatgtgtggtctctgggcaagatggtcaccctaagtaacagagaagattggaaaaggaaaggagagagaggaaagcgttgcctgtggcagggtggggaagatgaagagttcagtgaggccaaagaaagacccactcattgcagccaacgctgaatcagaagttcagtctgctgtttgttggtcatgaaaggatcttttctggcagtcccatcagctcttaagtttccccctttagggagagaaaaagcgccccatgtcctatggtcccgtatatgcctaattctgtcacccatagccgtcaacaaagattgcaaggcagattaatccaaagagaataccagttaacatcccatagtgccaaacccattcttaactgagaggtactttactgaaagggtctttctaactccctaaattttaggaaggactctaaccttcctaagttgagcctcaaaccaagtttgctcaagcatccttgccttttattaagaggggcctttaacccactctgtcttaggagagactcttaattcccctaaattgagtctttaacccaatcccattctttacccaggcaaatgcaccccacttacccaaaagtcagccagttggtgtgtgtgtgcagatgattttcctttgggtcggagggtctcctcaatatggtcccttctgtgtttggccagaaagatgttaccagacgccaccacttacctcaagttagcctttggttcgggggtttcctcagtatttttccatctgggtcaccagaaagatgttactggaagggggtcccaatccagaccccaagagaggggttcttggatctcgtgcaagaaagaatttgaggtgagtccataaagtgaaagcaagtttattaagaaagtaaactttatagaaaagaaattccaaccaagaatttcatatcctgccaaactaagctttataagtgaaggagaaacaaaatcttcctcagacaagcaattgttgagggaatacatttcatctagaccagtcttaaagacatccttaaagagtgctaaacacggaatcaaaagaacaaaacctgctacaacgaaaacatataagtatataacccacagccactataaatcaactacacaatcaattttacataacagatagctaacaacatggggaaaaggttaaaataatacataccaaccttgaatgtaaatgggctaaattccacacttaaaagagacacagtggcaggcttgatataaagacaagacgaaagcatctgttgtcttcagtagacccatatcacatgtaatgacatagacagactcaaagaaaaggatggagaaagacctatcatgcaaacggaaaacaaaagaggaacaagagccactagtcttttttttttttttaaagacaggaccatattcccactgcccagactggagcgtagcgctatgatctcagcccactgcatccttgacttccagagcccaggtgatcctcccacctcagcctcccaaatagctgggaccacaggccgtgccaccatgcccagctaattttagttgtttttagtagagtcagggcttcaccatgttgcccaggcttgtctcaaaatcctgggctcaagcgatccacacatctcagcctctcaaagtgctgggattacagatgtgaaccaccatacctgggcaggagccactattcttatatcagtaaaacagactttaagtcaataaaaggaaggacaatgaagggcattacataatgataaagggtacaatccaataaaaagccataactgtcctaaatgtatacatacccaacattgaagcagccagtttcataaaacagtttcttcttggcctatgaaaagacttcgacaaccacacagtaatagtaggagacttcaacaagccactgacagtgttagaaatatcactgaggcagaaaactaataaactctggatgttaactcaacatgtgaccaactggaccaaatggacatctacagaacactccatccaactactgcagaatatatattattttcatgtgcatgtgggacatagattctaagagcaaccacatgctcagtcataaggcaaatcttaataaatttaaaaacaaatgaaatcataccaagcatattctcagaccacagtgcaataaaaatataaatcaatatcaagaagagctctcaaagctacacaaatacaattaaacaatttgctcctgaataactacacaaaataaattaaacaatttgctcctgaataactcctgggtgaacatagaaattgtcagaaataaaaaaaattagaaattaatgaaaatagggacacaatttaccaaaatctctaggatgcagccaaagcagtgttaagagaaaagtttatagccctaaaaggctttcattaagaagttagaaaggtttcgaattaacaatctaacttttcacctaaaggaactaggaaggaaaaaaaaagaacaaccctaaagctagcagaggaaaataaataacaaaaattagagaacttaatgagattgagatgcaaaaatccatacaaaagatcaatgaaaccaagaggtcgttcttcaaaaaaacaataagattgacagaacactagctagattaacaaagaataaaatcagagaagatccaaataagtacaattcgagtttataaagatgacataacagctgatcccacagagatcctcatagaatactgtggacaattctgtgcacacaaactagaaaatctacaggaaattgtcaaatccctggaaacatacaacctccaaagattgaaccaagaagagagtgaacacttggaacagaccaataacaagttaggaaattgaatcattaagcgccatgaaccagatagattcacagtcaaattctaccagacatacaaagaactggtaccaatcctactgaaactctgcttaaaaatcaaggagaaggggcttctccctaactaattctacaaagacagcatcagcctgataccaaaatctcgcagagacacaacaacaaaagaacacttcaagccaatgaacatagatgcaaaaatcctcaacagaatactagcaaaccgaattcagtagcacatcaaaaagttaatacactatgatcaaataggctttattcctgggatacaaggctggttcaatgtaagcaaatcaataaatgtcattcaccacacaaacagaactaaaagaattactgggataatctactgattacctcagtagatgcaaaaaaaacttttgataaaattcatatctctttatgataaccctcaataggctaggcattgaaggaacatacctcaaaacaataaaagccatctatgacaaacccacagctaacatcatactgaatgagcaaaagctggaaccattccacttgagaaccggaacaagacaaggatacccactctcaccaatcctattcaagatagtactggaagtcctggccagagcaatcaggcaagagaaagaaataaaaggcattcaaataagaaatgaagaaatcaaactggctctcttcattaaaaatatgattttatacttagaaaaccctacagactctgccaaaaggctactagaactgataaacaattttagcaaggtttcaggatacaaaatcaatgtacaaaaatcagtagcatttctatatacagtaatgtctaattgaaatatatactaaattatttttaaaacaacttttagattttttcttacaaatttttgcaatgatgttgtgaggatgctttccttttgcaaaaggcttattacataccttttccttttgcaaaatgtttagttctgtaatcatgacataatcaacatgagacatgttagaggattggatgttcaaaatgctgactttcctggcaaaacctatgttgtcaagtaggtgataaaagtgttttctaataaaacaagcacagtgcttatttgttatatgtcagtgcaaaccaaatgagcttgagttttctagctggtcgaattttaaacacaacaaccagttatttctatcgattgcacttatccatttgtttagctttaaaccatattctggatttgttgttttgtcccattacactgttaaaggaaaaagagaaaatattccatgaagttttgctgagacaaaattttggaataaaatgaaatatgagctatgctgtaaaacaaacattgcaatatgaacatatggaatgaagcagctttattggaaaactcagatctgtggaggtggcagcactcatgtttgagattcacaaatgttagtgttagcttaagtgggataatgatgcttaaaaaaagagcagaatttccagtgtgcacagagaaaaatactgataagacttgatttattaaaagtaggaagtaaagtcaagtcatatacagaaaagtcctcacctattacctgaactcaaagggtaattcttttgtattgtatggcttcagttagttggatttacgtaatcttttattttttaatttagcattaaatgctttatatatatatatttattatgccttaagttctaggaagcggatttgcataatcttatgtcagtatccactggcatcgaggtggagccactctaataaatcctgcaggctagatggagaaagaaagttttttaatttatttaacgagttaagttcacttacatattgtaactgaataagtctggcaaaaatagatgacagacaaaagaaccttagagaacatccaacacagtttcccatctcatctgctttgatctctcctgatctcctttcaacttcttcaaatgcctgggaacatgcccacaccaacctaaacatggatggacacaagcttctgcataagagccagaaaggatactgacacaattgaaattgagcatttggcgttcatctatgtcaagcagaaatagattataaatccgtgtgaaattaaaaatagataagtacataaaatccatgcgtgtgtgtgtgtgtgtgatctgcttcagcaactcatcatttcttcctttaaacttctgtaaagagaggtagggcacagcaaatagacctaaggaacttgagttaaaaatttacaaagcatcactttatgacacctctaattaactccctctcctttgaaagaatggagaccactagagaagtggtctgttaccttaaatgagtcatttcaattctgagtgaggcatgaatttacttaatgtcatagctttaggaaatttgatcaccatattcctttaagttattagtaatttaatagggaaaaagtaagacatggaatgaaatgaaagattattttatgtgaatttttgtgaacagaggaatattagaaagaaatagggtttaggaaatagtctataatttgctgaagataagtctatggtagtaagtgattaattcagaagtagttacatcctgataaaatcaaatactttatgcttgtgaaaattcgaacacagtataagaaagtagacatgtgagcaatactgtggtatttttgtacattcttcagttggaagattcttcacttgtagtaggcttttggcagatctgggtcattgttatcctaggcagagttggggtggggtagagattggttaataccttttgccattgctacattttggattttgaatttctgaatctggctaagtttgcaatacatttttattctctaatgtttcctaaaaattctgactttcctagcaaagtgaaaactgttaaaggtgactcaagaagaaaaagaaaactcaaatcttcctatagcatgagagaaactgaaccattagcttatttttccttaatgatagcactaggctcaattgattttattggtaagttttactggagctcaatgttttatacacagtgttctagaagattgatgagaaaacctagcccatctcattttataaattttgtgtaacttcaaaaccagacaaggataattaaagaacacaaaactgtaaatcaatctcactcagaaacataggtgcaaagtttttatagcaaactgaatccagaagttttccagaccaagttgggtttattccaggaatggcagattgacctaacattagacattgtattaatataatttattacattgattgactaaaaagaaaactataccatttcagtgcatgcagaaagagcatttagtaacattaagtaccagcttatcattaaaagaagaaattagaaacttcctttacctgataaaggttatctaccaaaaacctgtaacaaccactatatttaatggtaaaatattggaagcattagctttaatatcagaaaccatgaaacctactgaaactaattatatttattgttgtactcgatgtcctaggacaggaggtaaaagaaataaaaatgccgttcattgacagaatatgattttctacatagaaaatctaatttaggccatatatactgcttattagaattaattggagtttaacaatgttgctatagataaacatcaatacaaattgaaaataaaaactttaaaaaacatcagtatctatggtagtgactataggtatctggggataatctttaaaaaatcatttgagacctttatggaaaaattatgacttaaaataattaacattttttaaaaaagactatgttcacagatagattcattgcaatataagttgttgcttaatggatctctagagtcagtccaatttctaagaaaaccaagtgggtttttttttgaaaaattatgacttaattaaaaaaaatttaaaaatgttttttaaaagactgtattcatagctagagacatttattgcaatttaagttgttatttaatggctctctagggtctgtccaagttataacaaaatcaagctctctttttttcttgaaatgtgacaaattgattctaaaatgttgtagatgagtaagagcccaaaataaccaagatactccaaagaagaactgagtgagggctgatttctgctacatgttgaagcaaaggagccccccacatgtagatgttgtggacatcacttgtctctgtcccttaagagaccccaaaacacacagcactgatgacacctgttctgcctctcacctaccatgggaccagatgaggttgatttaacttgacttgtcctcctaggatgttcctcctatcttactgaactgctcttggggattaaatgacaaggaatataataatgcctaatacagggaggactttgacagtgattcagcagtgaatctagagccagcctgcctgaattcaaatctcagcactacttcttatttgctgggtggttaatctttctctgcttcagttttctcatctggaaaatggaaaaaatagcagtacttcttccatatggctatcgtgaagattaagtgaattaatacatgtaaaactggaacatcacctggcacatagtgctcagcaagtattagctcttcttttcattttgtttacacctttattcttttcatcaaaatgctttcatccttgtgttactctttgacaatactttgcattaagtttaatttaatgttaaattgtattcaaatagtacataccttaagtgataaacacaataacatatttatttaacatgtgaatagtgaacacctggtataggctgaggtttaaagtgtctaggaggtcaaataactatcagtttattagggagatatttttcaatgaacagcatgattactgagatccactacaatggggatatgtaaatagtacagtctaaacataaaaaaagggtgcctgagtgaacctaagcaaatcagtccagaagacttcataaagaatataggattttctctgagattgatgaatgagtaagtgtcctggacacataaacatataagccagccattcacagaaatcagttaattaaaaacctttgcaaggtgtggcaacagtgtgtgttgatagacaccaacaaatcagatcaataatttcatttccttaatggcaaatgatacagaaaattatggaaacagataaatcagatgatgacacagcatactgtcacatggagatatatcttttcattttttcatggagtcttacagctgtggattcatagcaggcttgagtactctcatttcctttatcctgaccccagcttccttgtggaagttggcttgatgcctcctggaggctcttcttctggagacttgatatgaggctacctggtaactgaaagcaagtgactggtacatgtaaagaacaatacagtcctagatggtggttacagtgaggtcagagtcagtttccagaagtattcattggaccaacctccagcatatcccagatatgttcctcatattgagccggggtcctcaagcctctctcatcatttaagttacataactagtagctaagtctgagactcgctccctagtccttcaacttgtcttcaccaccaacttttctttcccaagaggcataatggccttgaagaaacagctttatttaatcatacagactgcagttagaacctactacttattaatagctgtgttttcttaagaaacttattttcatgtataaatataaatctcaattccttatttgtaaactgaggatgattatagctaacatatagggttccatgagctaacatatacaaagtggcttgtgcattgacagatatttaataggaatgtaataaattgtttatattcttttttccatattctaaaattgaactgtatccaatattaaatccacctgccccctctgtcaatattctgtgcttcacagtgctaatgattttctattacatttttttcagatatacccccatgaaagaacctctgttaaattttcagtaaattaaaacttaaacgtctccagatgggtccatgaatgactaaaaaaaatcttctagtgaaaaataacaagatcgtcaacagaaaaagtgacaaacataaagtatatctagccattatagaaaatgtaaaaaaaattatttgtattcacattaggcctattttaacacacaacactgtgtaaatgtccagattgacttttgttagaccatattgtcagatttattttagtagaagatgaagcacacacttcataatggagtataaaatttaccaaagttgtagataatccattcaaatggaatgtgtctatatgtgttttggactacttaacactgcaaatgcaacttcaaataattaaattaaaaacataaaaattattcccaaaagtaatatcatgggctactttacattttattcaatttaatctagcaaaaaattttgaatgccagatactgcaaagaattctacaatcacaactaaggggatggtcactgaccttggaagagctgatagtctagtgagaaataaaacaaatatatgaattaattataatataaaataaaataagatgaacaaaattggaagactaagctataaggtccactaagcagtggctattttttttcatttcccccctatgtatacaagtgtttatttgtattatttttacaatttggggattgtgctgtgtgttttgattccagcttattttcatttttcattgtatcatggacattgtttcatattcttaacttgttcaaaagtcgtgtttaatggccataaggtattccatcatatgatagtaatttaaatattcctctatttttgaccatttagattgtttactcactgctacaagcctcagaagaaataaaagagcaaaaatacccctaaacatttattattaatgtaaagtgtgttcaaacatgttttctactacatacattaagcaaagttactatcagatcttatattattgtatataattttgtagatataattaaacagtactactcagattaaatggggaaaaaaaacccaacacaggtagattttcttcttcttcttcttctttttttttttttttgagacggagtctcgctctgtcgcccaggctggagtgcagtggcgtgatcccggctcactgcaagctccgcctcccaggttcacgccattctcctgcctcagcctcccgagtagctgggactacaggcgcccgccaccacgcccggctaatttttttgtatttttagtagagacggagtttcaccgtgtctcgatctcctgatctcgtcatctgcccgccttggcctcccaaagagctgggttacaggtgtcagccaccgcacccggccgtagattttcttcttaacttgccttgccattcacatgtatatacctaccacacatagattttcataattgtacccaaatgctatagtttattgtgtacttgctattatttgctataaaatatttctttataataaacctattgtgttttggggtggtctactattaaaagtatagtttttttgttttttgtttttttttttagacggagtctcgcttttgccaaccacgctggagtgcagtagcatgatctcggctcactgcaacctccgcctcccaggttcaagtgattctcctgcctcagcctcccgaatagctgggattacaggcacttgccaccacacctggctaatttttgtatttttagtagagacaggggtttcaccatgttggccaggctggtcttggactcctgacctcaggtgatctgcccaccttggcctcccaaagtattgggattacaggagtgagccaccatgcccagccaaaagtatagattatcaacaataaattttaatattgggagctattcaaagtgcattctgtgtactttttctgtctcatactttctacagtctcatcctttctatagtctcatcattaattttataaaaatatttatctttgaaatatttacttgtgtaataatgactttgttattttaacaaaagagtaagtattcatgtattttggcctgtggttttttttgtttgtttgtttgtttgtttgtttgttttactgaatagcttgtggcttgccatctttatttaaccatctggtgaaatgtttctcttccatactaaaatggctttattctttaccattttacttgttaaaacttttattttagtatcggggtacatgtgtaggtttgttatataggttgtgtgtcacggggatttggtgtacagattattggccacacaggtaataagcatagtaactgataggtagcttttccatcttcaccctcctgccaacctcagccctcaagtaggcctcagtggtttgctgccttctttatgttcatgtgtactcaatgtttaactcccatttataagtgagaacatgtattcagttttctgttcctgaaataattagcttaggctaatggcctccagctccatccatgttgatgcaaggacatgatctcattcctttttatgactacatgatattgcatggtgtatatatacaacattttctttttttttttttaatttccaacttttaagttcagggtacatgtgcagaatgtgcaggtttgttacataggtaaacatctgtcctggtggtttgctacacagatcatcccatcacccaagtattaagcccagcatctattagctattcttcttgatgctcttcctcctccaacccaaagccctgcatcaggctggtgtgtgtcattgtccccagtgtgtccatgtgttctcatcatttagctcccacttataagtgagaacatgtggtatttagttttctgttcctgcattagtttgctaaggataatcgcttccagctccatccatgtccctgcaaaggacatgatcttgttctgttttatgactgcatagtattccatggtttatatgtaccacattttatttgtccagtctatcattgacaggcatttaggttgattccatgtgtttgctattgtgaatagtactgcattgaatatatgtgtgcatgtatctttataacagaaccatttatattcctttgggtatgtaatcagtaatgggatcgctgggtcaaatggtatttctgtgtctaggtctttaaggaattgccacatcatcttccacagtggttgaatttacactcccaccaacaatgtaaaagtgttcccttttctccacaacctcaccagcatctgttgttttttgatgttttagtagtagccattctgactggtgtcagatggtatttcattggggttttgatttgcatttctctaatgataacagtaatgttgcacttttttcatgtttgatggccacatgtatgtcttcttttgagatgtgtccttctgttcatgtcctttgcccactttttaatgaggttctttttttcttgtaaatttgtttaagttccttataaatgctggatattagacttttttcagatggtgatatggtttggctgtgaccccacccaatctcacattgtgggtgggacccagtgagaggtaattgaatcatgggggcagatctttcccgtgctgttctcatgatagtgaataagtctcatgagatctgatggttttaaaaaggggagtttccctacacaagctctctctttttgtctgccatcatctatgtaagatgacttgttcctccttgccttcccccatgattgtgagccctctccaaccacatggaactgcaagtccattaaacctctttgttttgtaaattgcccagtctcgggtatgcctttatgagcaatgggaaaacggactaatacagatggatagattgcaaaaattttctcccattctgtaggttgcctgtttactctgttgatggttccttttgctgtgaagaagctcttaattagattcatttgtcaatttttgcttttgttgcaattgcttttggcatcttcgtcaagaaatctttgcctgtgcttatgtcctattgcctaggttttcttctagggtttttatagttttgggttttacatgtaactctttaatccatcttgagttgatttttgtatattgtgtaaagaaggggtccagcttcagttttctgcatacgattagccagttctcccagcaccatataaaacagggaattttttctccattgcttgtttttgtcaggttcatcaaagatcaaattgttataggtgtgtggttctatttctgggttctctattgtgtttcattgttctgtgtgtctgtttttctaccagtagcatgctgtgttgtttactgtagccttgtagtatagtttgaagtcgagtaacattgatgcctccagccttgttctttttgtttaggattgtcttggctatttgggctcttttcaggtttcatatgaatttcaaaatagtattttctaattctgtgaagattgtcaatagtaagttaatgggaatagcattgaatctataaactgctttgggcagaatggccattttaatgatatcagttcttattaatgagtctggaatgttttccatgtctttgtgtcatctctggatttctttgagcagtggtttgtagttctcattgaagaggtccttcacttcccttattagctgtattcctaagtgttttattctttttatggcaattgtgaatgggagttcacattcataatttggctcttggcttgcctgttgttagtgtataggaatgctagtaatttttgggcattgattctgtatcctgagactttgatgaagctgcttatcagcttaagaatctttggggccaagatgatggattttctaaatataagattatgtcatctgcaaacaaagatagtttgacttcctctctctttatttgaatatgctttatttctttgtcttgcctgattgccctagccagaacttccaggactatgttgaatcagagtgatgagagagggcaaccttgtcttgtgctggttttcaaggggaaggcttccagcttttgcccattcagtatgatattggctgtgggtctgtcatacatatatggctcttagtagctagaggtatgttccttcagtaccttgtttattgagcatttttaacatgaagggatgttgaattttattgaaggctttttctgaatctattgagataatcatgtggtttttgttgttagttctgtttttgccctgaatcacatatattgatttgcatatgttgaaccaaccttgcatcccacgggtgaagccagcttgattatgatcgataagctttgtgatgtgctgctggacttggtttgccagcattttattgaggatgtttgcattgatgttcattaaggatattggcctaaagttttttgttgttgtatctcttccaggttttggtatcaggatgatgctggcctcatagaatgagttagagaggagtccatcctttttgattttttggaatagtttcagtaggaatggtaccaagctcttctttgtagcactggtagaaatcagctgtgaatccatctggtcctgggctttttttgtggttaggctatttattactgcctcaatttcagaactcgttattagtctattcagggattcagtttcttcctggttcagtcttgggagggtgtatgtgtccagaaatttatccatttcttctgtattttctagttaacgtgcatagaagtgttcatagtattctctaatggttgtttgtatttctggcatcagtggtaatatcctgattatttaatatcccagtatttctgattgtgtttatttgaatcttctctctttttttctttattagtgtagctagtggttttgttttgttttgtttttctttgagatggagtctcgctttgtcacccaggctggagtgcagtggcgcgatctcagctcactgcaacctctgcctcctgggttcaagcgattctcctgcctcagcctcccgagtagctgggattacaggcatccgccaccatgcctggctaatttttgtatttttagtagagacgtggtttcaccttgttggccaggctggtctcaaactcctgacctcaggtgatctgcccacctcagcctcccaaagtgctggaattacaggtgtgagccaccacacctggcctgagccaccgcgcctgacctattttattaattttttcaaaaaaccagatcctagatttgttgatgttttgaagggttttttgtgttgctgcgtttttcagttcatctttgatcttggttattttttgtcttctcctagctttggggtttgttttctcttggttttctggttcttttgatgttctagttcttgtgatgttagcttgttaacctgagatctttcctagcttttttacgtgggcatttagtgctataaatttcctcctcaacactgctttagctgcatcccagagattgtggtgctttgtatctttgttctcattagtttcaaagaacttcttgatttctgccttaatttcattatttacccaaaagtcattcagagcaggttgttcaatttccatttagttgtatggttttgagtgattttcttaatcttgagttctaatttgattgcactgtttattatgatttcagtacttttgcatttactgaggagtgttttacttcagattatgtgatccattttagagtatatgctgtgtgacaatgagaagaatgtatatgctcttctatttgggtagagagttctgtagatacctatcaggtctgcttgagctgtcactcagtcaggagaactgggatcagggtcccacttaaaggagtaatctggctgcgttttggtggagcagctgtactttactgaggaccccttttgtccctgatccatttgggctgcccaaggtccacaggctggaccagctgagaaacccaaacagcaaaggtggtggcctgctccacccaccatgcccgctgtcttagagagaaattagaactcttgtcagctgtagtacacagagggaggtggctggagaccccaagtgggaggacccaccctcgagggggatttgtaactcggggtctcatttaaagaagcagtctggcaatgcctcaacaaaacagctgtgccatgctgtggaaccacttttgccctggtcagcttggactcttcaaagcccgcaggctggaaccgctgagtcgtcaaaacaaccaaggtggtggcctgcccctcccgcaaggcactctgtccgagggagagaccagacctctgtccatagaatatgggctggtagggggagctcaggcctctggtgggaggtcccacttagcgagaaggaatagatcggggtcctgcttgaggaagcagtctggccacattctggcaaagcagctgtgctgtgcggcgggactcgctgctcatccagaccgtttgtactctgcaaagcccacgggctggaatggctgagttgtttaaactgcagagatggcagcccacctctccccactggggttccatcccctctcaggcagcctccacactgtttccagctgcctggaattccaagccactgggtcttatcttgtgaggaaatggggcctgtagaactgacactgctcagctccctagatttagccgccttcctaggggtatgtatgaacctcctgccttgctggggatcccggggccagagtatgtaaagctctgggtctctgtgctgcctgagcaaccgctctgttgagactccacagagttctgtgtgttggacccaaggccctggtggcatgggctcatgaggggatctccagatctgagggttgcaaagatccgtggtttcttagggttgtacattcgttcactgcttcccttaactgggggtgggggttcccttgactacatgtcactcccagttgggccatcacctcaccatacttttcttcattctccctgggttgagttgttttcctgatcagtcccagtgcaagtacctggatatttcagtagaaggtgctgtatttactcaccccccttttgttgctctctgtgagtgccacgcactacagttgcttctgttccaccgtcttggcccccgatcccttgttttttttttttaagttatttatttttatttatttttagagacaggatcttgccatatctcccaggtttgaatgcagtggcacaatcatagttcactgtatcttcgaactcctgggctcaaggaatccttccacgtcggcctgccaaagtgctgggactacatgcatgagccaccgcaactggcctgtttccttcgtctagaaaatgaggctcttagtagttcactggcatggtgtaaggagtgaattatggaaaatatgtaaagcacctaccacaatatgtggcatatagtaagcacagaataagtaaccaattccttctcttttcttcctgtttacaccgcaatttagagtattaactggcctgtaaaagattctgtaaagaaaaatgctgtatcagttagagccttttaaaaagtgaaaatatctttcggggatcttcctcccatcaggcaagttgttggactagggtcacttctaaggtttcattcctatgctgtgattttaggattccgaaacagtgaaaataactggtatgcttcattaggcagtacagtgtcaagtttaggataatttactttgacagatcataaaacagatgttaaaacatttataaacctcaatgaattattttttaattcacagtccaattatcttaagattttaagccatgcttgttttagatttccttgaatcataatgattttgtttgcgtatgaaaagtaattccaattctgtatcattatgagacaaaatattcagtgaaactcaaactgctttttttttatttttcaaagcctttttttccttttgcatcgactttatttcagttcttcataagaatataaaatatactccttttcatcagaacttttcttccacagccactaagttcatatcatatgactatttggtgggtaacaatattagcaaatatgtttatgatatccattctttatttaaccttactcttaataaatggagaaaattatgaaatcaaggtacttcccacaaggaattcttaaagggctttataccaataacttttgtcttgtgacttctgttttctttgcctagaaggaatggaagaaatgagaggaaactgatctcatttgttttactctctcagtggctagttattatttccctgcagcctgaacattggttttgttacagagctttgtggactgccttcttgtttcatgcatagactatgccaaccttggatcgcagtggagggcagaagctatttagaagcacccaacagtgtggcttttattctgattgttttcaaatgtgcttagttggctcaaatcaggcttcccagaacagaatcttagggtggggtttagaattagagcagcatttctccagaaagatttacgctgtcaaccttttataaattaggactctcactgggcttgctctaattctttaaaacatttgtattccaattgctttcatctttggttgagctgtctggatcagatgtggccgttctctctgattttgcttctgatacacacttagggcctgtgcagtttctctcctttacccttaaggggcagacttgactaaaattcaaagatatctgtgttttctattgctgccaaaatacccaaataccgttccaaaatacccaaaacttaaagggtacacccccaacttaaagcaacacagatttaatgtcttacagttctgtaggtttagagtccaacacacatatcaatggtctaaaatcaaggtgtcaacagagccgcattcctttctggagaattctctaggggactatctgtttcctagccccatctaacttcttgcggcctctcacattttttggttcatggctcttcttctgtcttcaaagccacagaaattgcatctcgcgcatctcgctgacccttcttctatagtcacagcatctgctcaatgaccacagctaggggaagttcaccaattttaaaggcatgtgattaggttgggcccatctgggtaatccaggctactattcccatctcaaggtttttaattacacctgcaaagtcccttttgccatgtaaggtaacatattcgtagttcgaaggattaggacatggacattttggggacaattattctgcatatcacaatccctttctcttttccttagtagaccacactagtctggtgacttgaaggaacctagccatttctcttctacctcaccacagtgggcccaggatatagtcattttaaaaacataaaacccagtgtatcaggctccaggccagggcttctcagctgactgtttctattggtgtaacagactggattttggctgtctctccctctactttcctccagcagtctttggtcttgttttgagatgttttccctcctgtggtcctcagtctgccagtgttcttcctataactttatctctgtgtgtcaggatatacactgtactctatagaaatggcagtggaaccccaacaattgtgggtgtttgggtaataatccacaaccttatcattcccaacacccttcccattgtagctttcctctataaagagaagtttggagctcctaaaaccagatctgaaatttatttattcaattaatcattcaaatgtgcaagatgtggggagaattggatatagagatatggctcctgccctcaagaaattaatagtcaaacagggagaaggacatgaaatacaagcattgctgtatgtgggatggatgtctgtatatacagttggtcctctgtatgtatccctgtgttcttcatctgtgggttcaaccaaccacagatcaaaaaaattgggggctaggcgtggtggctcatgtctgtaatcctagcactttgggaggccaaggcaagtggatcacctgaggtcaggagttcgagaccagtctgaccaatacggtgaaaccccatctactaaaaatataaaaattagccgggcatggcagcatgcacctgtagtcccagctactcaggaggctgaggcaggagaattgcttgaacccgggaggtggaggttgcagtgagccaagattgtgccactgcactccagcctgggtgacagagtgagactctctctcttaaaaaaaaaaaaaaaaaagaaaagaaattagaaaaaaaaattgtactgaacatgtacagactttttttttattgtcattgtttcctaggcaacacagtgtaacaatcatttacatcatattatgtattgtaaataatctagagatgacttaaagtatatgggaggatatacatagattatatgcaaatattacactattttataaaagggacttgagcatcttcagattttggtatctatggaaggttctcaagccaatcctttatggataccaagggttgacatatgtgtatatttatatatgtgtgttagttatctgttataatgggagcacaggaaagataagcccttaaatttccctcagggattcagggaaagttgtccagaggcagctagggttgagcagcagatgtcatgacactactaaccagataagtcttctcctttcactcaggccttatggaataagctatgcttgtggaattttttatgtggaaaagaattacatgaaacaatctgcattgctcttctcactgtttttagagggaatcagtaggaatcagaatactggctgactctttaggtatgtgggcttatatgaattttttagctctttaatccttagtttttccattagtagtacccaacttgctgaattgtgaggtttgaatgaattattaaagttaagcttttagaatgggacctactacccagaaaatatttaacaatattattgtaatgtatcactgtcaccatttattactacaatctctcttgaattactcatcacttttctgacatcatcatatgaaacaagttttttaattcatgccagcttctccctcttacttacggtttaggagttgcctctaatgcctaaggaaacgtgtagccctctggttgtactgcaaaagtggttgcattttgaaggcaggtgtatacaacttccagagtaagaatatgtgtattcaggtgtaggcgttgtcagtttccaataagataatttataatgcttaatttatattaggaagatctcacattgttctcttctgtaaattatgcatgtatttgtaaatctaaaaggaactttgatttttctctctgattaaggtgtataattataatcttaaataaaagtgaagttcaaagtagcttcatttaaaatattaatagacaaaacataagatcagttcttttagggattggtttgtcagccacatgttagatctgcttagaaatcttcagtgaaataggaaacattgtataaatgttacctaatgtaaatactgctaaatttaagatatactaaaatttgagtattttccctttagtctcaaataagcaaaaggaaatctgagttatatgaaaatgaaagcatgtattcagcttttataaaaccattataaataagttatttttcctaccaagttaaataggatatgtttacatgttttaaattttagttttattagttacagtatcatattgtgaatagtagcaaatatgtccttatatagttctgggttcttgctttataatgtacatagacaaatatctttttaaaaaaatttttgtgttccacagacgcaacaggttttgataatttcttatttcacctgttggttacagtcacaataatatgttctttcttctaccttatgattgaccatttctgacataaaagttaagaatttgtatcatctaaacagccttttatgtcctttctcttttttcatacatcttgataattgtagtgtttttcatgtttgcttctattttctatctttccgagtttgcaaaacattattaaaacttcatttctagttcttcactaataggacccaaatctaagtctctcaacttcaggctctacttaagtatccagagttcacaattcagcgaccgtttccagggtggaggcctgtagaagaatcagtcctatttttacaaaaacagagaaatttgtgctcctaatatttgcatagtcataaaattgcaaaagttatattggttttacaattttaaattgataggcaattatgatttttgcaaatgacattctaataaaaattatcaacatttggttatggtagcgatggtgaagaaacacagtgaaagcaaatattttcttatgtcacttatacatgtacaacaatggccatatttctgaaatgtaaatgaaagtataatgccttcttcgatttttattttgaccactgagtaaattaaaccttcaataatctcataaaaatgagatattttcttgctatacctctgatatcccctgtcccctgaaaaaatatgaaattagtacagagccagtaaaaaataccaagaacacccaggatagattctatcctaacctaaacaagcttatattatgaaagtggtgttattttttaacagatcataaattagacaatatagttcatctagggccgataacttctccccatgcagctgttgtcactcttgggaggtgcttcctagaatgtgtgctgagaaggatgctataattagtgatgtctgccttgggtacagaatatcagtagtggttaggagcagtacacattttccatccttaagtatctggatgggaagagatctagagaacagaatatcatatgtctcctgactcataacttgggatctttcctcaattctactgaataacctgtagtggaaaaccatgtttctatagtcctatccctcgtccaggtggattatctgaacaggactcctgtggaatggttgtggtaatgtaattcatgtggacattgacaagttgccatcatgtggtcatgaggatggtgttggattccttatgtgtgaggctgataagggccctatgttcaattcttagtggtccttttaaacctacacctgtttatattttttatcaacatgcccataacttatttttcgtgaatccactgaaacttccagagacttgaactttgcctaaagtttaaaacaggaattttttaaatcccttaaatgaaaaatagttttaagtgtatcccaactaatatgaaacaggaaactaatgtctaatatccttgggaactataaaatattcaatagtaatcaaaacataaaatgattctcttctgtctttccgttattctctacttccaattacattttgtaaaatgtaaacaattgcacctgcaattgatggaaaaataccatcatgaaatcaaatgtgttttctgacttcatatatgtattgtagtatttaatattaagtaagctcagaagatacttacatggaatctactgccttttctgagcacaagagaagcaatgattaatagaatgtggtacttgctccaaggagcattcatttaagaggagggatgctcctatttgggtcttcactgtataaagcatttatatgtatattacttaacaactaaaaggtatgtacttatgcagaatactgccatcattgctcttttctttactgtaatggtaccattcatcaggtccatggaagccagcttctcacacattctctcttagacataggcgttttctttctttcttttctttttttttttttttttggtgacggagtcgcactttgttgcccaggctggagtgcaatggcacaatctcggctcactgcaacctctacctcccaggttcaagtgattctcctgcctcagcctcccgagtagctgggattacaggcgcgcaccactacgcctggctaatttttgtatttttagtagagacagggtttcaccatgttggtcaggctggtctcgaactcctgacctcgtgatccacccgcctcggcctcccaaagtgctgggattacaggcatgagcccccacacctggcagacgtgtgttttctaaagtggatttattagaaattgggatccccttaaccatctttacttagaggagactttggcttagtgacctacagttgtgtgtaaatgaaaagcaaaattaatgggaagtatactcacaaaagaaggactttaaagttgcaaaaatagcatgcatcaagaatagtataaaattttaattcctccatcgtcaccaataaacatttatggagaatccccagagtgactgactctggattttacatcttatgttaaactaactcttgcattctgttcttgctgttttataattaccccaaatgttctctgttacttctcctaatgattcttctttttttttcttttttctttttttttttttttttgcatacagcagagaatgcctgtgggtttaaaaattttttaactaatcttgatgaatcaattataatttataaaagtggagcataacagttaagagctcatgctatggaattggacagagctgatttcagatactgttctgccacatgcaaagtgcataactggactagtcacttacctttctgaacctcagtttcctcatctctgaaggggatgatgaaggttcagccctctcatagggctcatgacaattaatgagataatgtcacatgcttaataccagcatcttgtatgctccataggtgttagctgtctgtttgtaataatatttttgtgtttggttacacaaacccactttcttcatttgttttctgctattaatgccttttgaagtattgtgttgtttgtgaacacatagtacaaattgacttttgtttttttaattatcaattttgtttctgtaactgcacagaaaagtgataaattgtgagcttatattttcttttaatacatagatatcgcctcccaacatacatgaattttaagacactaaaaaccccttaaagatcttttcttaatcagtgtttagtaaatgggcttacattctagcgtatagaccaattcaaactgttctacagtagagaggaatttgtatgttggccagtttttcatacagtgatttctaactctttccccttcagtatttccctaacatacactttctcatccagtatttcttttagaattctcacacttttgccctcataactcactttcatattcctagagctcttttcttcacactgattgtgctgctccttttcaatttttccaaccttatggaattattagtgagaaaaagcaaaattattattatttgagacggaatctcgctctgttgcccaggctggcgtgcagtggcgccatcttggctcactgcaagctccgccccccgggttcacgccattctcctgtctcagcctccggagtagctgggactacaggcgcccgccactacggccggctaattttttgtatttttagtagagacggggtttcaccgtgttagccagggtggtctcgatctcctgacctcgtgatccacctgcctcggcctcccaaagtgctgggattacaggcgtgagccaccgtgcccggcccaaaattattttttatatatggtgactttcccccaccctttcatcttacagtagaggcagctcagaaaaaaatcactgaattaagtcattcagaggtcgtttataatagctattcagcagtgagctggttctcagtcctggttatccattacaatttcccagcatttaaaattctgataccgtgaccatacccaagaataattaaataagactttctgtaggtgggacctaggcatctgtttttaaagcccttcaggtgatcttaatgggcagctaagtatgagagctactataggacagtgttgtatggcctgattaggtaggaatgagagggagaggaagaaatcaggacaggagatgtagacttattttgataagttttggtagtgaaaggcagaaaagagatgggactgtaacttaaggaattagcaggaaacacaacatacctgagaaagaacattctagcatatatatatatattagcatatatagtagtgagtctcagctactcccctagggcagtgtatcagcaatttaggaaccagggatgaacatgcatttggcaaaacttcctaattttgatacacctttccctttctcactaccctcccttctctcttctctccccagcccctgtctacaatactgctatcctgctccctctgctcctcgtccttttctttcttaaactgggtgacagagcatctcaaagttgacttccctcatggtggccatatggctccagcagttctcagcaagagttctgaattcaccctgattagaccattaaggtcgtatttcaactagtaactgaggctgggggaatggaatatgctcatttgtgaagtcaatcaagaaagtacataggaagatgggaaaggatgctggtagacagccagtactacccactatatatgtaaaagtcacagtgattcaatgcaatcagttattttacatgtgcaaattatgagtggtcttgtatggggacggttttgaataacatatagaaagtactatatagtactgatatttttctgagcatcaaatatttagagaaaaaaatctgtggtgttttagaatataatataataaacatcaaataatttactagatcaaacatggtttattaacttaaacactgtagcatatagcagtctgtagcacatcttactgactgatccttttttgaaaaaatcattacttcacattgttgatgttgtggcagaatctaggacttctataattacatttctggagattatcaggcaaatgtgtggcttttaccttttctggttactattttatagaaaaatgtaattgctaggtatgtcatttaagaccctgcaatctatttgtctgaaaaatggaacaaatgctagtaagaattttaaatgactctcaaagcctcctgcaaaatgacattagcagttgaaataaaatagttaacagtctaaaaactgtttaagataaagcccataactattaattttaggactgttttgtatacaatgtaaatgacacatgtttgagttaatccatttgatggtggtgatcacattcttaagaaatgatttggtatctcaaagcagtttcttaactagacaatgagcagaaaacctgttgctagttttggaagtttaaattgtcaaacttcaattacttctgtttaatttgggattaaagtttgggattaaaaacacatgagcaaaaatctcataaccccagttcagtcatgagagaaacaccagacaaatttcagttgagggatattctacagaatatatgtccagtactcctcaaaactgtccaagtcatcaaaaaacaacaaaagtctgagaaactgtcgcagccaagggatactaaggaaacaagaggactgaatgtaatttggattctggatgggatcccagagtggaaaaaggacattagagcaaaaccgaggaaatctcaatacaggttgggctttagttaatgtgtcaatactggttcattaattgtgacaaatacactatattagtgtaggatgttaataatattaacaatggtggaaaccggttgtgggatatatgggaaaactgtgtactgttttcatagtttttatctaaattttaaaatacctcaaaataaaacgttatttttaaagatgtggggatacatttttcaggaaagagtctccgccataagcttactatagcagagcctgaatgctactgtttgatgaatgaaagaagtccggtattcttggagatcttctctgtaatcctccaggctgaggcatcacttagatttggcatttgagacctttattgttgacctatgaaattctgttttatgtctgtctctcactttgtttcaccatagtatagtataggttataggagcaagaaaactgatttttctttcaagatccactgtatgccaatcatgtactggatttcactaaaattaacacatccaatttttagaaactttgtaggatagaggactaccctttctacaaaagaggaaaacagactaagaagagtaagttacttggccaggcacagtggctcacacctgtaatcccagcactttgggaggccgaggtaggtagatcacttgaggtcagtagttcgagaccagcctgggcaatatggtgaaactccatctctactaaaaatacaaaagttagcagggcattgtggcttgtgtctgtaatcccagagaattgcttgaacccaggaggcagaagttgctgtgagctgagatcgcaccactggactccagcttgggcaacagagcgagactcagtctcaaaagaaaagaaaaaaaaagagtaagtaacttgcccagagtcacacagatgtttactgacagactacatgagagccttgtttattacttgactccaatttccagcctttctaccttctcatatatatgccttctttgttatcgtaagattcagattagcaaggtactctttttaacctgtgcctatgttttaaaaaaaaattgtttaagtttgacataagtataagccagcaggaagttgcaaaaacagtacagatgctccccaacttatgatggggttaccttccagtagactcattattgaaagtatcgtaggtcaaaaatacatttaatacacctaacctgtaacttagccttgtatgctttaagtgtggtcattagcctacagttgggcaaaatcatctaacacaaagcctattttataatgaagtgttgaatatttcatgtaatttattgaatactggaagtgaaaaacagaatggttgtatgagtaaagtacggtttctactgaatacattttgcttttgcaccattgtaaaatcaaaaaatttttaagttgaacatttcttaatttggggactgtattagttcattctcacaatgttataacaacatacctgagactgggtaatttataaaggaaagaggtttaattgactcacaatcccacaaggctgggaaggtctcaggaaacttgcagtcttttgcatttcaccatgaaagagttcgtccaactttttaggtttttattacaaaataaatagtgttttctctgccctctctgtacctcgtatttgaggaattctcatacttctctttcaagatgtctttccccacccattttgtttatggtggtaatattataccaatatggccagcttttatgtactttgtgatctcgctactatgaagttagcccccttcagcatttattcagaataatgcctcttaaaaaagtgtttaatgatttcataaggtccttggtgtttcttaatgtcttcctttctcttttttccctccccttttcccctccccttttctcccctcccttctcccctcccctccctcccttccttccttcctttcattttttctctgtgaccatctgtatgttcttttctttttgtctgccttttagtattaaaatggtcacctgacgaccatctgagttgagctttgtcaagaaccaagggctgaagttctttttgttcagactatgtttctgttaccagtattgagggactaaggactttcaagcccttctcattctcccagcctgagagatattaagataagggaaaactagattttgcaggtaaactttgatttgttgaatgcctgctttgtgccagacattgcatgctacgatatattctattaaaaggattcaggaagggcatttactcttttagctactggagtttgattttctttattatcatgctgatcagtgtacactggcagtgtggctgattgagtggaaaagggagagctacactgtcttgtcactcacctagttgataacagattcaggacaaggactctcgtctcctttctaatacaatattagccctaaacccaaagaagttgagatgttttgtcattctttagtttttcccaaagggaacatttttcacaacataaaaagttagctgattggaattaacttatactttataagagatcagtgcatatctagaggcgacatagtagaattttcaaacaatcagaaatctcataaatcggaatctaagggaaaacaaatataccctcctgaacgttgtataattgggtatacagaaaactttctaattttattttgccttcatttttagactaacttgcaattaccccaagttgctaggtagcaaaattattatggtactagctcagaatttgctgtattttaatcagccttagtgactgaaaacacagagagaatgtcaatgagggagaaaggttttcctttactgcccctagataaagcagatgaaaatctgtttctctccacggtagattcctactccttgccaaagatacaatagacaacatttataaaaatacaatctttgtgcatgttgctaggttgctcaattttgagcctttttctttacaatacataatcatttaaaaaatactgaaagaggtaagaaatagggagtggaaaccagtagtgtgagtaaatgggaaattgatatctttaaggcactagatatggtaataaatatattagattactagaagagaaaaaatacttgaatagtagccaagaaaggattccaattacttacaaactacagtgactaacttctttcaattctaaaatcccctattttaatttttctaagtttctgagaaatgggcattttagtattactccttaaaaacttttttactgaataaaataattttcatgaaattacaaaaacataggatctgctcatattgatagtgtgtttgacttaccactcactgtattgtgtctcacttagattaccagcaaaaatattactcacatctaatgatatttctgggtatcctataaatgaaccctgagaggtttcctggagagtcttgtaatgcttcctagctacccctgtatatattctataaaatatagccatgtaaagtatgaagacaatctgttactgtcttcctggcagggctggtcaactggccatcagacactgtggttgcatctggttgtcccctgcttcctactgctccattgtcccactttgggtgtctccccctcctccctgtgctggtgctgccctttcataggccttctctcaataactggatctcaccaggctcctttctgcattcctagctttgtacttgctgtgtgacctggcaggagtgcttctcctgggttctttgcagatctggtttctccttctcaaatgacaccaccttagaaagccctttcctgagcatactgtgcaactcagagctccctgttagtctctatcacagaccccttacttacttcctttttagcactcctcaaacaccttcccccaactaaaacataaaactctatgaggatagggacattgtggacactcacatattaataagtgattgaaacatgaatgcatttttaaaaagatcagtaccaacatcctaaaggctcgtggagaagggcatttgagctgactttgaaaagtagaatgtgaagatagcagggtgtaggaaaacaagagttttagaagagagaggcttgtgtcaaggtgatcttataaaaaaaaaaaagctttggtatgaaggcaggcatgtgcatgtctttactgggctttgtggagaaaatagagataaagaataaactttggggaaccaggaaaaccttttatctaggaaagggacatgatcaaaatggcaccagtgtggcatctagtggatgagttgaaggttcaggaattgctaagaagtaaaagcatccacaccctacttcctgtcttgctgacatatatatatatttggcctcatcagtagcaaagctcattaatactccaggatgatacagaatagaaatacaaactggaattgtttgtttaatctatatttatgcattcacaaatatttactgatccctgctccatgtcagtcattgtacctctgatccatttgggcttgtaaatctgtgtatgtgatacttggagatgtttttgcatacctaaaatgagacaccacttaagagatttagctgttgatactcgaaccagtgaagacaaagctggcaaatacctccctaaataggaaggatatgtatttaatttggaaaatgtcaatttatttgttaccctacacagtaagaattagatatctagaaacaactacaggtatgaaatataactgttgaaatgtgtgcttcttttaagaaactccaagagctacgtggaagcatgtgttgttttcttgtcagttttccttctcatatgacatttgctcctaaaatacccaattttttttctgcccagacctacacacccaacccactttagctgtaccatccttagattactatgtcacaaattttaccttgttttgaaactgaagtacagtggctgattttgctatttttgcatttatttgcaaagctgaattctagtaattaccagcaaagataatcgttttgcacaaaaagaggtatatttctatcttgaaactaggttatattgttaatgccacagaaaaggaaatggctttttcagaatattagcgtttgtagctcttgcttattgatagggaaaagttagttgccatagtgatctaacagcctctggagggaatgcagtcatggccttaagcatccggcaacccacccagttgagagagcccctctgaaaaggatttccttccatggaaattgagtttctaaaataaaaagagtttattttagcttagatttgcttataggtttgttttgcacttttacctactggaattaaaggaaaaacatttataataaagacagcatatatttcttcagggatgacattaaataatagatttttgtgttaaccattccataaatgtgctctcagacacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctctgcagctgtgtttaacagttatcagtttggcacacagcatgactgctttggagggagaatagacacttctcatcccttttggcatttatgaagtaaccaaagtacctactgctgaagtgattcacttgagcttaattagatttgctacataattagcatttgaagaaacctaaagaaaatccttgggggttggttatttgttatgtcaattgtaagcatgctcatttgggggggactaggaattgaaaatgatgaaatttaatgcaccataaacccagatgtattatatgcatatataattttttgaagagtttttaaaagctgtgcttcgcagggatgactgaaatgcttgtctcagacaactgagacctgtgcaaggggattgatccatcagcatgtgcccatgtctgcttgatggcgcttatgtgtgtacaactagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtatgtgttgctttaattgcaaagaaaaaaaatgaatttaattttatactcgagacatttctttaaatactcctgaagtttgttctttagtattagagttctacaaagtgaattaactgtggagaatagctgtaaaatactgagaggagaggttaaattttatattccagtttaagttaaggctaggataaaacttgtaaactatgtttatgtaaaatattttctaatctgtcaaaaagttgtcacattttaatcaaattacttagttacctaaatttgtctagccataaataaggaaataaatgagagggaacaagtttaatttattgatgaagcactctgatgattttttttacccttatagtaaaaaaaaaaaaaaaacaccttcaaacttacatcctaccatatgttcaccatcaaatctcaagtcagaatcaggttcaaatcagaattcaaaaccagttttagaactcaagtggcagctcatgccctgcatgcaggcaaacggctaggaattaatcagaaagttccacccatgtccatccttcctcttacttgctcatcttcccagcaagcactaaaaagaaaaaaaaaaaaagtacaaattcgtacggaacctactgtaactctgattaaagagatcctgtattccccaatgaccgaccccctagctcccccaaaaaggaattaaacggctaagctttttataaatgtttttaaaatccttattggacttgacataaacatgcagataattctactagtctctttttcataggtacaataatagcactaagtacagaattccccttgtatccaagcaagacttttacgaaaacttaaacctgaagtcttatgcagtgcacctaaaattaaccaggagccttggtgcatataccagcaaatgttgtacacctgtgtgatagtggtcacctcacttaacctctcccagcttcagtttcttgtctttactactacataaagttgttgaaaggattaaaggagactatataaacagctatttttatttatgattaaataatatctgtgtggttactatttagtctgggtaactaaatagctgggtttttttgttctttgtacacatgcacatattccttttttaaaacaggcatatgggcaaatacattttttttctatatgcctccatgttgtttctctggatttccgccaggatgggatgtgccaattatgcacggaattgtttgcgtgtccatgggtgcttatataagtcattatctttggtgtatgacaaatacacaaactcctgtatctctagtagcctgtaattcctaattgagggacatgattgaatttatgtagtttagccccaagtaagtagataaaaattattaagtaaatgccctggttcatctaaacaaaatatgtgactaatagctttttatatgaactatatacatttagtttacctaagtttattaataaatagtatctctgggcatttttaattttatattttatacttaactatgaaagtatccagaaccagattccagtcactaactacctcttcattaatggatcaatggttttatcagatttattagaaatttgtctatactgagcatgtaatatgtactttgtgaaaataggtataaaactgggctcatcttatcagcataccatttacccaattatgggagtaaaaaaggaggcatgtgtatttttcccctaattctgaaatgtctcccagttcttgaaatttgaatgtgaaaatgtgtgcatgcaaattaagacattcaatctgaaagacttctttgtataaaatactaaccaaatttaaagttgaaccatagggtaaatatagtagaaaagtatattttgaattctgaattttatttccattggatacaaacaataattacaattgctagatgtgttttaatgaatagtttgaactcatcatgctagcaaaaatcatctgcatataaataatagggcaatttcaagcaattttttcttacttaggtcagatattcctgccagaaacttgtttgctttgttaatttgttcaattattaaactttgagagtacaaagataaatttactaatggggttcaattaacaaatttctgattacatttccctaatgatgatagtatagaacatttatttctgctgtgctttattagtaaaattgcagtgatctggtgactggaattaaactgctgaaaaatgacttggtctgatttattcactgagcaaaaccaagctttaaaggctgtgttgctatggcacccaagattaactgttaaaaaaaaaaaaaagtttaattttagtaaaaacattggtacatctcttttggcattgtgtagataaaaatagattcccccctcccccttttcttgtcttttttatgtttagcaagtcctttgcattcttttaaacatacactaaaagaaatttagcatatttaaagagaagggaaaaagcagtaaaataaaactgttttatcaaaagattacaatttgtaaaatagcaaatatttcagtcatcattttttatatgtatatatatatactttttattttgtctaatttaatcctttcaaaaactgtctggcttctcatactttttagaaagatggtgccagagagggagaaatcactctattctggtagtttcgttttgtaattagtcttcaaacttaaaaacaggttgcaaaattgggacagtaacaagttttaggagaaatcttaatgtagctctaatctttcaaattctaaaagaatatgttttctgtttcgtgagacaaaagaattgtctggttgctttagccaggattgatttctgtcttcagaacaccatttggtggtgttaagactgctagatgaagaattttgtgggaaaaaaaaaaaaaaaagaagaaaaattgaatgctttgtatgatcatcaaaagccacttttcaggagtattttacatttcttggtgccaagcaaatcagaaatcctaccttacagagagcgatttgttcatgagatgacccagtgctgcaagtcgcttatgtttatcattatgcttccacattctaaggaaattccactttcaaacgttgccgtcagtgctttcttctataggaagaatttgaactataaaatttgagaagcttcagcgtctgtggaaatttgagagcattgccttttttcctctttattgaatgtaaagtgttttaacaaaagcatggtagcccagtacattttaaatgtcaaaacttgcacatagtgtatctcataaagaatttaaattttagactttgaacttttaaagcctcaaacatctttagaggctgactacagcaaataaacagaatgttttgcagagagatttagtgaagaaaatttttttttgccgttgtttctcacagtgctctgcaggtgaaaatggtgaggaaactttgatagttcaagactatgcaggggagaatttgaaagcagaaacaagcttttacagattttacctggaaaaacaaagtggtttatatgaggtgctagttcttacctttatgattgctaatttagattttataaaaattgaaatgagttaatattttaaaatatttaagtatggtctctggacaacaataagcacagtgtacttttttaaaaagtgactttatgtaagattataaattacagaaatgagttgtcacttccctgttgttacttatttctgattttaaaatagcaaaatttataaagctatagttttgagaaaatagtaattcatattcttaaaattgttataatctctaaattaatacataaattattgatttaatgttaaattttgattttaaaatttatttcagtttctataggtaatatattgaggttctgacaattttatattaatgtatgattttattctgacacagctgttgaatttgaactactaattatttctaagaatttgttaataccattctccaactttgttttaggcagctagattgtatccagggaaacccatttagatcagaaataacatttcgttctaacttcaaaaaataagcatccactttaaaaatggaatctgaatttaaataaaaatcctaatttaggattcagttccattctttaactagcggaaagaaatcttagcaaaaaaaaccaaaaaaacaaaaaaaaaccaaatttaccagattgccagtaatttgcattaaggaggaagagatggatttttttttaagtcagcaggcattgaagatagttcagtgaagttaagtaatagagatctcagattttaatttagtcaagattatgattttacatagaagcactgttgaaataggcttgataataatattttaagtgttatacaaatctggatgaaattatattatttactgtcttactcattggttcaactgtgttttaaaagtgagagaccttatatcaatgagtgtttgttctgtgcatctcatgtgcatggtgttaacaaaataaaataagcatacttctaacatttgggggagcatcctattagtttgggggtaggttagggactctgctttccaaataattaatttgatagatccatgctcttgaaaaattgggtacatactatttttaaactttatttttcaaacatgatatgtattgtttaaagcattagcttaaatgaaaaataatattttacattcgtaaagttctgtttatttaattcagtaatgaaattaatttggagttgttggcatactgccttcacaggtttctgtgactcatttgctgagaaagtgtgattcaagagaccagaatcatttttttctcatttgctaaaactcatgttttgactatgggcaaatgttcatggcagatttaaaacaaatttaaagtaaatattctgtgataatatttggaagctgagtgatgtctagccttacataactaggacaaatataaatctgtgagttcacggacttcaaaagtatcaactatacatcattttagaatactggttttgtttttctcatattcttagagtttaactcttatactactaattatgacctctagaaggtaattgcatttagaagcagaatatctgctgttttattaatttaataattaaggactaaatggtgttccaatttaggtttaaaagtaagcacattcacacagcatttaaaactatttcttaatgtttttttcctagagaagaaatgatagctccatgatcgctatatgttctgttcaatactcattatatttataatttatattacatatatatttatccattatatttataatttagtcctgtccaaataaaatatattctcatagttaagtgtgttgtggtagtataatgattacatgaaataacctggaccttgctgtttgcaaagtaatttaaatgtttattttctgagttgctacttggaaattaagttgtggagtgatgtttctcattggtccaaggagcaacataaaatcctgatttatcagataatcctacaggaaacgtatgcctgttttgacttatgatatgtttcttagtacaatgtcctgcttttctggctttccattaaatgtttagaaaaattagttaatagttttgcaggaaaagaaaggaaatttatcagtctataccagctatataagaagtaggaacatatataaaagacctataattttccgatctcactttgaacttttcttcacagttttccaactcaagatggtatatagtcttgcacaatgggctgtagccaactttccgtcagaagaactgagtaaaaattattccaaaattgttcttagaaataaatctgagcctggaattgtcttgcattaaaaaacaaaaagcaaatgattgctttaaaagcacaccaaatgatattggatggtctttattcttgactctgttttttaaagtgtgtatacgttcattacatccagttgtctattgggcttttttactctaacttttcggaagttgactgacaggccacttttctatagtgggaaataggcaccttgtgtgcgcggagggatttccagcccccgaccccggaaccagcaattagcgtttaggcgtcctgcaccccaccagggggcagcaccggacactgcctttcctagaggcctgagtgcatttaaggctttctggcagtgctctccacccctcttcctcatacaggccttacgtatttttggtattttcttacacattttaggcttagtaagtgtttaataaatgttagctgtttaggcattgtgctatacggatgctacttttcaggtttgaccgttctgtgtacctgaattttgtctttaatgataatttgttctattatttaaaataccttgtgcttattataaatatgggattcctttaacttgtaaaatctagcaattattgagcactatgacatgtcaggcatgaaaccaggtactttttatatgctactgcagaatctaagtagacatagaggcaagataacaatagagtcataaaacaatatgaaactgcaataatggggaattgtaatacttctattttgatgttgaataaacagtataaacctcggggaggttaagtcacaatggaacaaagatcccttcagatagaattccaaattccgtgctgtatcaattatattatgaaaccttgccataaaaaaaaaaattgttgaggatgagcgaagccacgatgtgtaatgcctgagacagaggtttcagtgatgtaactccagtgacactgtgacaaggagaattagggattgacatacttaaaacttgaatggagaaatagggttagatattgagagatcccaaggaaacctgtgaaaaccttaatatatgtgtttttatggacacataatatgtaacatattacattcatcaaaacatgggaataaattgacgtactcttaatttttaaaagccccataaatatattttacttaaaaccgtaatggatcttattcttttaatttgtgcttgtcctctcttacctgctagaaaatttaaaggttgtctgtccttcctaattttaacaagatacttcattttccaaaaatgaaacaagacaaaaaggtaaatttgttttgttttgttacagaaaatagtcaaatgaagatattttgcctgtgtctgtgactttaatgatttggaattgttatttcacattgtttgctttcttttctggctataatgtgcatagcaatccagatggctaatatataaacaattggagttatgcttattggaatcatttagtgtggcttaggaggttcccactacccaggaccatctgttcattgctctgtgtattaccttcatgatcaagtttgtgttttcagctccttcacatatcttagcctacacctttctttatatgtgaaagaggcttctaagactgaacttaactcatatggccctcaaggctatattgtcaaaccttgataatccaagcctgccttccacattaccattcttctttattcctaattcaattttttcccttatcattgctattctcaatagtagggtcttaaaatttgcagaagagtgactaagaaaatgggctttgtagtcaggttcgaatcttacttggctgtgtatgtagcgatttgatcttgggcaacctcctttatcttggtttcctcacctgtgaaatggagtataatactgacttcatggatttgttaagatggttaaattagataaaatataactcatttagcccatgcctggtttattattaacataatttagaatgaaaattctcctgttgcaaaaaggcatattcagaagtaaattcaaatactatattctaaaatttcacagcgtcttttggaagaaatagctacttttctttaagcacctgtcatatgtgctttcacattgccaacagaatatatgtaggcggtactaaattgttgttttggggttcattttcagtccttcttactggatcctgggtgcaactttagaccccaagtagctagagaaaagtttctctaggtgcctgtcgtctctggttacatgttacactataatctgctttggagcctcacagccacatatgttattgttccacgtgaactgagccagcttacatacacagctctgtggggagaaagaccataaacgaacactccccgtttctagcccatattctgcataatacatgtaagtctctcaacagccctgtaggctatgccattacttaattcccaatttatgtggcttactttttctgaatgaaaagtcatcaaatatggtttttaagttatggaacagaagaatatgattaatctgaattgtcatgaaaattcagggcacatggttgctatggttatggcgtcatgtatttataatggagagatactttgtcttcattaatctacaaacttgccagtgggattcggtattttttttctgtgtgtgtgtgtgtgtttgtgtgtgtgtgtacatacgtacgtacgtacatgtatacagcttctgcatgaaaacactgaggctgaacaaggtgttctgttttggtggtagtgcagagaaacatactcacacataaattatttatatgtgaaccaattcagtgagaagtaagtacagctgcttaattgacctaagggtcttatttccaactgcttaaaaataagtgtaaagtgaagttcatggaagaaataacttaaggctctttaatatacttttgttggtgaagagaatttcaagctgtttcagtcagttagcatatattcttaaaaagactgatatcctattcgtagtcttctcttatatatccttgaattatcttccatgatttttatattttatatacttataatagcgtattataacaacttaatgctacataatttacagtaatcgtttccaaattaaggaagccctatgtgtaaaatcacaaatttatgtaacataacacaggaacttttattcatataagaaaatcattattcactttactgttttcctttatttcagcatcatttattacaaaattaatactgttttcgaaaaaccaaaacaatatattataaagcacaacgtggagtcttctctcacctccttgtcattcccagcctcaaagggtaaccactgtttacagttcaagtgtgtcttcacagcagatgtttttctatgctcgtgcagacatatagatgtattcctggaaagagtgatgcttgcattcttgaggagttaggagcattgctatttgaaaaaataaaaatccagtttgatgatgttagtcattatgctgaaaggagtgattttaacaaataccaacagaacttcttgtggtaggccagctttccaagttactggttcaagagaacagtcattttataacaggtataaaatcaaagacgtttagtaaaatattttgcccttaattctccatggatagcttgtttatgaagagttcagtattcagggaagatggaaaaacagcccagtgtcagctaaagtaataaaaccgacttaatcccaaattgacaatttaaagccctttaaaattacttgttgcaaacaagaaataatccacccagtctgtcatctcttttcagcttattagtagtggaatctcttaggtggctctttaaaccgtgtgtattaaaagtcctaaagttgttcgtggagatttccagttgctagggaataccaacacttatttggtgtttgatattgtaaatcatgatagttattggggccaaagggaggtctgtaaatgtccagtaggttctctttggagctaatttgtgctgtttgcattttctttctgccccaatacacttgtcactggaagaaatcacacagggggtagggataaagcatgaggtatcatgattccttcatgtaaaaattttgctcaaattaaaatgtgaacatagtataatatgtaaaaaaaactggacctccttaaatcctttataaagcaaggcaatgtgtaaacacatgaataaatatgaaggttttattttaagtaatagctgtgaatgttaaaagtaatattattttccttagaatagtttaatcacatatcccttttaaattttttaagcctttaaacgttttattttcagtctgggcttggggactcacacctgtaatcctagcagtttgggaggctgaggctaggggatcacttgagcccaggagtttgagaccagcctgggcaacataagaagacctcatttctgaaaaaaaaaaaaaaaaaaaaaaagaaagggaagaaaggggaaggaagggaaggaaagggaagaaaaaaacgaaaagaaaaggaacaaaggaaggcgtcggtgatgtgcacaagtggtcacagctacttggtagtctgaggtgggattgcttgagtctggaagatcgaggttgcagtgagccgtgtttgcaccactgcacttcagcctgggcgagagagtgagaccctatttcaaaataaattcaaatttgaatattttacttgagtaacattttttttctcctgaaaataattttctacagtgttctactgtggttgaggttttcatgtttaaatcagatctctagcctcatgggactcatagtctctcatggaagacagataattgggcaactacaatggattatgccgagttcggtgctttgggagctcagagcacaagccccttcctcatctgccctgtagggctggggaggtgctgtcaaggaaggcttcccagcgggagtgattcctcaggtaataacctgagatttgtacacacatcagtcaggcaaagagctgtggacttggggtgtgagtggccagagacccagcattatctgcaaaagctagactatgagagagatgagaacacagttaagtaactgatagaagttcagtctggctggggcatggaggaattacaaacatttattatgaaagtaatacatgtgcattgtataaaatgtgagaaaaacagaaaatgagaaggtatatattattgccagtttcatgctgcagagttaactactgtgaacatttgttgcatttttataattctttccatttatattcgtagaacagcgtatttgatattatcccagtttggcttagacaatagatatatatacaggtataaaatgcatatgcatacatgaaaacacataataaaactgggatcatgcgaacatgctgttacctgcttttttcatattacagtatacttaaatatttttaatgtccttagatgcaattgtatttttagtaagtgaaatattttaagttgcactatttcatttctgtgagtaaaaaaaattcttgaagttaagcatcctgactctgtctgcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttggtaaaaggcaactttcagaagaaaataatgtgctttagaaaaaaaattcaaatttatagtagtatatttacatttttgttgttgttgttgttctgagatggagtctcactctgtcgcccaggctagactgcagtggtgcaatctcagctcactgcaacctcccccctacccctgagttcaagcgattctcctgcctcagcctgctgagtagttgggattacaggcgcccaccaccatgcccagctaatttttgtgtttttattggaggtggggtgtcactatgttggctcagctgatttcaaattcctgacctcaagtgatccacctgccttagcctcccaaagtgctgggattacaggcatgagccactgcacctggctatatttacatttaatagaaacatatctagcatatgtatatgtgattttttttttttttttgagaccgagtctcactctgtcaccaggctggagtgcagtggtgcgatcttggctcatggcaacctctgcctcccaggttcaagcgattgtcctgcctcagtctcctgagtagctgggactacaggtgtgcaccaacatgcccagctaattttttatatttttagtagagacggggtttcaccatgttggccaggatggtctcgatctcttgaccttgtgttccacccgccttggcctcccaaagtgctggaattacaggcatgagccaccgcgcctggcctgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcagctacttaaactgttcatgaataggcgtactttctgtatttaaaaatggcccctcaagcaccgttaatttacattccagttatttacatgataattcatgacattctgaaacttgcctgtatattatctgaaaaatggatttcttgagcaaaagatctgtttattgtatgtaaggaaaaattttacctgaaaacaaacaaacaaaccctaaaactcagcaccactaccatttccagaagcttttttaacaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatatgattagatcctttaccttttaatatctagtttttccaaaaatgatagtaatatcttttgaagaactatgctttttcaaaagcaaaatcaactctgtataatagcacattctctactttttaaagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcatgtattctctcagacataccggtgtagatgctatatttctgatgtcttcttaatgtctgtgaaagcaactggcatctacaataaatcacacttagagctggttagaggactccttcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtc

SEQ ID NO: 1378 - DNA, 239644 bp, Homo sapiens; identical to SEQ ID NO: 1377

SEQ ID NO: 1379 - DNA, 2461 bp, Homo sapiens
gtggcacaaggcccctcttgagaagacagcccatgagacctagctggggcctgagaacatgaatcaactgatgagacagctgcagagaaaagatccaagtgctcttttcgttttctgtgattttattgctcctggctactccatcatcattaaacacccaatggatctcagcaacatgaaagaagagatcaagaacagtgaagaactaacggataacttcaaaccaatatgtactaatgccatgatttacaacaaaccagagaccacttattataaagctgcaaagaagctgttacactcagagatgaaaatttttagccaggaaaaaattcagagcctgaagcagaccacagacttcatggctaacttgaaaaaacttgaaagcagaaagacagaacagacatctcacagagtggggaggatggaggctgctggctgagagagagagagagagagagaggactctggagatgccgaagcacaagccttcaagagtcccagcaaagaaaataaaaagaaagacaaagatatgcttttaagtttaaaagcagtaatttagagagacagtaggagcagcttgactgcatcatgaaggaatctggaggaaaactgaccaggtggcttgttaacagtcagtgggaatttgaaagaagaaaaccagatggaacaagaagactgggacttccccatcctgtggatcccattgtaggagagccagaatactgccctatgagactgggaatgacaactggaagacttcagtctggagtgaatattctgcaggggttcaaagaggataaaaggaacaaagtaactccagggttatatttgaattatggaccctggagttcttatgtaccgcattatgactccacatttatgaatatcagcaaggataattcagatttaatctatgcaatctatgggggaagactgatcttccaagcaatttcagcaaccatgagtttctggccccatgccaagattacccatatgttaagacagatagtttgctggatgttttaacaaaaggaggggattccagggccctataagagttggagatatcacctgacgatgaaggccatactaggacacttgacacagcaaaacaaatggagattacacaagtagagccagcaggacatttggactctaatactcaagataggctcatggcactgaaagcagtaacaaactttggcgctccggttgaagtttttgactcttgaagaagctgaagtattccagaagaaacctgatgagaccaacaaattgctcagggagctccagctcaatgagcatttgaacacctgaccccttcccaatatgatgtctcttggatccctcatacaaagaaatgcatcttgctgaacaggtgaccaataatcttaaagaacttgtacaacaagtaactccaggtgatatcgtaagcatgtatggagttcaaaaagcaatggggatttccattccttcccctgtcatggaaaacaactttgtagatttaacagaagatcttgaagaacctaaaaagacacggagtggacctagtgggagttgaggccacctggtatttgattatgtattatgtacatacttttccattcttaacttaaaaacgctttcacaagatatcaaatatttgtaaattgtgcttttaattaaacttcggaacagtgaaaacaaacaaaaaacaccttcctggaactaattatagcaaggttacaggatacaaggttaacacacaaaagtcaatcatttttcagtatgtcaacaatgaacaagtggaatataaaaattaaaaaattcactaccatctatataagcaatcaaaaaataagataggtataaatctaacaacatatgttcaagatctatatgaagacaactataaaactcttctaaaaatgttctaagaagaactaaataaatgaatagatattccatgttcatggataggaagactcaatattgtgaacatgttggttctttccaatttgatctatagattcaacacaatcccaaccaaaatcctagcttattacttagtagattcaatgaactgattctaagtttatatgaagaggcaaaagacccagaatatccatcacaatactaaaggaaaagaacaaagttggagtactgacactacccaacttcaagacttataataaggctacagtaatcaaaacaatgtggtattagtgataaaatataaaattaatcaatacaacaaaatagagagtccagaaataggacacataaatatagtcaactgatctttaacaaaggagcaaatgcaatacaggggaaaaaacagccctttcaacaaatggtgctgaacaattggacatccacatgcaaagaaaaaaaaaagaaactagacacagaccttatattttttacaaaaattaattcaaaatggatcacagacctaaaacacaaaactataaaactccaa

SEQ ID NO: 1380 - DNA, 12146 bp, Homo sapiens
ctactgcaactgttcccataaactgggtgacagagtcagaaaactccccagctaaacacccgtaagacttcatacaacacaatactctatactgtgatgatcacagctgccaaggtaagaaacagatttcgctgactttggtaattcttactttctataattcttaattcctataatttctataatctgaacttttaaaatgagttaattttatgaatatcagttcaatcttaggcaataaaatgacatgacaaagtgcttaaatttataaatgcttatccatttagtgacaggaaaaatgagacaactttgaaatgaaaaaggtcatattcatctttgatcctggttactggtttgtcatttaaatttatctttcacttttattttgcttttcaaatgtgaatttctgccaattaaaaaatcttccaattatgttaccatatttggtagtagtggttaatttctccatgcaaaaacaatgacttaattttgttatttattgctctgctgagaaacagtgcagaactgagctatttacatctgaactaatatgaatagtcatttgactacaacatgcacattatcagcatgcctattccaatattatcataatttcatacagtgaataatgaaatggagtttcagaatatataatacaagctacttttaaagtgcccttgaggatgtttcccctctaaagtccagtcaacttttaacaaacatttctaaaaaaattccatgctattaataaattgagttactgatattaaattcaatattgtatcataaagaagtttagaaattttaaaacaatgttcacaaacacaaaaaatctgacgttagagaataatttgatactttaaaaagttattttgacacacgaatattcttaactatcttattttcacacaaatttgattaaatggatttctgcctattaatgcctatagttttgtcaagttattatcctccagtggtactccatttcctctctcggatttagaaagaaaggaaaaaataaaataaatgccaggaatggagatgccacaatcaattttatgacttctgtttgaattctaccctattctttatgttacaatcctcaatttagtaaatgaaacgtttcctcattcttagatctctgtcagggcatacagaaaattacatatattttatttattttgattttcatatttcatatatatgttaaaataaaatttatctctaaaattctcaattcctatgacaaatgttaattctattgctcactacaaataagaactttgtaactctgtaagcagctttccttaagacataaaaaaacataatttttgtctaccactgaggtatcctaattgtgtctccatatctctatactcatatttttcctttgatagtacataaaagtcattcagtgtaggtgtcttatgttatttgtgcatttttattcaaatatctatcaaattacattctcacacttcaaattgggtgttcacgagttattttattgtatcagaattttgctatatcacatattactctaaaaagtacacatacttctggatagagcagaaattatattaaacttacccttagctcactagtatgtctcagttaacagaaattacagttacagagactgctaaaatttcaaatataatgtggtagtaccatacattgtgtcccaactagttcatctataccttaaggtgcaagttaagtattatctttgtttatgaagacatgtggtttcaaagtaagtgctaaaaaaagtgttagatgaaatcaaatggaaaaaatatgaaagatgtttaaattaagaagcattaagttttaaaaacgcatgaaagagccagagtacttgctttactaaaaggcgtgacagcactatcatttcctaaaactcaaatatcaaatccattttatttgtattttagtaggcataaaggaaaatgatcacatttgggtatataatcatatctttaattagtgagattaagaaataataaaatattgcataaatacaatagtttcagaaaattttaatgtattttaatgttttaatgtactcattacacatgtacactaaattatgtaatatattaaatttttaattaaaaaacctaaagtctagttacctctccaaattagacaatatattaccaatcccagaaatgaggagggccaatgaacacttcttttttattcttaaagagcaatttcctaatatactcgtgtacacaaatatttcatttggtcctcttaattatatatttgatactgcatccctattctacaatttaggaaagatgcaaaaaggtgaactgctcaagatcacagaactaagaaaacagggaaaccttggcagaagtttaggttttgtcactaagccacatgcacatcctctatatactgatcagcatggcttaaagtaaaccatgacactgacaaacaaaatttgaaagcccccaaatactgtaaatgatattctaaaaggcaaaaggcaaattcagagaatacaaacttctattttaattaaaagccattccactccatttaaattcaatttatgcatagcattacattcttaatagtctaaattatattctactgatcattttcaaaaccagaaatatacgaaaattacagatgcccttagttattaagcaatacctcctggaaggcaaaattcaaactaactgcacagactttaaaaaaaataacacaccccaatcaatcaaagtttccttttatttgtttcattgctaaaatactcatgccttcaattcatctgatacctaaaatccaagttaacatctcctcaaaactttcacaaaaatcacatttcgatactttattctaggttccctagaatcaagtagtctctttgtacaatttcaaagttcttacccagagtaattctgaagcatgtgttaccaaataaacacatgaaaatgaagcctggatgtacagcatactcatagtcaactgaggacctctagtgcctttgaaaaggtactccatctttagttttcaacccccaacccccgcacaaaaaaaaaggttgactaactcactcacattaatagggggtatatttattaagtggcattcattttaaatccttaagactttctcaatactacctccccatattctcttcccccagaaaagattctgaatttccaactcctacagggttaagaagaatattttacttgtaaatacacttgtaaagcattgtttcaatatttaaaaaacaataatgaaggcaaacctacagacaatatagcaacagcaataagctaaattgtcagttttagagagaaaaatatctctgtgctgttgtttaatgaattctcctcaagacagagctttaacatgagaagcacttcattatgggtcaatttaggaatgagaatatattgatttttatgcatatacaattattttcataaccagacagaagcagcttgaagattctttcaaacagccagtctggaccaacaaagctctggaatgttgctaccacaaagtaacttcaaatagaatgtccaagtttagtattaggcaatctcaaaaggaaaatgactccactggagtgaacttttgtaagccaacagattcatcgtaaatctaatgatgaactgtcctaatttattaccacaagtccaaaaaagggtatatgcacattcacttatggcttatcagtggaaatgtcagaaagtagtagaaaaataaaattccaaacaatccaaatatagacaagtcctgtttattcaatctatagaaaattctaatcttctaaaccaattagatggaaaaaacatcctagagtatatcagactgtagccttagatattacttgaattcaatttaataaagtatttcttcagtactcccatgtttactaaaagaataaacaaaattaaaaggagaaaagcaaaattctaaattctacaaacataaagaatcccaggaatttattatttcagcaaaaggaataccaccaaaaatactgaagtttgagaagttctgcaagaagtgaacatacttaaagtatagatggagattaatgctcagcatatacaacatcattaaagtatcaattgtctagcaagtcataaagcaggccaccaaaagttttcagaagactattgaggttccttccgcacaagaatgcatctgatattacattgctaaaacaggactcactgcagacaaagtaaggactcctgaaggagttgatatatagtagcttccaccaaacatgttgcctaacatggtatatgacattagtcaaaagattagagttgcctaatggcttttctatttccttcttccacctcaaaaaaaaaaccagaataccatcttgaacttgattttttttttaatttccagcgttacttttcttgaggaaaggacgacaaccaaaggatttataaatcccacaaagaatagtaaagaattctttatttttattcttctcattcccctaaaaagtagagtaatcatggatccacagacataagatactctgtggatactttcctgcctctgacatgtaactcaagagacaggagtctggcatttctacacccaaactcctaacaagcacctttcatgttttcaatactcttgattctagggcctagaagacaatttgattttaaaattcatctataaatgaataccactcttgtgtcaaaacaaccaatttatatatattgtcattcttttaataaaagggtggagagcagcttcagtttccatggttgtttaggccatatacaagttcagaaaatcccaaaactatttatgattagactaacagaatgctctaaaaagatcagataacatgaaaataaaactaaactatttttgtatgctttccatcgaaaaagtactctattaaacagcttagctgttaagaaattaaaaaaaaaaaaaaaaaggaaactcatacagtggttgtcagtgcagagaagagaatgataaacatctgacaaccatgccataaattataatgtagtaaaggtcacagacaactccaaaaataggattctgctgttcccacaacaaaggttttcaattctcaatgtatgacaggaagccccatcttctatggataaaatctggcctaattatcatcatacaaatgttggtattcagtagaactaggattccacacatttcagatgataactgtaaaaaattgagcccaataaattaaatgtatatcattaacattttagcgtgtaaagcagatttaagtttaggcataaaatcataaagtagttacaaataactttaggattatggcatatttctaaatctgacaagaaacaggatactatttttggtcatctcctttacacccaatttgtttccagaaacaaactcttctttttcaataacagttagctgttgtaggattataagatcatctttaaagtatgttaactatgctttaaacagtaaagagctcatctctttagggcatatctctgtatttcacaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgcctaggccttccaaagtgttggaattatagatgtgagccaccatgccctgcccacagcattatttttaattaacaattttctaatagttttagtcataaaaatcccttatttaactttagtgatttattgaagcataccaattatgcactaagtactaggatactaaataaacacacagtttctttacttcagaaactatcagtctagctggggatacaaacatgtaaattgaaattgtgctataatctgacagatatcctcatatagataacactaaagccctattaaaaaccagtagaggtgacaaccaattccaccttaataactaatgaaaggtttcactaggaagtgatatttaaactgaaccttaagaatcaactgaagcttgcatggcagacaatcaaaaggtggagaacacattccaggcagagatagaacaacatgtgcaaagaacaaaatcacaaaagggaatggagtatttatggaaaggtgacatgtttcatgtgactgaagtacaacttaccagtgtcaacgtaggggatgactcctgtatatgcttcatgataaactcctggccaactccctcctttcccatgttttgtctcaaaataatttttaaaatttctgaccttttaagaccacttaagcccaaaaacctcacaaaaccatatgttcaaataggaattaccaagtctaattattattcctttcttaactgtattctgctacacatcttcataaaaggtgactactcggccaggtgcagtggctcacgcctgcaatcccagcactttgggaggccgaggcgggtggatcacgaggtcgggagatcgagaccatcctggctaacatggtgaaaccccgtctctactaaaaacacaaaaaaattaggcatggtggcgggcacctgtagtcccagctactcgggaggctaaggcaggagaatggcgtgaacccgggaggtggagcttgcagtgagccgagatcgtgccactgcactccagcctgggcaacacagcaagactgtctcaaaaaaaaaaaaaaaaagtgactactcaaatataaataaaatcttcccataattttccaatccactagatctacaataagcaaatatcaacataagcaaatatcaacataagcaacttaaaggatgaatctcaataaagaacaaaagaaaatctatttatattttacctgaagaattcaaacaaaagtcattaaatatatgtcaagtttaagctgctatgtcccttatttttaacttttgttttaagtttgggggtatgtgtgaaggtttgttacacaggtaaacacatgtcatggggagcttgttgtatgtattacttcatcatcccgttattaagcccagtacccaacagttttctgctcctctgcctcctcccatcctccccgctcaagtagaccccagcgtctgttgtttccttctttgtgttcataagttcttatcatcttgctcccacctgtaagtgagaacctgtggtatttggttttcttttcctatgttagtttgctagggataatgacctccagctccatccatgttcccgcaaaagacatgatatcattcttttttatggctgcatagtattgcatggtgtatatgtaccacattttctttatccagtctgtcactgatgagcacttaggccggttcatgtctttgctattgtgaatagtgctgcaatgaatattcatgggtgtatgtctttacggcagaaagatttacactcctctggatatatacccagtaatgggattgttgggtcgaatggtagttctgcttttataagctgctattttctaagtagaagtgttatagacaacctaaataacagcctttagccacctgtttagacaatgaagaatatatgctagaaaaatacaggtagttaataactctttaaggaaagaaaatttgatagaagttgagtgtttggaactccttgctacagaccaatattatgaagggggacagagtctcaagccaaaaatgcccagtctactatataattcagaatataatagacccaagttgaacactacagaatctaaacaccataaaccatatggtttctttgccaaagtaaatgccgggttctaactagtcatgcctgatacttaccttcccctttgccattctttcagcacttccttctgctcccttcagcactttcctctctcaggaatgggctaacaggttgagatgggcttttatgggatgtataaaaggacttaggagaaaataaaatctgacacctggggtaaggtagtaatatgttgattaacaataatatatcaacaaatgttaacagtcactatgtctggcagttaattactgactttttttctccgtttttcatttttcttatttcaaaattgacacataagtatactgattgaaaacaaaatgtccccaagtgttaataacgattatctctggacagttaatacagttaattttcagtctatatataatttttctgtaatgacatgtaaattcttattttattaatcatcaaagtataggccccacaggcagcaatagcttgtgggatctctgaaagaaggcatgatggaaactactactattaagtagaagtctgtaaataggatatgtctgtggtagtgagataataataattactatgtgttccaagcttgacagtcttcagtacttaacatcaaatcttattaaaatgttacttaagataacattctataaaactataaaatcataaaaaggaataacaatttgaatctatatttttggtaaaacacttcccatttaacactattttattttagattaaaattaagatccagggaacaatttgttgtatgcatttcctttttatgagattggctctggagctattaatacagtgactgatcaaaccaattacatctacagagtaacagatttaaagaaactatatgttagaacttttacccaaaagaataacccaaaacaagctgtaccttaaaccaaatacagcaggtcctcaaataacatcatttctatgtcattttgttataacatttaagtatgtgtggggcttgcatattctccccacatctgtgggactctggtttcctcccatatcccaaaacagtgcacattaggttcactggcatgtttaagttgtcctgggttgagtgtgagtgtgtacatgagtgtatcctgtgatggagtggcctcctatccaaggtgggttcctccctccttgagctgctgggattggctccagccaccagcaccccaaaccagaataagagggttgaaaaatgaatgaatggatgaatacaaattattatcgaataaaaattggtaaagtctacggtgatcatacaaatgcatgacaataaacgctatggcacaaaagcactcagagatcccaccgtatttgaattgtttttgatctgcatggagctggatgtgctcctgacaattttcatttctcaaacatgattccatgtttttaatagaccaccacaaccactgttactcactgattcaccaaatactgggtaattatctttgttggcttttttttttttttcctgggacagagttttgctctgtcacccaggctggagtacagtggcatgatctgggctcaatgcaacccctgcctcctgggctccagcgatcctcccaagtagctaggattacaggcacatgccaccagcctagctaatttttatatttttagtagagacagggtttcaccatgttggccaggctggtctcaaactcctgacctcaggggaactgcccgccttggcctcccaaagtgctgggattacaggcatgagccactgcacctggcctatctggtttttattaatctttcttaaatgtatacatagttcatatttctctcaacgtttaatattagaagtgtttggggtctttattgagaagtttggtgatgtttttgtgaccagaaatatgctataggaacttaactcttgtttacatcaatcagcctagggtaaaaatggttttgttatatgttgttttgcgtaaagtcatggtttccaggaacttatggaagacactgaggattactccaatacttgtagtaaatttgggagaaaaaggcaaggactaaagttactactcctaacacaaatgagacggtcatggtgtgccccatcaaaaaaggagagaaagagagacagacacatagaaacacgtgcacatacacacacacacacacacacacacacacacacacagagagagagagagagagagagagagagggagagagactatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaaca

SEQ ID NO: 1381 - DNA, 515168 bp, Homo sapiens
aactattttataatatctataataaatgcaaagaaatcaatacaaacaaaacttggctttagcaaactgtacatacataaatatctttttttttttactataacattcaacttttttcacataaagccttccatgatcttatttattacatctagtttttctttatacctctaaaaaaaagtgccttttagatttacagcttgtgcttctaaagcaaaggttaaaacatcatgccccaaaggaaaacaaggtaaaaaggaagctgccatataagctcttaaaaattgtatgttacaaggttctaaaatctcttcagcactggttggttggtagattgtacgacactgacatggtgcttgggagggtcatttatctgatggttggagcagcaccatgggaaagctgcccagatggtctactgaagtccttggctgtgcacagaatgggccaagggcccagaattcatgagtccggggaactttggaggtccttactcaatctccttagtgctaaggttcagagtctcaaaccagatttcttccaaaccttcttgttgtctgtttgttcccccgtcactgtttatcttccacctctgaagccataatttgcacacatgtgatctggaggagggctaaagctgccacaccgagggctttcgccaagatcaaggtcctcttgttggtagtttgggattgcttatgacccgatcctccttatgctaccagcacttctgcagatggcatctgcttagttcagagtggaggagggccattcgtgtatctgagcatggggtggaatgaccgggcaaagttgttggagagggcacagctgtagtcttcctctgacattggtacaaggcaggcaagcccgatgaggaggagcaggagaagctgaaggggaagagctgctcggaggactctgaacaggaagccgcggccggaccgacctggccctggctcagaaagggaggaatcggagccaccttttgtggacctgagagaagaatggacataaattactcagataactccagtgtcggagggacgctgctttttgcctctgcaccttcctggaagctaaagggccatgccaagcacaccccagcctggcgatcagctgccagccttccacagtgtgcccaggtcaccccccaccatcaaatgaggttgttggaaactgcactgacaagaaataaacatttagtcagtcaactaaacgtaagtaattaggttcaaattctactccttttaccccttaatgtggtgaaacattttctatcaacgaaaataactgctctatacacattctactagcatgaattaagtagatccagaataattaaaatgtagatatttgatgcagcatatttttgttttaagaatatcatgaacattgttaagcaaaattagttgctgtcagaatcataccaagtatcccatctagccatcctggatatgccaaaatccatgcagcaaaaataaaaacagtctttgtcattttgcacagacccataaaagcttcattaatcatagagcataccctggtttcatcttgcactgaatcagcatcaggccctgacattagcgggttccaaagctgtacgaacaaggaatagcagtggagtctgtctacagaacactggtgttgtatgatgtagatgctaggctgatcctatcactgacgtcattactttggaaaatggacaccattttctgaggaggatggactgtcatcctacagccccttctacactcaaagtgacaagtttttctatttcacttttatcttccttttaaacagtgcattagagattgagtacaggtttcagaactcttaagaaggactgcctggaaaatacagaatctggaagtagattctgagttgggtgctactgttttctttttgtgaacagccattacctttttttggttactagcagaaaagatgaagaaagaaatgttgtttacgacaggcatttggtgtacactcagacccatacaacattgaatgaacaaaaataaaagatgtagccaaaagaaacactccctcacaactagtataaattccttaagagttttaatatcaccaaggataaggacattgtatgtgaggctactgaaataatatgagcgtgtgaaagctgtattggtaactgtaggtttggtccagaagaaagcactatgtttgtagctcacctattacctattaatttctgaagacagactaccctaatatcggtgggggatgcggagtgacacctaagaaaataaatgttaaaaacagatagaatccccttagaagggaacagagggagtattcaaaactcttttattaaaccatcaaagaaaaatgggagagggctgggcacagtggctcccgcctgtaatcccagcgctttgggaggctgaggttggcggatcacttgaggccaggagttcaagccagcctggccaacatggtaaaaatacaaaaattagtcaggcctggtggcgtgtgcctgtagtcccagtcacttgggaggctgaggcaggagaatcgcttgaacccgggaggcggaggctgcagtgagccatgatcggaacaccactgcactccatcctgggcaacagagcgagactctatctcaaaaacagatattggttctgcagaaaccccaagaaacaggcagcacgcagtgtttctatacacttcttgtggtgtaaggaaaaatcaaatcactggtttaaattggaagcatgttcttttctgaaatccacacaagtaacggcagggtaatgtaaccttgaacaactcacttcatctctaggtgtcaacctcttcactaacctcttcaaattagcatagatggtcttctaactttaaagtttactgttcgatgtttttgtcttctactgatttgtcagtataaataatctcccaagaagccacaagagctcaatcaccatctagtggtcaaactgattaactgcccttgtgctaagaccaatgagttattcctaataagctgagggaaaaaaaaagtatattttgtgaaaatatagtagaacataaaagaagtatgtcatataccttattaatggaaaaggaaaatagaaacttcttgagttacctgagcataaaatattcatgttgagacagggccttagagagcatccagttcatctcctaattttgtaggggagtagctaaggacagttcatgtttactcttctaattgctaggcagcactctgagcatttatgttgggttctgtcatttaatccccacagcagtcctctgcggtgtgtacttattaacttcattttacagatgatgtgaaagaaagctcagggaagtgaaataactggctcaagctcacacagccagtggcagaagatttcaaccctgtgattttaactaccagaacctggagactctagacaggctgaatgacttgcttcagattctacagttaaaggaagaggcctagcagggactcaggcttccaaaatccctgcccaccgcactctctgctgtgaaatgttttgctggttggtgataggaataatggtaatggtaattcaggtcgtattcatttcacaggtatctcacatgtagaagcaaagaagagaatcctgaacttgcatcctaaaatatttggaaacaagtggtttcctcgtgtctaaagcctctggtcataaggcctcacagtatcctgcagatcatcaaatccgtgtgtggacgtggggacattttgttttgaggcagttacatgaccatgggcaagtaaattagtctctctggccttcagttttctcatttgcaatgattcaatggtttgccttaaagtgtcttaagaaggataggatagctacccacaaactttggatcaaattttcttcaaaacatccttcccctgactttaaaatatgccctggcaaccaacactcaacacctgtagctagatgagttataacagagtgactgaagagagctcccacaattcctagttattaaatacctgactaattttcattaggagacatttaagaactttagtgatgggaagatttacatatataattgatagtacaatctgacagagctgaatagctcctgtttgtcaactgttaaattctttgtgcaattaggtcaaagatcaagatcaaaacaagggctgcccattgacctgttcactcctgagaaaaatggcaaaccattgaatcataaatcatgacagccaaaataattttaggatattaatgcacccctcatctttgcaaatgagaaaactgaaggccagagagactaatttacttgcccatttttgataaaaatgtcaccatttacagaatgtggactcctatgttggagtctgttgaaggacatggcacatttaacagcatcagagcattttttattaaaatttaatttgtgcatgacttctaatgctgaagaacgccaagctaggaagaagtcatgggctgagatggggacagagagaacacacaatattcagtgactgtccgtgcagctggctgcccttgaaaatatccgaactatccactgggaaaatgcctgtccccttggggtaattaccagagtttcaacatgcccaaagctgcctcatcttcagggggaacttgttctagcgattttagtatcaagaagctaatggtcccagggaaagggttatttttaatatttagctactgtgctaaaaatcacctaagtttctagagtcttgggaaatttcataagggaaagaacaaaggcaacttgttgactacccactggtcattctcctctggtcttattacatacatggatgccagtttagattgtgtttatataggaaaaattaaatgtgtgagcctccttaaggaacatcatcaatacagatatatcagatagttctgtccagcaaaaaacgtgcttatttgctacaagtaaatttttatttatttttctcacttccctcactccttcaaatttccaggtaaatagctgcccaggagttgcttcatctctgtcccaaaatacctagacaattgcgggataaggagaatggcagggagggagtagtggctaaaatcacacccttcaaaagaaagtgtgtaggacacacaattgtgagaagtctgaatgccatgcacatagggtatgactcactttgaaaattgtttataatcaaggaaatgaaaatgagttaatttcgtgcatgcatcatttaaagccaaatgagaagaaacttctaatttattttgttacttttcggctaacactggcagtatgtaacagatttattttgcagaaacatctagattgtccgtgatcttgatcctgcccttatgtgtcttgtctttgaaacccagtgtttcctggatatatggttcaggagacaagtttccagaatcaagttaggacccaggtcttctttttttccaaaccaaacattcttgctaatcctaaactacctgaggcagcctgtggtggcctcagctctaaaaccattgtttaaaggcttctacccatcaatggcccttcagcagagtggtacggttaacggggtagggtctggagtcaggggagacctgggttcaaatcctacatctttacacctctaatccccagtgtccttgtctataaattgggaatatagccatgtcatgggattcttgtgagggttaaatgaggtaaaacacatacaatgcttagcatgtatacaattaagcactaaataattgaaacacattaagtactaaatgaatgtcagcagcttatcactattatctgtataatgataccaagggtgtgccgactcatacccttaggggttggctggattcggccttttctctcgggaaaacatacctgatttattaatagtgctttcaagcatgtgataaatttctcaaactgcctgtcttgttccctagaaacaccaggaaggcctacctcaaatagcaacagagaaacctatcggagccttaccctacagctttccttggggcacgggtgagcaatctgccttagaggggagaggctctgtgctgaggctctttgaatgctttgaataaatagatccccagataatgaaaagacttcaaaacaaattctacaagaaactgagtagtgtttatagtgaggccctagtgtacatgcaaaaaacccccactgcccttgcttaaatgtatctgattaacttgaatacatttttaaatgagggcttttttccctctttcagtgtttcggccagtcatttgccacttctcattccatcttagttctctgtaaagaaggtgccagagacctaaggtgcccaaggcaattttgcattttacaattctaagctttagaatgaagtcatcaatttgctacatccggactacagtgcaattattcctttgccttgctggaaattggagtgaaatctttctagctgtcaatttcaactcagttgcagtagtgttttgaagaattaatggcgataaggttagaaaattttaagtcaaacgtagggaaaaagtaccagctagaccatcataagcatttgctttgaaagcatgcttctaaagtgtgtttaacctcaaataacagtcacaaatatggttattatgaatgtatgcacagatttttatgtttctaattttaagaagttctagggagctccctgtaacgatttagggaatctctagattctgatatactgcaagtcttttaatggtaggaatcacattgaattaattttgtaggcccagggcctaaatttagtaggtgttcagtacctattggcatcaattcatatgtaggtttaaaatactgtatgaagatacagaatcaccaccatcaaatcaaattgaaatatgtaacaggctagtataatattaacatctgactttaaacaacaacaaagaaaccaaatgagtaactcctcccttcaaactaatagtcagtttcttccaactcagtctctttctcctctcaggaagaatgcgtatctaaaaatttcccattgcagactgctggaaacaacattctaaactatttatgcttctgcaataacctttccaatttgctggaccagtgcaagattaaacacgagatatctcaagtctcaatgtaaaggaacaccacgacagcctggactgtgggtgaagttcattcttccccagcagactctgcctttcattctcggggttgggtgtgccccaaacagaggtaccgacggtaacgaagcccaagaatgttcaaccacaacctgtctgtgaaggtgttggatgacgtttgccattcaggtgaagattatttatgttccagtcccacctgagtagcaaagtgaacactgtgctgaatgctcagaaagatgttaatgaaccgtgctggacagagcagagctgaaaggcgccttgcgagtgtcgtagtgagaatgtggctgtcccagctgcaaagccctgttaggaggcatgaggaagcacttgctgccctaagaaacgatgccttcgacattttcaaaagatctatgtggctgtctgaaacaatgcggagagcagatagacgcaatatttgggaaccaaagagtgactgctgttggcgttgcatcataacataagcgctttcccccttctcgtcactatcatttgtatcaaccaaagaactgatctctggtatcctcgaaggaatgctgtggggatattcttcatctctgttcatggtacatcagcaatttgtggggaaaagatggactatataacacaatgatctgcctaaaagaaactgtctctacttatagggggctgagcaaaccttagagcatctgcggatgctcgtcattatcttcaaaagtccccaagagtttttctccatactttattattgctattttgtttaggctagaaaaaaaaaaactcataaaattgtcttcaaaccaaaccaaaggaaatgaaaagaaaaaaaaaaacagtacagggaggtctaaaaccagagaacatatgaaaatacgttctgcctgacttcagccgagtgggaaggaccaaatgaaatagccagtcccttatgtacagctggaaaactaaaattattactcaagggttgtttacagttctacatttcctcatccccaccctccttccaggaattcagattcctgctcagtggtgataagtttccagagggacaagctactttaacagtgaattgctagggactggaatgaaaacaggctccgaggacagtgttttcattttttagaaagctgtctggggaaacttgaactgatcagtggaggagcagaggagcacagacaccacaccgacaacaaagaaggcaaagcactgctaactgcgggagtgaggggctgctggaggccaggcaggaagcgcggagtggcagctgtgagtcggctctcgggaggtgactgggcaggggcactggctgctgcgggttccagagtgagcttgccaagtgcccggaaagtgagtggctgggtgtgctggatgaagggaagttttaggataagcagaagagagaaggtacttataaatttccaatgaacaccaaattaggacttgccattttgagactccaaaacccacaatctggataaaacatgaaaataaaataaaaagttggggatgttagtatattttattcagatatgcgggttttgtgaatggtaaaagaattcactgatcgattacctgtcttattgtaaactctagaaataaagaggatgataaaagtctgccatgaatcaaatggcagtggtgccaccaattgtaatcaaatccttattgacaatttgatgaaaagtaccagatgggctatgttgagacaaacagaattttcacggagtccaaatattttatgctctgaaatttacttgaacatttcattcagaaacttctcttccaatgtatgaggaaagggtgtggactgaaatgagtaatttcccaactaccctgaggcagaccagatataggtcaacctaagtcatggacaattttcatcatcctcttggggttctagaacagtgtggaaaccaggagaaggaggtacctgctatgtggactgctgacagagggtccaggctgtgagagactacacttgcctcgtggctgtttgcaatgaacagggggtaaagaaagaagaatgttcagtccaggcaaataaagacaagctactaatgaaaattaaactaaaagtgcagcaaaggaaaaataaatcaaatgaaatgatcagtacccatgaattaaggaaactggcttttcttttgttgaagaagtaaaataaatttatatctatgtgattagccactgataaaacattaagttgggattctggagtccatactatggtgggcataattctcatggcttttcatggtagaaacacatgtgtatatttacatacaataaatgtaaaatgcactatgccatatcacatatttcaaagacacttaatatattttttttcatcttttagaatagtaaaacagtgttaaaattcttggcccataagaaataacaatggcaatatgagattggtctttgtagtgatgaagcccaacttaaatattcaacttaaagaaaggttaaaatttgacttgaaaagccagtattccttcacattcttaaactaggatctataggaaactagtgaatgtagtaaaaaaaaaaaaaaaatcctaaaaaagataatacatttatcagcatagaacataaatgtttataacaaaaaagtcaaatgaaatcaaaacttctaaaaactaaggaaaaatggaatgaatataatcataaagctggacaaaaaatatataacaaaacaaaaaacaagcttctaattacacagagaaatcaaggcatagagggtagcaggggccgaatttgtcctttcatcctctttgtgttcagtgaggcagcccccgccaaggcctgtgggtgagttgttgccattttaggggtggcacaactgccgcaaaccttcaggaccaccacccagaagcggcttagcttgagagtcaacagaacctccacttgccttaacgagtcaatggctcacaggcgttcacggttctgtgcacctccagccgaggcgccccgcaagtggaggcctaccttttaagatagtcgtggcagccatggcttgaagaaaggagccaccaaagggacaaatgggcaccattctggaaattttcttatttgagcaagaaaaataaatgttctccctgcataccagccacacgttgagtcctgattcttttgaaaaccagaatcgctcttttccattcctgagcgcgtgctgggaggggatgtggcagggctgaggaagcgcgctaccctgtgtgacagccctcctctggaggggacgcctgcctgtgaaccctgtggtgggtgcaaatactgtcacttcccagtgttcactcccatgggccaactgaaaacgaccagtggaaagttaccgttttctgtctgtttggggtgctccttcctgatgtgggactcacagaccctgaggtgtccagttcatcagcagaagaccaggaagacaaatcctatgtgggagaaagattcttttaacaactccatgtcccagacccatgggggccctctgttgcaccacgttatctcccactccatctccatccacccccatgtctccaccataaaaatcaaaccattccttggggaaaatggaaccagacaggtacaagaatagggccaaattcttctagtgtgttgggatttcctagctgtccgtttggccgttctggaaaatatagctatgattttgttattgctatgtttcacttatagctttattatttcttggagacatggatatgaatgaattgatattggcttgggaggggaagacacctgctgtagagcctgctggtcactcaggctgaacagaagtcaatacattccagttggaaacaaaagatagtcatctaggagtctgcctttttgcattagaggactttactatttcagacactgctgctattcagagtagattgttcttttgcatgcttacagcagggcaaagcatgtgttcatggcaggatttcacagcagaatggttgaaatcttaccaggcatcaccacatctcacctgcaaatgcatttctcaaaaccaataataccacaatggagttgattgtagaaaaaaaaatataaaaaattaaatgagcagaggactgttttttaatttttttttttttttctgtatacataatggagaattcatgcctgagagtggttaaatacaaaactcagatacaacaattggtttgctctaccatggctgtgtaattaaagtgtgtaaattcttaaacagggtgaaataaaatgccacagcagttgtggtaatagcattagtagcaacaacaagagagcttttggatttaacagaatcaaaagcagtgtcctgttgtaaaagtttatgtggctgcttttttattttgagacaggacttgtaagagcagtggctgaaaggagacactccattctgacaagtactatatttaaagtctttctaaaatgcatgaagatgatgcttctttggtctccagtaagaaatgctacacgatgatgtctgtttattgcttacctgctgactacttgacacgtctaataacttctccagttccttgatatgacgactgacctccttcaagagaagtttgagccgatttccaataacatggactttttctttggcttctaaacagtctgttccttcagcattcaccagtagttggcaagacatgtcttgcaaagaggctactctgagttgggattccaacagctcatgctttatttgctatgcatacaaaaacaaattaatttttctaagcatttttgataattggcaaaagctccaaaagtgcagaatgcaatcaacttaacttggtgggaaattatacctgagcatcaaacgtggagctcacacactaaaggatgcagcagctcacggcctgagttctaatcctgcctctgccaaaaatattctataagacccctgaccgtctctgatctcagtttgatttgatgcctggtccacagtattattggaaggttcaaattagttaatgtatatatgacagtaattaaaatatagattagtatgcaagtgagatgtaagataatcttttaaacagaaaagcacaacattaaatatagcgaagcagaagtatgtctaggtatcctctgatatctagtcaagatttgaaaaaaaaaaggggtgattcgtcattcacagcttgatgccagaggtcaaagtgaagtaaaaatgcagttccacagctatttcctctaggtttctaagactattatggtactgaattaaaaggtaccaattctgtagtttaggtgagtgttaaatgttaagacataacattttaaaaatacagagagctacaaagtgcataatattttcttctaatggaactcaaatatgcttccttatcttctataaagtcacttaaatatactgtacattatattgtccaaagatccttgtataagagtctaccagttaatttcctcttgaatttagtgctagaaaaagtttctccttccttgagaagtggtatgttttgtttttgccagataatgaaagtaagtttactccttgtttcccattttgtcttggctttcagaaaacttgatgctcaggttcatgtttaatctgatgtatttaattcctctttgaaagactcggctgggtgtggtggctcatgcctgtaatcccagcactttgggaggctgaggcaggtggatcacctgcggccaggagttcgagaccagcctggccaacatggtgaaaccctgtctctactaaaaatacaaacattagtgaggcgtggtggcttacacctgtagtcccacctactcgggagggtgaggcaggagaattggcaggagaattgctcgaatcccggaggcggagattgcagtgagccgagatcgcaccactgcactccaccctgggcaacagagtgagactctgtctcaaaaaacaacgacaacaaaaacaaacaaaagacttaattgtctcattctattctaatattttaatgaccttttactacaagccaccaaatatacttttgggccatagatgtaacatgaagtttaaattaagctgccttaataaacaacacaagctaattaagattgcttgagaacactaagatttttacaactgagcaacaactttagaatcagattctaaagctagcagatatcatcttctatgcacatgtttgctttacaaagattggaaaccacagggagttaaaaaagtgtaaagtagagactataatgcaaaaagttaaaaaaaaagaaacaacacttaccacttatattcattttctgtaaatgaaatgcaaccctgctaaaaataactggaggctgccagagttcacacatcttaccataagctgtttgtgatggtcctgaagtatctctgcatcaaggttagaatcaatagggacaatttcatttttccttctgtcaatgttctccagcataagaagcaaaccatggctcatttcatggaaaccctacagaaaacagtttaaagtaactgtaaataaaatatttttatttctctcaaaacttaaatgtctttcaactgccaccattagcaaacatacttggttttaagaacatacatgcaactcctttctgaggaaggcactggtgctgttgtaatgacctgatcgtgagttcacgttcttaccaaaagcatctaatttattacttggaggacaatttagacgaaaggaaaactggcatcaacatacgttatttctgaaaaaagggtagtgctattatacagtttggaaggaagcaactctgctgccctctcttctctgtgtagtcaaatctttccatattttaaggcccacctaggctgaatctcatatccccttcattcattcatttattcactcattcattcatccatttatttattcaacatacagttactaaagatctcctacagataaggcactgtactaggagtgggtgcagaggtgaaacagcagtttaggtacccgctttcaaggaactattatattactcttggggcacatataaacctggagagcaggcttcaactccttccagggctttccatggcgctcagaatatgatccaatctcctggcctggacctacaaagccatctggttcctgaccacctcctcagtctttcttctcactccctggctcagctcaccgactacactctggtcacaatggcctgttttctgttcctaaagacactaagtcctttcctgcttctgggactttccatttattatattaccttcatagcaacatccttccaatgttagctcaaagagccaaataaattccctgactaccctctcaaagtggcttttctcagttacttttatcatccacgtctgcaagtatctggtttaactatttgcttgcattttattgatcttgtcttccccaacaaaagcagaggccatgctgtattcaatgttttagcaccacgtctgccatatggtggacgcccagcaagtaattacagtatgaatggaaaaacaaatatttgcaatgctcactttgatgttcaagaagggtctgcctacttgcccagtaaatatctgttgaataaataaaggaaataaatgaatgagtcatagaaggagcgttgcgacggagataaacatgaggaatagtctcttcttatctggacagaagataggacctagagattttgaacatgatcatgaacatgtagaaatgctccagtaaaatgaaaagtttgggcacaaggttatctcactgaaatactgactttggggagcaactgcgtccctctagaaaccatgatacatcaagtcacacactcagctaaattgctaatgtctctctctgagtcacctcctgcccaaagctctacagacctggcactgcatcagggcatcctgcagcaggccccgccactcctccagcagagagcacactcggtcccagcgcccattcatctgcgacaagcgatcctgcaggtcccggctctccttgctgtcagcctgggtgaactcagggctgcagagattgatggagaggatgatggctttgcggtggtccacagctttctggagctcctgaaaagaacaaaaaagacaatcaaacaaggacaataatgacaaagatattttcccttgaaaatgtttcacatgaatgaaaagatccattaatttaaactggccttaacaggatggctaggtaaaagacagagggtgcgtaccactgagaactgtatggcagttggaagaaatgaattagatgagtacttaacaacatggatgaatcttaagaaaacagggtgtagagtgaaaacgtcagaaacagaatgttacatggaacacaacagcctcaatacattcacacacacaaatccacatttttaaagaatatatctgaacaaagaaggtctgccacatatttcagaatagctaccattttgaaaatcaaatgggaacttagagttcagccagggtagggggtgcaggggggaggaataaagaggagtcttgtaggaggcaacaataacgctaggcaatgacctcattaaggagtatgattgagtccacactctgtacagaggttcaaccacaacaaaattcaaatttgtgggcctaaaaatgaagcaaagaaaacagatgccagggccctgggatccagatgtactgagtctgcaggctcagtggcccacaggctgagaatactgcctgtgccacactgatgtgaaggtagagagaatgaattgggtatttcatgagctaaccagttaggtttgatttcacaaaaaccaggtgactgatttttggctttgtgcatttccaaaacacccagtgctcaattccaagaacttgagcacaggagtctgtattagtaattgagtatctaggtactgtttaaaatcccccaatccagttagggtgagagatcctggaagtcacattgacctaggctgcattttgaaatcatttctcactagccctgcaatgttcccaatctgtcttgattttgcacttttcaataggttcttaacatactgtagaatagattcaaccacacagacaacatgggtttaagagacactgtggaaaatacttgattattccacagatttattcagagaaaatacagacaggaagcatcaggagaaagtacaaaggaggatgtcttttttcttgtcatgccggatgactttcaaggtcttatttccctaccctaatctctctgaggtctcagaccctggccagcatttgcttcatcaactttttaaggaatctggttataatgcaacatggccttactagagtaatttagggactctagataaaaatgcatttcataatgcagccattgtaaatctctctcacgtggtactttgtcctgaaattcatggggtagtgtagaggcctttctatagggatgcaccttttggatcacctggaggggagattcatttctcttgtttgaagttttctgtttgaaaatttaaaacagaccaggcgcaatggctcatgcttgtaatcccagcaatttgggaggccgaggcgggcggatcacttgaggtcaggaattcgagaccagcctggccaacatggcaaaaccctgtctctactaaaaatacaataaatagccgggcatggtggtgcatgcctgtagtcccagctactcaggaggccgaggcaggagaaacgcttgaacacaggagacggaggttacagtgagccaagatcgcaccactgcactctagcctgggtgatagagtgagactctgtctcaaaaataaataaataaataaataaataaataaataaataaataaataaaataaaacaaaatcacacaatcactaaaagcaagccaaaaaacatcaaccccaaataaaaagcatatactaaaaccacagaaacacaaaagcagcacacacttcattccttatcctgaccccggagagcctaggtggccacattttgaggaggagcacatcttaatactgtccaaacaggaaaaaacaagcactgatgggttttaaaaagaaactgagctctcagttcatgagatgctcacaatagtctccatatattaaagcattttagtgtctgggttaaggaggattttaagatctagagctggagttaaggtgtactatatccatgcgggccaagccaaaatcaaacgcaaatgccaggtgtttcaccacaattactctatagttttatttattacagcaaaaattgcttctaccactactgtaatcaatttcagaagtttcacttacttgaggtcaaataacttcattatgtcccccacaaattcatgcagatacaattttggagaggatttctctccagctctagatataggcctgtaggagccaggtcattctgtatttcccttacaaagagttcttgtaggtcccagaagtacctggatgcttcatgaaattttaattggacatttcttaaaatatcaattcattaaatcgtgtgtgcttatttacatggtgtatagttctacaatatggtccccttttctgcccttgaaaaccatctttgtggccgggcacggtggctcatgcctgtaatcccaacactttgggaggctgaggtgggtggatcacctggggttaggagttcgagaccagcctgggcaacacggcaaaaccccatctctactaaaaatacaaaaactagccaggcatggtggtgcgtgcctgtaatcccagctactagtggggctgaggcaggaggatggcttaaacctgggaggcagaggttgcactgagctgagatcatgccactgcactccagcctgggcaacggagtgagactccatcaaaaaaaaaaaaaagaaaggaaggaaggaagggagggaggggggagagaggaaggaaggaaggaaagaaggagaaagaaagaaaaaaaagaaggaaggaaggaatgagagagaaagaaagaaaaagaaagagaaaaagaaaagaaagaaaaagaaagaaagaaagaaagaaagaaagaaagaaaagaaaaaaaagaaaaccatctttgtggaatacaggaatttgggatggctggaggtgaggagagcattctcactcatttttgttagatcccttttctgctgctgtgtaagagcagctcgaactagaggtgccatctgcacggtcgttcacgcggtggctctctgtttgtccgccgtgggaaaggcaaggggcagctaccttgagctttttgatctggagctcgatggtctggatgtcagtgctgagttccagacgctggagctgttccaactcctcctccgtgtcccccagccaggcccagatgctgttcaagtctgagttaaactgctgccacttctggaggttctgcttcatcctcaactccttgctcaatgcctgggcctggagaagctcccatcggtcaatcacacctggcaagacatgcatagaacagtgaggttattttcctctacatgtgatgtttatgaaatgctttaaacataggttggcagccaattttaaatagcaacagaaagaaaagtaattccactgggcattttcgttgttgtcatctggaaataacagttacatgggtacaatggctgtgttttttctatttgtatttctaataataatgaagcaaaaaagttagttacatgggcattcacactgtaaagagctttacgaagtaataagcagtcatgagcacgaacgatcgttcaattcttggatcctgtctacaatagggctctgagcacacacatataaaatgcctgattagatatgtgagaaacagtgcattaaaataattggaacatgagagctggggtggtagtgcgcgcctgtaatcccagctactcgaggggaggcgggaggattacttgagcccaggagttggagtctagtttgggcaacacagcgagacttcatctcaatattaaaaataataataataaatgaaacatgggcaaacactaccatgatggcatgcatcatcccctcactgtcaaaggagactgttggccaggtgtggtggctcacgcctgtaatcccagcactttgggaggccgaggcgggtggatcacgaggtcaggagatggagaccatcctggctaacacggtgaaaccccacctctactaaaaatacaaaaaaatttagctgggcgtggtggcgggcgcctgtagtcccagctactcgggaggctgaggcgggagaatgccatgaacctgggaggcggaacttgcagtgagccgagatagcgccactgcactccagcctgggcgacagagcgccactccgcctcaaaaaacaaacaaacaacaaaaaaggagactgttataacttggaaggaagttctcaggatagaacggtgtagaagaaggccaagccccctaagtggaatttcgctgttaacaaagtgcttcaggatcttctatttcattcactcttgaactggatgctacgcactcaccagccgtttgggtttcggtactatgcaggttaacaaagccaggaaggctctcctcttcctccttcagtttgtgctccagtctcttcacggagtctatactgctactgcattcgcccagcagtttcatctgtttagacataaacaaccggcccctgtcacccaaatcttcatgagtgcaaaagcttccggggaaaatctctttgtaatttctcagcaagagaagtgtctgtgtttggctcctctgtgccaccctgctaaaaataagccaagatggccgagtgtggtgtctcaggcctgtgatcccagcactttgggaggccgaggaagatggattgtttgaactcaggagtttgagaccaggctggggaacatggcaaaactctgtctctacaaaatatacaagaaatttagctgggcatggtggcatgcatctgtagtctcagctacctgggaggctgaggtggatcacctgagctcagagggtggaggctacagtgaaccataattgtgttactgcactccagcctatgcgacagagtgagacccagtctcaaaaaaaagaaaaaagaaaaaataagcagaggtaggctgggcacggtggctcctgcctctaatcccagcactttgggggccgaggtgggaggatcagttgagcctaggagtttgagaccagcctgggcaacatagcaagaccctgtctctataaaatattttaaaaatgagccaggcgtggtggtgagcacctgtagtctcagctgttcagggcactaaggtgagaaggttgcttgagcccaggaattcagctgcatgcagcgagctaagaccatgacaccgcactcaagcctgggtgacagagtgtgagaccctgtctcttaaaaaaaaaaaattaaataagcaaagttcaaaaacatgccttttaaacaggtgatacattcacatatacaaaaaacaatgccttaaagatatactttgcatacatgattttgcacgagaagtccttcaagtttctttacgattcatgactcaaaacagattaaaccaatctgcaatttaaaactcggagccctcagctggcaatgcagtatataatttttggcaagctgctccctctttctctttcttaaattgaaatgtgggaacgttaatgttacgacaaatctcatgggaactttcttgcattaaataattaaaatacttaaaattatagagcaatattaaagccagctgttttataaaaaaaatgtaagcaatgtttaataggcatcaagggactaaattctaaagtcaaagaaaagcttccaaattcatttttaatatcacatacagtattcaaagattaaaagaacaaatcatttcaagatactcctgctgtgcttaccataaatcctttaacaaatcacaatgccagtaggactgttattctgattacttttgattgaggttaagtgtaatcccagtgatgtcagtatgattaccataaaactatatcataggtatttttaaaaagtggtttcactataatagaagttggtataataggccaaactgaacaggaaacaaactcataattgaccgctcttctgtaattataaggataataaaatcaacatatatagctagaacagttttctttcctaatttcaaagagtagaacatgtgagttgtgaccagacttggggaaattcatttttctttccttgtactaaccagtcttttggatatgaaagaagacgtgaggcagagaagagactggctttaaaattctcttccttaagtacgcgtaggaaagcaggtagttctctagggaaaattaactggtcagtaactcgagtagggcaaataaccctctgctagactttatcatacatagccaatagccgcatagatagaactggtagtatatccaatgccttgctatcttttccccaaatccctcttgctagaactgttttcttcagaatgagcacactaaaaaacagaagagaaaaacattcccaaggtcattcggtgaacccaggaaaagaactaccaaaaaaactgcatgttagtaatctattagctaaaatctgctgctccaaggataaccttggtccaaaaattattagttgaatttggaaaaatgcctaatgacttttgggagccaaagtattttgttgctctcaatgaaaaggatctccctaagtgctcagtgtaaaggaacaggtttgtcattacaacagttttgtgggcctaaaaacagacaagttctactcaaatggtaacttaataacagggcttggctttgcacatccaggttcacgagttcaagggcagcatggtattcagagaccacataaagccctgatgctgcagacgaactgttctttgacacagaactgtggtttcgcacaggtcggaatcaggatggccaggatacttacgtagcctttgtagctggtgtctagctccggccccgtgggagttttgctgcgaatgatattttcggtttgctgtatctgaaaacggctatcatccagggctttgcccagttgtcggatctgtgactctagggcactgtggtcccctgcggtggcaaccataagaatctttactggacaaactatttgacttatttaaagcttgatattcaaggagaagtttcagaaatgatttcagttacagcagcatagaaatggcaggtgtgggtaattacaaagcaaatttagtaccatcgtgccggtgggttagacattaaaatggccaaaccaatgaaggtgcttgactgagagccctagcagatcggacgtcgcaaaacggctctccagtccgttttgaacagcttcgtgcacctgaccctcttccagctgaacccctgatcatctgaatgttgtcagtgtggaaggcctttctaaaaatctgcaatggtgtctactgcatctcagtaaggagaaagctgttctttttctcatgttctttctgctatcgcttagtgagcaggggaagatcctccctctgatttttcttcatgcacctcaggggaagatagtgtcacggaaggctcaggttgctgcatcatttactgaaggcataaattcattaatcaagaaaagagtgcctcagaatagatatatacagagatatcaaactagcaacgacttgctttttatctaagatctgaaacaaaaccaggagaaagctaagattttaacatttccatctaggcaggttcttactcatagcctagaattctggctcattctcctctcaaagttgtaacatttctttgtaaaattactgagagtgtgtgtgtgtgtgtgtgtgtgtgtcaaagtcttcgaactacacaggaacatttgatcatcagtgaagctagcatggggtgaaagcagaacaaatattagtaagctttattaaatgtttttatttgtttctaaaaaaggccttctagatacacctaggagaggtccctccctgggaatcaccctctcagtaatgttactttgctttctgtccttttgattttcttcaaaaactgaagcgtaaactagtaactccgtgattcaatatcatatcactgcgttcaaactctattccccgccgacatcccacatcactgatcctgaactcctgcactacagtttgtctaacacaacactaagcaaaactagttccatttttctttctttaattcttcttgtttcaggaatagttctgttcttatctatggctcagcataccgtgaaatacatttttcatttcaaattatcttttacgacctcttaaattaaaattacatatattttttagagctgaaatctgatctcaccccttgtctcatacgggattcttgagatgaggaggataaagtggtggatgggccaaaggtcactcatgcaggctggcggacttgggaccagagcctgcaccctgagtctccagccacaggtaggtctgcatgcagtgaagctgaaattaccacaccacgtagaacactagggcgcagaggctgatgactgggttttccttctcatattttctgcagttaatggacatgagaggtctatacctaatgagaccaatcaccatttaacaagttgagaagttactttatttcgctcaattagtgaaatcttattcttggtgtggatttaaccagctgttttttctagtacagcagtaagagaggaaggctgtgccttaacatgctagagccacaaagctgggagagagacagcagatgtgctaagagaggaggattgctatacaggggagggagggaggctggctccggcttgttgtgcctaccggaggtatttttgattgcattttctgtgagttttacataggcctcagggctttcggggatcattacatctgcaaaaaaagcacagtctaagttgacagctaagttctggaaaccctgaatcccttgtgcaggaaaataactttcctaggggaaaaaaaggaagtcagttattctagacacatagctcctgagcgcacagaggagcgtgcaggctcaccaaagctttcctgaaatgaatcataagaattcacagtgggtggggcatggtggctcacgcctgtaatcccagcactttgggaggccaaggcgggtggatcacctgaggtcaggaattcgagaccagcctggccgacatggtggaaccccatctctactaaaaatacaaaaattagccaggtgtggtgacaggtacctgtaatcccagctacatgggagtctgaggcaggaggatcgcttgaacccgggaggtggaggttgcagtgagccgagattgtgccactgcactccagcctgggcaacagaactagacttcgtctcaaaaaaaaaaaaaaaaaaaaaaaaaagaactcacagtgactgagagtgtttttatgagccaggctctggtctgagcacaaatttatcacatagaaaccctatagggtacctgggaatgttattcccattttatagatgagaaaactgaggcacagaggaattaggttccttatctaagtttaaacagaaagtacatggcagaactgagatttcagcccagactccagagcagcgctgtcccatatatttctatgtgaactatatatgtaatcttaaaggtttcatagccacattagaaatgtaaaaagaaacttataaaattaattttaacactacattagacagggattataacatgtaatcaatataattattaatattttattttctttcttgtactaagtctttgaaattcatgtaagcatgttttccacgcacaacccatctcaatttgcacagtcccatctcagagctcaacagtcccaactggccagtggctggttttggacagctctgcttcagatgccatatgcctgactaataggccttactgtaaagacaaaatagaaatgagagaaatcattttctttttagaacagtgtcatcccttgggaatctgatgtgaaccaccagaaccaaacagaaattccccagatgtcctttgacagaatgtatgagatacatttccaagtgccacaaatcagcctccaactctttattctatttttattcaccttccttacagagtttctgtttctctgtccatcccttcactgcatgtgtggcttgggtggtggtccttcttgttttccttcacacactcttcctgtgggagctcctccgttcactccaggaccattgccatttacatgtgaatacctacccaatctgcatttctggcttctgcacttcacaccgtgcatctacgactggacttttgcatttggatattctgcaggtatctcaagatcaggatgcacacaagcaaactcatcccctccctgctctcacagccccacctcccttgcccacctgcacccacagtgctccttccctcttgtggtcctcagggcctaggaccacctgcatctttcaccaagatgcccagcccagaaaatcgcctccatcccagttcaatggactgagagttctggaggagtcttctctgtgtgatttctcacatcattcccattctccccattcccaattctgcttcccctagttcaggccaccaccctacttctgtctgaggttgtaaaaggtttcatttggactctctccgctgaatatgcccttctccctgtggtatccagaaagatacaatatgaaaatctgcacatccctgaggagggaggatcccagcacctccctccgcagatcctgctgtggctccacgaccttcaggataggagccacagctcttttccatggtgaacaggctgcttcacagccaggctcttctccactttgtccattccatgcctgtcattccagacaaactgccaatgatcaaaagcaccaggccaatcacaaagcagggaggcttcccctcctttcttcctctaagcacttccgagcccacctgaccaactgcgattcaccctctggactctgctccatggtttctttcccgaagtctctcccaggactccggctttgtcgcccctgcttgtgtgtcctgccaccacactgccatctgagccccaaacacttcatacagtggtttctcactgtgtcccacactagagtggaagctctgggagaagaagaggaactgtgtatccctagaacctggcaaagcgcttgtcacctactaccacaaatctacgtggaataaatcaacggccacaccaaattttgcattttataatcacattcatatctaagtgttcacttaggtacaatttccccgcatgaaagaaggaagcaaatgattctggatagctgtcatgtttccagggcaatattaattccctctgactttcctttaagctggcaaactggagaggctctttcctacctgataagccaacagctccccggaggtagaaatctttgtcatcctgaccttcttcatcctcagagggcagagctctggacattgcagactccaggtcccgactgaggtcatagtcgtgatcccactccagggggatggagtccacactagccggggtgtctcgtcctgaccgctcgctccggaggggctgagcgagcgagagggagagattggaggaaggctgtggagaaagcaggctgtctgcagagcggtcgtgccagtgcaggtccgacagagctgcagagtcttccagctccagctccctgtctgagaggtcgtgctcatcgtctgggagctagaagggaagtcaaggcaaccctgtcactgtagtggtcagactagcttcttatctgggccacctgcctaccatgtggggacaatttttaacttcttatgagcaaataaataagaatcttctgatcacagaaatacaggggacagtgctgctctagagtttgactgtctgggttgaaatctcagttacgctgtgtgcttcctgtttaagcttggataaggaacttaattcctctgggcctcagttttctcatctataaaatgggaataacagtcccaggcatcccacagggttttttttttttgagtgggaaaaaattaaaaagtcttataaattatcctacataagcctcagtttcattgttggtaaaatgggaataacattaaaacatacttcaaataattaatataagattaaataaatattataaagaaaggcaatctactaccatgcccaccacacaacacctacacactggcaaggatcggaaataagagcaaattactaagaccttagcttgtccttatagcccagatataaaataggtttgatcgtagaagattccaaatactctaataacatctctataagtaagatgtgattatggtagcaattaggaaaatggaagaatgaaaattcacctaaacctaacctcatcaattaagaagctgttcactttgcttccttttattgtatttcttctagaggcttctcttatttcttctagaggcttctctagagcagtgctgccccatgtttctgcgatcaaaagattcttatttatcttccatagaagatatgagccaaatgttcttctaaactctttgtatacattaactcatctaatgctcaaaacaatcctttgtacagggtagttactgctactaaaccactttcacttttgaggaagctgaggcaagaagggtgaagtgagtagcttgccgaaggtgacagcgacaatgtaggacaaagctaggacttgaactcaggtgctccagctccagagtctgagctctcacccactatcaatacaacccaatcccacacgacttattctctttagatttaatgacaactaagaaaatcaatgttacatacaggcaggcggatcagtttcttatggtatctttccacacgcccgaagacctcctggcagtaccgtcggagctcatctagttcctcctcgatgatcgctgcatccaagggctcactcttttctatcagctgttctccttgggcaattatctgctcaatcttattgtggttcagtgaaatttcctgctggaaggcctagggagtacaaatctcatgtgattttgctattgttgttgcttacattgatataaaagaatcataatagatgtatttctcattacattaaaaaagacatgtaggggctatttaattgaccatatacaatcacaagacaagagtctattaccttctaaagtaaaacatatgcattttcagccagaacaggagtcataaatagaaacattcgaattccatgatcagaaaagcgcttttggctaataaaatttaccatcacaggtagtgtgggtagagaataacaggggaaaatattcaaacccaccgtaagttgacagcactggttatccctaatgaaagcaatggcagtcaatatactgtcactgaaataaatgtagcattttaaagaaatatcccgatcattttaatttcagatatcctcatcctatgtcaaacatgactaagagaagccatccaatgccacgccttcttctcaggtgattcttttattatttcagaacataggcaggtaaagttatgatttgaaaaacaaggaattccaggaggattatttagactcattctatgtgttgcaaaagatttaaatcactgggtatgtttcagtgttcacttttaattcaatacaataataaattgtggaagagctgaattgtccaatggtgaaaaagactcccaggagagaagagagggtagtaataatttccatcatcctgccagggtcccaagggacaagattcaattacacttggcagaaactttctgtggaaggatgtaaatgttgattcgcctgtgagatgacaggagagaggaatcaggggagagggtgaggcagaatagcagggtttactgtttcttccatcctgagaatccatgtctacgggcaagttccttgttttatcataacaacccaaaggttatgggcgtcatgaccattctttaaaaaaatccatctatcttgggaggaaaatttcataagcttccttggaaaacactcaatttgttaaatactcccacttttaggaaatccttacatctaatgtatatccctcctattcgaatttctagctagccactgtgtttgaattatatagtgaaaaatacaaaatgtgtttaaaattaacttggcatctaagaatgcagactatgaggaatgaaatcccgacataggaaagttgtattgctttgcaacatggaggttaaaggaaccatgtgaaggtgctacaaacacattagaaaaaataaacgaaaacaacaacaacaaggccaggaagggtggctcacacctgtaatcccagcactttgggaggccaaagcagctggatcacttgaggttaggagttcgagaccagcctggccagcatagtgaaaccccatctttactaaaaaaatacaaaaatacaaaaatttgccggacttggtggtatgtgcctgtaatctcagctccttggcaggctgaggcaggagaattgcttgaaccagggaagtggaggttgcagtgagccaagattgcgccactgcacttcagcctgggcgacagagtgagactctctctaaaaaaaaaaaaaacaaaacaacaacagcagaacatccctaacaccctggcaatcaagctgattgaaaatcaatcaagctgttgaaaaatatcaacaacaatatcgatatcaaataagataagagcactacccagatataagcaatagtggttatttctgggtagtgctctttatctgattttttatatattttacattttctgaatttttttgcagtccagaactaatttttcaaaagaaaagttatttgctatgttcttcacaaaagagccacaaatcctttcattttcaggctttcttcactttggtaacttgaaaaataatctattaccttgagttgctttattttagcttgaacatcacactcagaaaaatgttcaatattagtgagctgcagatccatctctgtgagccagaccagaatgctgtcccgcgcagtctcaaactcctcacgctggccaataaaatgctggaaggcaagaggaaagtagtaacaattatttttattaaaagtccttctaaacatatggagatggcacagcgaattccagtgttctgtaaagtcattttctcagcaagcaatgagaagcctgcaatcctttgctatatcactccccggtttactcctcctgccatcccattcttacaaaatcactgagactgtgtctcaagactgcattcaaatggcccagtcccatcctctggcctctaaattacagatgaggcatagcaaaaaccttgagtctgcgcaagatggaggtgacacgcttttgcaggttgtcccatctctggttgccttcgtgaaccatctgtttgaggctacatgctgaatcagtgcggttctccctggccaggcggcggtactgcttgttgatcagttccagctgcgtcaggcactcgtggacctgtcgctggaaagcctaaggccacagagaagcatatcagtgtgagaaatcagcgaaggactctcagtagtggctcctggttttcttattgtagcgtctgggagaatgggaagttacactatcacagagggaaagaatgatgtctaataacggtacacttccccttgttaatgcaaagtcatctagtcagcgtaacttaaaggaaagggagaatctatcaaaaaatatgaaaatggggagtagtaatgaataaacacacacgcatccaacacacatatatagacacacacacatacatacacacacatatacacgtagctttaaaaataattaatgtcctggaaacaaatattcccacaaagcaaaccactataaaaaatatacacgtgtgtgtggaaatgtgagtttgaaatgttgacaacttctgctgtcaatatggagaaaaagatatctataatggaactgtttatttgtaaaatatgtacttttctaaaaatctagaaattacctcaattctgctgtccattaggaaaaaacttaaaactaccttttgcaaaaggtcttccaaaaaatcaagctattataagcttttaagaaaagtaatttagtaaaatacaagtaactttatattttaaaaaatttggaacatgctctgtttcttttttgttgttcctgtgatttaattagtttttataaaacatgttagagctagtgtaccacccacacagtagcatcaatttacttttgaggctatcccagggtcagtttagagattctgaaggtaaaatattcttttctgccttttccctccaatgtagaagagccctatagcataagagtcatttggccaaaataaaatgaagctttaaaaaaaatcatttgtatgatttatgactgatttttatcttggcattagaccaaaatgaaaactataattaataaattgaaccgcactcatcaaatccccaaattctgttttccttggctcatcacactgtttacatgtgaccacatttctgtctcttaaattgctttccttgtgagagctgctttcagagccttcatcctaggaaatcctagcttccagtctaaaaaccttaagttatttctccagcaaagggagtggtaaggaaagttcagctctggccatgactggaagtcccagtacatgtttgcccactggggtaaggttggagtacccccaggcagataccccagcacacccatgtccatcccaaacgttcatgcgattggaccagctaaagactgcccccaagcacaacttcgtttctgcaattcatttctgtctcttaagaaaattaactacaaaattcatgataaataataaaatcaatcattatagaagctaactataaggctaacttttgctttaaaatctgagagtctaaaatagcatcaaaaagaatcttatataatctgctttgcagtataagccaattataaaaggttttaacctttatgaagggagtgtgtaagatgcagttgagcagctctccactagcattcattcacatcgagatgacctggaatctactgcagagtttactgtgctttttactagtagttttctaagggagtatcttttatataggaataaaagtgttgtttattttaatttagtggtatagttacatatgaattcattcaccattcagacatcagagtaattcatccatttcaaagtatttgaacatttttctagattcatatagctgtccatgtacaaccctgagattttaaactccataagaataaaaaagcgaacttcttatttcccatcataggcctcagaaaatgcctggttacctgatgttgcaaggtaaaaatgaatgcagctacatttcattacattttcagtcttatttctaaacatctcgaggaacttgggggcataattagcaatggtcagaatgcttctgaactctttgctgttaacatacctgagtacacaactgcctattagtgggaactgaagggaaaaacaccttcaaatttaaaaatggtcaattttgggctaggtcaggtcttccatgaaaatgaaaggcagctgagaagtcagagcttcattgtacaacagtgatagagtggactcgagattgtgcaagcaggcaaggtattggaatcaattcttggataacttctttctttatgaatatgattacactacagctattttcatctcagtgtaattgaaaagttttggtgactcaagaccagtactactcttcactgtgtaattagaaatgaattataatgaaaatgttttattccattctagagtcaactcttttatcaaatacacacacacacacacacacacacacacacacacacacactgcgattaggtaaagaaaatacaaaaatgtatgtggaaggtagatttttatggtttaaaaaaatcatattttaatcttagaaaagatggttgactgtggaataattctgaaataaaaatcatgccaagatcttttgggaggaatcacgattcttcttttctaatagaatctctcttcattactacagtatttatgcttcttgataatcttaaaataaaaacctctttttcccccttcatacgtatgactacgtatgaggtcataataaagatggctgcaaagtcctcacgcagcaatttgagcagataacatgtggtgaacagctagtttaggtcttggaactccaactaccagctggctactttaatagcaaaataaggattaaaaatttggaattatagattacctcaaatttctttagttcttccttggcaactgtatagatcaccccagaagagctgggaaaagcagctgtcctttctgaagacttcagccaatcttcaaaacgtgaatagtcatccagaaatttctgccacaatcgccacgtctcttcgattctggggcggaaaatgaaagaacagattcagattattggagactgttttcgctccagaacccggtctgctgcctgcgactggattaagggtgcccacagaggcaactgttgtgccaaacgataaccattcctcgagccaaatttgaccagagagcaagagagacaactgcttgagctaaaataaaacggctgttttatttttttaaaaacacgtcctgcaactctggattttgaattagtcaaattgaaaattacaagcacatcacacgagctgccttgaatgtgtgcaccaagtttagaaaagcaacaccaggtttacagtgtgcactcaggccagtgtcttacggaaataaagacgaggtcggaaaatccatttaagtccaacattcaactcacactgacaaaagttaatctatgacagcaggacaaatattaagctttcaacagtttaccagagagcacagccatgatgatcactttgtaacacagcacgattttctgccaccttgaatttcaaagggcttaaagataaatctgcttttattatttaatttttaataaaagaatgttactgttctcacagccacacattctgtaatgttatgcttgtttgacaagggtgtatttttatgtttccgtattatatttcaactgttaggtcagacataacttggcttgttatatttatatattacctttatacctacttattttcccaactaaatgtagacaatagtaagtttgggaagccacagctatttttggacattgtaacgaacaggaaagagtgaacagtggatactctgggtgatttttattttctttttggtctttcctcttccctatctgtttcagcatcccagctcacttcagcctcctttccatggacatagcacaaatgtttctccaccgccggtccaggtttctcgtagcctgctgtatagagtcacactcggcatcagtggcacaggcgtcacagtcgtgcagcaggacttcacacaggttgaggacagatgcaacacctgtactgtgcttctctatgtctctctgaagctcctgcaggggaacgtaacaggctttattcaacaattacatgtatacagatgagagaaactgaagcaacctatgttggtaaatggctaggctacaccttgacaaatatttaatttccttgaatgtatgacatttattgagcctcatttatgaaatccagcaagctcaaaagtactagaaaatggatgtagaaatattttggctatgcgagcaatgccaaaatataaactgaacaaatgaaatggtctacactaagagtaaaactaacttctttaatcaataaaaaatgaatcttgccccagactctacttcacgaatacatcactttcattccaatcaatcaatcatcatctcttagtatctgtcaggggattggttccagaccttccctcggacaccaaaacccatggatgcttaagtccttgatattgaatgctgtagtatttgcatacctcctacacacatccttccatacactttaaatcatcttgagattacttataatacctaatacaatgtaaatgctatagaaattgttcttatactgtattgtttagggaatcatgacaagaataaaaagtctgtatgtattcaatacagatgcaaattgttttccaaatacttttgatctacggttggtggaatccaccagtgtagaaccgtagataccaagggcctgtatatatgcatgtgctagacctggcactcaagaactgggctttaagatccaaagatttacttttttttttttgggatggagtctcactctgtcacccaggctggagagcaatggcacaatatcagctcatggaaacttctgcctcccgagttcaagtgattttcctgcctcagcctcccaagtagctgggattacaggtacccgccatcatgcctggctggtttttgtatttttgtagagacagggttttaccatgttggccaggctggtcttgaactcctgacctcaggtgatccacccacctaggccttccaaagtgctgggattacaagtgtgagccaccacgcccagctgatttgcattcttttttaaacagttaattccaccatcattaaaaggtaacatggttatcaatggacgaacaaataaagaaaaagtggcatatatatacacaatggaatattattcggtcataaaaaaatgaaattatgttgtttgcagcaacatggatggaaccggaggtcactatgttaagtgaaataagccaggtacaaaaacacaaatatcacacattctcacttgtatgtgggagctaaaaaagttgatctcatggaggtagagagtagaacgccagatagcagaggctgggaagagtgtttgggggcaatgaagtgaggtgtcaatagacacaaacatacagttagagggaataagtcttaatgttcgatagagtagaatgactatagttaacaacaatgtactgcatatttcaaaatagctagaagagagaaattgaaacattcccaacacatagaaataataaataccagaggtgacggacaccccaaataccctgacttgatcattacacagtttatgcatgtaacaaaatatcatatgtgccccacaaagatgtagaaagactatttaagggacctaggttctatatcatgcatgacatcagcagtttcctcagagaacaaattctttttttttttttttttagatggagtctcactctgtcgcccaggctggagtgcagtggcatgatctcagatcactgcaacctcctgcctgattctcctcctcattctcctgcctcagcctcctgagtagctgggattacaggcgcccaccaccatgcctggctaatttttgtgtttttagtagagacggggtttccccatgttggacaggctggtctggaactcctgaccaggtgatccgcccacctcggcctcccaaagtgctggaattacaggtgtgagccactgcgcctggcatagagcaacttttaatgtagggcagaagtaaaatgttttatgataaaaacaaagcattggatttccctggagtcccacaatgtgaaatcttcattttaactgtataaaatgtaaattcaaattgtatgttgttttctctattgaacttttaactccatttactccaagtaagtattccattattaaaagtaagctctaccagtatcattttttgtttactatattcatcaatgtccttaatgtgttttccttttcttttatcaggaagttcttgaatttgcttattttttctcttgctctaaaaattcctcaatttacgcagatacccgggatttatattcttgtgttgctcttcctcttatttttttccttgatgccatgttccaacatctatgcaaacactagctattgtcaaatgtcatagtgcctttaattaattttggagattttataaactagacactagacgataaattttactaaaatatttatatttgtataaacagtcctttcaaatctctgacataacctccttcacttacatgaaacaatatgtcacaggaattgctgttctaaaaaatataaaatgaagtaatataaaaattaaacttagtatttgcttaaagataaatataaagacaaataattctgtaaatgagattaccaagtacatttgaggtcttaaactacattttgtgcaagcatatacatttggaagaagtgttaggcccctggacataaaccatgcatttaagaaagttagcatttttatttcattttccctaaatactcaaaagtttttgttaaaatcaatatatgaaatagcaaccctaagatttgaggggatttataatcatacataagtgccctaagacaaagttttaggctcagcttcaactttttttcttttttttgagacggagtctcgctctgtctgcagactggagtgcagtggcacaatctcggctcactgcaacctccgcctcccaggttcaagcgattctcctgcctcagcctcctgagtagctgggactacaggcgcgcaccaccatgcccagctaattttcgtatttttagtagggacagaatcattcttaaaaattttccacaagggaaactgtggtaactgtgacatgattaaaataaaatgtatcaagccctgactttgtgttaggtaggcactgtgctcagtgcttcttcttagtaatttgtataatcacactgtgtggtgtggactctgatgattggcgttctataaatcagggctctaagggttcaaatagttatggctttgtcccagatcacatgggaatgtagtgaggccaagatctgaacccagaaagtttacttttaaccactggtgtacaggactttttaaagtcttaatttaaaatttaattaaaaagctatatgtgcatatttaatgtagtaaaaagtaaaaaacgactagcaggttctgaagaaagcagcatgttttccaccccggagttcacctgttcaggagcaaccatttccatctcttgcagctctttcttctggtattacttctaccctttttaattttttgagacagggtcttgctctgtcacccaggctggagtgcaggggtgtgattatggctcactgcagcctcaaattcctggcctcaagtgatccttctgccttggcctctcgaagtattaggattacaggggtgagccgccacattcaacctatttctatatttctcagtaatatataacttctctatttctaagtaacatagctactgcttgatttgtccatactttatgaattcttgtatagtagagaagaaataaacttctacatggctgactgaactctaatgactgttacagtacaacttagagctagggtaataatcactgttctcatgattatggttatttaatatttttcacatttgaggaacaaaatatactatggttatgtttcttttctttttttttagacagagtctcagtctgtcgccaagctagagtacagtggcgcgatctccgctcactgcaacctccgactccctggttcaagcgattctcctgcctcagcctcccgagtagctgggattacaggcaagcaccaccatgcccagctaaatttttgtatttttagtagagacggggtttcaccatgttggccaggatggtctcgatctcctgataactcattttcctggattttacaatcctctctctctctctaatttataatgcttgcttctattatctctcttattgaactaataaaactccttccggagtggttaagcccatcagataatctagcccctcctggctcctcctggaaacatccctcctagagcacccagagcccctgctcccatctggacaggtgctggcttggctgcagtacagctgtcatcagggactttcctgcaccttcactctgggaattccctttttctttctcctgagttgaatagcatttcccctcttgctttagtgcgtgtagcatatgcagcatatatagcatagtagtacgtagcctgtgtagcaagtatgaagtgtattttcctctcactttcatgtatgcagcatacctttcattagcttcctgaaaatgggtacataggaggtaaaatttgtagatattaagtggcagggtataaaattctaaattataaagaatttttctccgctttctgaagttagagccattgtcttccagctcccagtattgttttggagaagccagagtttatttcatcctggaaacctttaggatctccttatcccttgtgttttgcagttttacagtgtggctttgctttgttttacattttcctgggcactcatacagcccttatcatctgcaaatgcatgtttttcattttagatatatatatgaatatatatacacacacatatgtgtaatgtgtgtacacatatacgtgtaatcttccacaaagtaaacaaaaagataaatatatgaaaaataggagagaaatatagacataaacataataaaattaacaataatgcgagagtttcaaaatccaattcagttattttataaaagtccccccaaaaaagaataaagaaaatggagaggagaaaattaacatcgtagtaatgtaacaaaaatataaatatatatttaataataaatatataaaatatatttttacattactacattatttatttcataataaacatatattatttaataataaatatatatattacattactactatggtaattttctcctctctattttctttatttttttttagcaggggacttttacaaaataactgaattggattttgaaactctggcattattgttaattttattatgtttatgtctatatttctctcctatttttcatatatttatctttttgttttactctgtggaagatagtctccattctgaatgctttttttaaagaaaaatggcatcctatcattttatgaatgcaaaacctctcatttctgtgagtttgtttgttttgttttgtttacattttctttctctacaatgtgtttcctctgattgttcctttctttatttccctctatttatttttttttcttaatggtagaagctttcttaagtggtgaggattcttgcctacccacacatattcaagaatgagtcagctatagaagctgtgtatgcacctaaagtatgtcaactgggaggcttccctgtggagagttaggcaggggtctggccttttctgggttaccttaagtatcactaattgaaggtactttttgcttgtctgatcagttctccagaaaggatgctccaatctcctggctagggtgtaagcctgggtactgacatagtgggagccaagctggggaagcgggctgggagccctagcatttggtattgagccagtcacatcatctccccatttttaacatagtgactctagcctccacggtgtcctgatccccaaacccagagtccctctggtttgctttctccagagagtaatcatctgatcttctacctgagtaaaggaagcagagttccctggctggctgggcttaggaggaatctgccagtctcagcacaccttattcagattttcaagtaatcttccattttacagctcaataggcaactcaactttcagcttcacctgatctccactttctgagccttcttcgaactctgtggcatgaatcaactttctccaccctccattctgttaacaacatcactgatctatccactttctatcttgcaaaattatgttggatgtctgtcatctctaccattttctctcctgttctctttgccattgtggttttaacctttttccctctctaccatcattttattggggttttagtagtaggtggggctataaatacatatgatcaatttgccatatttaactagatattttgttgattttcatacacttgtgaaattacgatacccgccatttgcatttcaactcatcactatagacatcattaccatgttctctggaagaatctgggaagccggatgccaaccaggatccctacaattcaatcatcagaatctcaaacatcaccacccatcagaaaactttaatttcataaaaattgaaaaacgtcttgctaacagtttttttaaagcaatggaatatagtgtatgtttcaagatagctagaagagaagattttgagtattgtaagaaatgataaatgtttaaagtgatagatatggtaatcaaattacctcagtttgtttgattattacactatgaaaatatgcattgaagcaccacgttgtaccccacacatatgtacaattactatatattcattagaaagaaaaaaattttaatgataattttaatattaaaaaaacctcaacacccaaaactgtattttgacacctatttcattggcttaaatagtctgtaaaatgaagtaagtacataaactataagattttaaaaataggaggtatttacattttatagcattttaaaattaagcaactttgctgcaatggcctaaatgtaatggagagaaccagagtgtggatagaatattcaaagcaacctaaatgcatggagtaacaatacctctagcgggggatttacagtgtttgctattggcaactggagtccgatatacttagcaaggataaatgagggggcctggcacagtggctcacgcctgtaatcccagcactttgtgaggccgagggtgggcagatcacttgaggtcaggagtttgagaccagcttggccatcatggcgaaactccgtctctattaacaatacaaaaattagccaggcatggtggtgcatgcctgtaatctcagctacttgggaggctgaggcaggagaatcgcttaaacctgggaagtggaggttgcagtgagctgagatcgcactactacactccagcctgggcaacagagtgagactctgtctcaggaaaaaaaaaaaaaaaaagaaagaataaatgagggagggaatgggaggtgaaaatttcttctgtatacattttccaggatcatccctttttgctttgttgggttgtacgccgccagtgagatattctgtctttgctacacacatgaaagtggaattactgtgtgcgatctgcaggtcatgcaatcctttttgcaaaacaaaattttttcaacttgaaaaattctaagtatgccttgtaatctttccccaaacactatacacaggaaaaaaagtcgggggcaggggggctcctttcagtcctgtctaagtgtatggtagtgggctagggctagtgactctcaaataaataaaccaatctgttagcactgttttagatacgtaattgcaactccaccttacctaccatcttagaaggcttcttggtggatggatgacactaactgtacaatggcacaaccatctttgtaaggctgaactctgcagtgacatggaacctgttggcctcaatcgcctgcctaggcaaagcccccttcctcaccagtcctgcctagctccctgctgaccttccatctccaggcaccatctcatgcccaccccatcatcctggccaggaggacagatattccatggcttattaattccatttccattttaagtcttacctgctgctcattaagctttctctgtatttcttccgagttacaggaatcgtagactattggcttggccagctctgactcgatgtgagcgagccaggtcctcaggctgctcatgttcttatcaagctgctgcacggctaccagggtctccttcagcttcttcaccctgtgggcagagaagggggaatgtcccacttcagcgagaggcccactcatgtttctctagcgtgcagaggagaacactgggctttaacaatctttttaggcagagttagaaactcatgtggaagaagccaaagacagaagacaaaggaggatagaaattagagatgaatacagacaaaggagcaaggatgcagaggaggcaggggtccagggcacaggagcagagatagataaattagttttgaacacagttttcccagtgtgagcaaggtgtgatcagaagtttgggaagaaccacaggtagtatttctcaactccattactacctacttacagcaaaaatcaattattgactccctgttaagagcctgacatggctgagtgtacacagattgctctaaagagaaaggtcatggtgataataagcatatgatcaatgatctattagtgcccttatttaaaaattgctgctacctttagactatgagtctcgccttttggttcaggaaatatggccacctaattggcactgctcataacagaggtaaacagcagatgagcaaaatacttcaagctgctagggtgtcatcttggctcaactgaagaggtatctatcttcttgaaaatatgtcaagagcaacatgacttgtaagactctaggtttgtgatacatttaaaggcagggatctgcaatagaatgttctcaaagattgacaacttatacacttagagtcatcagatattcgcgccccctcccccacccccacattacttccaggcatttaaagaagtgattctcaagctgggattgtcacacagtcagtggagggtgctttcaaaccacaggtgccaactaccagccaccaccgccaggtggttctgatacgtttctctgatcaagacacactgttccgaagaaaatgtctcataatcaaagtattttgaacatttgatttatttttagttgcttaaaattgttatcatcacttctgttccagtttcaataaatcaatgtgtctctctcaagtgaaaatgtagtcatttgacaacatgatcgcttttcctttttgtcatttttcctcaaagcactgtcatataaatgctcttaaaggattttcactatggtcagctgttaataatatctatattttaataattgtaattaataattcttctatttgaataacattttcagtttgtaaaaaccctcaggaacattaccttttattgttttaaaaaatgtgtatttaaaaaattatgttcatatttcacaatatattcttttggtagaaaatgaaaatatgttacaatgtttattgtgacttacaattccactcgagataagatttccccaattagctttataaatacaaattgtaccctgtcccccagacacttcaaggcattggccttgaacactatttccaagaacttttacatacaactcactcacatttctctcatggctaagacaaaattcatctgggcatcagtcagtgaatgacagttttattatggctactgggtacaaagctcatggagtgcatttgatcgaccacagcatggacatggaattttacatggctctggccatagtgccccagactgaaagaagagtttaccatcaataaacccactggaagaggcctgaagaatggcacacagcacagagaggtccgtcctgcttttacatctgtaggaatgtcttctcagcagcctctcctgcatgacttcagatttcgtaggatctgaacacttactaggcttggggatggtaatgtcatcagggttttactagaggttggagtgcttgttttctcccttccttattttagttccctggtattattcatgcattaattggtctcctccatggtaacttccttggaaagctggaaatgtgaatttctatatttggctatttccctaccccggccatgctaaactcagtgctttgcactaaactgggtactgtttaagtggttgctaaacattaataatgaatattctaagcgaattgtgtttatttaattaacatgttttcattttaaaatttttatttgatattaagtgtgtattaagttttacttctagattcaacatttgccagtgctctatttgtcaagtactaaaattcattcgtttttttggttcaaaactcacaaatatgatcaaaagatccaaagcacaaaaggatgcaagtaaacactgttccataggaccgtctacattagaaaaataaattacaggatagcttttgtaatatcgaatgagttccaagtcagagtggttagtatgcaatatgtcaagggcatcatgacatggaaatgtgtgttcatatagtccattagggacaagttcctctttcaagcaaatgtgtaaatttagtaaagtcgacgggggtgaacatttaagcagttctttttcatttttttaaaaattgtgtttttactacaaatagcaaaatacagtgtgcatgtgtgctgggggagcagaggtgagcctgtagggcatgggtagtaggattaataagccttggcttattaaacttgacatttatttgcaggacagggatcattcttttttttaggagaaatgtcccatgtttctttccattatttctttaaagataatttttgggtgaagcgtcacagtatttttatttatctatcatcgtgagaagtctgagcaacattacttttggtaagcatccaggattatcattcaaattagatacttgcagacgtcacatgtctgggtaagtttagcagcttgataaatctgtaagtccctgcagcttatggttctttcacagtccagtgtgtatcacaggcacttgacctttcttgaaaaggattctactatgaaatccaaatgtccagcttcttaacactgaaacacgtatatacaaacacacataaatatgtatatacgtacttacacatatatgcttatatatctatatatattgtatctatatttcaccactttccttcaaagtaatttagtatatccataacccaaaacaaaacaaaaagtccaaattctaaatataatagaacaaaaattaccattgggtaaatcctattcatttgtagaaatttatctgagggatgatacagtaaagaaaaacatattaaaaaaattcctgtcatatttttattctaactgaaaaaaatcatgaactaaacatttgcataatgcactaaattactattttagacattaatttgtacactttgcacatatattttataagcttcatattagggactaaaacttactgacaagcacaaacaaaagcaactttctcaaacacacagcattttctagagccctgaaatagttttatttcatgaaaggaaagctttcaactacaaagctgtgaaccagctaaggctaaatttcagtttcatcagaagcccatcctttaaatagcagatgatggactaactgagtctttttctggatcgctttcctgtgtctcagcctctctactctagccatactccttgtatgacgcatacggtccagagacaactggaatacagagtcataataaagtccattaacctttttgtccagctctgcatgcccagtagaggtactagaaaacaaaccaacgaataactcttgggagtccacatggccagctatctcccaacaccaatcctcttcatgtaacattggcaaaaacagttctggattaaggcttccagcgtctatcctacaaaccccacgtaacatgaaagctatgtacaatggaagaaactcaagaagatgcctgccttgtgacatcgcagttacaatctgggagatctgcatccacacagctgtcctctgccatcctcagggcactcaggtcctccgccaccaccatgaagcttccacttgcaaaagttagactctgcagagcaaaaagctatatcctgcgtggggatgaaagtttccccttgtctgtgtatagaagtatgaaaatgctcactgtagacaaatgttggtagtctctgcccgataacatgacactgggcagtgacaagtggtcatgtttctaaataaaacctacattcattaacatgtgccaggcttgatctcctggaatgtaggccacgagtgtaagaaggggaaaaagctcagtgtaatctgtaaggaggaggaagctacaggtctaaagaaaggacagcaaaaacaacatcggctgcacacactctgctgttctgtaaggacagtcaacttttcttgcgggcagtttgttatgctgggaaagctatttaaagaaaacaaatcatcccactgcaaacaaacaaaatgtccacaaacacagcaaatggtagtagcaaaaggagtaacttccttcttttttgggttcagtatgccagctcggtagtgtatgcaagagttttaggggttgtttgcgaaggtgggaaagtacatgctctttatctttgagtagactatttggggaggaaaaataaggaagaaatattattctcccttacatatgcaaaacttttgtcctttaaaaataatcatgtagatgacaaaaataacattttcattttaagacaattaaaaaaataactatattcatttgctcagggggtcttcaggtaactctttttcttttgtgaatttcaagagtttccaaactttctgcactaagcagatgataatttaataatttatacttttaaagaaaataagtccccaaattattaattcctataattcaataaaatatgattaatgctggatgctttacatcctttaggggattaaaaactacacacaaataaataataaatattaaataaataatgaaaatttgctaagttctttccaaaaaggactacatgatgatttgtaactaaaataaaacaaagcatctggttctggtcatgtgagttgactgtttttaaaacagaacactacaggaaacacattttcttaataaaagaaatacattggtggctcacgcctgtaatcccagcactttgggaggctgaggttggtggatcacaaggtcaggagatcaagaccatcctggctaacactgtgaaaccctgtctctactaaaaatacaaaaaattagctgggcgtggtggcgggcacctgtagtcccagctactcgggaggctgaggcaggagaatggcgtgaacctgggaggcagagcttgcagtgagctgagatggcgccactgcactccagcctgggtgacagagcgagactccatctcaaaaaaaaaaaaaaaaaaaaaggaaatacacctgccagcctgggttacaaagtgacacctcatctcaaaaaaaaaaaaaaaaaaaaatcaaaagattatccaggcacagtggcatgcatctgtagtcccaggtaatgaagtgggaggaagactgcttgagcccaggaggctgaggctgcagtgagccattactgcaccagtgcactacagcctgggtgacagcgcaaacccaatctcaaaaaaaaaaataaaaaattaaagaaaactgcattttatataagaaataaattctagaaaacatagtacttaaagatattgtactgtgaattcttttataaaacaatcattcttcttatattaatgtatttttagtaatcagaaatgaaaatattttaaactttgattaaagaaatatattggttatgaatctaccactataggcaactttgtttttttcttgattatgactaacattttaaaaaacctgaagtcttcaaaacattttattgtcataatttccttagtttaatttcttttaccttatttagtttacctcatggagttaaaaaatttgaaatttttttcatgcttattattgttagcataatatatgtattccaatgaactaaatatgagacaaggcaaagctctaaagatacaattattcaaagagcaaaaatggcaatgttcattgatacagaaaatcctagataagttgtggtatatttatactatggaatactctgcaggtttctaaaagaatgagactggcatagacattgttttatagtaaacacagtcctttcccttgcattttctcattggagatgtggcagttagtttcattaacactttgaaaatgagcaacttgaggctcagagaagttactcagtaagacctgggccacacagcaggaaccaggtggactaaactcaggcctcttgattagttctgtgctgtttctgtgctcatcgcatcaatgcattcctgatccttaccaggcaccttccgactcaaacacccttaggtaataccagccgtgaattccaagaatttcatttcctttgacctccaacgtgggtagaacaccctttaaactgaaagtcctcctgagggcagctgctaggaacttcacaaagccttgcttgcactgcatatgtgttttacctccacagcctttgaactccctctgggatgagagctgacctctattgaacatattctatgcttagcggttgatatggtttagctgtgtcactacccaaatctcatcttgacttgtagctcccacaattcctatgcgttgtggaagggacccgatgggagataattgagtcatgggggtggtttcccccagactgttcttgtggtagcgaataaatctcatgagatctgatgattttataaggggtttccccttttgcctggctttcattctctcctgtctgccaccatgtaagatgtgcctttcgccttccaccataattgtgaggcctccccagccatgtggaactgtgagtccattaaacatgtttttctttataaatcacccagtctcgagttgtctttatcagcagcatgaaaatggactaatacagtggtaaaccactaatcattcttctgagctagctactattatgattctcattttatacatgtggtaaccgaggtgctgagaagataagcaagttggtgaagcagaatcacgctatgactcaggcagctgaagcccgaagccaatgctttgctttgtgtatgctttcatttgtgtgcgtacgttttccaccctatggtttagatttgagaaactcagcaaatacgggagtgactgctatgtgcaaagaacaaggtcaggggctgggactactatggtgatcaaggttagatacacttacattttagcagagaaaacaggcttaaaatgactgatcacacaagatttcacatagttcagggaaatgctatgaaggagaagcctactgagcccgtaagaagaatctgatctaatctggagagaaggaaaaacaggaagaaccaatcaggagctggccaggccaggggcaggcaggagaatgcccaggaagagagaatagaaaggaagaggccctgcagtgaggaacgcttgtgtacttgcattatgacacttatttggttagggaccattttctttctcatctttatatccctagagcaggccacctgttttggtaaacaaaattttgtgggagcactgccatggttttctatttacagatttttctatggctgctttcactctataataacacgctaatagcaacagagactatttggcccacaaaactaaaaatatttactatctggtcctctacagaaaacatttgccaacctctgccctatagcaagaagcatagtacttcatatatagtaggcgttcaatcattttaaaaaattacttgtttttactctacttctacaaaatgttgaggcaattataataaatatagagattaaaaacaaccagtcacaaaaggccacatattatatgacctatgtatatgaactattcagaacaggtaaacatgtagaaacagaaagtagattagtagtttcccagggctgggagaagtggggaaggaagaggagggaagaaaagagtgacggctaatgggtaactgtttttatttgggactgacgaaagtgttttaaaattgattggagtaatagatgcatagctttataaatatactaaaatcactgaattacatgctttagatagatgagttatacggcatgtggattatatccccaaaaaagctgctattgagaaaaacaaaaagataacagccaaataactaaaggatgcttttgccttggtgatggggatttaggtttagccgagagaaaaagaattttctctattagaaggtccagttacccacttccctgcccccaaatcatcacaacagagtgcgcaagttgaatttgaccttcctagatgctaagatgagaaatgttactaattcgttgtctgtgataagaaacattgaagaattaatactaaaaagacagatttccttttagtcctgagctctagagaaattgctatgtggattttctgcactggattcattgacaaaacgagagccagtattcttaaaggcagttttacagaaattagagtgatgcgtcaccaatgacagcttcttatgttgacttttaaaaaaagccaagggctcagaggtactttaattatctaggccactgctgaacaacagaactttctgagatgataaaaatgttctgcattgtacagggtccaataaggtagccactagcctcatggggttattgaccacttaaaatgtggccagtgcaactgaccataattaaaattaaggagtaatttaattttattccatttcagttaatttaaatattctgtaatttaaatagccatccgtagctagtgactgctgtattacatacagcagatctagaaagtatggaaaggacactagaacattattcactgagtcctaaaagtaactgagcaacttttgttgccctaaaaaattgacaatgcttgacaacacaatttaaaaactcaatgcaaagcacatctattttgtactcagagtaatctaaactaatctgatggtgatgtcaagttgactctaaattatgcgttctatttttatgtatgtaatagatttgttatcagtaaatctttttcttttcttttttgttgcttctgtgattgaatattaaagacacagttcatgtttctattagctgagatgttcacctaaaaatactatcatcttcaaaaataacctctccattcccacaagagcaccaatacaggacagaaatgtcgaaaggcatacactgggttatattttgctttagtgcatcagcgctggaagaggcaagagtggtgaatggactgaatcatagaaacctaatacttcagctggcagttcacagttgaggatgggtgtgggaaacatgcatccaatctgtgcactaacgaagcaccaataaacaaggaaatgcaatgcagatgtgacagccgggtgtctttcaggagaagctgcaagggtgactgtgactctaacatggtgttaaactccaggatggctcaatgatcagtgcctaatctagtctaatttggaaggaggcaattagaaacaggcaacatatatacaaaaatctcctgtggaattttatctgggtattctgaggctttatgtaagaggaaacaaaaattagtattgtataagtgactatagtgagaagcatgtgtaccttataaacatgtaattgattcaagtttattaatatgtcttttggcaaagtaaacaattaatatctagaaaactctccactgaacagccagacaaaatatgttataaataaatgtgaattcaaggagacagcagcaaactcatttgctgtaatattggctcatagttgggcatacactaagttagctgcttatgactagattacattaaatctgatttaaaatatctttgacatagtgcatccttactctccacatcactgagtcactaaaagtaggaaaataatattaactagtttaactggattacgtggaaatgtcaatcaatctatgagtcaaatttgaccaaaaaactccccgggggatgtttaccaaacaggcagtttccctaagaaggatatttatagcttgaaggacttcaattcctccttctgaaacaggattttgttatcattttagtgagggagaagtgggactgaacacagcactgggattttaaaatatacatttgttgaaactccgagaccagtttaagctaaaatattatttccatctctttatagtgccttttccagagctcctatttatctcattgttttactccattcccatcctgaacttctcaaaggagaagttctccttcagttctgtcattttatcttgactctcacagtcactgtcacattgtaagtactttacaaagaactgagaaattagattgtcgagatcaaaaacagaacttatcttccatttaactgtcttctctctaacagggaaaaggaagtcacaaacttgagaggcaggagggcacagcactccaggacacgcgctttggagtctgagcacaggctgtgccacacaatgtgtgcgtgatgatggacaagcctcaaccttagcccctgtatctgtaaaatgggcataatgataaggccacctcaaaggacattatgaacaatacacaaaaagatgcctatgaaacccgtagcatggtcattggaatcagcaaagtgttcaataaatgttagctatatcagtgctatggttaaacatttaaaaagctgaggctgggtgcggtggctcacacctgtaaccccagcacttcgggaggccgaggcgggtggctcacctgaggtcaggagtttgagactagcctggcaaacatggtgaaaccccatctctactaaaaatacaaaaattagccaggtgtggtagtgtatgcctgtagtcccagggattgggaggctgaggcaggagaattgcttgaacctgggaggcagaggttgcagagctgagattgtgccactgtactccagcctgggcaacagagcaagactccatctcaaatataaataaataaatataaataaataaaaagttgatatacatttattccattttgtttcattgtcactaaaagataatctcactttcttgagttagatactttttgataactctcttatagaaaagaaatatatccaatgttttcaaaatcagcatacagggttgtggtgcccacatgcggttttgatgagcacatggtacgcagaggacattgtttcacgtccacttttatgcagcacggctaaggaaagaaacccagattttaaaagcgtattgtgggatggaccccaaatggcaccatttgtaacattccaactctcctaattgccatgaagaacatttactcaaatattcaaatattcatttatgcactgaagtattcattgagtccgtatttaggcactgttcttagtgcttgtgatatgtagtgaatacaatggagaaagtttcctgacctcagggtgcctaagttccaacatgaagccaaattcacctaaaataagacatctcctttttatattaatagcatagaacatttttataacatagtgcatcattcatattagacttttatattgctagtaaataccctcatatatttttctttttgactttcatctctcttacccaaccctacccttctgcaacagaaagtgaatgtaatattcttcttaggtatgaggcaaacacttatagttagcactaaagctcaacacaaaattactataatgcagcagctgatttttacaactgagcagagtggcaataatcagatttatttctataccttgctaactaaaaatatggcagagatttagtaattttttttttttttttttgctactgcagacaaaaacactctccacaaatactggtcagcagtttcttcctgataggagtttgaatacccatgaagccctaaaataaagaattttctcttgggaattagttttgtttggatatgactctctctctctttctcgcagctacatacaaacaacatgagatttataaagtaagaggagaattttcaaggtaactaaagtgccacttatgagaggagcatgaacagttttgaaaatggtgagataacccaggaagagagactgatttattggattatctttggctgatgaaaggcagactgaaaggctttaaaatactgcccacacgtgccctattgactcaggtcctctttacctggctgcaatgaggtccaggagatgctgccaccggtcgttgacctttcccagcttgtattcaatctcagatgctttgctttcatggctggctttagcaagtcgttctcccatttgttggagctgtattttgttctcttgagcaatagcaatttcctcttgataatcctgtgtaataaatagcaatcacagaggtcagaaagcatattcttaatacatccagcccagctctactagaaacatgatgattactgctttctactgcttggaagtagtttgagcataggaataccatgtggatatcagcccatgtgcacaagtattagtagtgcctattatttttggtatgtatgcagagttgggattaaatttttatatagaggttctcgaaataaataggatgctgcttcctatttacttgaaatacatattaaaaaacaataaaagatagatataaaaaataaaacttaaaagattttaatattggaaaattatagtttatttctctcatcactaacctgatgttatacttagaataaattctcagacaaatagttgctgagagacttataaaatgcacacacacatatatatatgcaattgatatataggtatatatataaatgtgaatgtgtgtgtcaattatgttatttgtgaggaatattttaaaagagttccttcattttaaagagataatcctctatacaatgtcaatattttgcagtaaataaatcaatgataaattaactttcaataataataactattaactatagagaatcgacaggcctcaaaccttcttaatttactcactttctgtgctagcttctcttagattgtttgagttaaagaggacagactccatatggactatttgcaagagataagcacgaaatggtgtgatttaactgacgatgaaaggacaatcccctccccctgactgccactgctatccccaatgaccctcttactctcttgccacagtgacaggatccagtctttaggatcaacttttttatttttggcttaagctcctgttacgtaataaatagtttctcagcaaaataatatatgaagacgggtattatatgagtgtgaacattttaaccttctcttggtctaaagttagtgtggtaacagagctatcctcccaagtcatttacctaagccaaagggccccaggggaatggtagggaccaacaaaactttattccattccagggctgactgctgtcctcatacctgcagccccacccaccctcctttttatgttatttcaacacaatgggattcaaagaccaatacgttgaatgtatttattaacattataatatttcagcaaacatttgagatgattttattgagaagtgtttctttcaagggaattactttaagacttaaaaagtatttataataaaataatcctcttggattgtctttaaaatcaaactgtttttgagtgttaataccaacagacactaatatcttggcttcaattttttttatgaatggcctttttctttttccttcatcttattagcacttcccagttgacaactgcctttttctatgttgccaaaattaccaaaccttgatgttattttcctttacaaaagagacgccacaaagaggaaaactcaaaagccctttaaaaaaaaacccatgagttattaatatacgaggtagtatagttaacattttaaataatattcctaacattgtgccaaacaatgtaataaaattatctatatgaaaagctgaaatttttctaaattttaagttctggttatagattgttcaagagatggtttttttccccacactctcacaatatacatcctaaatttagtaaaaaaaaagcaatgagaatagagacaaacttaatcaaaatttattctatagcaaattttactctactacctatagtgcatgaatcacgcactgacagcattctctgacacccagcaacttagcaaagggcaaccgtgagcagatgctaaaatgaaatctgtatcatctcagccaagagttttaagttttacaatatcaagtaaacaaatgcttatccatttggatttatccaatggataagcaaattggatacataaaggcttatctaatggcaaatccattagatttgtaacatcattaatagtacatgttggctttggatgttttaattttctatgtgtgcatatggatagaaataatttttcctaataaccatttatatttcttttcagaataaatgcagtaaatactggctgagtgcttatgagaagttaggcactgtttcaggtgcaggggatatagcaataaacaaaattagacaaagcccatgctcctggaaagctgacagatcagtggggtctccatttggacaatgaataagtaaatacaaaaaatacattgtacattagatggtgatatgtactaatgagaagcacaaattaaaataacattaaaatcactgattgttcacaagcactgtggaaacaacactgaaatcacccaattctttttttttttttttttttttgagacagagtgtcactctgtcacccaggctggagtgcagtggcacaatctcggctcactgcaacctccatctcctgggttcaagtgattctcttgcctcggcctcctgagtagccaggactacaggcatgtgccaccatgcctggctaatattttgtatttttagtagagatggggtttcactgtgttggccaggctggtctcaaaatcctggcctctggtgatctgcctgtctcacttcccaaagtgctgggattacaggcgtgagccaccgcacccggccgaaatcatcaaaaattttaaaatgctagcaaatttgatcagctttatatagacatcagaaatgttttggatccaaatgaatatgtaaaataatttgataagatatacatacctttaaaataatatgaagccaaaattatcaggaaactcttaattcctatctgtggtctataaatcatattttagagagaaaatgtcaattcaatttatcttaagaatgttttctttcagtttctctctagtggctttacctttttaaaacaaaaaaaaatacacaaaaaacaaaaaaaaaaggaaagaaaaataatacatataaagggttcctactgaacaggtaattaagacccccaaatactgaactgaatagtagatgctctatttcatcacaaattgcaagtattctatatattttatgtgtaaagcaggcctttttatgcaagtttattttatgctggatatccttttttttttttttttttttttttttttttgagacagagtctcgttctgtcaccaggctggagtgcagtggcacgatctcggctcactgcaatctccgccttctgggttcaagtgattcccctgcctcagcctctagagtagctggtactacaggcgcgcaccaccacgccaggctaatgttttgtattttagtagagacagggtttcaccatgttggccaggatggtcttgatctcctgacctcatgatctgcccacctcagcctcccaaagtgctgggattacaggcgtgagccactgcgcccagctgcaagtttattttatattaaaaagataaaatgtttaaaatatactgctcctttgacaggaaagtaattgtgagtaaagccaccttctgtacctgtgaaaagtacacataagccttatgaagaatgaaaacctaagtagccatgcattccataccttcttgagcttctctatcatttcttcaatgagaatgtctccattctgagaaactttgctttccatttgagtcaaccactcacagagttccttgttcttttcactgaagactgcccattcattcaatctttcacctatttgctgccgccttaaggagagctgaaaagtttaaaatgggagaataggcaaaatgattatcagagagaagaccacactccaaggaaaatagcaaataaactaggactaaaatgaatgatagtcatacatctttttagcccactgtttcctgaagtctaggatttgctattataaagtgggagacattgaatcctctagttctttcctgaagattcacatacacattagcttattaaaggttctggataatgcaacttcacacaattggttcaggatagataggatacatgaccagtgaatgtaaaaaagaaagaagaaatggaaaagagtagggaaagaagaaaggaaagaagggaagtaaaaggaaagagagatggtaaagaagggaggaaaaaaaaggaaagaaagaaaaaaggaatagaaagatgaaagaaaagagtaaaaatagggaaggaagaagaaaaggaagaaaagaagggatggaagaatgagcctcaggtatctagagagtgaggaagcgggcagcatccaagcgaagcggcctgaaatggaggcaggtgccccaaggctcagctccatactgacacgtggactccaggcaagttcctctacttctctgcagttttcatttttatttatttaattttgtttcttttccttctttttttttcgcatgacagatttattaagatgtatttcacatatgatacaatcacctgtttaaaaatgtacagttcagtgcttttgggtatattcacagcatttgtgaatcaccaccatcatcaattttaggatatttttatcattccaaaaaaaaaaaaaaagccaggtgcagtggctcacgtctgtaatcctaacactttgggaggccaaggcgggcagaatcctaacactttgggaggccaaggcggacagatcactagaggtcaggagttcgaaacctgcgtggccaacatggtgaaaccccatctctattaaaaatacaaaaattagccaggtatggtggcgcacacctgtaatcccagctacttgggaagttgaggcaggagagtcgcttgggcccaggaggcagaggttgcagtgagccgagattgtgtcactgtgttccagcctgggtgacagagcaagactccacctcaaacaacaatgaccaccaccacaacaatgaaaaccttgtagccatcagcagttactctactgctcctcctcacttacctcccagttctaatctcccttctgtccctgtggatttgcctattctggacatttcatatacatggaatcatacaatatgtagtcttctatgactggcttctttcacttagcatattttaaagattcacctatattgtagcatgtatcaatacttcattccctttattgctgactatattccattgtatgaatataccacattgcatttatcaactcatcttatttgggttgtttccatttttttgcctattctgaataatgctgttataaacatttgtgcacaagtgtttgtatgaacacatgttttcatttctcctaggtgtttatctaggagtagaatgtcttggtcatatggtaacactatagattgttttccaaagtggctgcccatttcacattcccaccagtagtaggattccaatttctctacatcttcaccaacacttgattacagccatcctaatggatgtgaagtggtatctgatgatggttttgatttgcatttccctaaaggctaacaatactgagactcttcatgtttcttagccatttgtatatctcctttggagaattatctactcaaatccgttgcctgctttttaattagattgcctttttattactgagttctgagagtttcttatacattatatatatacaatgggcttgttttcctatctctaggtctagaattatcctttccagaattctaaaattttctgatttcaaaatataatactcttgtgttcatagtgctggttgaaatactaaggaatgtttctagttgagttaaactacacgttggcaaaacataatatgatttggtaagaaggtctgaagacgttcttccacagtcttgttcataatgctagctattccactattcattccactgcattaaacatatccctattgattttattttacccccaacattttattacaaaacatttccgacacagaaaagctgaaggaattggatggtaagcactcattacatactccctgggctcaaactgttaacattttgctatattttgttttaagacattttccttccttaatacatttactttttatgtatttcaaacaaatttcctttttaaaatgaaaatgaaaatatttctaaggtattatacactttctagttatcaattctgtcttggatttgctctgttaatgattagacagataacacaaaactaaatatctgtgattctacatccttgtacactagtccaggagcccaggatacgtatcccaaggccagccttaggcatagtgagttgcctagagagtgagccccataacctaccataaattttgaaaggccaccatgagaaatttattcttttgattcaattatgatcttttaaagtaaaagtttttctgggttgggtgacactggtgaacctactaagtatttccccattagtataatttagtttctcattgaggtttttggaggcagaataatacagaacagtcaaagggcagtgaacttggggtagggcctactagaaatggaaaaagctaaggaaacagagatttaaaagttttggggacaaattttgtcactttacaccataccccaaatagcactgaagaacataatccttccaggaccccttacccctctagctctgagagccgcgtgcactctgatcttctgctgatctctcagattgagaactctctggtgaatacggccttttccctttcattcacagagcagcaagagtcaggagtctggctggtagttaaaatcccggttcaattgatggccaaactgaaactatactcttattatttggactgcccaaaataatcattgtctatgaatcgaagctgggcctggtggcacatgcctgtaatcccagcactttgggaggccgaggtgggcagagttcaagaccagccgggccaacatagtgaaaccccacctctactaaaaaaacaaaaattagccaggcgtggtggcagccatctgtaatctcagctactcgggaggctgaggcaggagaatcgcttgagcccgggaggcggaagatgcagtgagccaagatcacaccactgcactacagcctgggcaacagagtgagaagaaaaaaaaagaaaaagaatcgaaactcctgcccttcagactgaagatgaacaagtaactccttacactgcccccgaatcttggccataagccaagaatgaactctaggcctttactcaccaatatctgcagggaggatggtcccaaaatagaaaaatattacctattactttcataggtaagtattattatccccattccagagacaaggaatatgaaagttggacaaatttggggcacttgtttagaatcagtacaagataagaccagcaaagtttgagtctttgacatggggtgcaaatatgattaaatatccagaggcagctgatattcaaaaatagttcatccatcactgactaactgcatgatcaggacaaggtccctcattttctctacgacttactcctttcatttggaaattattcttatgtttgctccaaaaattcattaaacaaatgtttattgtctgtagtaaacaagtgtctctatgtgcccagcactgtcctatcaatatggtaatattagagaaataagagagtaatttaagaaattgactgatatggccaggcgcactggctcacgcctattatcccagcactttcggagactgaagcaggtggatcacttgaggtcaggagtttgagaccagcctggccaacatggtgaaaccacatcactattaaaagaatacaaaattagcagggcatggtggcaggtgcctgtaatcccagctacttgggaggctgaggcagtagaactgcttgaacccaggaggcacaggttgcagtgagccaagatcgcaccactgcactccagcctgggcaacaagggtgaaactctgtttcaaaaaaaaaaaaaaaaaaagaaagaaattgactgatatatattaaagacctgacaacagctggccattactatgctgttgctactagtactattatacatgactacagggcatcacttaagttttaaattttttttcctcccttgacactcatgtattccatatctccactaagcagctggattatacacatatatagatagatagatagatagatagatagatagatagatagatagataaaatatatattaaatcccttgtgtttatcacacaccatgaaaatgttgctttcattttcttaccacggagctacaccttaaaaaagacacagtgaggctacaagcactgggtgcaaacccaggccaaacgcttttcaaaagataagggcaatggcatcttccttctggtttgtacatctagtatttagtctatatactaagtaaacattaccatctctttctttggattcagatgaaccctcaaattatttatcagcttagcacctatttatgtttttgcaagggcacaaatacattgcattgccaacagctgagaagcaccagctaaaaccttcagagtgtgcagcagctcaacaggaaatacatccttttctggttgaaatatttttaccatgatgttttgacaaaacaacgagcaattacgatgatgacatatacttatatttcagctagaattacacacaaatctacaaaccaaaacagaataaaaacaagtataagctctggctgtacacaggcacaacaaaacatttgggctgtctacttgaaaacagatactttaatatattaactctgccctgcaatgtttactcacggcctctattccgcattctcatcgccagtcccaggtactccagactcctcatcaactgctttggtcagaataggaacagactacttgctccttagtagggataatgttatgttgaactcaagttttgacttttacaatgagacatgggcacaagctcatttccttttgtggtttcatacttgacagaaattcaccagaaacaactaactcaagaacgagaaactaatctatatcctccttagagttacatcctggcaccttgatcaaacccatgactaaactctcattggtttaaatattatttttcagactgaagtattaataacgtaagtacgctttagcttcaagcattaagacacttcaacatggaaagtttctaaaaacactatgtattccgtttgctgtttctttttaacgtcttagtctcctcacaggtgcaagttattaatctatttacagcatatcgcatgatcaacatcagcttttgaaatatattttcagatggctgtctagatatatctaagtctggagaacaattttacaacatatgaatgactactttagcaattaataatagcaataattccatggcatttttatacaacacttttcctaaatcaaaaagtattgcataaccataatcttcttaatcttcaaaatattcaaaatcttgtcattattttacactaagagaaacgtaagtatgaggaaatagaatcgatgccataatgtcttcattataaacaatacatcatgaacacttagctactctagacactgaagatgcaaagaaatggtctttgcatatcaaagtcctcatattcttggaatgaggtcacaaacattgaaaagaataataacacaatgccacataatggcacaaccaaaagagaaataagaattcagaggaccaagaacatactgagggctgagaatttcataagtgacatcacaggagttgtggaatgtaaaagaaaacaggttagaaaattagaagggaagaccgggcacggtggcttacgcctgtcatctcagcactttgggaggctgaggtgggcagatcacctggggtcgggagttggagaccagcctgaccaacatggagaaaccctgtctctactaaaaatacaaaatttacagggcgtggtggcacatgcctgtaatctcagttactcgggaggctgaggcaagagaatcacttgtacccaggaggtggagtctgcggtgagccgagatcacaccattgcactccagcctgggcaacaagagagcagctctgtgtcaaaaaaaaaaaaaaaaaaaaaaaaaaaaaaaaaaaaaaaagaagaagaagaaaattagaagggaagaaacagtgtcggcaggaagagtggcataatccaggtctttggggagggaagttcatggcatgtttgaagcaaacaggatccaatctctaaaatattatctctctgaaggcttcacaggcatcatttagctaaagcaatagatctggtctaattcaattcatcgaacatgctaaaaaatattaagagagcaggtagtgctagacttctcctaaaattaagaaaaacagatgaatgggctcacaaacgtaactgaaggttgctgtgataatttcccacaatttgtacccaccaaatatctttcattttgatacatcatgataaagtctttacattgcaaaattataggatgatttactgtataataaggtattgctttcagtttgaagaattcagaaatgaatcaagtgttgtgattagcattactaccctctatgcgtaaatccatgtaaattcctcattgtgttcactgagaaaatgaagctttgtgaaagtagccaaattcattttgaactcaaatcattaacatgttggtaaaagccatctcatacatgtatcccccgttttaaaaagtatatattcataggaaactgctcacacatctaccatgtgtgctccagagttttctgttggcccacggattgagaaaaacatgggttttcacctaaatatacagagagaaattttcctgaaaatacacttcttgttgatatcacatcaatcaagaggctctgagcctcttaaactctgtttaatggttcctgaagtatgaggataagcatctctaaagtcagagaaagggtggaggatgggagacaaaagagatcccagggcagcacaattggcagggacataagagtagggacataagagccccctctcaacagccccttcctcagtcttcccacaccagctttttccagccagttcctctgctccaactgccaccttgtcagagtgttcatttgcttcctcccatcaatcagtctcctccactccccttttcgaaactcaattcaaaatgtatccatctcaagaaacatttcctttattccttgccatccacactagccttagcttgcttaaatctttatacagtttgtgtgtgtgagagagagagagagagatggagttacgctcttgttgcccaggctggagtgcaatggtgtgatctcagctcactgcaacctccggctcctgggttcaagtgattttcctgcctcagcctcccaagtagctgggattacaggcacccgccaccatccgcggctaatttttgtatttttagtagagacagggtttcaccatgttggccaggctggtcttgaactcctgacctcaggtgatccacccgcctcagcctcccaaagtgctgggactacagtcataagccaccacacctgggtcctttagacagttttatacattgtttttacctgtttatgcctggttttcttcttaactgtacacattctcctagactgattttagtctcagatcaagtttaaacttgacgatagggacatttattacagtttgttaacatcacaattattaagatgactgatccatttaacagagatgtatcacagcctattatgtgccaggcagggcactcggggtatagaagtaacaaagacagggccctgcttcctggagaacataacctcaaggcatttgggtctgttcttcattatgagcctttgaatctgtttttcctctttgcctaggatgtcttctcgctgcctttccaccaatctttccctttcatttccaactcaaagtcaatctgggatatttttttaaaacgttgtgcacatagaaggtatttaataaatgaataaagtatgactaaaaataaatgaatataaattaccaggaaacaactacagtaaattaaaagtgataataaatattccctgaacaaaaccagctccacagtattagctaatgttgcaaatacaacagtagtttttcacgtttcaagtatatctacccagcaaaatcacatctgtgaaccataacattgtgctttctcttaaaaatattatgccagcggccaggcacggtggctcacgcctgcaatcccaacactttgggagggcgaggcggacaaatcacaaggtcaggagatcgagaccatcctggctaacacggtgaaaccccatccctactaaaaatacaaaaaattagctgggcatggtggcaggtgcctgtagtcccagctacttgggaggctgaggcaggagaatggcgtgaacctgggaggtggagcttgcagtgagccgagattgtgccactgcactccagcctgggcaaaagagtgagactctgtctcaaaaaaaaaaaaaaaaaaaaaaaaaaaatatatatatatatatatatatatatatatatataaaatgccagccagcaaaagtgaaagaaaaagaatccagtttaggtttttctaaaatgtggtaaaatataaatgtattgatctgaaatgttctggtagtaaccacagtgttcttcctttgtccgtactaagaattatgggccgggtccacatgtgggttaacccatctgacgttcaaattcatctcccaattttccatcatcaagataattccatttttagaacttatcttacctggtggcatagttcttcccactgcctttgcagaagctctacgcgttcattaagaatggagatatcatcagcactgatataggcagagagggtgtccttcagcaggctcaactgggtcaagtcatctgtccagctcccaactgcattttctaattcctaaataaaaaaacaaacttgaatacccacggacatctcctgccaatgatttctgaagtgtttttgaatcccctcttgatagaatttcctttgtatagccctcaatttaaatatctaacttgggatctagaggcacatcatggcaatattacagatttggttccagaccactgaaataaagtatatatcacaataaagtgagtcacaaattttttggtttctcagtgcatataaaagttatgtttacactatactattgtgtataaaatgtgcaatagcatatgtctaaaaaaaccaatgtacataccttaatttaaaaatactttattgtttaaaaatgctaatgatcatctgaggcctcagcaagtcataatcttcttgctggtggaaggtcttggctcaacgtgaaaggccattgactgatccagtggtgattgatgaaggctagggtggctctggcaatttcttaaaataagacaatgaagtttaagcagcactgatgactcttccttttacaaaagtttccttgtagcatgtgatgctgtttgagagcattgtactcacagaacttttttcaaaatttgagtcatcctctcaaaccctactgctactttatcaactaagtttatgtaatacttgaaatcctttgttgttacttcaacaatatccacagaatttttaccagaagtagattccatttcaagaagccactttcttgttgacggccataccaccctaaacatgcccaatcttgtctggtctcagaagaaaccactttttttattgatccataagaagcaactccttatccattcaagttttaacatgagattgcagaaactcaatcacatcttcaggctccatctctaactctagtcctcttgatgtttccacctcatctggagctactccctccaccactgaagtcttgaaccccctcaaagtcatccacgacagctggaatcaacttcttccaaacacatgttaatgttgacattttgacctcctcccatgaatcatgaatgttgcttttgtgaaaataaaatttatttttaatttttgtgggtacatagtaggtgtacatatatatggggtatatgagatattttaatagatgatagcaaagtaaatatggtattcatcacctgaagcatttatcctttgtgttacaaacaatccatttatacccttttatttatttaaaaatgtatgattaaactcttactgactacatttgccttgttgttctatcaaatacttttctattttttgtaaccattaaccatcctcatcacccctgcagcctccatgtaccctcccaagctctggtaaccatctttctactctctatctccatgagttcagctgttttaatttttaactcccacacataagtgaaaacatgttgaatgacagtggtgaaagtggacatccttgttgtgttccagatcttagaggaaaggctttcagtttttccttattcagtatgatgctacctgtggatctgccatatatggcttttattatgttgagctatgtttcttctatgctcagttttttgagggtttttatcaggaaaggttgaattttatcaaatgcttttcagcatcaatagaaatgatcatataacttttgtctttcattctgttgatctgatgtacacattgattaatttgagaatgttcaaccatcattgcatccctgggataaattccacttggtcatgatgaatgatctttttaatgcacagttaaattcagtttgctattattttaatgaatatttttacataaatgttcatcagagatattgttctataattttccttttttttttttttttgatgtgtctttgtctggttttgttagcagggtaatagtagccttgtagaatgagtttggaagtattccctcctcctctatttttcagaatagattgagtaggattggtattagttcttctttaaatgtttggtaaaattcagtagcgaagccatcaggtcctgggcttctttgctgggagactttttattatggcttcaatcttgttacttgctattggtctgcttttggatttcttcatggttcaatcttggcaggttgtatgtctctaggaaatcatccatttcttctaggtttcccaatttattggcatatagttgctcataaaagccgctaaagatcctttaaatttctgtggtattggttgtaatgtctcctttttcatttagatcttctctttttttcttagtctggctaatggtttgtcaatttatcttttcaaaaaataaacttttcattttgttgatcttttgtattgttttcttcatttccatttcatttatttctgctttaagctccattatttcttctactaactttgagtttggtttgctcttgcttttctaattctttaagatgcattgttaggttatttatttgaagtttttcttcttttttgatgtaggtgcttgtatctataaacttccatcttagtactgctttcactgtattacgtaggttttggtatgttgtgtttccattatcatttgtttcaagaaatttttctatttcctttttaacctcttcattgactcactggtcattcagaaacacatagtttaatttctatgtgtttgtatagtttccaaaattctttttactattgatttctagttttattccattatgatcagagaagatacttgataaaatttcacttttgtttgaatgttttaagacttgttttgtggcctaacatatagtctatccttgagaatgatccatatgctggggagaagaatgtgtattttgtagctgttggatgaatgttctgtaaatatctgttaggtccatttggtctgcagtgcagattaactccagtgtttttttgtttattttctgtctggatgatctctccaatgctaaaagtggggtgttgaagactgcagctattattgtatttgggtctaatgtctctctttagctccaataatatttgctttatatacctggatacatgagcatacataagtgacagaaaaccaaggaaaaaaattaaatgtatattattattattatttgagacagagtctcagtctgtcacctaggctggagtgcagtggtgtgatcttggctcactgtaacgtccaccacctgggttcaagtgattctcccacctcagcctctcaagtagctgggactacaggagcacatcaccatgtccgactaatttttttgtatttttagtagggactgggttttgccatgttgaccaggctgttctcaaacatataaatatatattatatatttatctgggtggtccagtgttgggtgtatatatatttacaaatgttataacttctgttatatcctctggctgaattaacccctttttcatcatataatgacattctttgtgtctttttatagtttttgtcttgaaacctattttgtctgatataagtatagctattcctgccctttttgctttccatttgcatagaatatcgttttccatccctttattttcagtgtatgtgtgtctttacagatgaagtgtgtttcttgtaggcaacagatcattgggtcttatgttttttaatccatttagtcactcaatgtcttctgagtttagttcatttatattaaatgttgttattgataagtaaggacttaatactgccattttattatttgtttttttctggttgtttatatggtcttctcccccttccttccttcctgtcttcttttcagtgaaggtgatttcactgttggtatgttttaatttgttgctttttattttttgtgtatccactgaatgttttcagacttgaggttaccatgatgttttcaaataatatcttaatacacattattttaaactgatgacaacttaatactgattgcataaatgagcaaactaacaaacaagcaaaaagaaaactagtaaaaactctacactttaactttgtcagctcactgcaatctttgcctcccagattcaagcaattctcatgcttcagcctcccgagtagcagggactacaggcacacgccaccccacctggttaatttttataattttgttagagacagggttttgccatgttgaccaggttggtctcaaactcctggcctcaagtgatccacccaccttggcctcctaaagtgctgggaatacaggtgtgagccaccatgcccagccatgttgtttcttatttatatcttatcatacttgtctatatattgaaaagttgtagttattatttttgatcagctcatcttttcatctttctacttaaggtatagtttatacaggccaggcgcggtagctcacgcctgtaatcccagcactctagggggccaaggtgggcagatcatgaggttaggagatcgaaaccatcctgactaacacggtgaaaccctgtctctactaaaaaaatacaaaaaattagccgggcgtggtggtgggtgcctgtagtcccagctactcaggaggctgaggcaggagaatggcatgaacccaggaggcagagcttgcagtgggccaagatcccgccactgcactccagcctgggcagcagagcaagactgtctcgaaaaaaaaaaaaaaaggtatagcttatacaacacaattgcaatgttataatattctatgtttttctgtgtatttactattaccagtgagttctgcaccttcacatgctttcttattgctcattaacattcttttctttcagattgaagaactccttttagtacttcttgtaggtcaggtctgatgttaatgaaatcccttagcttttgtttgtttgaaaaagtctatttttccttcatgattgaaagacgttttcactggttatactattctagggtaacaggtttttttcttcagcaccttaaaaatgtcacctcactttctcctgttcggtaaggtttccactgaagagtctgctgccagatgtactgaagctccattttatgttatttctttcttttctcttgctgcttttaggatcctttctttatttttgaccttcgggagtttaattattaaatgccttgaggtaatcttctttgggttaaatctacttggtgttctataaccttcttgtacttggatattgatatctttctctatgtttggcaagttctctgttatccctttgaataaactttctactcccatctctctttctacctccttttgaaggccaataagtcttagatttgccctcttgaggctattttctggatcctgtaggcatgtttcattgatttttattcctcttcatttgtctcctctgactgcgtagcttacttcaagctcacgaattctttcctctgcttgatcaattctgctattaagagactctgatgcattcttcagtatgtcaattacatttttcaacttcagaatgtctgattgattccttttagttatttcaatttctttaatttatctgatatgattctgaattcattctgtgttttcttacatttatttttttattttttatttttttgagacagagtcttgctctgtcacccaggctggagtgcagtggtgcaatcttagctcactgcaacctccacctcttgggttcaagcgattctcaggcctcagcctcctgagcagcttggattacacacatgtgccaccatgcctggctgatttttgtatttttagtagagacagggtttctccatgttggccaggctggtctcaaactcctgacctcaggtgatccacccacctcagcctcccagaattctgggattacaggtgtgagccactgcacccagctcaaaagagctattttgaattatctgtctgaaaggttgcatatatctgtctctccagaattggtccctggtgtcttatttattggtattttttgggttaggtcatgttttcctgaatggtcttgatgcttgcagatgtttgctggtgtcttcgtattgaagaattaggtatttattgtagttgtagtcgggacttgtttgtatttacccttcttaggaaggttttccaggtatttgaagggacctgggagttgtgacctaagtttttagtcactgcagtcaaatctgcatcatggggcaccccaagcccactaaaactgtggttcttgcagactgatagaggaaccaccttggtggtcttggataagatctggaagaattatctggattaccaggcagagattcttgttctctttccttattttctcccaaacaaacagcgtctctttctctgtgctgagttccctggtactggtggagaggagagttacaagtacccctgtggatcccccaccactactggaactgtactgggttaggcctgaagccagcacagcactggctctctcccaaggcccactgtaaccactacttggctactctctatgtttggtcaaggccctaggccatacaggcttgtgttcttctcttcagggcaatgagctccccctggccccaggtggtcgagagatgccagggcttggagttggaaaccttagaaatctacctggtgctctgttctactgcagataagctggtaccgaaaccataagaaaaagtcctttccactcttcccttccctgtcccaggctgaggagtcgctccccaggtccactgccacaacagaaccgtggggaatactgccaggccattgctgatgtttacattaggcccaagggctcttcaactcagcttgtggtaaatgctgccaggcctggaacttacccttcaggggagtgggctcccctctggcccaaggtagatccagaaatgccacccgagagccaagtcctggaattgagtacccctggagcctctttggtgctctttcctgttgttgctatgctggtacctaagttacaagacaaagtcccctttgttcttgcctctcttttttgtaagcagaagaggactctcttcatagccaccgcagctgtgaatgtgctaggtcacacttgaagccagcatgtctccgaatctgacccaaggcccacagtgtgtaatacctggttacactgctgactatccagggcctatgggctctttagtcagccggtgataggtcttaccaggactaggtccttcccttcaatgcagcaggttctcttctggccaagggtgtgtctagaaatgtctggaaactagggcatggaatgaaggcttcatgactgtgcccagtaccctatcttactgtaattgagttggtatccaagttgcaaaacaaagtcctctttactctttcctcttttctcaagcagaaggaaggggtgtcttttggagctgcaagctgtattgcctggggttgggggaggattggcacaacaactcctttagctgtcttcctggtgtgtcaccgggtcatgtacccccaagtccactggctccaagcccagtactgcactaggacccacctaggagtgtagtacttgtggcctagacagcctttcaaatttatgtaggaccccagagcattttagcccatggtagcaagtgcttgtcaaaactcagattctgttggctgggatgggagcttcccctttggctaggtcttgtgtaaatgctccctccgtgggcatcagctgagttctgcctggtattggcagcactgagctccaatgcaatgcagaccaactgctgggctctccttcctcgatatgcacagatgctctctccgtgccatgtggctgctgctggggcaccgaaaagaagaggtggtgtgggcaatccaaggttgtctttcctaccctcttcattgcctctttctgtactatgaagttgaaatcaggtaatgtgattgctcacctgattttttattcttatgaaggcgctttcttatgtagatagttgttacatttggtgttcctgcagggagaacagtcagtggagaattctactcagccatcttgttctgcttcctcaggtcaaatcgggaatgttcttactgccatctgcaatgacgaatcctttccacagggttttccatttactttgcccagatccatcataggaatcactatctatggcagctatagcctcacaaagtgtatttcttaaataataagacttggaagttgaaattattccttgatccatgggctacaggatagatattgtgctagaaggcatgaagacaacattagtcttgtacatctccatctccatcagatatctagggtgactacgtgcattatcaagaagtggtaatactttgaaagaaagccttttttttctgagcagtgggtctcaaaagtgggcttaaaatatcagtaaaactgtactgtaaacagatatggtgccatctgggttttgttgttctatttatagagcacaggtagagttagcataattcttaaaggccttaggatttccagaatgttaaatgaacactgactttaagtcaccagctccatttgcccctaacaagagagttagccttttctctgaagctttcgagccaggcattgacttcttttaagctattaaatttctcaatggcatcttcttccaacatagggctgtttgatctacctctagcctgggcaacaagagcaaaactctgtcaggaaggggagaggaggggaggggaggggagaaggaaggaaggttaaaaggaaagacggaaagaaagagggaaggaaggaaagaggaaggaagggagggagggagggtaaccacttccatcaatgatcttagctagatcttctgcataacttactgcagcttctacttcaacacttgctgcttcaccttgcacttttatgttatggagatggtttgtttccttaaaactcatgaaccaacctctgcctgcttccatcttttcttctgcagttacttctcctccctcagccttcacagaattaaagggagttacgaccttgctccagattaggctttggcttaaaggaatgttgtggctggttggatcttttattcagaccactcaaagtttctctgtatcagcaataaggatgttttgctttcttctcatccatgcattcactggagtattacttttaatttcctttcagaacttttcctttgcattcacaacctggctgtttgtggcacaagaggcctagcttttggcctgttccagcttttgacatgtcttcctcactaagcttaatcatttctagcttttgatttaaagtgagagacatgagatttttttcaattgaacactcagaggccactgtatgaattggcctaatttcaatattgttgtgtctcagcaaataaggaggccagaggagaaggagagagattgggaacattgttggtggagcaatcagaacacatgctacatttatgaattaagattgctgacttctatgggcacagtgtgtggtgccactaattacaatagcaccatcaaaggtcacactgactgtagatcactgtaacaaatataacagtaaagaaaaagtttggaatattgtgagaattaccaaaattatgcagacatataaagtgagcacatgctgttggaaaaatggtgctggtagacttgttctatgcagcaatgccacaatcttcaatttgtaaaaaaaaaaaaaaaaaccaaaaaacaaaaaacaaaacataggatctgtgaaacacactaaaacaagtgcaataaaatgaggtttgcccatatttcatttgcttccacataatttgataaattgctaagtccttctgataaagtatgattgcctgcagaatctttctgccatctactcatcattttattgatttaaaatttttttttcctaaattgaagtttaatcactgtattgatcttctttactttagactgacttcataaacctctaacttatcctttctttttgtcctgaattgctgatcacactgatgaaatatttttaaaaacagacacctaaatttaactttcattttcaagcactatagagttgctacattctgtgatctatacttataatgtaatagctgagaagatctgttgctgttactactcaatttaaaacaatgcactgaatacattttctgcaggatcagacatttctttaagttactaaaaaagattatgtaccctgtcttttaggggaatgatttaagaaaaaaaaattcatatagcaatatttgaatgagttgacattagtttttacaatattttgaccaattaccagttttgcaatttgtataaccagctgttgtttttagattccagctagttttgtgtataaatagagtatttcatgtgccgtttcccctccctttatgtgtctttacacggtagaaaggtttccaaaggcaatggcaattagcggtgctgtctgaggctaacttcccaagcaatttaggcaaacaagattttagcctgaattttccaggtaattgccttgttttgctgctaagggcagtttggggaagagtagcaggactagacgaaaatacattttttaaatctacacactcaatagcagcgtgtgtttgtaactgtcatgttttttgggagataaaaaatgacgccccatggcaacagtatttggctgaaagaccaaaccatctaggttaattaaatatgcaacatttcttctaatacttctaaacatattcaattgttataccactggaaagattttccacttttcacaccgatttctacccccccaactcgagcatcagatttgtatatggatttaacaaaagtacataataacaccaccaccaaaaaccaactgtttcagacgcacagtataccaaccccttaaacgagtcagtgtggcaaaaatatagcctgtagatacaggcaacccagatatttactgactttgaaaagttattaaatttccagaggcctcagttttcccttctgaaaaggggcaataataaatgttttcacgagcttttgttaatgccaactgagataacaccaatatagtcacagcccctaataaatgcccattcctgctttgcagaagttttctttaataatttttaatgtatttatttttttacagacagggtctcactctgtcagccaggctggatgcagtggtgtgatcatagctcactgcagcctcagattcctaagtgatcctcctgcctcagcctccccagtagctaggactacaggcaagcaccaccactctggttaatttttaaatttctttagatatggagtcttgccatattgcccaggctgatcttgaacatctggtctcaaatgatctgtttgccttggcctccaaagtgctgggattacaggcatgatccaccacacccggcttctttatttttaataaatttatcatcacaggttcaaaatgcgctttttaatctttgtaaccattgcatacttctgaatgtaacagctcaagatagtacttctttcactttccatccatgatgtaaaatatactaccttttaactttcctaaatctgcctttttcaagtttcaaataatatccttagattttacaactgaagaaaaaattcttatagccacacttttcatgatttctagacctctttaacaattatcatctcttaaatgcttaggatttctttgccaaagtgaggcagagaatttctaattaaaacccaagtcatttaagtatatgcgaatttttaacagaattaccctagagcaataatttgcaaatgactggggaacacaagggcatgtttaatttgaaagaaaaacatttttaaaggtacgtttgatatgatcagcctattgctcagcaaagaactgctgtttggacatttcacttggctacaaagatgtgaaaggcatgaatcttatagccactgaattgtgttggtctcggtgagctcataatccagggagtgatctgtattagctactgacttgcttccaagtaccatttgaagtgttgatcataatctttaagtacttagagccctgagcaatttagggattgtgtgtctctatgcagtcactgagataagctatttttccccctttccttgcataatggtctagagggcagggtgtgttctttggagggccactgtctgcagattttccaggctgttgatccttttttttttttttccttcttgtagactcgattcttctggtagaatgactccccagtgtggatgcttcaaaaaaaatgactttattgctcttgactcagcttttaaatatcttttaatgtgttttaaattttcatttgcttccttggagtaatccataaactagtctataatttcatcaactgcaataaatcagccatacaagtttcacctgagttgcctgtccttatgtcatatactaggatcttgtatctgcatgtagataacctaagagtttgactggattatggccccaaagacattccagcagaggcacacaggtgacggtgaaaatctcagttcagtaatttaccttgcaacgcatttgttctgcatggagctcttcatggtgatccgggagagactgcgaaagcttctttttgaaagttcgtagtttctccagggaatctgctattcctttctcacatttttcccagtcctatcatgggaataaaaacaaatagcatagatgtttttgatgtaggaaactggggggggaaaagaaaagaaacactcttcttcattcccagagaaagaatgaaagttacactgatggctgagtgtggtggctcacgcgtgtaatcccagcactttgggaggccgaggcgggtggatcactcgaggtcaggagtttgtaaccagtctggccaacatggtgaaaccttgtctctactaaaaacacaaaaattagccaggcatggtggcaggctcctataatcccagctactcagaaggctgaggcaggagaattgcttgaacccaggaggcagaagttgcagtgagctgagatcacaccactgcactccagtctaggcaaaagagcgagactctgtctcaaaaaaaaaaaaaaaaaaaaaaagcaaaaaaaaaaaagaacaaagttgcgctgatgaacaatatgaaggtatgcccacactcattgccaggggaggcaacatgctgttgtcatcagaagagctgagttcaaaactgactctgttactgactatctgtgtggctttaagcagataatgctctatgtttccattttccctacgaaaatggaaaaaatacaaactctccatatttattggagcccaaaggaagcaatgagtgtcaaggcatcaagcacaatgaccagaatattatgggtatccaagaatgttatctgaatccacatctatctgcagaggtaggactataatctcagtaccttgtctctttcttaaccccatccataactacacccaatgtctaccctttcccaaatgtactataagggatttaaaaaaaaaagaggatatggcatgtcttacagaaagagaaatatgcactacaaaagcatggcatttttgactggctttatcttgttcatgctgaaacatatgtagcaaaggattaaatgtgtaatatataaaaacccatgtaaattaagatgtagaagaagagagataatgcacaatttaagaaatctatatctaatatgcaaagtagcagtaagtgctctggagaggaataggccagggcaggtggtagagataggcagtatagaatgaggtagagctctatgtactgacaaaataaaacatctattgtgtggttatgttttgaaaggttacacagcaaactggtaacaatggttacctcttgagaatataggagaatttggatggcacaataagggaaatttcattttttactctgtatagttaaattattacctaatttttaaaaatcagacacacgtaatttttttgtaataaaaaagtagaattttaaaaaatgacaggaaccacagcagagcttgatcttttttatagcaccttatctacacattaactcctatccggtgtcttagtgccagtgaaaattaatttcaactaaacaagtctccttcatgttgtccaacactgcccgtttgtcaaactctccaatccaggccttcctgctccccactcatctccccagtggccactccatacaccgtgaattacagaattccaaagcaagacaactagaatcatgactagaatcacttttagttgtcaatatggtgtcaaatcatgttccatcttccttcacaatatctcttccattatcatcagtcttttcttatctggattatttctacttctctcctgacaccttagtttgagcataacaacccagaggtgttattaccacaactattttctggaagcagtgttgactaaagtgcccccttactcaaaatgtctttattcaaaaactgaactgagaatttggcacaagtctcatttctctttaaaattccttcatagaacttcttagagtgcataaccacattccctcttcccaattaccagaaaaaaaaattcttaaaaaacaaaaaaaaattgtctatcagggacagagttgttcaaattctcctttgttttatgctttgtgttcccagggctacaattagcttatcaatgctaaccatagtgagggtagacaaaaagtttctctttctgcttaaattaaacaacattctcaataaaactatcaaacatcctgaattgatcaacatacagttgataaaaatttattgatctaaaagagataagatcatcacgggtgctgtgacccacacctataatcctagcactttgggaggccaaggaagggcagatcacttgaagccaggagttcgagaccagcctggccaacatggtgaaaacccatctctactaaaaatacaaaaattagccaggcgtggtggcgtgcacctgtaatcccacctacttgagaggctgatgcacgagaatcacttgaacccagaagagtggaggttgcaattagccaagactgcaccacagcactccagcctgggtgacacagggagactctatgtcaaaaaaaaaaaaaagaaaaaaaaacaagaaagaaagataaaaaagatcagcttcttacttttcagaacaaaattaagagatgatagtgaagaaggtgaacatacagagcatggaattataatgcctatatttggcatacttactaacagtattaaaagctaaatatagataagtattatagctggggtaaaaaatagactaaaatgaggctatataaacatcaaaattcagattcataaattccttcttaggcaaacggatgtagtgtaaaagtcaaaataaaataaactttaacaagaacagaagagggattcctctttccaaggatgacttagattctaaatctataaccaagtccttttatgacgtgaattataaggaaataacttaatgtcatgagcctgcaaatatctattaaagtggatgttttctacaccaacaaacagacagacaagaaaagcaaatgtagtgactcagacatcatgccttattaagtcttggaaacatctccaaaaatcacatcacaaatttaaaaaaatatatgattaacatgttctctacaggatgagttacaatgttttaaatcctttcctaaaagcaaaaggaagaaaatgaacctggcatattacattactgatgaaactgtgctgtgtgcaaataatagttttttatagatgtccagtggcatttttgatggattgcttactacacagaaggcaatatattattaaataaaattcaatagaataaatccaatgggtatgtatgcacactttaagcattaaaaaaaaaaagcaaaatcttttctattaaccttagtcattacctttgatccaaacatgtgacaggccaaatttaatagataccctcactgaagtgttggtgattatcaacatatacaggaccataacatttaggtgtctttacttttaaagattgtaataacatcaactatgataatcactatcattcatttagcgctcagtatgagccaggtaaggtaccacatgattcactatcattatttcattaagtcctcacaatggccacatggaggtggtgaaattatatacccactctaccgatgaggaaactgaggcttagataggctaagttaactgggtcacttggtttaccatgattttaacttgagattatcttattttagaggtcctgtcctttttaaactgctcatttaattatgcattatacatgcaattgaagagtgagagagaaaagcatattgtgggaggtccggataaatctacattttccaaaacttactgtgtgatcagtatgtgatctgtatccaactaagggcttaatacacctcctggagattttatctcatggcaacttgcttggatcagctaagataaattaagagtatctttctggattggtttttcccttccataaaagaagagataccaatcttgaaaaccactttagagtctcagattagggagtggaacctaccctttgaatttctgtgtggatttataaagtcatcacatggctaaggtttcatactggtcattaatcagaattcatagcttagacagtcttattagactttactttgttgggaggttgtcctgaaaaattaaatgctgaaaattgggaaacttttccagtttgtgcaagataagacaaagtcttaaataaaacacagagaatcaaaatactgcagggtattatttcatgatctttgcattatttgatttgtagaataacaatgggaggaagtagtacaacgactaaaagggttttttggttcgtttttttctaactgaacttactttcaacaagaaggctagttttttcttctgttcttccagccgcatgctggctgatttccatttctcttggatttcagcgagttcggcctgcaaggcggcctcagcgccactgtccgccgagagaaggagttgcttgccagcctccacagtcaggatgtagctgccttgttgccgcagaaacactttttctttgaactgaaaggaaccatagctttttattttctcattctttctttcatcgtttccttcccataaggatttttaaatggccctaacttttgccctctttcatccagcaagcatttaccgtagtggtgctttgcacatgcatgcaccagtgaataaatgagtgagaatacaatggagacaggcttagtttctgtctccaaggtaagtacgattgatgtaataagataaccactctttaagattgatgcgtggaaatacagagggacatctgacccagcagggggcgcaccaagaggcagagaggcttcctcaaagcagtaaaggctgaatgtgtcttgcgagacatgaacttcaccagattaagaaggacctggtgcggtgagatgagtgtgatcaggagtggaggagaggccaccttctcacagagaaatgaggatgcgcacattcactatatgagaaaaatatgataaattcaggaaactaagtatggttttcagtggctggagtgtggatggcatgtgagagagtggtaggagatgaggccagacgacatcttgcagaaatttggtttttatactaaaagtgactggggttcacagaagaatattgatgttgggattaaagttttcataaaagcactcaggaatcgagtaaaagtagaatggaagaaggatgtgtgttggatatactaagattaggaagctattgtctatctgggcaagaaatcgcgagcacctaaccaaggcagtggcagcagggatgtagagttagggagattagataaggggatgatagacaaggagaagtatagctctcaaattattctaggattcctagactaatggcacttcctggaagtgtgatgggaaagggagaaaagttggtccagagaccacaggttctgctgggacccacagggtacaaggcatctgtgatgcacatagacataaactcacaaggtggttagaaacacaagtcaaaagcacagcaggtaaatatgaccagaagatatgaatatgccccttctctgctggcagggggcagttgaagtcatgtctgcgaatgagggctctcagagaaatttggaggagaaacgaacgaaagaacagtgactttaagggaagaggaactcattggatacactggggagaactcactagagtgataggagatatctctctaagatgctagaagcctgaaggtaaggggcaacctggaaatgaacaaagaactcaaacaggacagggcttcctgtcttctttggaatactcaagttacgtgtttaaattgctcaagaataaaatgtatgcaagcaacatgaagtttttcttcccttgccattaccttttcatccctgctgggatttagtgagctgcggcaggccatagtgtgtgaagtgtaagcagcctttgtgagaggctggggcttactatcatttcaccattagatatgggctttgtattgcaatcattttgtatatttctgttgacatttgagaacaatgtttgtcccagctgcaatgtcactctagagtccttttgaaaaaccgaggcgaaggtaaagtgtgcggtggaaatgcctaagaggtgtgagaacactgtgttttgcatcttacctgcacttcatcaaagagggtccttgcttgttgcagtggtataggaacacttccgagaccactcatggggaggtaggacacttcaaccaaccatttacgaagcttttctgccatctccctatagcgctgccactggcgaatctggctgtcaatgatcccccgcctctgctgggccctgcgaatcactccctgccattgattactgaggagtgtcaatttcaggttgaattcatccctagtgaagaaataattacatggtaaaaaagcactgttatcttggatgcagttacgcaatcagccaatgtatacactgtcaacaaccctaagccctgagaagtgatctagggcggtggtttttgaatatcatgccatgatctcttactgggttttgggtctattgcaattaatttttaaaattaaaccaccagtgtttgcaaatggtgagtgttttcatgtctcagcataggttgaaggcaaatatacaataaggtcattgtccttcactgtctccctgagagcatgagaggggaggagtggacagctgcaggtgcaacgggaatagctgcaaatcctaagcagctccatagcaacatgtgcagctcgtgatgatgatatcatcttgtgggacacactgcaggaaaatgtgtggaacaaggcttatgtagaacctctgtcttcagttcgaatcataagccacttgaatcaaattatgtaatttaaaaagattttttaaaaactgtactccataaactctctcagtattccctcacaataaacagccccaacctttagcaaatcattccagatgttcatctgaattatctcttctacattgtaggctgacttcactttattcttagaaagatgaaaacttgttatcatagtctgtataaatgtcattaatatatttagaaataataaattttacttaagatttctcaagttcaggctaaagtatatcaggtcttctaatgtgttcttacctctctgttttctggctttaaaaaaatataggtagttctttattacgttttatttaatatttaatttatggctctagaactggctagtaagagtctgtcccgcatgaaacagaatgagtttctatgtagattacagtgttattcacacctaaagtgcaagtaatgttgcactttaatactaaacacttgcacttctctattacaatagttttgcttttcttcctcagatatactatcctcttctcttgagggtagcatcaactttgaattggacttgctattgtgaacttgtatcttcttgaaacttcctattatccagaaccactataaactttgattttgtaaccaaatatgctgttagtcctagaaacttatttaatgactcaacttaaacaaaaggtgaataacacccagacaacgtcaacaaaacaagtattaaaaataaaatgtactaagtaaagcctctgcaaaaaatttcgtatgccctctcatcttaaaaatagatccataatgggccgggcccggtgactcacgtctttaatcccagcaccttgggaggccgaggtgggtggatcacctgaggtcaggagtttgagaccagcctggccaacatggcgaaatcccatctctattacaaatacaaaaattagccgggcgtggtggtgcgtgcctgtattcccagctacttgggaggctgagacaggagaatcacttgaacccagaaggtggaggttgcagtgagccgagatagcgccacttcactctagcctgagcgaaagagcaagacgctgtctcaaaaaagaaaaaaaaaaaaaatccatgtgatagctacttagattttgatgatgacttctgtttttgaaaggaaattttgctgtattaatcaatgtactagcattcaagtgtgatgaattaggttcatgatacttccctaaaagttacaagcatctgtcatcgcagaaaatgtacaactccaggacttgagaatatcgtataatcttgctttccctaccaggtaaccatccaaggcctcttaggattccccaccctctcttgatacaaccaagctgtcccaaactacctgccagcatgaggaattacttaaaacatgacactgttccctgtgctgaacttgaagctctaaaaaacgtaactcataaattaactttcagaacaaaatacacttgcaatctgaggccttcttattgtcagtaggctctaatctgatttttttttcccttcaactttcaaaattctttaccctcaagtctaacctcccattttcatctctttggtgtattttccctaaatgttagtattgaaaagttaatagatgctggcttgcatgtgagtatttaatttttattttacttaatgactcaaacatttataatattgttatagagttggctaagaaatgataaagcaaaagataaaagttaattgtatttgaatttgttttattttcaaggccttaaattctcaggaaagctcccatttaagtttggcttacttagagtagaataaatataatatcacattctgttgttccaagcttaaccatgaagatcttttatgtacttccaaagaaatagccacttaaaactgaaattgcttctacaacattaaagacaaaactctcaataaaaataatttattttttattttttgaaaaaatatcaaattaattttagtcacaactactggttcctaaatatgagaaaggtatacatatgtaatagaacacatgaggctaatactccaaatatcaccacggaaagtcgattagataaagtaaatattgttcctaggaaatgtaaatatagtatgaaattgtcatttctcataccataaatctggggagaagctaaatttttacctctccatttttaataaagagataatttgctattgtaaatgaaaaggaagaaaagatttcaggcggcatgtaatctgacttaaggtagcaaaccattttcaaacacagaattctcatggcatgagaaagctggctggtatgatccagtactgactgaaaaccagacatgagctccaggcctgattctgctgctacttagttctgtgaccctggtcaaatcagttcacatttgtggattttgggtttttcatctgtaagtaagagagatgggctagtgatctctatgctccttttacaaaaaaatttctgtaattatataagaatattagaagcatctgtttacaaaccgttgataggtcattgatatggttcatgctgatctattcattaattccatttcctacagatgactagtgaaggttggctaggtgatttccaattactctatgcccttcatataatataatagcagctctccaaaaaagattcaatactcattcatttcagagattgagacaagtttctcctccaattactgaggccccactacagttcaattgcctcaggaagattggatatatgccctccaatctgctcattaaaaagaaaatgactaatttactggaacctttctttgtaataatttatcaaagatcctacctgtcatcaacttgaccttgttctagaagacgttgcccatcaataatgattgagtgcaaaatctgctgacgactgaacatctcggcttgaaacaactataatttaaaaaaaagaagaacatactttagagttcctaattttagtgatcggttctctgataactttccaaatattctagttttcgcaagactatgaaagctatcaccagctgaaccagaaaatgtgtgaaatcctgcagtttaggaatcatttatttttaaatcatcaattaagatacactcaaagataaagtttagtgtttggtttactaaaactagatgaccaaaagtagaattatatttctcttctttctttcaaaaacacctaataaagtaagttaatgcacaatttgttttctggtttattttgtatataaaatatggtccatattcaaaacttagagaatagcttaggaccgttaaagaagtcaaagaaaaaaaatagcctagtctttttctgtcttttaaaactcactgtttttaagttttaaattttaaaattaataaattttaataaatttatttcactattttaaaaaactcaagagaaggtccttcgaattatttctactgttttttaaacaactttattgagtaacaattcacataccatacaattcactcatttaaaatgttcaatttagtggtgtttattatatttacagactttacaatcattaccacaatcaattttagaattttcattgccccaaaaagaaagtccatcctcattagcaatcattccccatttcttcccaatcctccagccttcagcaaccactcatctattttatgtctctatgaattacttactctggacatttcttgtaaatggaatcttgcgatatgtagtcttttgtgactggtttctttcccttggcataatgtttccaaggttcatacatgttgcaacatatatcagtaccttattcctttttattgcaaatagtattctattatatagacatttcacattttatttatccatttatcagttgatggacatttgggttgtctccaccttttggctattatgactaatgctcctataaataatgtacttacacaagtttttgtgtggacacatattttcatttatcctgagtatatacctaggagtggaatttctgggttatatgattactctacgtaactctatatggtaactctatgttaactgttttccaaagcagcttcaccattttacattcccatcagcaatgtattagggttccaattcctttacaccctcaccaaaatttgttattttttcattatagtcatccttgtgggtgtgagatgcaatctcattgtagtcttttttctattatttcatcatctgtcaattcaacaaaactggatttaaaaataccttagatatctttaaattttctatttaaaaaattctgaattaagtttttcttttctcttaggtaagacctatctctccatgtgcatatcattcataaatacacaaactgacttagttataccggtaaatagcaacataaggattaacagtgggcaaatttattaatttactttgtgtatatagttcttctccctctttgtttcttaagaaataattataatgcaatttaatcaagaggtacacctggagacatttgatagattgatttcctggtataaaattcatatacgctctttgaagatcacaaaatttttaaagacttttgatcaaagcatagtctcttaagcaattgtccttggcatattaaagtagtctctaacccagtttgaaaattgtctaactatctatacacgttccaccaactttgcctgtctcgagtaagtagcctttaaccacaattctggcattatactttacaaggaactgaagattgacacgtgcttataaacaatcatggagcagcgaataggactacatttttataattaagttatcaaaacctcaagcttaagaaagaaggcaaaatgatgcatgcatttagacactcgtgcaaagggcatgattttaattctcccacacagcatttcgtagcatcttctaagggcctaaaaatttcttattacccccaaatctactgatacaacttacctcgtgtgctctctgctgttccaaaaggtgctgataatttcctgaaatctctactgctaacttttgttctgtctgaactaggaattccatccatgtttcacatttttccaagaaagtctgatgttgtagcaaaaatgactgcaacttgctgaaagaacaaagggcaaggaacaatggttatttcactgcttattcttacttctctagcatataaaactagattaaataatctctgtgctcaattctaattgaaccaccacaaagctttcatgtcaggtggtaaaattattttaaaaaagaagaaagaggccagttgcagtggctcacgcctgtaatcccaacactttgggagactgaggtggacagatcacctgaggtcaggagttgtagaccagcctggtcaacatggtgaaaccccatctctactaaaaatacaaaaattagccgggtgtggtggtgtgtgactgtaatcccagctacttgggatgctgagacaggagaattgcttgaacccaacattgcagtgagccgagattgtgcctttgcactccagcctgggtgacaagaatgaaactccgtctcaaaaaaaaaaaaaaaaagaagaaagaaagttgaaaaaatgtagaagtttaaaatgtacctcttttaaaatgataaaaattatgtatatacttttaatatattctcacttaaaagagttttctgattaaagtgctatttagtacactaaacatgagaaacgactttacaatttgaatttcccacttttagttcaaattttgtcagtgttatgggaaagatcagaatttataaacatacacaagtcatgagcttatattctattgatacattggtgctatggtgtgaatgtatcccttccataattcaggtgatgaaacttcgtggtgaatgttggtagtattctgaggcagagcctttacacggtgattaggccatgaggactcctcctttgtcaatgggattaagggtcttttaaaagaagattcacacagcgttcagcactgttgtccttctgccttccactgtgtgaggacacagcaactctcccctcctgaggatgcagcaaaacctgccctcttgaaagcagagagcagccctcaccagacaactgaatctgctagcaccttgactgcggacttcccagtctccagaactgtgagactgttcaacatttctgttctttataaattatgcattctgtagtattttgacatagcggcacaaaccagactaagacaactggagcaaccaagacatctcttgtttactctacctgaatctttctgtagtctgagaggagatcagagaccaatggcggttcagattctgcattcttttgatttccttatcattcaagggtaacctatatccaagctcatttagacggtctaaatctggagccatgctgctgaattttaacatctgtccctagaaggaagatttaaaagtaggtttagcaccatggtcaaaaaagtcaaaactttttcaaagtgcgcagtgaatttctgatttcaggaagtagctggtcttcggtctagtggcctctgcatttctaggccacttacttacaatctctaggtacgaatagcgaaaagccaaatctacttttcagtctaaactgctgctgctgctgctattgctactcaagctactcattatcctttatggactacttaacgtgtattctgttatttacttgatatattatttacttgtatggtttatacatacaaatatattatttactttatttacacgtattatattatttacttgatttttattacgtgtattatattacatatactatttacttgatttactcatatgtaattatattacaagtattatattatttacttgatttatttactcataggcaattcttgacagaactgattaaggatgaaaattatgctgataagtaaaagaccttacttcttaccatttacgtttaatttgttcatgctaatttcctcctttattattcacaactaacaaaagttataacagtgatagctaacgtttattgagcacttactatgaatcaagcactgacaagagctttacaagtaagaactcattttatcctcaaaacgatcacataagataagtcatgctgctattctctctttacaagggaggaaagggaggcacagaaactaagtaaattgctccaggccagccagctagtaaatggaagagggtaaacgaacctccttgggttcttgctagagaaaataagatttcacttgagctatgaagtgaccacacattttaagagctccagttttaggtctctgacccgccaccccacagctggtgagactcaatcaaaagagcaatctattcttttggatctcttccctcccttcaaacacaggacaatgttgtcggttctgattttcccatgggtatccttatctccatctaggaaattggttacaggaaagaaaaaatgtcaggccacctttggctatgtgtgtgtcttctctttgcatgttctgcaaaagactcatgttttttgaagaaagaataaatctcaaatattgaaaccaaaatataactgttaaatggcataatgtccatgggtagacatcagcaatgaacaaaatagccatgacacagtccttcccctcgtggcacttacagggaataagatactattctagtagtcaaaagtgcaacagtagtcccctactcacaggaatgtaattaaatgacatgatagagcatggaagaaaaacaatagtgtgctatgaaaatgtgtcactggggggcctggtcctggacagacagtggagactttcctaagagagtgacattgaacaaaatgaccaggactttactctttttagtgaggagtgagctgacgaggacaagaaaacaaatccagagagaggaaatatcacgggcacagtggcacgggagtggctggagggagagagtggctatggtgcaacagaataagatcctcaggaaaggtggaaccaggatgccgccttgagaagccacatggtcttttccctaagagcagtgggaaaccttgagagctttaaccaagggaataatacaataaaattttcatgcctgttgaattattttgcttacttgattgaatatttaaaatcattcacaattggcagggcacagtggctcatgcctgtaatcccagtgctttgggaggccaaggagggcggatcacaaggtcaggagttcgagaccagcctggccaacatagtgaaccacccccctctccatctctactaaaaatacaaaaattagcagggcatggtggcacatgcctgtagtcccagctatttgggaggctgaggcaggagaattgcttgaaactgggaggcaggggttgcagtgagccgagatcgtgccactgcactccagcctgcgcaatagagcaagactctatctcaaaaaaaaaaaaaattcacaactaagtaaaacctttttttttttttttttttaaaaaagtattacattaggcctgtaatcccagcactttgggaggctgaggcgggcagatcacaaggtcaggagattgagaccatcctggctaacatgatgaaaccccgtctctactaaaaatacaaaaaaaattagccaggcgtggtggacagtacctgcagtcctaactactcgggaggctgaggcaagagaatggcgtgaacctgggagggagagcttgcagtgagccgagattgcaccactgcactccagcctgggcgacaaagcaagactccgtcacaaaaaaaaaaaaagaaaaaaaaattattaaattatttttgatggacaaattataatcgtatatatttatggagtatgatatgatgttttcacacaatgtggaatgattaaatcaagctaattaagtaaaacccttaaaaagaacaaaaaaggtcattctgacagccaggaggaggggaggttgggtgaatggatgcagatctgtgggaggcggctgtagggtctcagagagataggagtagattgagctaggagtagatgatgttagaaacagagacgagaggttcaaaagttaatagagaggtgatggactgggtacaggaacatggagagggaccagccgtggaaaggaggagtgaggtggtttccagcggtggaaagagggaggagtgaggtggcttccaggagtgagctgggaaatcagcctgtgcccactgccagcacacagtctactgtttgccagagaaagtctcactgggggctcactcgaaagaaagagtgggtctacatcagctttgagtttcacttaagattttgaaaacagggctgggtgtggttgctcattcctgtaattccagcattttgggaggcctgacctcgggtgatcagttcaagaccagtgaaacctcgtctctactaaaaatacaaaaactagccaggagtggtggcgtgcccctataatcctagctactcgggaggatgaggcagaatcgcttgaacccggaaagcagaggttgcagtgagccgagatcacaccacggcactccagcttgggcgacagagtgagactccatctcaaaaaaaaaaagatttttgaagacagatggtaaaagatctgggactcagatttgaacacacttaccttaagttcttccatcctttcctggattgtggagaggtcagatgagtggctagggtcctgcccttgtagtatttcttcagcttccactatccaggcctccaaagcttctaaactcttggcaaaggtttcataatcaagaactccagcctttttttccacaaaagaaattggtatttcagttaaaaaaaaaaaaattggtattttaataaagtctggtaaaagggcaagtggatattaaaattatttttcatattcttgtatcaaattgccattctctagacgttcctataaaaaaagctataacaatttaaatcttctttatgtaatttttctaaaaactataattatttctatgcaccataagtcaataacaattcaaattattctttaaatacatgatcaaacaacacgtctgaaaaatcttctgattcttgtaaaagtctgagttaaataaacacgaatatttatattaaagccgcttagtgtttattaattgaacaggccatggtggcaggcattggttcaggggcttgcatcttaaaccgattttaaaattccttggcagagaacagcgcaaaacgtccaccttcatcgtccccaccagaacttccaagtttgtttacttgctattttcttgagtcttgaaggaggcattgttgccatgacaaggaattctttttctgtgtttgtgcccagatattagagaacagccaatatacagaagatactaaataggagctctgtacctgtaatgaagtctgctgtttgcagagagcttgctccagggcacacaagtgttgactcaaagagagttgatccgattgaatagctgatgctgcggaagcatccacttgttgcttcagttgctctcccagctcatggagaaaaaagagggaatctttaactgtgcccagtcctttgaggaggtcctagaagaggtgaaaatatgcccactctgaagcatgttgatactccttatcataaacagcaatcggcaaagggctacacatgtagaaacacaccattcctacggatcatattattaggctaaataaacttcacctgtggaaaaatgaacacgcactgaaccccattttttaaaatgctatgttaatattttaaacatacattatacacatataacctatggctatatataattactcttttgttagtaaaagctatgtaggttcattacaggaccttggggaaatgcagaaaaacatacataaacaagaaaaaaaaaaaaaacaaacatgacccaagagtagagccaataactggaaatattttggcagtttttttcctgcctctttatgtaatttgtatcaaattgaaaacaaaatgttatatttttcctttttctattattatcatacacaccaggaatttgtccgtggtgtcttctatatgtgtggtcacattattgcaagtacagcaacctcctatctcagtagggtacagaacacagtgatgattttggtgagcagggggtgagagtagcctgtattcccattcttttccatgggatctctttgcctccactttctgtgggaccctcctacaggttaaaaaatataagccaatggaaactccctgtttctgctttctatcctatcattgagagataataagtgactgcttcttctacctgttgctggtatcccactcagtcatgttatgcctaggcagtgacttctgtgagagaaagaagaacaaagggctctttacgcttgacacagataacagacaaggtgtatttcaattcaggagtattgaaaatgacagttcttgtacacacaaattatgtggatgaaaaaagcactgtattatctttattttaaaatacccatctttagctttaaagtgattattcaggttgaagatattagaataggttaaacttttatttacatagtttttatagcttgcctaattctaataaactgatttggaaaagtttataaaaagatcctcgtaacaagctcttaaaaataaagacaaataaggacaaatagtaagagccatgtaatgcttgaaacaagagaagagctgttccttaaacccttaagtaggttattggcagctacagtgaaaaagagaattattaaaaagccattaaaagaagtataccagtaaattaggagagaaagacttctttctaccattaatatcttagatgaaactattgtgtagatgcttacataggagttaatgaatgtaaatggacaacatctggaacagaagattttttaaagatagaacactattccccatatggtcatgtcttatattgaccaccctagaaaacacaaagagcctcaatctttcacattgactaaattccactaggaaaaatgggaaaacaactcattttaaaaaataaaacaatgggaggagacctcttagtctgatgcatgtgcacctgtgttctgaaaatcaggcaggctctttgatcctaagacagttatttttgggtaactgtctcacatagaaagacataccaaagcttacacagaccaaaagctaaacttgggcagtctaagaagggcatgtggggaaaacaaggtagctcctgaacatacgttgcaatcttgaatccatgtggcaacctcatcatcggcaatgtccttgtttgtggctgccttcaacagctcattggttcgatcctcctgctgctgaactgtcgaagcacactgtttggagtagtccttgtatctttgccaaagctgaagtagggccttgctggactgtagctgctcagcaatctcttccagcaagttattccatctggaaataataaccaacactcatgagcagattaccacctctcaccaaatgtggatatgtgctattttatttttcatgatcctggttcatgtgaatatagacataatcatttctagttaacataataaaaattaatgtttcatattcctagtttcagggtaggtaatgaggatgatggcaatctttgggtgtacagtacttctaattctttctaaatctcttcactacatttatttatccttaaattcatgttgtgaaagagaagtttaaaggaatagaatctatatagctcaaattcaaactgtcattgttttaattatatcattatttataataaggctgtgatataaatagtgtgtaaagttaacatactccatacctcatgttgacttctttcagtgtattggtaagagtttctgtcacgggtgggtgacactcttttaataattggttggtgatagagccaaatttctgtaagctcctttcctgtttttccagatcatcttggagattctgccccaaaaaaaagacccatagatgacataacaggatctaaattctaataagcaagtttaaaaggaatttgtatatgttttcataaatatgtacatatacttgtataaaccaggcatgacttagcaccaatgctttatcagctttctttagataatcatttattctcttttgtaggattttgttattttggctatgagaagaggttctgagcaatgaagccttcttctattggcatttgcattctgctgaaaaactcacatagggtgcccttgtccattgtctggtaggaagctgccagagatggtaaattcctcttcaaagggtttaattgtgtaatgtccttgtccttggttcagaggcctcacctccttgtactttcttgtttctggcctgtgagcagccctcctgctcttgttgtgtcctgacttgcccagacatgtccaaacttgccttgtgctgtaacacagggaccactcctacccctccctcccttgagaatcacatatttaccctaattggaaaagtttaagtcttagccaactgaggtcagtttagattgagtggtccaaccctagccaacaggggaaggatgcagggatagggactgcgttagggataaaaactccttctctcctttgttcagtgtgctcttgcagcagccagaagtgtgagtggcaccctcctgcagaagtaaatttgccttgctgagaaatcctttaagtgctcattttccttgctaccccaagctcttgtttctaacaaagccatggcaatggtgttatgtaacgtgctatctgccaaactgtggatctctttgacactcaaagccaaagccaggtctctattttgttacatacccgcagtgcttctaccacaaactcccgaagatgaagactctaagaaggcacagctttgccaagctttatctctgggtgttcttccttgccaagaattatttttaacttaaaaaaatgattttcaattgacaaataataattgtatgtatttgtagggtactatatgatgttttgatatatgtttacattgtggaatgaataaattaagataattaacatatcattacctcacatacttatccatttttgtctagcaaagttgaactcatagaagtagagagtagaatggtagttaccagggcatgggataagggattagatggggaaaagaaagatgttgatcaaaaggaacatagtttcagctacacaggagggataagctttagtgatccaccgtacagaatggagactataattaataataatgcactgtatatgtcaagattgcttaaagcaaagaatatttatcagacaggtttggcatcttctaccaagcctatctaaatagtctgctaccaaggaccagtaagggaactgaaagaaagttgtttctctggaaatagtgctgaggtgacagactcagttcttcataaaactccacaggtgaagtaggctacaaaaatcgagtactgtttaacaccaatatctgattaccctcaaatgaaaacagtcaaggaaaagacccttaatcctttcatgtcttaagacagctcttgcaagtattaaacataacatatattaaattaaaaagcatttctaacctcctcaaagttataagatgtgcttttaaatttactatcctcagaagaagttttcgtgatccttagtaacgacaatttaagggttaagaaattatatagacaaatttgtccttcctctcttccaccctaccctaaaaaaaatatttccttaagaaagtcggccgggcatggtggctcatgcctgtaatcccagcactttgggaggctgaggcatgtggatcatgaggtcaggagttcaagaccagcctggccaagatggtgaaactccatctctactaaaaatacaaaaattagccaggcatggaggcacatgccgtaatcccagctactcaggaggctgaggcagagaattgcttaaacccgggaggcggaggttgcagtgagccgagatagcaccactgcactccagtctgggcgacagagcgagactctgtctcaaaaaggaaggaggggaggggagggaaggagaggggaagggaggggagaagaggggaggagaggaaggcaggctgcatctgaggtcagcaacatagaagctttgattggctggccagggaggcggactagatattagcagggcacatgctggtctcttgttggcctcccatcccttaggggcctgccctgcccatcccatagtctgtgttctttagccaagaagaaagagcagtgacaggtgagagtggcccggtgcacaggagagtgggggcagcaggaatttgagggcggtgacctgagacaggagagagtgctatgttgaagacaaacatcagggatatcattttacatggacacaatgacaaaggacccacaggaaaccaagcagtaagtgctagaaaggaagattctgtggacacgctggataggccactgatattttactgaatggaagcaactgaatggtttaaacatttaccacttttgccgtttttctctgtgttttcttttgaacattccttagaatatgtttggagatgcagataagaagagaaaaggaagacaaaaggcagtgacaatgaatcaaggaggttcagttgggcataaaatcattgtataaaagacgatgtgaatatttttttacaacaggatcttggaaaccatttagttatataccagctaatccagaatttggcacacacaggcaagtttgctcaagtaacaataacacaggtaaaattaattttaaagatcttaaaaaataattaaacgtaaacaacatatggcaatatttcaggatgatgtctccatttggtaatttttcagttttctaaaattaaaatgaacgttaaggatgtgttaaattaattccttacctgaagattgtccacctgaacttgcacagcttctaaggagccagtcagcagacggaatcgggaaagagagtatctggcctccatgaggtaactgtttatcttgtcaaaggccactttgtgactactccattggtcaagcactgatttcagcagtatctttaattgtccaaccttttgaaaaagacaaatatggcttataatttcataatatctagaatgatggaatatatattcaattgatgggaaaatattaacatctaagaacttcatcagggtttcaggtatcataaacaaacaaaactaaaaagaaaaagatttaaaaggtaaaatgtatcaactttgaaatttatgccttccacactttaaacactcagttctaagtggaaatgcttaaaagggtaactgataaatatatatatatatgtatatatatacatatatacatatgtatacacatatatatgtgtatatatatatacatatatgtatatatatttttaagttataagaggttgatacttttaataaaacagtttaagaattgtattaaatgagtgtttcaaatgcattaactcatttaatcctcacaacaccttatgagataggtatgatcattatccccattttatagatgaggaaactgagacactaagaggtaatgaaaattacccaagattatactgctagaatgtgagaaatttcaatttgaatacaggtagtcaggtcccagaaagtgaaatctatctatagctataacaatatccatatctatctcacatatgcgcaaacacacacacacacacacacacgcacacacacacacacactcagataaatatcttaagacaaaacatctaagatattccttcctcataattatttatctctgtcagaaaagtgtttagcttggtttgcatcacttagatacagatatccactttgtatatcttttgccaggctggagacagatgtttgagaatgatctattgccatgggaatggatgagatcattaagagagtaatgtttaaaataaaggcttattctagaaaacaccagaaactagactttaaaaaaaaaaaagaggataacgaagtggacttaaaagtacaaggagataatgtatagatttgattatttcctctgctactttaggaaaaccaaaacccagagtttggacagagctggcaaacacggtcctggagctggctttctgtgagcaatattaccatgtgatctaaatttgcccaggtttggccgagctctcgcagtgtgctcatgacaatgctagagacgtcttctttcttgttctgaatcaaagcaagtccattctgctcaattttctctacttctttttcttttgctttaatcaaatcttccagatcctgaaagatttaaaaaatagtcactttaaattgttctattatggaactctggggtgcactgaaattgggccattatagtttcatgtcctaaaaaccttttactaatccaaaaagcttatctctttcagaagaggcacgctgcagaagtacttcttcctacactcaaatgcaaaaaaaaagtcatctttttacacatggcaaattagcataactttaaaaaagtaaaatttgatattctaccagataaggaaatggtactatgtaattttctcaagaggctgtgaggaaagaaatacatgtcagaaactgtaatattatttatattattaagttcatatatgttggtattcaaaaagttacgctgcctacctcataggaagaaatgtgatcgaatgtggtattctgggccctagtatctgagatttagtcacatttctactactcacctacccaaagctgagtcactttgggtaggtgagaaatttctactgggtctcagtttcttcagatgggaaatcagaagactgacttcagatgggaaaagatcatctgtatgatcctctctctctaaaatactctgaattctatgtgattctgaaaggcttcaggcttctttgatgaatcaaatcctcattttatttgggatatgcattcataattgtcagtataaaatgttcaagaatgaaaagcaaaatgaagaaaagatctggagctcatactgaacctgtatcataaccctaatttctattttaatgccatctgaaaatttgagaagctcagtgaagcagactgagactgctatcaacattttataaataaataaattgaagatcaagtcatccgacctgtcttgggtaaaagagctggtgagggatggagtggggattagaacccagtctttggagcctatggactcccagcctgatgccagaaggagtcggctgaacctcagactgtggagggaatataaatcccatgttggggtgatatgaaaagccaggcattaaggcatggttacagtcccatattcagaagtataccctcagaactaaaagcagatttgtagttcttggagattcgaatggagaaaattcccaaatactttaactttggataacacctcaattgtataaaaaatattttcacccccctcatgatccatacatgagtaataagattgaaattggatagtgctgctgataaggtgttaatgaggagtccagtctctgttatattaatttcaaatgtcatgcctctttaaaaataatttttgcctcttttatttctgtttctattatggttcaacttgttaatctctctctacctcatttttaaaatagtaataataagacattttctccttactccaaggagataaaattaggtaaatatatataaaatatattttaagctgtcaaaaagtagctaaatgcaagatattattatgtttagccatttggcaatgtgccatgtttcagtgcaaatttatttatttttctctattgaattatcatgaagctatttttgttttggttaattagttagacactcacgcatttggcagcttaaagtgatcatttttgtttttcatattgttctcttatttccactctataattttgtcactattttgacagctttgataattaccagagaataaatatagtgattgctggggttacaggtcctttgtgtagtataggaaatataattaatttactatttagaacttttctatttctgtaaagagattaaaagaccagaaacaatccttccaatatgtctttaatatgattctaaaattcaacaattagaaattgagtttatcctcatttttctatgatgttaactttttctcagtgaggaatattaaatgaatgttccattgcttagaaactatttctaaaatgccctgcacacgtatgttggtagaagagcaaaacccatgagggaaacagggctgaaatatatattttataaaaaataaaggtgtgtttcccttgctttcaataataattaaaagatgattctgtttctgatcaaaaaggggaaaggccaaacctaccatttttaaaaacaataaaacattcttaacttcgattaattcataaatatcagttttatgttggtttaaattaataaatcacctataaaagactgggaaaatactcaagatttttaaaacaaaataaagctggaatccagtcaccaatttaagtatactggcttgaatttcacactttggtccaaaaaacaatttctcaaaaatgacagttgtatcaagacctgtagtatagccaaatagaaccttccagttaggccattgtgatttatttatatgcgttgtcccaaaataattatatgggctactttcattctgtcttttgtttcaaagatatgacttttcatttgaaatcatgaaccggcatcagtacaaagttctttcaaccacactttaagctttccctcctgacactgtctgacctggctctctgaaagactaaaacttaggtcctacacttggtaaaacatggtcaagctgctgctatattttccagatggtaaggtgtctccctgttaaatagaagaaatgaacaggagaagaaacaaaatggaaaatggcagaaaaagctatgttaaagagaagaaaaaaatactaagagagagaaaaagtaaagtatggaagaaaagaagtggaaaaaataaaagaaaatgcaaatggtattaatgtggtatttcagtctttcaacagtaaagtttatcacaaccatgcaaccagaaggtcctcactttgctaattctaatacgcagaattacctttcaaaatcaatggatatgttttaatttaggaactcaacaaaagttatgacattttgtcctcagaagtaaagagctgaaattctggattacttgtagatttttgaatttatggcctaaatcagaaataccactggcctctagaaagttggaaatgcaatgagactagctgaggcatgttcttcaacttcagtctttaagcacccattttctgatgtgaggcttttttttattaaataaaaaaactattattacttcaaggtattctctatacgatgtttttctttatcaattttatgcagtctcaaaattgtaatccattagctggggagccagcacttctcttccttttcagaaccgaaaagctttgattaagtgcttaaatatacctctctttatatgtgtcccaaacagaaaacataatgattggaagagagatcattaccaaagttctttctttctgaaacccgaaatagaaaaacaagatttgcagagagaagcttttctgtagaattacttcactgtttagttttcaattgtttttaggaaacactataagggaacagtcataatctgtaacaatatatgaattcatgaattattttcaaaaatcttattactgtattaactgcaatagctcacttttcttttgggcacacaagaagacctgtggaaagactgtgtgtccctgagtcactggaaaacatttggaacgttactgcttcacctgaactttcaatccgcatccctcagagtagaacaagcacactctgtgtacttctccatgtgacaaaaaaggaagtaacatggatacttcctattaattaataatgggatattattaataattaattaataggaattccactgtgaagtgcttgttcagaggaggtgaacgggaatccaactaagcctctagtgctaacttccatttataggacatacagaggagagaagaacaaattaaacatcttaaggacattcataggccaatcctgaacatggcacccatcaacagcttctgcgacaggttatggtcttaaaaaaatattcaaaagatttaagagatctaacaagcaaatgtagcatatgcatattgtttgcatccttattttgaataagttaacatataaaagaaattttaaagacaaccgaggaaataggattatgcgttgaacataaaataatattagaaattattaaacttttggtggtgataataatatggatgcattaagaaaatgtctatttttcaaagatatatattgtatgtaagaataaagtgacatgatgtctggtatttactatgatatctattttagaaaaagaaataatttaggcaattttttttttcttggaaacagggtctcactctgtcacccaggctgaagtgccatggtgtaaacatggcttactgcagcctcgatctcctgaattcaagcaatcctcccacctcagcctcctgagtagctgggactacagggacaagcaccaccacgtctggctgatttttgtagctttttgtagagagagggtttcaccatgttgcccaggctgcaaatcttgacaattattaaatctgatgctcagtatacagggttcatagcatttctctctacttacgagtatgtttgaaaattttcataatttcaaatttttaaaaacgagtgaaaaaaacctaatgtattttaaaaaaaaccctataaactcacaaaatcagcaaaatttgttactaaatgcaacttttaaatatttaaaaaaatatttaacttgcaactctcaaggcctataaacatattagcatacgctatgaaattgtgagatggtgcatgttagccacctggacaagttacctgacagtctttcagtgcattttgaacagaagcctgatctccaattcgatgctgttgttttagtctcttttcctgggtttcaaaccatgttttcagacattgtacattattttcatattctgaccaagattccaataagccttccaacagctggatctgaacaaacacaataaaatgaaatttgcaactttattttaataaaatcaaatcattagcagactaattattctagccagtattttctccaaattaagaattcttaaaatacagttcatcgtatatatgatttaaaacaggggtgtctaatcttttggcttccctgggccacactggaagaagaagaattgtcttgagccacacataaaataaacgaacactaacaatagccgacgatctaaaaaaaaaaaaaattgcaaaagaatctcataatgttttaagaaagtttacggatttgtgttgggctgcattcaaggccgtcctgggccgcatgcagcccgcgggctgggcaagcttgatttaataaatgaatttcataaagtatgaatcaatgactattactgggaagcaagaaaggactaaagtcaacttgaagcaaaggcaaaataaatcaagaggcatctttagaaaactgaaacaccataaaatatacaaagagcagagaatgtataagagaaaatcatcaacaggttaaaggaagtttagggtgattaaccttcagcggtattattggaagcgttctttgcccagtatagccacgctacttgtgaacccagtcttccttacagagtgtgcctgttcttggggttttcatgtaaatctggacagtgggaagccactggcttaccttctcagttactagaccttgcagaatttgccaacttttattcattgctccaagttgctcagcaaaatcagtcttatcactacgcttactttccacatcctgactgctgatttgtagcacggactggttcacaaaatccactgtcagctgtttacagttaatgtctatcttaaaaccctaaaaaaaaagaggagaaaataagattatacaataaatgtctcattagttttccaggagttggaaagccttaagtaaccttaatattaatattatcacttccataactcagctgaaatggcacaatttgtctgtgttcacacaacccattatttttagaagccgaatatatatttgtatacgtttatatgaacataaacacagatatacgtgtgtatgtgtgtgtgtgtgtgtgtatatatatatttaggtagaagatttagaactagataaattatataacctcactataaaatatttataaatttatttttataatttctgtaattctttaataacacaaaattattcaaaatcattcctagtactggatatttcttcttatttctataactgataatgcatttttcttgctattgaattcctatctggtcactgtgtaggaaacatacattccaagacttgattaccataatttgagttttttagttctttcaaataaaatggtctgaaaatatgaaaagttaaaaacaaaaaattttaattaccttatatttctgaaggtattcatgaattgccttgtaacctatggaatttttaatattatcttcatccttctgaataacattttccattagagaaatccaactcatgacttcagaaatggcatggcgggaaggcagtttatccatctggagctgtccaagtcagggagagaaccagtcccaagtgttaaaatggaaaccccaacttctgctaacttaaaaaccctacaataattcttaaaaatgtaccaagagagataacactccttaatgacatttggagatcttaccctttctgaaagcttgaagttaaacatcaggcaaatgttgaggaataatagtcattttatgttcacttgatatccaatactgtaaacactgtataaacattaactaattaatcaaagcaccagaaagaagagaatattattcttattttataactagttttatgagtctaaaaaaacttaaccagaaaacattcaacagatgtattttattaattatcttgtaaaatctctgcatattatgactcaggaatgttaaaagaagaaagaaaaataccacactacaagctatcattttctagagtttttggcactctaatctttattcctaagaacatagccaatttcctcagcccttagctgatatacactacttacaattcgaaatcttacttaacatatcacacatttatgcatatgtgtattacgatgatttggaggaacaaaagcaatcatttaaaatctttgtatatcaacttctgtgtggtgctgaaagatatagcaatgaacgtgggttggttcctgccctctgggggcgcacagctgttgcttaggagagattaggcatgtacacaaaacacagctatcctgcctgaaacacagtgatgagtgtcaaagagagataaagataaaatgttctgggatttcaggggaggtgggtgtattttcagataagaggattatttacatctactgaatgccagttgctctcctatacataagatatttttaacatatattacgttctaaatcttcataaccactcactttatgagaaaagtgtatgtaactgtccacattttatctgagacaaaacagagtttaaacaaagccagacaaacattccaatacacatacccacacccacatacacacattaaagaaaccctcagaggaaatgcctttggggcagggctttgtagcgtagttcactcttttttttttttctggagacagtctcactgtcacccaggctggagtgcagtggcgcgatctcggctcactccatctgcctccccagttcaaacaattctgctgcctcagcctcccgagtagctgggactacaggcgcacaccgccacgccaggctaattttttgtattttagtagagacggggtttcaccgtgttgcccaggctggtcttgaactcctgagctcaggcaatccaccctcctcagcctccctaagtgctaggattacaggtgcgagccaccgcgcccggccagagttcactcttaatattaatacaacgggagagagaagaggccaggtgtctgggacaaagctgatataaatttgtgagcaaaagcaaattaatgtatttctccatgtcaaatagcttaagtcagctatttcccacgaaagcaatcctttctgtacctggtggagcttctcctggacggctgggatattggttagcaggtcagtccactggctatcaatgcgcgacagctcagagcgcagcgtggctgtgtccaccttttttagtcgaaggagctgatttccagtactcagaacagatgatttcagggaagattgggcatccacttctttagaaaactcctgaaacaagtagcgatgttcaaattagggttaaatagctagaccattcattaaaaggaaagcgaccaatttagtgcatgaaacaatttcctttacatcctggagggggttatgctgaacactcaaaagaaaatgaaagcagtacacccttgccctcgaatgaaaggaaactacgaagccccgacttgagaactacttgtaagaggcagtgttgagtcactgagccctattactttgcataattatggaacacacatagtcaacattaatatattctctatagcttagtttattaagtatatccactgatggttgacttcctttcttttcttttctttttttctttttagatggagtcgctcgctctgttgcccaggctggagtgcagtggcacaatctcagctcgctgcaatctctgccttccgggttcaagcgattctcctgcctcagcctcctgagtagctgggattataggcatgcactaccacgcccggctaatatttgtatttttagtagagacagggtttcaccatgttggtcaggctggtcccgaactcctgacctcgtgatctgactgcttggcctcccaaagtgtgggattacaggtgtgagccaccgcacccggcctgacttcttttctactggtgtatgggtcaggcctaacttataggcctgaatcaaatgctttagattcttagacttaccaggaaagcatttagatgatcacggaccatttccagctcttgtgggactgtcacagattgctgagtccaaaattctagccggtcttttgcagattgtaaccagtgaattagatctgcagattcactttgatatctgttaagtatattatggagtccattaagtaaacatttcatccctatcttctactcacctacgttactcaccaatgccaacagttttaaaacgagaggtctgaagatttagaagaaaaatgcatgaggttggcactctgaaattttcttcatattgatacctttatcaagcctgtctctctgggtttccgctggcctgtctttaagctgggtataaaaatacctttcccctactctttcacattgatgctacttagaaaatattagatgatggttacaaaaagtcctttgaaataaaggcggcttagacacagactatgtcattatgtaaaaatcaaccctccaccccgctgaatgcttcccattgcccttgagaagcttctgcttctcaatccatgttttctctttctctccctctcaggctttactgtgatatctcagacacagtgattaggcaagggagggtgaaactcaaaggtaaggtgccttatgcatctgcctccctgctcacttctaattatatgtttatatgagtatacaagaatccaagtggggactttctacttttcttttgtttttgagatggagtttcgctcttgttgcccaggctggagtgcaatggcgcaatcttggctcactgcaacctccccttcccgggttcaagcgattctcctgcctcagcctcctgagcagctgggattacaggcatgcaccaccacgcctggctaattttgtatttttagtagaaatggggtttctccatgttggtcaggctggtctcgaactcctgacctcaggggatctgcccgcctcagcctcccaaagtgttgggattacaggcgtgagccactgcacctggcctctgcttatctttattttccaaactatacaatacgtttctagaggagccatgtcactttcaagtgaatatctacttgccttatttatttatttatttttgagacacagtctcactctattgcccaggctggagtacagtagcatgatcatggctcactgcagcctcaacctcccaggctgaagcaatcctcccacttcagcctctccaatagcagggaccacaggcatgtgccaccatacctagtccttttgtaatttttttgtagagattggggtcttactatgttgcccaggctggtcttgaactcctggcctcaagcagtcctcccgtattggccacccaagtaatgagattataggtttgagccatcatcccccacccgcactagccttattaatacaatgcagcacttatctaaaaatatacaaaacagtcattgtattacctggtccagtgtttcaatattgtttccagtctgtgaagttccttagacattttattggtgttacttagccagcactctccaagttgatttagttggctttctagatctgagcagctgatggatatcagaagtcgtttcccatcatctaatacttgatataatttgggctggtattcattaaggctagattttaaatgctaaaatattgaaattattgagttaaaagtttggatatgcaatttttgtctttaagaattataatttctctggtacctacaatgttcccattacctgttattcaaacttaaactatactcactcaagtaacattgaaaactttaagatgtttcatctatatttaagtatagacagtctccttttgttgtttattattttttttttggtaatgactttaggtggatttaaaactgtcaaattattatttcaagaattgtgtggcatcagcataaactacagaaaatgcttggtggaggctgaattttcaaaaagagctctcagtaaaaaaaagaaaaaagaaagacttttaataatgtccaactataaataacagaaacattatctcctttcaatgtcaataacttgaaagaaaagtaaaagtactaataaaataattgatcacaagtttgtttacattctgttaaaactattggtaagtttctaaaggcaatgtggcggcttgtaacaccaacctggtagagtgttatgcggtcaataagcctgtcctcgttctcctccaccagacccacgcttgggatgctgctttccaccacctccagctgtctgctgagctcctgctggtcctcatccagatgggaccacgtctagaaacacaacatgagtctgtgagctaaaaaaaccctcattagcgaaagacattcttccttgggtgcaaaatacgtgcctgacagtctctccttaaagttatatcagagatgtttgcgttgggccttgctttgggaagcaaaagatggctttaaagcaagtaatcaaatggtgacccttgaaagcattgtgaatgggctctggaatctgccactaagcccctttacaactgtgagtaagctactaaactctgtacctcttttccatacgttacaatggggataataatagctatcttctccatcatgaggattaaatggaataatgtatgcagtgtaccttctattgggtatgcacttttttttttttttttttttttagataggctctcactctgttgcccaggctggagtacagtggcacaatcatggatcactgtagactcgaactcctgggctcaagggatcctcctgcttcatcctcccaagtagctgggaccacaggcgcattccaccacaccaggctaacttaaaaaaaatttttttgtagagatgggggtctcactatgttgtccagcctggtctcaaactcctggtatcaaaagatcctcctgcttcagcctcccaaagtgctgggattacaggcatgagccaccacatctagcccaggtatgtatggttttattctttaccacagtaaggatttaagtcaaaaggatggggatgtttgcctttcatgtaacgagtaaacaaatcaattacatttgcatatgaaacatatctataaatatgaatatatagtttatatattctgttaaagaaaaataccacatcacttattcctaagttcagacttttattttatttaaaactggaaaacactttttaaaagatcagttgaagtcttttccagtaatttacgctgtgggtcagcagtttctcagtgtgagtatgctcacttcactgtgcagttggagtggcaacagggcacagtagtagaaacccatgctttttaaatacacttaccaaatatctattgcctggtattttcaatgcctagggatctgggagtaaataaaacagacacaaacccaggccttctagtgaggagagacaggcaatcaataataaacaataaaccaaaaacaaacaataagttgtatggtataatagagttcttgtgctgtggaagaataaaacagaactgggtaggggtgggagggagtgcccaggtgtgtgcctggtggggctacaatttaaatggtgtcatcaggtaagtttcatggagaaacacacatttcaggtcgtgaagtcagacagatgaaggtgtgatctctgactttgccaccaattaaccacgtgtcttggcaaacagttgctcccagactcattgctgaaacagggattcaaaattctatctcaaagggttatgataaagatgagatggattcatgtaaatgtaagaagtcttgccagggacctgacatgtcaataaagtgtaactattattacagagatttcaaacgttaaaggtagatgtctctccaaaatatagggaattccacatcagggaattccacatctgggatttgggggttagctacctatgaaaatgttggcccagggaaaatcccatttagaaaaaatgcaaatacgacctgcaggcaacccagttaagatcagtaatattgtgggagtgggtggggaagtccacaaaggggagagagattataatctctaaaacttccaagggaaagaggaagaatgagaaagcaggaacagtttagggcaactggtacagttactgaagaaagaaaggggactgttccatcaataatgtcctacatttccacggggttctatagcttgccagtagccaccactgagcactactctgttccaagagcaaccgcatttgggacagaaaaaaatatttctacattttactttcatttttttttttttttgagacagagttttactcccgttgcccaggctggagtgcaatggtgtgaccttggctcactgcaaccactgcctcccggttcaagtgattctcctgcctcagcctcccaagtagctgagattacaggcacccacgacgacgtccggctaattttttgtatttttagtagagacggggtttcaacatgttggtttgtttcatcatgttggccaggctggtctcgaactcctgacctcaagtgatccacccgcctcagcctcccaaagtgctgggatgacaggtgtgagccactgcacctggcctatttctacatttttcatactcttaagtaagctatcagtctgaatatcaaaaccccaaatatcttcatgcatagtctgaagtcagtgtgtatctatcttactttcgacatggcacagcagatagcccaatgtacacagaaaacacagggggaataagcaacacagaaccataggaaaagtgcagtcctgagcccgagagcgcagctagttctgaggttatgtgaggcaaactgcatggatagatacatcttgcattaaaggtctattttgcagcaggaagtttgcagcacagaagatatgacatcaatggtctcacctctagaatgtactccagctccacacccctcttgtgagcccgtttcagtacagcagaagcctgagccatcagctctgtatggaactgggtttccttttggactgcaaagctgattatctttctgaagagtgtttcagtcaagatcatatgagattccaggccctgaaagtattcctgcaatttttcaggaagaaagaagtcagcaactcattcatatattatgttagaatcaaaattggtttagggccgggtgcggtggctcacgcctgtaatcccaacagttggggaggctgaagtgggtggattacctgaggtcaagagctcaagaccagcctggccaatgtggtggaatccgtttctactaaaaatacaaaaatcagccgggcatgctggtgtgtgcctgtaatcctagctactcaggaggctgaggcacaagaatcgcttgaacctgggaggccgaggttgcagtgagccaagatcgtgccactgcactccagcctgggtggagaggagttcacaccaacccagcgctggagctgagtagacagctctgcatttctagaggagagtgaggagtgcgcgaggagtccttgaccaggacaagggagggcagagggagcaactaggaccaggtgtacaaaggggcaaaaaggaaacacagggaaaggtagaggtaagaacgaaggtgggctcctttgaagacaggctctgagtttttctttgccaggacagttggagctctggttggagactccatctcaaaacaaacaaacaaacaaacaaacaaaaaacattgctttccttcctccatggctgggcttgggctctactttctgaacttctaggatatttgcgtgctcattccatgttgtcaagcacagctttatatgcactgattgatattataaatttgctttccttgtattatacctacacataacataactgtaggccttgcgccatcctactaatgtttttgaaatgttaccgtttgtgtataatagaccctggagaatggagattgagcttatctcatttcctgttcccagtaccatgataaaatggaagagctggcaactgataatgacagttaacattaattatgtgcttactgtttgctaggcactccataaatactttatctgactcatctcatcctcctaacaactctataactctatgagataggcagttttgtttccagttttacagatgagaacactgagtccccccagtctatgtagcttgcccaaggtcacatagctagtcacggcagagcttggggttcaaacccaagggcagtgtggctttatctgtgcttctcaccagcactgcagaactctccctcagaaaatgggctggtgagtagaagctagaatcattatttttaaccaacaattaccaaatcagagtcctaaagttggaggagactttgaagttcatctagcccaacatgcaatgaaagctgagattccttttacaagcccatctcccctaaaagccttggctggacttctcatggccagaagggctgtctgctcaatggcagcttactccttttatagttctttttctattgaggtttatttccctgttatttatactcattgatcctagtttcccctctggaataactcagaatgatcttttattgctatggtcaacaacgtgagaaacaccagctgtggactttaaagcaatgttttcaaagccaaatgataaggttttaataaatcatgaagctttggacaaaaacgtctgggaaaaaataggaacgacaatttgaaaaagacaaaaaaaacccacctttacaagccaccagagagctacacaatggtagaagattttaaacttctataacccaatgggatttttttagtttccctacaggaaattcccatagtctagaaggctgggtttctggactggcaaaattgctttcgtaatcattgccaataatgcaagagctgtgtgtgtgtgtgtgtgtgtgtgtgtgtgaaatacgcattcttctaccatggagtagtgtccaacctgagcttggctgtggcacacaatgatggagtgatttcgggcctcccaagtttgattacatagtaaacggccttgctgttcccagggagaaagtctgaagtctacagcaactagaggagcatatgtgtaagggtcagaggatctaaacaatgcatgtaaaagacaccaacccaaccctggatctgagtagtcagctctgcatttctagaggagagcaaggagtgagcgaggagtccttgacgaggacaagggagggcaaagagggtaactgggaccaggtggacaaatgggcaaaaaggaaacacagggaaaagtggagttaagaatgaagatgggctcctttgaagagaggctctgagttttcctttgattttagctcatctagggagaaagcctggctaatactagtgaggaactgataggtaaaattacaggtaagttggttttcttttttaatttacaacattatagaaacatatcccctataatttctctgtgctactgaaagccagtgggtttgaatataaattttttggccatttttaaagaataacttatacaagtaagaactcataaaagactgagaatattaggttttactaaatatatatcagggtttgagagcatgctttccaattacattttctctctatcactcttttttgttatgtaccttatgtttgtcaagtagttgctggatttcctctttggaagacacgatgattttctggtctcctgccatcttctcctgaccagtttctagcaggtcagccagatcttgtagggccctctcatactgactcttgagtgtaaggttctgattcagaccactcctccgggagccaatgatcatcatcagctcatcatacatgtcctaagaagcagagaccacaagactcactctcaattcatattctggcaaccctctaaaagcatatgaactatgaacgcaccaagcccgagacccaaccaagaaaatgccttcagggatgtgcctcctggaaacgctctacctgtaggccatctgcttgtctttctatgagccttactttgaaaacatgtttcacaaagaaatgacctttggacctctattctcatgcctatgatattcgttgtgactttactgtgtcttgatacctggtggttcaagttctttcattaatcttatttggtattcttatcttgctgttttaaattttattttatttctaacggacaataaagcacaacggagaaactgaaaaaaaactgaattcataaaaatgtaagtatgaagtcactgaaaggataaaataaatattcaataaataatgtggaaacaactcaactctttgaagaaaaataaagtcttatctcatgccacatatcaaaatgcaatttagattgattacaaaataaaaatttaataagttaaaatatgaaaggaaataaagatatgtctataaaaaataaggttaatattttaagattttaaaggacatgtaaaagtgtttcctagaaatgatacatgaggtagatttgacaactgttttctcaggatatcaatagtttatgataagatgtggggtaaaactgttgaaaaactgtccatgtggctgagggacatgtcatagaaaatgtaattcccatttttatagtattctcaacattcatataatttcagagcaattgaatataatatccttaacattttcctgctaaataacaatcatatttgggactacccctcaaacaaagagctagagaaataggggagtttaatgtgagcagaaagagtttcaaacttaagaaggcaatatttttgccaaatgtggtggagtatataactatttaaactggaaagacattttaggagatgatgacacaccaaacacaaaatttatttgaggcatacggacctgattaacatatcacattaaggtttagcaggccaaaatggttcaatctggaagagttcaattttaatgcctatttacggcaatgacatttgactcttacacctgatgcttaagtgctgtcggaaaactgtctaaaaaagtacaaagtgggggaggtgggcttatgatattatgaaatgttagataaaggacagatacagttaaaataaaaatgttcttttgtttataaggtctattttattttctcaaagaaagaactcacaaccctgtactggactgaggttaccagttctcaatagttctgcacacagagaaaatctaacatgtgtgtctgtgtgactgtacacagttgtacacaattttttcttgatcgaacataactgcttgcctagttgatgctaaattttgttggtctaatatccaaggatcttcttcctaccccaatatcagattcttgcctaaatgtcagatctagcaaaggaaattaacccaaagcattattctctgttcctgaaggatgataggaagtctgtttagatttcaactaccttctagtttaatttttgttgttgttgttctagaattgaaacaatgtctctattccattcaaacatatatggaggataaactatagtgcttgccttagaaaaaaacactttctacaaagtattactttgattatttgctttttaaaatagtatttgaagacatagtgcaatacgagggtagatatcccttttttaaatttttctaggtaggattaaaagttattctattttctacagtagaaaataatatgctacaactaaactatactgtaatgcttaaccatgagaataataataaagtaactgtcagaaaaacatatgaatcttagcagcatgaaaacaactcatttccttgtactaaacatgttaagcttcagaaaattttctaagagttgcttggtagaaaggttaggacctaagtggcgtgaattttataaagaaagccaagaaaaataaagtgattttttctagacttcaagtttgatgtacccctgcagctgaatactactggctgaaggctgcacctggagcttggagagttcttgcatggacggctgctcgacctgtagcttgtcaccacgcctctttaattcaatgattcctgcatcaaattctttgagtccatcttcagcctgttgtattgcctaagtaagatccatgacattttattaaaactcccatgaacaatttccccacggaagatgtgattattgtatctctttctgtgttcctcctctccatgtaaaacattctcaatatatacaaaaggaatcatttcaataaaacaaatcgaaagccatgttcagagggtatatagaaaacagaagaagtcccctcattagtacagagcagttatcttacagataatgaggcaggagaaagtcagggtagagggctgggagaaggatgtcttgcttaaacaaaaaagggagttttgaaaagcaatagttaaaaaaaagagcatcatttaggacatagttaaaaaaaggtatttgcctgagattttctaagggaccatgttctgctgtccttgaaacgtagctgtgagcatctttggagagagattcagcgaggcaacaaaacatatattacagcatggtcaaagaatctgtgctccttgttgtgaagtggaaaatcaatcagtcaacaagtattcaagtggctgctattgctaagccttgtcttcccagtgtgaggtctgtagaagcagaacaagatctcatcctgtccttcaaggagctgatggtctggttaggaagccagagtaaacagagaaaaataaagcaaggctgaatataagtaagtactatactcgataatgcaactcatccccattagcagagatcagagaagggagataccagaccacaaatcctggagcagcctaagcaggcgtttggaaagagggcaacagaggttgcccctgaaggaggacaaaaacaagactccagatggcagctgaaacacatgtgtccaatgttctctttcctgaaaaccccctacagtcagagtgagtattttgtttgcttgttctctggcatattttttccccataaatctaaaaggacaagggaacagaaaagaaaacaatgccaacaatatgttgggagctagaagtcaaaagaatacatgataattgacttaggaaatctggggaagctgaattctaaaccagtggaggatctccaccacccacttcagagcaacagaaatctctggaactctgggtgaagtaagctggggtgctaagtaaggagggttagtgaagagctgcttaaaggacagttaacccacagatgcccctccttattccatactgtccctttttcttcccgggtaaaagactgaaagtgtgttctctggagaaggtaaaacagacagaggggcactggacacagctgtgagcttgagtgcttgactgaaagcaagggatgaaataactggatgctccctgcatgctgaatgtggggcccctgagtcttctctccctggggcaagaagtgctgcagtcagggctctagtctccagagatgagagggaaaaatatctgaacacaccaataagacaggcctgacaatttgacagaaggattctctaacaaataaatggtccatagagaccatcctgcaggaactcttaaaattatcatgttccatccacacacagagttccctttcagctgtttagtcctccatcctaaacctgaataggcaacaaaagatttcaatatgcctttcgatgacatgaaagatggggactaacagaagcaaacaaataaaagcaagctggaggaaaacagattatacaggaaaagtagaactttaaacaacaaaaaaaaaaccattaatatacccagaaagatataaacgataatgtattcattaaaaaaaataaaaaatactacaaaaaggatcattcggagaaccaaagtgagctccgggaaaattaaatacgtgagagcagaaatgccaattcagtacaagagtctggagttgaaattgaggacgtttctcaaaaagcggagcaaaaagacaaagaaaggtctcttggtaagacagttcaagggttgaacccgagtatctgacaaaaaggagttctccagaaaagaagacaggtaaaatgcaggaaagaaatgtattaaataaatcattagaaaattttccagaacagaaagatgagagctgccaaatcagaagagtcccttgagctcccagcccagtggataaaaatagatcctccccaaggcatgtgattgtgaaatttcaggacactggaaacctttgggaattagaatgtttttagattccttaagacaacactgagagctagaaaacaatgaagaaaaagccttgaaactccaaaagaattcatattcaacaaatgaccctgaaggatcacataaaaacagcaaagcgatcaataaagtgtgaacatggtataagaacattttcagacatacatctggaaaaatacacttatcatgtaccctttctaagaaaggacatgcactaacgaaacaaggaagcaatgcagtaaagagaaagacttgggattcagaagagagaagatccaacataggaagaaatgaagggattctcaggatggtggtgaagggaaatccaagaagacaactgtgcaccaggtttatgaggcaagagaactgctctggattggaacagcacaactcaagagatgactatattgagtgaggtgtgtcttccccatgccctctgctgttattgcctttttaatccaagttgggtaggcatggaattagcacgttcattagttgcattccatttattcaaagaaaaaaatctaactggttatttcttcatctgtgacattcagttatattggtcaaaaattagtaaaaattattacttgtgatcatacatatctcataattcatattagaaatccaaagcaagacatcactacagttgctccagtcttttttggaatcacacatacattataagccaagaaaaaaaacaaaaagatttttcatggggagaaatgagaaatctctttaaaaagcagatgaaattatggtcaagaaaaatgcacagccggatgcggtggctcacaccggtaatcccaacactttgggaggctgagatgggagaactgcttgagcccaggagttcaagaccagaccagcctgggcaacaaagtgagaccctatctccatattaaaatatatattttttattatatatatatatatatatatatacacacacacacacacacacacacacacacatatatttttaaaaataaataaaaagaaaaatgcacactcacagttttgcaaactattttgagaggtgttctttaacacacacacacacacacacacacacacacacacatattatatgtcagattattctctatcgtctatccatagattcccgggaagttcgctgaaattaaatcagagaattctattaaaacacatacttctcacaattacttagcttatgaaacaggagatattctaacatccctcccatttcttctatctgcattttcatgccatcatgccagtttgggttctcattctttctctccagtacagctacatgaagcctcatgatggatctcctgtttcctgaccctggtgctgtcatgtaaactaaccagaagcaagatctagaactgccattcatttttacctgcaaacatcccctacaactttccatggccagggatctcccagctgagtctaaacacccaagagtgtgcaagatgatttaccaggatgaaacaccacatctttcatttatattcaaccacattaattttcaattttggttgtagcatgtacacaaacaaaaattgaaaataaatttggctgaatttaattgtgatttataacataaattgcttataatttataaataaataaaaatacatacacttatgctgcatatttatttccttttttttttagctaatgaggcatgcaacaaataaagtgtacaggtaactagtttatagaataaagtccaaagtcacacattcaacaggccctacaaactgccttaaatttacatatccaatcttgtttgtcctcagtcactttcatttatcttaaattcagctaaaatagaattacctgtgtttttccctaagtgctcagaattctctaacaatttgtgccttttttcttgctgtcctctttaccgtgatatctttctttcctgttgttgtgtgtccaaactcttaggttcagttcaaatttccctctacaaagcttccctaatcctacccctgctggaggccagaagggtctgagtacccataatgctttgtcagtaccactcccaggacagtttgactttctgccctatgtcattgaggttcatatctaatctcatcattgggcagaaaactccttcaggtcagcatctgccatggataccttttcccagctcacatttcctagttctgtgcagatgtaagtaacagagtcaatgtcacctggtatgttattcaaacccagtactcaaaaacaaaaatactacaaacaaaagtgccactgtgagccattaatctttcatagaatattcaaaatttcatagtaagtcatatctcctctatgcattttctcttctaggaaaaggcagctataaatacctctatttgttctgctacgggctgttcaaacacatttgccagtttttgcagaatgatgtatttgttgtcagccagtgatgtaaacagcactttcagatcattctaaggaggaaagcaacgggaaaactcaaaatgtgtaacagggaattcaaaatacttgtaaatataacacagattctaagaaataacatagaggcacagaaatttaatttccaggagaaacaatactgtgctatgggaaggtaaaaggaactggtaacaatttacttatgtgctaaaactgactcctgaagaatctgttacccaaagtattttctacataacacaaatgaagttgaaccatacatgtaaaaagcaacgcttgtcaccctaatctcattacatccgaaataaatgagcacagtcaaacattgcacagaaatattatattagtggctcttatctagggaaataacctataggtgttatcctgatttgggaaataatatgatacttaagaatcatatgatttccattttgctctctcctcttcttccctccctccatcagtttcttcttctatttttggaaaatttgcacaagctttaaaaaagccatccagaagtttagaaaataaatattatccatgatggccaaaaacatgtgaagagacaacacaaaaagatcttgttaggtattttgttcaaaaatattactcatttaaatgtccaaatatatttatattgagttagatttgtataaaaaggagacaactatcagaactttggtacttaattccacagggaataataaattagaagaatatttaaattataaaaaattttggccaggtgcagtggttcatctctgtaataccagaattttgggtgcctgaggcagatcacttgaggccaggagttcaagaccagccggggcaacacagtgcacccggtctctacaaaaagtttaaaaaaaaaataagtggacacagtggcatgcctgtagtcctatctacttgggaggctgaagtggaaggatcccttgagttcaggagtttgaggttgaagtgagctatgatcacgccactacatgccagcctgggtgactttatctcaaaaaaaaaaaattaccaaaaaaatgtatttttttctctaaaatatcaacaaataagttctatttcataatagtcagcaaaaatatatttgtcagaggttaaagctcaactcaggacctctttaccagggcctgatcacgcacatcaccaacatgcaaacattctgactgtctaatgagtggaaggataatcgtaccaaggaagaaaaacatctataagaacatgtgaaggctttataatgtaaattcaggtctaaaaagcaaaataatgggtgcattatgcagtaaaaattataaaattgaaaatatagcgctgaacatgagaactagaatagttgccactaaccaaaactcaaagcaatctgcaagtctagtggctaactaaataggaaattataataacagccctggaaaaatcctagaaacaatagttttacatatgagttactaggtctgtatcattcaactgtgttcagagtaaggtcacgtgggccattaaaaccatcacacatttatctgtttttaaacctagtaaaagatgtcctgcattcacttgaacagaagcctacattatctacatatgtgtgtatagtgacattcgtccagttaatctaaatgagtagctaagtatatataacataacatgggttagaaatgaagagtgcatagatagatttcctgtatgccagttttatgctttgttttgttttgttttgagacagagtcttgctctgtcacccaggctggagtgcggtggcgcgatctcggctcactggaacctcagcctcccaggttgaagcaattctcctgcctcagcctcccaagtagctgggactataggcatgcaccaccacgtctggctaattttttgtatttttagtagagacggggtttcaccatcttgcccaggctggtcgcgaactcctgagctcaggtgatccacctgcctcagcctcccaaagtgctgggattacaggcgtgagccaccgcacccggcccatttttatgcttttaatagcatattttctctcttaactatgttctactcaaggtggtaggaaacacagagttcatatttctggaagtcagactgattattgggagagactagtcaagaagatagtaaagcaaagaatatgattgattttaaaattactaaataaaaactttaagaggtgctagtaatcacatggatattgacattttcttaaaaataaaaatgcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacctgggaggcggagcttgcagtgagccgagatcccgccactgcactccagcctgggtgacagagcgagactccgtctcaaaaaaaataaaaataaataaaaataaaaatgcaaagaattgaactatttttgtattattacacttgcgatacaacaggataattaaggtatccatatattacaaacataaaatacatcactttttttttcttaatagtcactggaattattggcagggcaaaaaggagcaggattctagccattgagaaacagatttgcagaaagtttcaagctttaaaaccagttgtgtccgggcacagtggttcatgcctgtattcccaggactttgggaggtggaggcaggcagatgacctgaggtcgggagttcgagaccagcttggccaacatacagtgaaagcccatctctacttaaaaatacaaaaattagctgggcatggcgtgcatgcctgtagttctagctacttgggaagctgaggcagaagaattgtttgaacacgggaggcagaggttgcagtgagctgagatctccccattgcactccagcctgggcaacaagagcaaaactctgtctcaataaataaattaaataaataaataaataaataataaaataaataaaatcagttgtgctgcctcactcattcattaaagaattctttcattcattttccaattttcaaaataatttacaatacacaattatatgtttggggaatttgaggttacgtccatgggtaaaatttttgaaatacaaaatagttcataattgactttattgtgattctatatatgtaatgtacatctacataacatctatgcatccttccaaatagtctttttggtatagaataatgttagcagtctggcaaaagctaatcctgaaagattaaatgcagaatgaaggcatacccttccagtaactgctgaggactgacagcataccaaggtgtttggtgcaaagttaaaacaaaaaggaaaatagtttgtgacttgacctttaattatgttaacattggaaagtttctctcaactaaattggaacacaaatattttgaaatgtctttttgttcgtgagctggccaccaacaaatagaaacttgttggcagaagaaaaatagagaacgtgatttaaagagaattccatgattctcttagatccttaaaacaaagtaagttccagagcattcatgcctaattcatattttactgtgactggtgataattaccaataaagtttaaaagtatgaaagtactaaagatactaaatgcaattcacaaaagatatggggaatgagagcaaaagggactgctgaggcactcggggattctgacttgatcatcttgggggcagtaactatcagggaagactgctagatagcagtgccactgactcagggacaagactgagttgctggtggtaccatcaactggcaaaggatattggataaaatttaagagactctaatgaaggcccacattctccatcttccctgagatcaccctaatatgataaaatacaaaaatatatatattctttgagtaaaatcctggctctagttcttaatggttgagtaacactgaagtaatttaatctttctcttggttttagatcctgtatctcttataatactactactaataacaataacaacacttgctgagtgtttactatgtatcaggcactgttcagagtattttaaacacatctcaactcatttcatcctcaccacagtctatgaggcagttaatatgagtatgagtttgatttgacagttgaggataccaaggttcatggaagtcaagccgcaaagttatacagcagtaagtgacaaagccggaatttgaacccagactgttagctttggagactacatgtttaatttttactgttctgactttgcaaaattattatcagaacaacgtctgcaggatgtcgcaaagattaaagacaatgaatatgagaaaatattttgtgaataaaaaaatgaaactcaaatgtttgtgatggttttactctgtggttttaagaatgtagactaccagaaggcagtggtaatttgtgcctcgtgaaaattccatgtttcttggctaatgctacatttatgtgtagtggtttggttttttttttttttttttttttttttttttttttttttttttgcaaatcaaaactccacatgaaactcttggccctaatgacatgtctctattttataaaatctttcatgttggttaaaaataacattcaattaaaacttatgtattctcaaagagtgctttttattaggaatgaaaaatcagcactaaaagtttatcagcagcttttgcatttgttccggtatatattcataggaaaagtttcctaagcacacaataagaattataatatggggctaaaaggcagtaagtctgaggagttaggactggaaagtaacgtaacacattttaacacaggtagaagtaattagaccacagccactttcaaagactcttaggtactacagtctatggccctttctatattccaacactttctgcatactctttttttttttttttttttttttttgagacggagtcttgctctgtcacctaggctggagtgcagtggtgcaatctcagttcactgctacctctgcgtcccgggttcaagcgatcctcctgcctcagcctccaagtagctgggattacaggcctgcaccaccacaccctgctaatttttgtatttttagtagagatgggttgcattatgttggccaagctggtctcaaactcctgacctcaaatgatttgcctgccgtggcctcccaaagtgctgggatcacaggcgtgagccactgtgcccggccattttctgcatattctttcgcaatgtgtttaaactccggtattagtaactaaaaattataattataatgatccataaatttgacttttattgattgaattctattcagtccttagtttgaagtgggtggttttctcaaccttccatttctaggagcaaaaaatctttagcttctaatcctttaattcaacccccttcattttctacaatgctcttgttcttcattacgcatttagaaaaacaacaaccaggtctgtaacacagactcgtgactgactattactgaatacctagagaatggtcacgtatcctttgataatatcttacttacctggaaatttagtatttgctgaagtctttctttcatctgatgacatcgttgattcactactgagtctagcaaggataacctgcccaaaagacaacccaaagtatcttcaataacatctcgattatcaccattctctggaaaagcttgggaaaacaagtttttgttcttatccatttcttcagacatttccttaatgtctttggcaagaatctagaggtgataaaagggcatttttcagtgtttagatacatgaattgatatgcaaatcatgttattttctcatagaaagtcaactagatctctctggctgcttagtaataatcagacctaagacaactggaacctctttcaaatacttctatacatttcaggaagttgctctcagagactttacctcattcactagtaataatgagcaatgtaaagtgctatttaggaatttggtactttttttaagcatgtgtttcgtatttggaagatttgtgatacataacagtgtttctacaaagagtttcccatttttccctcatacttacacaagacaaagaatgaaaatgcgaactataaatattctgcatttaagcaattatgttctgcattattagaattgttttatgtttgactttctttatgcataaaattaattatcccatcaaaatgtcaagtgctttgtaatgttatacacacacaggcaggaactactaaacctacctcttggttgaagagacaagtctctgtttcttctggtaaaagtgctgtggcaacaaataaacgttcttcaacgtcatccaaccaagtagaggtggctgagactccatcatacaacttctgctccaagtgtatactctgcctctttgcccctccactctgggaaacacaaaacagggtcaaataatcaatttcagtgttttgaaaatccaggaaaaatatcaggatggggccggtgcagtgctcacacctgtaatctgagcactttggtagcccaaagcagacagatcacttgaggtcaggagttcaagactggcctggccaatagggcaaaaccccatctgtactaaaaaatacaaaaatttgccagtcgtggtggcatgtgcctgtagtcccagcttcttaggaggctgaagcatgagaattacttgaacccaggaggtggaggctgcagtgagctgagatcgtgccactgcactctagcctgggtgacagtgcaagactctgaaaaaaataaaataaaataaaataaaaaacaggaaacaggatggggccaggcgcggtggctcgcgcctgtaatcccagcactttgggaggctgaggcgggcggatcacgaggtcaggagatcgagaccatcctggctaacatggtgaaaccccgtcttcactaaaaataaaaaaaataaaaaaaaatcagccaggtgtggtggcacacgcctgtagtcccagctattcgggagggtgagacaggagaatcccttgaacccaggaggcggaggttgcaatgagccgagattgcaccactgcactccagcttgggtgacagagtgagactcggtctaaaaaataaataaataaataaataaataaataaataaataggatgggactccagggtccagtgatctttgtttcagcgcttatcactagtgttgggtctcatgctcaggggtggatgcaacagtctcacagaggccaggcaaatcaatacaagcaaaacaagactcttataaaccaagccaaacacactgataacacagccttacctgggatgaaacctcctcgaaggcttggttcagtccatccagcaaagatgtaactgcagatttatcttgggttggcacgtcccctttgtacagtggcacaccagacaagagtcgatttggcctgctataaagctgtaggcaaacaaaggcagcttgttgaagagcatatgcattatgtcccagtattctcatttggaaatgcatactgaaatagatgctgaaaacactgtccatatgaaaatttcttctagagaaatataacttctacaacataccatgtccactgaacacagtggccagatgcatcaatggcaatgtttccatggatggattttttttttttaagcagtggaaaaaaatgtctgacagataggaggaataagttctggtgttctattacacaggaggtcaaacacagttaactataacatattgtatatctcaatagctagaagagaggattctgaatgtctctaccgcaaagaagtgataaatgtttgagatgatgagtctgctaattaccctgacttgaacattacacactgtatacatgtatccaaacatcacactatacaccagaaatatgtacaaatattatatacaaataaaataaagcaggccacccacgatggctcatgcctgtaatcacagcactctgggaggctgaggtgggcagatcatttgaggccaggagttcaagaccggcctggccaacatggtgaaaccccgtctctactaaaaatacaaaaaatagccaggtatggtggcatacgcctataatcccagcaattcaggtgactgaggcacgagaattgcttgaaccagaggcagaaattgcagtgagctgagatcacaccactgcactccagcgtgggcaaaagagcaagaccctgtttcaaaacacacaaaagatgacattataaaaaaagaaaattaaattaaaaggtggcttgcaaattttatgaaataaatgacattaagacataaataaattagaaacagaaaggatgagaacagacattgctgaaaatggaatcactggcatagagaaaactcttgcaataatcagatgaaaagtaaatccaaattttaaaaaaacaaagatcagtacaactaaaaataagtcaataggtatagaaaaaagatgatctaacacaaggataattgatgtccctgaagcagagatataataaatatagcataaaatacatctaaatcatgccaaaaaattccctaaaattaataaaaaagcaaaccttgattcttaaatataaaaaaagtacattgtgttacaggaaaaatatgatagcagaacactcaacatcaaacatagcctagataagctgttgaaacttaaagaaaactaaataattcttctggcatccatacagagaacaatgacaaaaaataaataaggggaaaaatagtagactgatgttagatttttctaaagcgtcattcaatgccagaagagaaaaatagatataaatacaaattctgaagggataaaagtatgacagaaaactgtccatccaatatagaggcaactagctgatattcccaaacatgatagaacctgagttttcttgaaaaaagttatttgacaatgaaattaatacctgagagctggatcaaaattaaaaatttaggaattaaaaagatatgctgaaaggattggttatgagcactgaggaatttaaagattaaattgatttacagaatatgggaattgttacaattgttccttttcattttcatctttgcacttggctgcattatgcgaattattataatgcatatatgtagtttttcaaaataatagagtaatttttcttaaaattgactaaataaagttattagcaatcataaagaaatcttatcacagctttcctctcaacttttcttcttggttttagtagtacctatagtgaaataatccatcctaaatacaagactcctagactgatctctttgctttcattattaaccccatttcccctaaactcttttaggtatacatatggctccccaataagggcaatgatatggtgtagcattcaaacttttgaccatgttttcaatcaaactcagtctcctttttctttttttcttcttctttttttttttttgagatggagtcttgctccatcgcccaggctggagtgtagtggtgcgatcttggcacactgcaacctctgcctcccgggttcaagtgattctcctgtctcagccgcctgaatagcttggattacaggtgtgcaccaccacatgaagctaatttttgtatttttagtagagacaggatttccccatgttggccaggctggtcttgaactcctgacctcatgtgatccgcccgcctcagcctcccaaagtgttgggattacaggtgtgagccactgcacccagccatcagtctcttttgacttttcaaaatacctcctcacctttcaggctgactactcatgatcctgtaaatatgccaagcccattccccattgcagctgggatatcctccacccagcatccccttaaaatctactactttaatttccataccgatcatagcaacttttgactattttttcttaacctttgtttcctttgaattcctgcttatggatcctgtcatagttgcctaattttttttttagaaatgtatgcactatttccttattcgggttataggttctcagaagcaggagctgtatttcaccctgaagccaagtaggttgttgtgcatggaagcattaaatacattggaagtaaacagattaagaaaaattgctctaagaggttagtgccctttgacctagtgaactttaggccaaaatgtgcctgtttttacatatgaaactagtaagtatttctaggatacaaaattgccattaaggtagtatgaaagaggagggacttaggtaacagagatatcggcttcctgattccagattcacctcttcttagtcgcaagaccctctctaagcctcagtttccaggtctacaaagtagagataatattgacctcaccacaacgttgttagcgatgttaacacctagaacttaaaatgtgctcattatatgatcactcctttctgcctggaaactgacagctaaattgcttcttccctctcttttccttcaccttttcacaccacagagaggaaaacaacctatgaggcactttgtacaaatgaccagcgattgctgaaacaaagcactcaaatgcaaaaatgtcattaaaaaaagaacattcaatgcttttatttctaatccaaaggcaagggaggcacaacatgaacctaaatttgaacagtccaggtattgtggaatgtcagtggcagcagggcaaggtttgttcagtaagcacagcatggaggacgctggagtgtcggctccaactgagagcaaaagcagctcttgaagatgaaagcgggtaatggatgagacctccaggaggtctgcagatgccggacgaatcacacaggtgctttatgaatggagaataatacgcaagcacagaatctagaaatatcgtagatttctctaacttaagatagtcagaaaagactgcagtccctgattcagaactgtacatacctctcctattcaaaggattggagggatactagaatatgaagggagagctagcagtcaagtccagaagatccgtatcaggaacaaggaatttgagctatgagtctggaggacattttatcagggatttgaggaaggatgaattaaaatacagggaggaggtccacgcaaaaagtatagggcaccatttgccagggtggatacgattctgggacacctgcttccaggaatacagtgctttaagtttcccagggcagagctggtggctatttctgcagacagaggtaaagaagcctcctggccagagagggaaagtgagggggcagaaaattcacaaaagcatgtgcttttataaaaacagaatagaaagcgtggctctggagagacgtatgtgtggctatccacagatgacaggacaccttatgaccttcagaccagcgatccccaacctttttggcaccaggggttggtttctcgggggtgggagagacggttttagaatgaaactgttccacctcagatcatcaggcattaaattcataatagaagcatgcaacctagatcactcacaagcatagttcacaatagggttcacattcctatgagcatctagtgctgctactgttctaaccaggaagcagagctcaggcagtaatgctcacctgcctgccgctcacctcttgctgtgaggtccagttcctaacaggccacggacccatacctgtctgcagcctgggggttgggaagccctgctttagaccatctccttccatttaactctggcaggttgcgcctgctttctaatgcctactttctcagctccagcgtttccctcctccaattcactacagttattgacaccctttgcttctggtttagcctctcccagcccctaagctagttctggccagagcagagaaacagcagcttccgcagagcaacaggaaaggttttagaattcactccgataatactgctgacttggaatgagcctagatggacgctgctagcccaggacaaaggactagtcttgtatctgaagaattcctctgggccacagctgtggtaggcatcccaggctggcttgtgttcctgactccctcatttgccctctaactttctaagtcctctgacttccagttgttccctggcttctgcttagagtgaagtaatagccattatctggaaccatctgttgctgtcttcaattcccttggatttggcatgcctggtggaaccaagcccgacagcacacagtatccctcccaggaaccagccttgcagatgggtccataactattccagctgaccactggcttcacttccctgccctagacccaccaacgtcccaatatgtttctcattaagatctcctgaaattattaaatactggaagtggcaatggaaaataagatggcctcacaattgagttccagatttgtggaaatccttctgtcctagatgtgcatatccttgatttccatccttactttttcaagtttgcaaaacacacacaaaaagagggcacttaaaatgtaatggtttaggctaataaggaatcagatattaatcatctctgaggaaaaatattgtctataaatcaaataaattttcacatataaatatataattatgaagggaaatgtgaaatagacttgttaagaaaaatgtagagtgaaaaattggtgtcatgtcttagtttgaaattgatcatgaaaattaagttgattgcacagttataatccctcagcataaactctacatcttttatattagttaatatataatgtaaaatatttgataccacttgctcttgttcctgttccagaacattctgtagtagtttctgcttggtactaaattcttgatgtaggctttcccatttcattctcatctggtcttcagcggatgatttctccccttccatccccaactcctgggataacacatcaggtttttcgctattagaagaataaataatctaagtttacaatgtgcacaaaaaagtgataagacaggtaacttattgtgtgtaccagacctggcttctcaaatgaaataagattaccttagttattagcttacactttaaaaataacaaaaatgtttaggccaatcataaagcaactatattcctactcattgataaactgaaccatgtgcagaagggatacttaaaaatgcattgaataaaaataattgtaacatttggaataaaaaattatagcacgattacagactagtatcctttggcaaatagcagaaaagttagttcaaaaccttaaaaatgtgttagtctagggagagttacgattatgagtccagagaaaacacaggacacaggagggcggtgcaggacacaggagggtacaacaggacacagagaaatagtacagggcctggaaaggtagtacaggacagaggaaggatcgtacaggacctgggaaggtagtacagggcatggagggatagtacaggacctgggaaggtagtacaggacacgggaatgatcatacaggaactgcgaaggtagtacagggcatggaggtatagtaacagggcctgggaaggaagtataggacatggagagataggacaggacctgagaaggtagtagaggaccctgaggaggaataatacaggacctgggaacgtagtacagggcacggagggatagtacagggcctgggaaggtagcacaggacacggggagatagtacagggcctgggaaggtgatacaggacatggaggggtaatacagggtctgggaaggtagtacaggacacggaaagatagtacagggcctgggaaggtagtacaggacatggagagatagtacgggacctgggaaggtagtataggacacggaaagatagtacagggcctgggaaggtagtacaggacacaggaatgatcgtacaggatgtgggaaggtagtatagggcatggaggaatagtacagggcgtgggaaggtagtgcaggacataggaaggatcgtatagagcctgggaaggtagtacaggacacagagagacagtacagcacctaggaaggtagtacaggacacggagggatagtgcagagagatatgggaggaaggccctgcagtgtcatccttaaaggtaggcagcaatgtgacatctgagattggtatggctcttatttatttatttatttttgagacagggtttcactctgtcacccaagctggtgtggactcgtgtgatcacagctcactgtacactcaaactgctgggctcatgcaatcctcccacctcagcctcccaagtagcctcccaagtctggtatgcaccaccagacttggctaatttttttttttttaattctttgtagagacagggtctcactatgtttcccaggctggtctggaactcctgaactcagatgatcctcctgcctcagcctcccaaatttgtggatttcaggagtgagccaccatggctagccaagtttaacttttagagtgagacagacctggattatgaccctccctctagcacattatctgtgacactggggtaatttgtttcacttctctgtgcctcaatcttctcatctttaaaatgaagatagtatctaccttgcatgattatgagaatgaaagagaatacatgcataaggcctataaccctatctgggaaataatggccactcaataaatgggggttaataatgacgaaaatgggctgggtgtggtggctcatgcccagcactttgggaggccaaggcaggtggatcacctgagatcaggagttcaagaccagcctgggcaacatgatgaaacctcatttctactaaaaatacaaaaattagccaggcatggtggcgcacacctgttgtcccagctactcgggaggctgaggcaggagaatcacttgaacccaggaagcagatgttgtggtgagctgagattgcaccactgtactcttcttggtgacagagcaagactccatctcaaaaaaaaaaaaaaaaaaaaaaaaaagatgaaaacaggaacaacctagggtggctgaatttccacggatcttcattcttcaggacctttgaagtcctaactaaaaccgtgtcatctaaaaggaatactagatattaattaatattttgatgcagggcgttttgctcaagtgaaaaaaaaagaataacaagtgtgttggcaggataatactctgtggtaccccaaagccaattattcttagaataaatgtaaacacaacagtgtctttagataagtctctagaaataagacttaaaatttctgtaaactggccaggcacagtggctcacacctgtaatcccaacactttgggaatctgaggcaagaggatcacttgagcccaggagtttgagcccagcctggacaacatagccagaccctgtctctacaaaaaaaaattcaaaaattagccaggcatggtggtacatgccggtagtcccagctactttggaggctaaggcaagaaaatcatttgagcctgggagttcaaggctgcagtaagctataatcacaccactgcactccagcctgggtgacagagtgagaccctgtctcaagaaaaataaaactcttaaaatgtgtgatgcagggattccactcctaggatataatgcagagaatctttcccatctgagagacatgtaggaagttaatttaaacaatgctaaaagcagcaatcttagggctgggcgtggtggctcacacctgtaaacacagcattttgggaggccaaggtgggtggatcacttaggtccggagttcaagaccagcctggccaacatggtgaaaccccatctctactgaaaacacaattagccaagcatagtggtgggcacctgtaatcccagctactcgagaggctaaggcaggagaatcacttgtacccgggaggcagaggttgcagtgagctgagatcgcatcactgcactccagcctgggcaacgcagcaagactctgtctcagaaaaaaaaaaaaaaaaaaagcaatagtaacaataataataatggcaatggcaatagtgcaaatatccagcaataagaaaatgggtgaataaattatgttcacaaaataaaatactattaaacagttaaaatgaagaactagatctatatctcaacatgcatatatctcaaaaaataatggcgagtgaaaaaaatgccaaaacataattgataccttcagttgagtgtctataatattagtatctgaatttttctattttctaaaaattatttttaaaaagctttgaagttcctatgaggttaaatttctttattgcttttttcttttgtggtaatagcctatagtatagcacttttaattcatttgtatttacataaaaatttgtaataaaaccagaggaatatttaatatttatagtcttacatttaatcattgacacacgtacaacaccagtagcaaaccttttaaaacatagccttttgttccccatgaaaattattcttctttccttttatattgacatcaacaaatttccagttgtttttccttagtaatcttggaaggcaccctccatcaaccctcgacaagtaacatagtacttattccttacacggcaaatgtgtgactctataaagtaggtcatgcccttcccacagaggtttcctcacacaaaccaagtcacatttatagtcttagaaaagcagctggcaagttaagggctgaatatcaggctttttcctagcaaggtttatatatatatacatatatatttactttggaatgtagatatcattaattcatggttaattgtttgcctggtacccaaaggcttgaaaacaggctgagctgttatcaactgcatataaaggtgaagtttcttaaaaatttgtgtaaaagttaaagaatttataagtagtctttaaagtggatcttatatagaaagccagtactgcactgcaaatttatttttaaaatattttttatatttgaaagagtaacttacagttgtttgtatttcatttaggtcctttccaaagctaaaggccaaggaaagaaaaaaatatatatggtaataaagttgcagaagatcccttctgctcctttagtgatgatacatacagagaggaagcaatgctggatgggttctttgtcaaaatatttgtttggcaaaaatattcagaaaactatgcaagataagtaaacattttagaggacctggaatgtaacgtgaaggcaagtcttggctcaatcaacatgaaagaaacagtctcacttcgggtttattacagacacatattcatggtctaatcagcatctttaagcatgatacacaacagacagtttttaaactcctttatatttttaaggcaatttttacagttttagggttatttaaagtcagtccctgcttatagatgccataatactattcattcctattcttttacattgatatttattagccatgtcaaaactttcacagatttttgttttgttttccttttcttgaatgccttcctatttcctacattttttgtcacaatatatctgctgcaattgcattttagtttgtttattctcctatcacttgccctcagaattcgtatatatgtatatatgtgtgtgtatatgtaacagactgtacgtagtcagcattgacgtcatatgtcagcactgattaaactgcaaaaaaaaagtttaattcctatgtcgtccatctctaaaatgttttttttattattgacggtctattctagttcttatctacacacatactctactttcaactttatatcacatttttacttagcatcatacatttattttttgatacggttacatcacttttggttaagattatatatgtataaaattttcttcaacttttttatagtagtgagcatttatgtctttttaattatttggtattacaaataatatttccaaaaccaccttcataatacatatttcctcctttatgttacttcccctaaaaaatgactattcagaaatgggaaatggagtcaaagttatttgccaaaggatactaccaaattacaacttttagtaatacataaacacagaggttgcatgaaaacttttttttttatgttttagatttcaaagaaagttttcctgtatatcctctcagttgacattcataattatcacaaaacttctgtgatgaccttagtggattattattctaaattctacagaggaggctcacagtcgagtgacttttccaaagtgaccttcgtggaactagaataaaactcagacctgcctcaaaatatagtggtgcttccacactgctgcaattcctctatgaccttttaaataaaagtcttcaacttgaaaattctccaacttccttaatttttcttgactcttctgtgtagaagactttgaaagtcttcactccagaccaagatttcaaaatatttaacgggcccctgcatttattttttagaatgttgttagggcaagataagctcttacagagagaatgctctccagtgagatacaatcattcagttagaaacatcatgcatctcatttataatgcatttcttattcgattaaaaagatgaactcatgagcatctttggacagataggctgcgcaggctggaaggagggcaaacaagtaagcttactacaggcgctatgctcaggcaatgcaacagaatgttcaaaatgcaggtacatttactaccctaaagtaaaaataagatgactaaattttgcagaagatgtttaaaataaaattttgagtgagatgtttacttttcttcaaatgtcagggaaacacaatgaagagaaaatggaagcattttgaaacatacccagcatcaccagaggtctctgccgccgaatgttgaattagaatctcctctccacgactggctactgagcgaaggagactcttctgctcggctaattcctgttctaactcctgctcaagggaaaggacaaacgcaaacacatttgctactttatgattattgcctacaatcatagttctagctataaaattctcagagaacttcggtagtgagcttttaagtttgcatattgcataaagcatgaggtttatgtaaatattcaaatgtgtctccaaagtactctgtagtgttcttttgctttgatacaggatacctctgaaaaatctgggggttaaaaaaaaaaaaaaaaccaccaatgggaaaagaaaattttgccgggcaatagtgccctcaagtggtacaaaatgtactctcatttttcaaaatcaatattgtcatgctaaaaggatagatccttgggaaaagtggctttttaagttctccacttaattgataaattaggttatcaatagatttggctttaattcttcattatttataataaatcctcttgttatttgagaaaataaaatatttgaatatgctttttacatacagttaaggtaccaatgagaaatcattcttattcatcaaagttcatttgtttcactaggcaacaattagcaatcctattttgtaacgacatctacttgaaagtaaaaatacaaactgcattcattaaaaaaaataacaaacatgcaacttacactttcaccaaacctcaaaaggctttcctgagatttatattaaaattaaatagattcagagggcaaatctgaaaacagaataggtatctctggtaaagaagatgagagccatgttacactatttgtaaacctaaacacaagcttttcttaaagactggattttcaaatgaccaatcatcccagtggtcatgagtcaatacactgaaacaccaacatcttgcttcattcaaagagaagataaagagacactctgtctttagtacagaagcaacttgtctgtccttctgaaatatgcctctcaggttcttctctgggcagatctgcaagctagagagaggtaggaaacactttactttttgttgctggagactgctctgccgctgctgggtccatgtggtgcgagcttgggccagccattcctggacgccggggctctgcgtggctgttaggtcaacatcgctctcctccttctcctgtgctgttccctgcttttaacgaggcagaaatcaagtcatgctacacaccggaaaaccttaaccaaaggggagagaaggctactttggtgtgatctatgtaatgataccaaagtggctccactgggatgtgaaaccacattttttaaaaaaaacagtaacacaaaacccatctaagttatggcatttgcaggagcaagaacaacatacagataatcacacatagaactgtttgaggggaaaacccatatatttagaggttagtcttttagctgaccaatgtggtcatcagatattccagattttttttccacaaaaacataactcaagatcctttgatgagtttgttttttaagtcacacaaaggtaaactgtttctcaaatgatcattacccacaataattgtgtctctcccgtgaaagcattaccctgccttatgtcactttctctaatccaggtccagacaatgaaagatttttagaataatcttcctaaaaatttttctaaaagattattaatcaaagacattttaatgtctttgagaagcaaaaagttcactgttctgtaaggcatcatactctctggaattcagtaagaacttaaatttgattctcagttcatatgggagaaaatgtactgcagcatagaggcaaggagtctaaacaagggtttcccaggccggctggacatcctctgttccacctttcacagaccaggtcttgacctctatgtcacagagcctcacctccaccacagtaactcaagtcccaagacactgaactaggcaggaagcctcatccctgatactggtctgtgtaaaccttctgtgtctaccctactagggcgatagatttaaattattcctagaattctctatctttgagagtctgctgtttatataataatatttatagactgacctacataattaatagactgtactcaaagatgaaaactctttaagagtctttctttcagaaccatcaattagcacattaaaaaaagtcatttactgtgggcacgtgtggttaccattttacaaattcaaagcttaattgagccttgagaggtcagtggtgtgattattaaaggtgagatctctgaaaaagtacccttcactccctccatcaccatcaccagaaactggcccattgctaagctggcttggagaaagtctgactaaaggagaaagaccaaagtaatgactcagcacctaggcaagagttgatccttcctgcctgattattctaatggaatttgaaaggccctaaaatgttgcacatcaaatgggattagttctgaatgagagcttttctactcacatagattcatctgtcaaaggataaattataatttcaatataactcattcactacttaataagcactcactagacactgttctagaagctgggagtgttttggaagccagatgagggccctggtggggagttagactataaacaaacagataactgagctgaagataaggcctacagagactgataatgggatagaaagttttagggaggcctaaggaagcatctttagaagagacaattgcactctgcatgacgagagaccaccagccttgcaaagatctagagtgagggcattcagacccagggaacagttggcacaaagaccctaaggtgaaagaaatttgccatttcagagagaacagagcagtgaagaggacagcagggctggcgtaccatggggcagaggaaggatattttacaggttgcttccacggaggagcctcctgccatctatttctggagctgctgctcgcctgcccctggttgttctttgcaatgtctgagcacaacatgggacccagccattccagctcatccaacctaactgcccacagagacccttctctcgctctcctattttcagagttttatactcaccattttagggaaatagatgggatctgtttacctttctgtttcttctttttttcattagaatctcatgattaaattgtctaatagactttatctttatctttgcaaggcggtgtcggtgcttgaagctaaatgaacagtaaaaacctgtaggtaatagtatataaaactttctcccagattctgagcccacccgagctcagaggtacttcctttcctttcagatgatccagccagagattgcagtttaggtagaacaacgggggtgcaatggtctaatatatgctagttgcattttgcaagaccttcagaatgggtgactagtgacactaaattctccaccttctgcggaatttctcaaagataagcagtgattttcctagagatgggaagtttgggtggatgggcattctcccagaactggaacccatgattttctgcatgaaaacagattctctctcatctaagactccaccaccttctaagaataagctctaaaagatcctggttcttccaagcaaagttgaaacagcagttcaaaaggaacccatagaaaatggcctcaagaaatcagtggacgagactgaaagttgtccccatcagagctgctccagctgccaaagtagtggccctggccatgacctgctgacttgcttttgtgggatccaggccacttcctctctgcttttctcttcagcaaaaatttgtttttcagagcccggcctgaagactcccttggaaaattctccgagccctgagcccaacacgctcttctacaccagttactatggtctgattgagagaggttggctcaagttccttacaccaaatttggatttggaacactgacaatcgaaatgttaggtcttaacaacttcctcacttttatatgcacagatatatattcagattctatgcggttagactcagtttttcagtgagtgaatttttctctgaatgatttagtcattgtgaaacataagacttggaccacaggaagcaaaccatgattaagaatccagttcaaatttcattctctttcccctggggataagaaggtgcagccagaaggaatgtaattatggtaattactttctctgaggtgtgataacagttttctgccatgcctagggaatgcagaggttaggcggtttctgtcaccagtccccactgggtggggctacataaactttattttggaaatactagaacagtaaccacttttgccaggaacattccttggaagatgaatgaggactgggcagtgctaaacattacataaaacatttctttataaagctttttattattttatggggcaatctctctgttcttttaatgaatgataatgtgtgaaaaagacccagcttcatgaagataccacgtaattcaggagatcttactacatgcccttaagatcttcacatagagaagcagtctatttgataggaaacaaaaaagcatagtcattcactgatacccatgcaagtcaaattagttaaaaggaatggaggtaagaggtattaccatctcccagcttcagtagcactaagtaatggtgtgcttacagacttaggaaggtattccaaccctcctgaatcatccaagccccaattaaagagcattaacattgctgagggctgcatttaatggatgatttgttttctgcaattaactttagttaatttcagattaactccaaattatttttagttttctacataaagggacatgatccttttcatggcaataataatgtaaacagggctccttttcttcccacagatggaaaaacaatcttccaggaagctctaattattttaaaagatctagtaatattttatatgctgggaacttcattagatgaaagatgatggaatttatagatagtttaaaaataaacagtaaccaatttccatgtagtaaaacactaccacatttttctgtatttacacttcacccaatgtgggcagggtcaggacttgactcagtttaaagaattcccgtggacctgggcaggatctgctgggtgtggacaccacagtggtgtgtacatgctcagtccagcccgctaagtctcaagcctggcctttcagcatagcagaagcttcttcgtctcaaagaatgtgatttggaaacagttggttattgttattaattattttaactgctgcaatttgagcatttattgtattacttgcatttaaatcctcactgttttttttctttttgattattttttccacatgttctaaagaatttttttaagttaaatattattatccatattttacagatgagaaaactgatccgtaagaaagttgtggaaaatttaaggctcttgccccaggtcacctcgttaataatgaatgggaaaaagataaacagatttcaatcctggcttgtggatatgctttctttggcacacaaattattttaaaattttagatttaaatgtcaacgtttaaaagttgggaggctttagaaataaatccacattccctatctcttgaaaaactagaagatccagcaatgccacttgtaaattcttgtgtgataatagctagagcttagtaacagctgcttcttagacaggagaccagcttgccaagggccaggctgggcctgctcccctcattggttttgcccttcccaggccacgagaccttggaatttgtggttcctgccttgtttaatccctcttgtgcttgtgagtgaggatcaggccgccccttcccttactacctgcctctagcggtagggtggggcaagggagtaataagagctttataaatgattgctatcctacctaggaaactttcaaggctttccctttattttagcttctttagaaattaagttcattcagagatcaccactgaaaatagaagaaagcattatatattagacctataatagctgtttacaaaactaggtgaattgctgtctacttttacagctagaaaatcattctacttctgttcagttttagtatgtgtaaccttttcttttgactttaattacaaagtcacattgcatgtgcattttcaagtgtgtaaatccaagtgaaaagttatattttttatttgcatctatttacccaacacagagttcaaacgtcttttcatatgttcattgtccatttatatttcttttcctgtgaattatctcttcatatcttttgtccatattctattatttgatctttccttattgttttacaaaagatttgtgaattgcatagtttcttccctgtttgtctatgtcttttgttttattttgtgttactcattcctccctgtctatgtctttcaatttggttacttttttgggggtggggaaggggggtcatacagaacttttttatttttgtgtagtagtttcatttttatttgtttatttatttatttacttattcatttttgagatggagtttcactcctgttgcccaggctggagtgcaatggcgtgatctcggctcactgcaacctctgcctcctcggttcaagtgattctcctgcctcagcctcctgagtagctgggattacaggttcccaccaccacacctggctaattttgtatttttagtatagacggagtttcactatgttggctaggctggtctcgaactcctgacctcaggtgatccacctgcctcagcctcccaaagtgctgggattacaggtgggagccatggcccatttgtttatttttttagttggcgtctcacactgtcacccaggctgcagtgcagtggcacaatcatagctcgctgcagcctcaaccacctgggcttaagggattctcccacctcctcccagcttctcccatcccagcttccttagtagctgggaccacaggcgtgtgccaccacgcccggctaatgtttttattatttgtagagatggggttttgctatgatacccaggctggtcttgaacttctgggctcaagcaattctcccttcttagcctcccaaactgctaagattacaggcataagccaccaagccctgccaatgtattagtttaaaagaagctataaaattatgggtttggggtatactggcaaaggttttccctatcctaagattaaaaaaaaaaaatcatacattgagtaccttgcagacttaagttttatattgaaatctttgatccacctgtgatacatttttctgtaaaatatggggtagaaaatacagtttatcacgtttcaagtgattatttacagagtgagtcatattttgtccactgatttgtaatgccacctaaaatatttatcaaattcctttacataccaaatctctttctggaatagttattgtttaattttctgttcacatatttattgcgccaacaccaaactattttaattattgtaatattgtattttaatatgtgattagactggccgggcatggtagctcacgcctataatctcagcactttgggaggctgaggtgggtggattgcctgtgctcaggagttgaagaccagcctgggcaacattgagagacctccatctctacaaaaaattaaaaaaattagctaggcaggtggtgcgcgcctatagtcccagctactcaggaggctgaggtgggagcattacttgagactgggaggcagaggttgcaatgagctgagattgcgtccctgcactccagcctgggtgacagagcaagaccctgtctcaaaaaaaaaaaaacaaaaaaaaatccacacacatatatgataagactaataatccctcaaaactcttcattttcaaaattttatatgggatattacattattcctctaacttgttttttgtctatgtaaaaactataaattctcgacttcttttttttttttttttttttttgagacaggatttcactctgttgcccaagctagagcacagtggcacaatctcggctcactgcaacctctgcctcccaggttcaagcagttctcatgcctcagcctcccaagcagctgggattacaggcatgccccaccacacccggctaatttttgtatttttagtagagatggggtttcaccatgttggccaggctggtctcaaactcccgacctcaggtgatccacctgccttggcctcccaaattgctggggatacaggcgtgagccactgtgctcggctgacttcattttttaatttttattttttgttggattcttttatgcttttcaatgacctaacttcatatttttaataagccagtcatcttcctaaatttctccattgcttctaaatagtttttagttgattaagtttggttttccatatcatataatcatatcatcagcaaaaagccgaaaaaaaaaatacataggttagtcctaacaatcatcctcacactgagaaaacagaagcaatcacagtgaacttccatgaagtttccgttaacaatatttatgtcctacttcctaccagtatttgtattccaacatagatgctttccctccctcctcattttacttggagaacagattggcctggtctcaaccattattgcaggagaaaggtgtaaatggtaaaggaaggcacagtttggattaggccacaagaaggagcagatgataccatcagatgcttatagggttggggcagctaatgggcttctaaactatttggtccctggcttacttagcaagaagggtagggaagaccaaactctgcactcttttttttttttttttttttttttgagacggcgtctccctctgtctcccaggctggagtgcagtggtgcgatctcagctcactgtaacctctgcttcccaggttcaggttcaggagattctcctgcctcagcttcccaagtagctgggactacaggcgcccaccactatgcccggctaatttttggtatttttattagaaacggggtttcaccgtgttagccaggatggtctccatctcctgacttcatgatctgccagccttggcttcccaaagtgctgggattacaggtgtgagccaccgcacctggcctgtgtactttttatcctatccgtttcctccccaacaagaagattgttcttgcaatcacactcctttttctttttcttttttttttttttttttttttttttgttatgagacagagtcttgctctgtcgcccagactggagtgcagtgatataatctcggctcactgaaatctccacctcccaggttcaagcaattctcctgcctcagcctcccgagtaactgagattacaggtgtccaccacaaggcccagctaatttttttttttttttgtatttttagcagagatggggtttcaccatgttagccagtctggtctcgaactcctgacctcaagtgatctgcttgtctcggcctcccaaagtgctgggattacaggcgtgagccacggcgccctgcccacattcctttttcaccaacttttcctctattgagttatttccatcaacgtgtaaacttattatttttctgatcttaaaatgaaatactcaaattgtgatgaatgtaaaagaaaaaaagagataaaattttctttgacccacttctccttatagcttatctcattcctctatataccactttacagcaacactcctggagtagcctttactttccctctccagttcctctcctctcattgttactttcatgtcagagtgctttttgcctccaccactccgctgaacagctgttgttagtagtcctaacaaaatctatttgcaaatgtttgccaaagtccaagagtgtaaacttaaagctgcatgctaaaatgtcagcgtaaagcaggtacacacacaagtacgcgtcaccgccaacctgttcctttacctggcaaaccttagaaggagcacgtgaacagtgtgccaactttcagctgtgggccagcggctggaaccctcacctgcatgttgagctgcttatcatgcagggctctctgcagctccagcaggctccccttgagccttctcagctttccagccagctgctcggcctcgtccttggtgtgagctttgccctccagcagcaggttctcattgtggactgacagttctgataaagccaccaccttctgctctatttccaccagcatattctgcagcaacagaaataagaatgaaactcacacatctccccagcctctgcaaagactgtttcccacagtgaaatacagccctttggagtcttttacgaaacggacaggctttcatgattttttgtagttttcccacggccttgacgagtaagtagtctgtaggctttttttttatattttttaatttatttttatttttttagacagaatctcactctgtcgcccaggctggagtttagtggagcgatcttgactcactgcaagctccgcctcccaggttcacgccattctcctgcctcagcctcccgagcagctgggactacaggcgcccaccactatgcccggctactgttttgttttttagtagagacggggtttcaccgtgttagctaggatggtctagatctcctgacctcatgatccgcccacctcggcctcccaaagtgctgggattacaggagtgagagccactgcacctggcccttttttgtttttgtttttttttgagggagggtcttgttctgttgcccaggctggagtgctttggcatgaacatggctcactgcggcctccatctactgggttcaagggatccccttgcctgagcctcccatgtagctgggatcacagacatgtgacaccacacctggctaaattttttattttttcaacagaaacaaggtctcactttgttgcctgggctggtctcaaactcctgggctcaaacaatgctcccacctcagccttccaaaagtgttgggattacaggtgtgagccactgtgtctggtgacttttaattgtctgttatggtattagaggggtccataaaaaatttgcctgagcctctcaatttttcttttcttttctttttttttttttttttttgagacaaggtctcctctaaaatggagactaaattagagaaaaagaaaaatagcctttcttcttcctagataagacttaaaacaaaaaacaaaaaagactaaaaaaaaaaacaaaaaaaagttttactttccttataaatcattgtttttatgttaattctgcaccctttgaaatgtactttcttctttatattaaataaagtaatttgttaatgagaaaagatacttcatttccctatacaaaatcaaaattaagaatataaagtcaggctgggtgtggtggctctcacctgtaatcccagcactttgggaggccgaggcaggcagatcgcttgagctcaggagtttgagaccagcctgggcaacatagtgaaaccccgtctctccaaaaaatacaaaaaaataagccaggcgtggtggcacgtgcctgtactccccgcacttgcggggctgaggtgggagaattgcttgaacccaggaagtcaaggctgcagtgggctgaggttgcaccactgctctccagcctgggtgacaaagtgagaccttgtctcaaaaaaaaaaaaaaaaaaaagaatataacatcaaaccaaaaaactagaactaagtagaagagtaatacttttattaaaataggaattaaaagatgatttcctgaggattattgttaagaaattaacataattctgtgcagggttgattttaccattaggcacagcaagtacagtgctgagggtctgtgatgcttttagagccccaagaaaatgtttgattttaatttcttttaaaatcaaaagaaaaaaactgaatataataatatggaatacatcacaacaaatctattccgaatcatgtaagtctttgtaccacagcaattgtaaaactgaaaacataatttttagcacttccatgggggaaacagcctacaaaaatgaagtgcccagacccacaaaggacatcacgtggttccaattctgtgtaatagtcaccgttataattagtgtgcaactgaattcatattagattttaactgacaagattttagctggcttatatgtaagattttaattgaatctaattaaaatttgaattaatttaatgtagtaatttaatattagatttttaaaaactattttctggtgtgatttaatatgtttccagtttcttaaagtaagcttgtccaacccacggaccatgggccgcatgtggcccaggacagccttgaatgtagccaacacaaattcagaaactttcttaaaatgttattttttttttgtaatttttttttaagctcatcatctagtgctagtgtattttatgtgtggaccaagacaattcttcttcttccaatgtggcccagggaagccaaaagattgaacacccctgtcttaaagtatggtcaaaacactattttaatactttggaaaagtattgaaatacattacctggtttatggactttatgtgttacaataaaaacagatatcttcacaagagagaggtggcagtatgataaaacataactttgaaatgttagtttgggtggtaacttcaagtgccaaaaggcaatgggctaatagatgtttcttctcaaaaaataaacattagaaagaagatataaagagcagaaaaacttgcatatggctaattaatctctatcatcatggcaaagaataacagtgctttggatacacatagataagtttcctaaagcattaaaaaatccgaatgataatgatcaatattatgaatctcaaatcacaaataagaatagccaaaatggtgtaccgtaaattaagaaaaaagttagtgtgcactaagtaatgattttcacatatttcctctgagtccaaaaaaaaggaatataaagttgtatatattgatacttaaccctgaagactagacagggttttctagatatttcctagttaataaaatgaaaaagcttttaaggtatacttcacccatgtgcgaagtcaaatatgaagatcatcattgaagtttgatgacaagcatatgggacttcattatctattctttatacttatatgcatttttgaaaaattccataataaagaggtaagaaaatagcattagaataaagactttaatgcaattactcctcacagtaattcctagagccctaacataggtggaaaacacattctctgctccaaaagacagccttcccatcttcagtctccctgtttgcctaaaactgacacttggaaaagttttccgaataatatatcaggattagaaccaaaattgtaacagagcacctagagatacttcctgttgtgtttatttccagtctgactcactgctactgattctccccattggctttgtattccttaataagtactaaatacagatattatggtattttggtatctacagtttttaaacatgacctttaggaagccggagacactgtggtcaatgtttttcaaaaagtgagtccaagtttggatttcatttaagcttttataatgtattacttttctattctttaaatgtataaagtctatgggttgggaaaaatcatatatccacaccaagcctttttatagtatgttttctgtagtttaaaaaaatgtgcttcatgatgttgacatattcctttgagaccattttggtacctggcagtccataagctgggcctccatgtccatgggctccttgggtggactcagcgcagtgtccagagtggccttggtactcaagagccagctgtccagctcatcggcttcacagcgatacctctgcagggcctgttcctgcctttgttcctccagctgatcattcaacttctcctgttgaattcagtagaaggtaatatagatcacgctaaggtaaaatcttgagaatttaacacagtaaagcaatggttccaggccctggctgtacataagaatcactggtaaaacttttaaaaatttcctttgcttaggccacatcccagaacaacaatcagaatttctaggggtgagtctcaaaattggtatttttaaaaagactccctagtgattttaatgtgtacctagagttgaacaaggtattctcaaataacatacctataggaccaggcagtaatagaaatgatggaaatcagtcaaggattagaacaaaacaatggcataaagcggttggtaaatggcagtagacaccggacctctatttctgggaagagtagggagtgatggagactgtggcaaactgaaaaacatgcggcctgtctaaaacagcagccacatacagtttcaggcaattgatccctgtgggaagcggtggcccagtgttaactttcatctccagtaaagggagaaatccaaatttctaggttagctctctgagtttttcaatgattgcaaataattcatgttgaaaaaaaaatcgacgtcaatcgcttcattttgaaacccccacaagtttttcatagagttactggggacaatataaatgaattaaaagttaacttttaaaatactctaaatactttattttaaaaattattttatgaataattcattattttaaaattaattttattaaaccatttaaaatagaaattaagaagtagggcagacacatcggctttaaatttctctaatacaagaagtattaggttggtgcagaagtaattgtgatttttgccgttacttttgcacaaatctaatatatgaatatattatttgactaatcatataataggtaaaactagagagagactacacacccagcaacagggtcatggttaattgcattatggtgtaattagcagctaaataaaataatattcagttcatataataagaaatgtattgagaacccattatgtgccagagaagctgctaagagatacaagatgatagatactgtaaaggtctttagggagcctccagtctaaccaaactacaggagcaacaatatgagtagcctagaagcttagggccaagaatttacgagagaacaaataaaaaaggaagatagctgatttttaacacagatattactgctgcccaaatttgtctctatattaaataatatttaaattaagtaacgtgggaaccagaatagcaagagtattttcatgaattactatgtctgaattggctaacagtgactaagtaggatttattctttatagtgttagtaatatcatccatcaaatgctgtcgtgtaaacatagcaaaccattatgcaaatcctctacaattattcttcacaaggctcatgtctaccaagaatttgctttccacattctcaatatttcacgcctgaaatgagtcagaaaggagtcaaaggacatattcatggctacacactgactgtactctattcgggagactgttttgttttgtttgtttgtttgtttgtttgcttttttgagacagagtctcgctctgttgcccaggctggagtgcagtggtgcaatcttggctcaccacaacctctgcctcccgggctcaagtgattctcctgtctcagcctcccaagtagctgggactacaggcacacaccaccatgtctggctcatttttatatttttagtagagacagggtttcactatgttagccaggctggtttcaaactcctgacctcgtgattcacctgcctcagcctcccaaagtgctgggattacaggtgtgaaccacccctcccggccgtggagaccattcttgaaacacaatcccagcttaggagagggaagcaatgaaaatgtaaatacgtaagtaacccacatacttggtaacacaacgttaaaagttaactcagaagtgaggaggccactttacagttattggttacctccaaaagctgccgtttccccgaggctttcatcctgatggtggacattcgctcggctaagacagtgagcgtggactgcaaggccagctgctccgcagggtcggcctcacaagactcggataccagctcctctgcgagagaggactggagctcattgatttcatcctggagcatgagaatctcatccatcaatgcctggaggaaagactgtggaatcacactcatgtattcatttcttcactgagggatcattagcactagctgagtctcacatccattgggattagcggaagagatttcacctgggaatcattaatcaatcaacaaatagcagcctactcacctacatttctaaatgaaaggccaggacttttctgattttatgtatgtatcactaaccaaagtgagtttgaacaacttaattaatctttctagttttcaataggatcatctgtaatacaaggatcatctgtaataccaacttattttttattttttagagacagagtctcactctgtcactcaggctggagtgcagtggtatgatcacagctcactgtaatcttgaactcctgggctcaagcggccctcctgcttgaagctgggactggtgtgtgctaccacacctggtaatttttttttttttttttttttttttttactttttgtaaagacaggatcatgctatgttgcccaggctggtctcaaactcctggcctcagggaatcctccagcctggatcacaggcatgagccaccacatttctcaatcatttctaagagtctccaatacaacgttgaaaataaaatgtattactttcttcctcaacatgattttcccacattaacctgttgctttccccaaatctgaaacagcattgaactctagtccaaaactcacatggtttctcacaggatgggagaaacctgtaacctatttctatgtcgtcacactactcatttttctcatttaccaaactctaaaaaataagggtctctcccgggtgatgtcttccattcccaagatttcaaatgctttctaatcctgagcacttccaaaggtacatccctaacccagacacctgccctaagtttcaggctgtgtattcaacttacctagttcacgggtgtctgcatagtgttaagtctaatcctgcttccccgcctgtcttccaccacctctcattatggctcaagctggagacttgggaatcactcttcacaccttcctctccttcactcaccagatccaaaccatcacccagtccaatggcttttatctcaaaaatatatcttgtatatctgaatatccccactgcccccacctgaagccaaagtcaacttcctctctcgactgagttgctatataatggtctactaatgagtctatctgcttacactcttgttgctccagtccagtctatatgaagcaattacagcaaccttttgaaaatatcaattaggtcctctcactcccctgctttgaaatatgtactggattcttgctgtgaaataaatcaaacttgttactacactcgtgtagtctcactcttcctgcctcgtgtgccacactcccttcttgctcaccatactccagccttcttcagccactccagggccccacttcagtcacttcctggcttcagggcctttgaacatgctgttccctcaacacgaaaaactcttcccgctctgtgtgagatggctctattcatcctttgctcttaggttaattgtcatatcttcagagaggcctttcatgaccacccaatcctaagaaaatctccatcattctctctcatagcaccctgttttcctgtctatcataattatacttgattttatttctcttttttggagtattttatgacttgctctttagatggaatcttcacaggagaaattgttatttaggatttcaatgaagttggaaaaacaggctctatcaccagagcggcaactatgatttcaagtaaagtaacataggctttatatttgccagcatttcatagtttccaatgtgcccttatttgcataattcctatcttttccacaggactggaggcttcactgtaagtgcagtgcctcctcagagtgggctctcacaatgttaaacagcaaaaaccccttatcttttcctaatatcaaatatcatcatgacaattaatttttaaataaactattaatattatatacatctagaaaagtgaacagattataagcacaccaactatatatatccatgctgctgctacccagatcaagaaatggaatatttccaggattctataagctcttttgacctcctccttcttgctactgctgtcctcaaaaatcaccactgtgttaacttgtaaatatcaggggactttggcccttatttgagctttatagaaatggagtcatacacgatgcactgctctgtgtctggctcctttcatgattgtgagagtcgttcattttgttgcacggagaaagagttaacccatttttatcattataccatattccactgtcgcctggttgtgaattgttttcactttaagtttttctagtgggtttaatagtggaatctcattgtaattttaatttccatttccccgatgactaatgagattgagtgtcttttgtgactgcctgctaaaaatcttttgcccattttccactagagttgttccttttcttattgatgtatggagttgtttgtatattctggataggagtgcctgtgtttcttttggttctgcatatagcaaataatctgttcccactttgaggcatggttttcccttaacgggaagagacttccttaataatatctgttgatggaaagaagttcttaattttatcatggtctaatagaatcaatatttccctttattgttagggcttttggtatactatataggaaatcttttgcctaatccaaggtcataaatagaatacattcgcatacgttatcttctgtaagaatgctactcaaagcgtggtccacagaataataacagtctgcacaatgtttgttactggcttatgatgagataaacatattgagagcaagtgctaagaaacttttatagtaatttgacagttatgacatccaagcagcatttgatttaattttactaaagtatccgtctgtgatggattagaatgttttttaaaaagatcattcaccatagatattttaaagtattattttcaaacttttttttttggtaataacttcacatttagatctacaaaccacataaacttaattttcatgtccagtgtagaaagaggtgaaaattcttctttttttcacccattgttttgcagtgtaatctttgccacaagtcaagtgtctgtataaatgtgattctgctctgggctcgaattctgttccatcaacccatttggctgtttgtgcaaataccacacaatcttaattattgtagctttataaatctccctatctggtaggatatatctttcaactttattaatctttttcaagactgtcctggttattctttacttctggcatttttaatatatattttcccacacatttgcagcatactttattattattattactatttttgagacagagtctcaccctgttgctcgtgctggagtcagtggcaagatcttggctcactgcaacctctgcctcccaggttcaagtgattctcctgcctcagcctccagagtagctgggattataggcatgcaccaccacacccagctaatttttgtatttttagtagagatgtggtttcaccatgttggccaggctggtcttgaattcctaggctcaagtgatctgcccgcttcagcctcccaaagtgctgggattacaggcatgagccaccgcacccagcctgcagtatactttagaattagcttgtcaacctccaccaaaaaacttgctgcaatttttaaaacgtgattgcaatgaatttacagactgatattgtttattatatatgcaaagtattttttatacattcaaagtattatacattcaaaaacttccattcagtaaattattttccattatttcataataatgttttgtgcctgaatgctaaaagtataaaatctatatttggtttgattttaaatgctcctccataattagatggatcttattatgtctttgtttttttttttttacactgatccttctgtacaagcaagaagagcctcctaacaatttcacactgtgttcattctcatcctctcttctgtgcctttccacacacatttacatttatagtgcctcctacccactcctgttgccattccaaattttcaaactctgtctcctcaaagtccttgttagatctcatttaacctactttccactaactgtagcccacaagcagatttctgttttctgtttgatgtgttggtaactctcaccagcactacctcattaaatctcattggctttgaccaaccaggtgtgcactgaaggtatcagctgccatttaaaactcacaatgttcttaaatagctctctgaatgttctgcagtcagtaataaaggaattaggaaaatctggaactgttcacttaaatctttttttaatttttttgggagacagtctcgctctgtcacccaggctggagtgcagtggcacgatctcagctcactgcaacctccgccccctgagttcaagcaattcttctgccttagcctctcaagtagctgggactacaggctgcaccaccacgcccagctaatttttgtattttcagtagagacaaggtttcaccatgttggccaggctggtcttgaactcctgacctcaagtgatccacctgccttggcctcccaaagtgctgggattacaggtgtgagccactgtgcccagcctcacttaaatcttgttagaagcagtcctctccactcatgcttgagtttactcttaaagatgagtggacatttttggaaggtagctagagtttttaacttcaagatctagcagccaggctcagggggggcgtgagattttcttttggggtcataaaaatgttttggaaccagagagagacagtggttgtacagcattgtgaatgtactaataccactaaattgtacaatttaaaatggttaattttatgctatgtgaatttcacctcaattaaaaaaaatttagccatcaaatatgtcttcagtcccataactctgagtataagagctggtggccagcagctacccgacaatatatgattcaagataaggagaaagagatgaaatgcatgcttttgggtttctgatttgtaattgcaaacttggcatgtgtatgacacttacatagcttagagaagttccatgagcttctctaacataaaaactctttaatagtaagggtgaaaagaaacacggaccttatgtgaccttcagaactgtctacatgaacacaagtttttgtttgtttgtttgttttagggggatggaagcttgctctgtcacctagctgccatctctgctcactgtaacctccaccttccaggttcaagcaattctgctgtctcagcctcctgagtagctgggactacaggtgtgcaccaccatgcccagctaatttttgtagttttagtagagatggggtttcagcatgttggccaggctgaaatgtttcctattttatttatttatttatttattttttgagacggagtctcgctctgtcgctcaggctggagtgcggtggcgcaatctcggttcactgcaagctccgcctcccaggttcacgtcattctcctgcctcagcctcccaagtagctgggactacaagcgcccaccaccatgcctggctaagtttttgtatttttagtagagacggggtttcaccatgttagccaggatggtcgcgatctcctgacctcgtgatccgcccgccttggcctcccaaagtgctgggattacaggcatgagctaccgcgcccagccttttttttttttttttttttaagcctacagtacctggtattcctgggcagtctcccatccaagtactaaccaggcccaaccctgcttaacttccaagatcagatgagagaccacagttcttctcacattctattttagttgttacatatatgaaaaaacaaaacaaaacaaaataaccacagacctctgtgcgctatatatcactgagctttgtgtggcaacacatgtccctaaagcatcagatgcccatgataataaggtcgcaatgacagagggcttaacagtcagtacaacagccacaagtcagctcatgaactgcattcaaaccttaaaatgaaatctgtaagacagccaagcatggtggctcacacctgtaatcccagcactttgggaggccgaggtaagtggatcacctgaggtcaggagttcgagaccagcctggccaacatggtgaaacctcatctctactaaaaatacaaaaattagtccagcgtggtggcaagcacctgtaattccagctactcgggaggctgaggcaggagaatcacttgaacctgggaggtgaggttgcagtgagccaagatcacgtcactacattccagcctgggcaacagactgagactctgtctcaaaaaaaagaaatctataagacaatttagagaggataaccagaaaggcacagcattccacacaaattcagtagtttagacaagtgtttaaaggaaaaatgtaggaattaggttacctccttaaaaaaacatgaatacttccaagagagtgttgggaaagaaataaaaactaaagtatttctattactttttaggaaatataaaaaaccatactggacttcctcacacccattcagttgaaatttagaaatagtaattctataacagtgcttgacatttttaaagtaccattcctgaagctaagaacaaatttagatactgtgataccaccagcttttcatgtgggcagctgtgttccagaacttgtagaacttctggcacagacagcaaaaggtagcaaaaatagctcagatgaaatatgtgatgatacatgaaattatatactaaattctacattattgctattttctttccctctcattagaacattaatatgttctaattatattaatatgatatattaatatatacaattatattaatatgatatattaatatatgcaattatattaatatgatatattaatatatgcaattatattaatatgatatattaatatatgcaattatattaatatgatatattaatatatgcaattatattaatatgatatattaatatatgcaattatattaatatgatatattaatatatgcaattatattaatatgatatattaatatattttctctcttaataaaccattaagccccaatgactggtaatcttcactaaattagctgtacctccttactgctgtgatggctagtacgactactaccaacttagaaagggaaaaaaagtcatgtggttggccttaatgacaagaaaagtcacagattcacttctaatttataattatcagaattaatgtgcaattttgagttgtctccattaaatcccttgaacagaatcatcattttgctccacattcagtttatgtgtgtttccatcctaatgcctgagcaacagggtggtggtgctgattggaagctaacttgcattttcatgtacgaactctggaagggcagagcaggccaccagtatcctgttttcatgcagctcctaactattgtgggagccagtgatgggtctttggcaattgtgggcagcctcctgggccacaagaatgggggcttgaacaaaggtggagatgtcctgaagctggagagagggtcaaactacttaaactttctgcaacatcgtcatctgataatctgagtgagtgactctcaaatgcactctaatccagcccttgcataatttacactatattccttctgaatgcttaaagaacggggcctcctacagaacagccatcgaggttggcctgaggagcacatactcaacctgaaggaagctctctggctccttccagtacagtgaagcagaggtgcagggaacagctggacagacagaaccgcaggagcaaggaagacctaggagccacagggagcacactggagcaacagggacaccccttcagatcagaaagaggtggccgctggcaacagaaaactgaagtagcagctaaagagaactgggagacactgaggcccctttagaaaggagaggggtttgggagactagcagtctagtgataaaatgggggaagctcagaagtaaatggcattggaatagtcccccaagcccctgaccatcctcctgattggtctggtcttggataacaagggttaattctcatttcgtgctttcatagcatcctctgcaaatgtggctaagggtgggtgactgtgggatagcagaaagacctacagaaggtagttttttaccaaaataaggcctaaaaatggacgctatgcacttcgatctctatcttcagaagtcacaagagtgtaaaaaacctgaaaccactatttctcaatatgctgtctctagatgaaatgttctcatttttatgttatactgaaagatatatactgcaaaagaatgcaactttatctgactacacatatgaacaggcagtctattccaaggttatcctgcttccaaaactagaaagatgtaaagtagaagaaagacaaagtacaacgtttcactcctaaagctgttaagttaccctgtgttgataaacatgcttaccatgccatgctttcatagctcttaattaacatctaaaaatatctttctttcctcctgccttctgaaggattgtcacatgctcctgggttcttgtcccagccaggcagcattttcctacctcacggtgatgaatatgtaggagaatgtgtgcctcagtatccttagaccccagttatacaaaataaatataattttaacagcgtacctcattagactgctaaagtattaaccagactttaatttctgaacatttcttagcatgcattttaacttgacacatttttaacattatctttctgcattagattaatgtaatgatctctgtttttcatgtaaagctaatattttgcctagtttaaccttttaaaaaatgatttaagtcagggacaatcacaagatgagacttagaacttatgaagtctgagatgtattttctgaagtgataatggaggggcaccccctggctaagtttcttaaaacaacaatatcgagaaaaggtagatttggagtatattttattcttacaacaatggctcacaacaaaatcaaaataacttggcaactctaaggaaacacattttgtgtaatcaaagttaaaaagcaacataaatgcatgtagctttctttaattagattcaaggtctgcatgtctctctctctctccctctctctctttttctcagatccctccctgaatcagtagtagaaatgaccaccattaggacccttgtttactctggaagaactgataaggttaaaaaatttttaaaaagtcacctggctgtctcaaacacatgcctgacaggccaaccagtcacaacagtgccttattcaatcaagtaggaaactgaagtcatggctatttgtacctgatgttcagccatctggctttctggactcctgccaggctctgggctctcactgagtttcagctcaatggcctccatcttcgtagagatggactggagggagtcctggtacttctgctggcgttccaaagcttcatagagtgtgcgctgcttctcactgatctacaccagaaaagggatattaccaaatgcttcccagccccttatctttcagattacaacatttctttcttcagtgctttacctctgtggcccaacatagggtactcaactgtggactggatatgtaaactctctgcatgtatttcataagacaatcgctaaggttactggtgtctggtgggcataaactagtccaccttgaagacttaccacattctttaaggtttcccaagaacgctgcaaatcacccagtttggcagtagcggatggctccaatcccggttcatagaactcctgggatgcggatgtgctggggtgaatttttgcagcatctgtctgcaacctctcagcagacaaggcttggtaatatgcaatgtcctgtgagtgcaaagcacagtattgaattaaacaaaaagacaaagtctagattaatatgctctgggtactgttggtcatgtcaaggaaaggtttcagatctacacctttcatggggcactacaaactagtaaattagtaaactcttgtgacaagaaaaatgtaaagactgtatcaaagcacactgtaattgtttcagaattttggtttatatatatcaaaaaacaactttaccaatatttcaagttgccaaaactcaatcttattctatgtttgttaaatggaaatacaaaggatttaagcagtacacatgtatttaaaggttgattagaatagcaaaaaaagagaatcttaatgatctagttcctaaaatgttgtcgaatgtattcattaaagttttaaataatttaaaaactacttgacttaaataaaattaaatctacagatgcagccagatcttcactatctgtgggttcatcatttgctgaattaatttaaatattttgatattaaataagaaaaatgtaatggggaagttaccactactctaagaaacaaataatataaaggttttctatgcatttcctaaaagtatacacacaaaaaaaacaaagtgaatgatgaaatatcatgctttcaaattttttaaacctattataacattacatattttatttgtactgataaaatttactatatcaagagatatagtaaagatatatcaagagatatagtaaagatggtttttaactgtttctatggttatttatctgtatttcagtagaaatttaattgggggagtaattgctattataaagttcattgcttttgcagttgtactgttgaagggaattatgtcagcttaaaatacctgagtcttattgagaatcatgtattggtaaaaagtattgaagaaggctccagccgtctgagaaacaaatgtagcagtgtcatgcggtagaatgaattcagactgggacagctgagattctagcgaaattctcctcttgtgtagctatataattggagcaaataacttatatcttgcacactggttcactcattggtccaatcttgggtgggattgaggattatatgaaataatatttgagtgactatgacagcttctacccattttgttgttgttcctgaggtctccagatgagtccccaacatttattgatgatattggaacatggagactgcttcctctttattcctaaccctgtcactgtcttgagtggattactcttcatgtccttaatagctttagatccattgatcctcactcactcccaccccacttcagtcctccacacccttgtatgctgtcatcgctcagctggacttgtagttatgtctgaagttacttaaacccctttcttgccaagactcttgtttctcttgctcttttaacctttacttcatccacttggaaacccgcaaacatgactcaatccagagtcatttatgcatgtgtgtgtgttactgacacacacacacacacatacacacacaaacacgcacacacacacatacacatgcaatccaagctgtcaaggagatactgcaacttctcaaattttcaaaagtctatgtatattcacactcacccttatcttatgctttccagtttcactgcttaaacctgactctcccacagactctgagaatcccataaactgctttttcaaggatcttggtctattaacatcctctctggctttgttgactttctctcttccatccaaaaacacctgcacgcactgtttcttttatttgttttcttgaaggatatcacattttctaaaaagtccacagttcacaatgtgacggatcgtcacacgtgaatgcacttgcacacacaggctccatcctaatttctttgttttctccctttcatttcataatccaacttctgaaagggtgattttcatgggactttctcaccctcgatccacttctaaattccagtttggactttgatcctgatgactgcagagcttgctctcaccagcttcttctctttgacaaaaaatgatgaattttcatcccttcccttgccagacctctagcattcaatagcactgacaaaccctttccggaaacactttctaaaaaatctctctgttctcctcccagctttctagtcattcactctttctcttttatagtttgttttccactcactcgccaatattggtgaattgataagctccagactcacatatccagatgttcatgcatatcctgtaggctcttcaaagtcaacatttccaaaaggaaccaatttaggaaaaaacaatgaagtattatccatcttgcaataaatggaatgtcttctcacctaagctataaacttgggatttattcctgatttctcctcccccttaacatccactgcttatgggaggatggagtgctaacgatgcatatcctggccacagccttggttcaagttctcattacagtaacagcttcctaactcaaaggttgcaaactggcagcctgtgggctgcctctgacctgcacatatttagtgtggcttatacaatgttttaaattgtttaaaatctctcttcatgaagatagagagatttcattaaaattcacattcgtagcttgttttgcaaaccacaaggtatggtaacactgggccctgtgtctttgttaaagtaatgctaacagaggagacattgcctcatttatgtggagcaggagctgtccaggcctctgtagtccctcctggcctctgtagtccctcctggcctgtttctctcatttttatcaccagggtggaccaagcatgagactgtgtaacttctgtttctaacagctcccctggctctgaatttgcacacttctattctcctgtccacattgatccagaagtatcagttctgtacacagcttctcattaaattccctcagtggttaaatattagcttctggaggaagctgaaattccttcctgtggcattcagggcctccatgatgtggttcccatatccctctcagtctcatttccccctctcctcctcctccaatgtttctccaattacactgaaactatttgcagttgcctggatgggccattttgcttcccgcctccacagcttccaacaggtggtttcttctgcctgaaaatcttcatctcacacgacccaactgcactccaactgcctaactgtgctcctcccttaaaactaaagggggccatccttgacctctgcctgactccagccagtttaggtgccttctctaggccctcccacaacactgtactgccctcggccacactacctgccaccttctcttgtaagcatttgcctgtcctcacacacactgtaagctccctaagggctgtctgggtcactgcttttcgtcttcatcctgagcacattgtggagtgtttggcaaataacaggcaggcctatatgttcataataaatcatgcttgtaaatgcacttatataaattctattattttatatacatgtaaagtaatactattactgtccataaggaaaagcaggaatgcctttaaatggtgtaaacattttacattagatactctattataaatacagaaggctcccaaaagagctagaataaaataaatttattacaaataatttttttctggcagtctcactctgtgtgtgtgtgtgtgtgtgtgtgtgtgtgtgtgtgtgtgtgcgcgcgcacgtggctcatgcctacagatatgaatgacaactcctggtttcttaaaaggatttgaaaatatgtcaccttttatagatgaataatttctatttatttgaggtacatacataaattgaattaaaataaatcactcagtactataaataactactaaagtcaatacttgatgtagtgaggagtcactgttacaaatacgtttctcattgcttatgtgcctaagttataagacttatgagtagattcctaaggaaataaatttggacaactgtagctactatttgatcagtattttctagtttaaaaagcactttcacgattcatgtcacatttcattttcacaatgctgtgaattaagtagtattgcttctcacttacaaatgagggtatcaagggacttcccaggtgcactcagcttagaggagaaagagctgcaactcagtgtgagcttttaacttgaaggccaatgattttcccattacactcttgctccctcttttcaaatgtattcctccctcaactcttctgcagagtctaagccttggcttgcttctaaggggaatcaagaagcctacagcaaaatctaggaatgcctcggtatttctaccttcaagtaagctaaactgttattacattttagctaatagctactgtcagagacagaatacactgtgagtgggaccaggtagttatataacggagatctacttgcaggaacagcaggcacaaaaccttttttttttttaacaactgtgattttataaagcagttctatttggctgctccctgaaacagctgtacacattctgtgcacaaaactcagggtttttaatctgaaaactgaaacttaaggggatcctacatgtcctcctcagtttcaagagacaattttataaatccagtgcatcaccggtcatggtgtcatattttttcattgtcttctaactgacattactatacaaaaataacatgtggccgtaatgatggggttgatttgtttgatgaacaccaagcataatacatttcctttttaacagctccctcagagtaaagctgtgtgtcttaatctaagtaaaggcattttcccctactttgcagcatcacatgtaagtattttagattaacaatgcaatttaattgatgttttcctgtgactaggggagaggggaagaattaaaacaaagcctaatctcactgagttttaggacctgatgaagctttgtggttaatgtcaagaaataataatagaaatatttgcatgtttcatcatttttagggcactttcatgtatcctttgacactttacaagaagtagcatggagatttacagttttagaaaaggtatattttttccacaaagtctcaaataagtatttattattcagtttgaaaaatttgagaacctaaaccatattaaatagaacaattttttctatataataatcagccgactatagcttaatttctgtaataacatctgtaaccatagggaaggacaaatcatcaaagaatgagtaatacatattttaaaatgagaatttgaaaaacactttcccaaattccccacggctccctgaacttctccttttatgttgctgtttttagtttcctctgatcacattgttattatctgtcccatgtctgcctttctctctagactgtcagggccttgcaggtagggccatgctgactccttctcagctgcatcctcaggaaccaacacaaggtttcacgctgagcaggtgtcagaatgtacttgacaaatggatgagttgataatttccctagagctatcctgatttttaccaagagaacagtgtaagtgtattaactaaaggtttcatcaccttgatgttcctttttttttttaatgaggggggattctctttatcacagaaatcctatgacagtctgaatgcttctgctttaaaataaaagtaatataattgaattataatacaggttataaaacatttgctctgtttaatgcttctcccttaataatacatatcaacttctttgaaaaaatgtaatttcatagaatagtttacattttttagttgtcttcactaaaaaataaagtattacttaacatgcattaaaagtctttggttactataaaggcatatttttgatttctatctaacatttgacataaaagctttttgacatttaatttagtattatctacatttaatacatggtaaaaggcttcttataactaaatggttattttattttccccattttatagaaaataaaatttaagattattgaaagataagttaaacactcaaatctagtaggcattctagtataaatatggcagacattccttacattggtacacaagttgcaaataaagaagaagtctgacataataaatggaagtttcctgtcttcaaaatctgagctggtaaatgccagcactattttcaatgcatgttataaagccatcgaatcacgttattttacaatggtgacacacatcttttattttctgttggatgcagaaccccattccagatgattgctggaaactaaggccataatgtcttaaaacagagccttctgggctatcattcccatgacctaatttttgttcatcccactttctgtagcccaggagaggagatgacatactgagacacatgacaatcatagtttgtgcaactataacacctaatagtgtgtccctggaaccaaatgcaacaaagtctgagattcatacccacgatctaatggaaacagagaatggagtcctgcatctgcccagagattattgctagaggaatgccaactgggaggtacctggttaacagaagcatctgtattagccacaggtgaaggggagcgacaggcaggtggagaggaaatctcactgttggttccctcctccccagactcctcagtgaccggtgacagcaaagtgtgacagcgacctgcagtcatctgccacgtaaaatgtagcccaaaggacatgaaaatcaattagctatgttaacataagtcctgttcaggcacaggccaaaacagagttaattataaaacgaaggttaaaattactgggacccgaattcacatattaatcctgtgttagtatttaaaagttctgtcttcaagagaatatgatgctagtaatcatttgtaaaacaatcagggatgggggtgcatatgacattgaagttttgttgttgattaaatacttcattattttcctttctttggagagtttgtggctttataaataactggaaaaatcacgaatcatacaaatgagaaaaggtctgtgaaataaagcttggtcttttgtggacatctcaagtttcaaatatggtaggaagataaatgcacccaaagtactgttattgccaaatgggctcaggtatggttactcattacctgaggcacagcacatataagggaaaacacacagcactgggaaacattatagtcaccaaaatactcaatgcattttagatggcaagtgtataggaaaatagtggtgcagaatagaaaataacaaagttgatttattttaatccaaagccaagctttagacggtctgttttcatatttttctaacaatagctgttcttctaaattgtattacacatttatacagtagagtacatgcacatatgtagttagctagttagcgtggagaccacaactaaatatatatgccatgaatttcccatcccccagacaactaaaacactgtgcaagtaaattattgtttaaagctcagagcctctcagtattattgcgaaattataaacaaatacagggtagacctctgacatgttaagtaattcagctgtctcgagcacatagtttcattttaactgtcattgtttacagtgtcaaagattggcccggcccaacggtagtcaaagagacttaaggaatctgttcctccctctgaatctgcaagatcgaaggctggtccctgaaatcagccacggagagggaacatggagccactcgccaggctccagtcaaagagcaaagccgcggggacccactggatccttaccatgaccacagaggggtgggccgaaggcgtggggaggagctccccatccaggtcctctgtcccttccgccagcccctcgacctcggtcaccgtcagcagcatggtggcgtgcttggctttcatcgtcagcatcttgcacttggaattcaaagaagcgatctgctcctggtagcccttaattttctgcgccagctcctgaggaaacatttcccccaccggggtgtcagagcagcatcaaaaggaaacagaagtagtagcgttcatcttcctgcagggcgagccaatgagcgcgcagagccgcgcgggcccgggaggcaggatgtgtaggcggcgagtcctcctgcatctcgctaccgagccagaccgcaggctgcgcggcgcggcgcaggcacagccaaagtgcccgagcccgcgtccccgcgtcggtacaaaaggagaaatgaggggatgaggccgaatgagtggtttctaatcgcgagaggccccatatggaatcatgaacttccgcaacattaggaactgacaactctctttaaaagcagaaagcatctgaaatttaccagatggttcctgccatggaaattaggtcatgtgatggctaaaaccacaccaaaaaaaatgcaaggctcagctcttaccctactgagtacattcaacagagatgacagtcatttattttacatagggtcacatactcaatagcctgtctgttcctatgtctctaagaattttttttagataggctagatattgcatatggaaatcccaatttttaatgcagattgaccccccaaaaaaattttgtatattcatcaaattttttcttgctcacttcatcatgtctcaaatgttgctgaggctttaactagaactttaaacttgaaatgcaattcggatttagtgtcttttaatttcacttgcttttgaaaaaataattgtttttttgtttttgtttttgagcagacaagaatgaaaaaatatattatgagagatagaggttttaaatattttattaagagcttattggaaatataatctggatagcacataacccttaaaaaggtaactatagattcattttaggagtatggtaattctaaaatattaaagttttactttcttgcttaaatattttaagtatcaaatattaaaattatactttattgcatctttaaaaaacgaaaatacatatttcaaaacatgattcctaaaagtacaaaactattattctttttttttttttttttttggcttctttgtttcagaggctgtcatttattgtgcacatagaacacattttgtgggccgggtgcagtggctcatgcctgtaatcctagcactttgtgaggctgagacgaggggatcacttgagatcaggagttcaagaccagcctggccaacatggtgaaaccctgtctctactaaaaatacaaaaattagccagaaattgcttgaacccgggagatggaggttgcagtgagccaagattgtgccactgtactccagcctgggcaacagagtgagactctgtctcaaaaaaaaaaaaaagaacacattttgtgacaaaaatattaaattgtaatgtctttaaaataattgtgtacatacatacacatacattcatatatatacacacacatatacacatgcacacacacatatgtacacatagtcatccctcagtaactgaggggcgttggttctaggaaccctcttagatacaaaattcacagatattccagtttctgatgtaaaatggcatagtatttgcatataacctatgcacatcttcccaaatactttaaatcatctctagattactaataatacctaatacaatgtagatgctatgcattataaataggtgttatactgtacaatttagggaataatgacaagaaaagaagatcaacatgcagagatgcaaccatcctttttgctcctcaaatattttccatccatgattggttgaattcatggatgcagaacttatggatatggagggctgactgtatgcaaaacacgtgtgcacatgcacacacacacacacacacacacattttgttattattgttgttttgtttgtttcttcctgcccaactgaagccgagtggagcaaaaaacagtccagcagaactcagccagcaggcagtcagtcttcttgactcctaatagtataggaatttttaaaacaaggatttaaaaagtagacatcattgcttctttacctctggggatgcagttaattaaacctaataggatttttaaaaacagtgattgaatagctatttactatatcttgtctagtggctagcacgtgggtactcaataaatgacatttactgcaactagttaatactagaaaagagctctagcagattactggactccttgaatttcaagtcaccaagctttcgcacaatggtttgccattatacaaaaattgaaggaatcttttttattattttattttattttatttttgagatggagtctcgctctgtcacccaggctggagtgcagtggcgcaatctcggctcactgcaacctccatctccggggttcaagccattctcttgcctcagcctcccaagtagctggaattataggcacgcgccaccatgcccagctaatttttgtatttttagtagggacatgttggccaagctggtctcgaactcctgatctcaagtgatttgcctgccttggcctcccaaagtgctgagattacaggcgtgagccaccatgcccggcaatttgaggaatctttatgaagtagacagagttagtattaggccttccaccctttgtaatcacatggctgggcacagctccctgctacagtatcctgcaaagatgtgcccacactgacagcaagtgaccatttcttaagctgcaattctcaaccttattgtgtacaaaactcatttggattgtttctttaaaaaatgcaactctggtcaccacttccaaaggttctgatttaccaggtgtatgacagtctgcacttcataattagcccatgtgactccaatgcacgtgacttccactgagaaatagtactctacgacttgcttctgtaagtgtaaacctcttgtaatctcattacctttgagggttggttattcaagctgtggtcaaatccactaaaataaaatggaacacttggtttaatgttacccattctctttataaaatttctgaaaatgtttataaaggtaggaatttcaggtagagtggccgctagaagacaagcagccctctgtggccagtctctggtattcatgagcaggctttccgcatcaggcggaaagaaaagaggtgtgagtatcctctcctatgatttaaaagtggcaggatgatttttttcaaattaaatgcaacttttgaaaaagtattattattattattttttgagacagagtctctctctgttgcccaggctggagtgcagtgacacaatcttggctcactgcaacctccacctcccaggttcaagcgattctcctgtctcagcctcccgagtagctgagactacagacacccgtcaccacccaggctaatttttgtatttttagtagagacggggtttcaccatattggccaggctggtctcaaactcctgaccttgtgatctgcccgccttggcctccgaaaagtactgggattacaagtgtgagccaccacacctggccgaaaaattatttttaaaagtttgaattccttaggcataaataaatgatcagttatttttaaagttatttgtaagaaaactagattcaccataagattgagattcaattaaaacaagacagaaaatacaggcagaaaccctcttcccaatttgtatgttatcatcagttaagctttctccactcagcactttccttcctgtgtttgttttatacatacaatgaagctcacacaggactgcatcattttttacatgaaaatgtgttctaagtcacagttggtttaaaactaacaaacataacatggatgttcagaactgtggaagaaaatgtgacaaaataaacagctcactggaccaagagtcaggaagacatagtccactgctgactgagctgagttcactctgtgaccttgggggactcatttattttcctgggacttcattattctcttttgtttaattaagtagcccagatagtttctgttacagtggaagaaaaatcacggaatttggacacaaagatactgagactgagtccaatttcaatcagttactagatttaggagctcaggaagtcattttttctaagttcagtttttttgtcagtaaaataaagatgattttaaaaaaatccttaccccggccagtcgtggtggctcactcctgcaatcccaacactttgggaggccaaggtagatggatcacttgaggtcaggagttcaataccagcctggccaacgtggtgaaaccccgtctctactaaaaatacaaaaattatcagggcatggtgatgtgcgcctgtaatcccagctactcgggagcctgaggcaggagaatcgcctgaacccaggaggtggaagttgcagtgggccaagattgcaccactgcactccagcctgggcaacagagcgagactccatctaaaaaataaataaataaataaataaataaataaataaataaatacctcatagagttggtataaaaaagtgatgtaaaattttgtaagttactttaaaaaacataaagctggctgggcatggtgactcatatcttttattctagcactttgggaggctgaggcaggcatatcacttgagcccaggagtttgagaccaacctggataacatggcgaaactctgtctctactctacaaaaaaaaaaaatgcaaaaactagcctgaggtagtggtacatgctcgtagtcccaaatacttggaggctgaggtgggaggactgcctgaacccagtaggtacagactgcaataagccatgatcccactgtgagccatgatcttgccactgcactctagcttggatgatacagcaagactgtgtctcaaaaaaaaaaaaaaaaaaaaagcacaagtttcttggggaagaaaaaccgtacaacaaaaaagtttagtagtaataacaattattactccagaaaagattttaaaaatatctgtaccatgatagaagagttgttacaacaaaattttggatcttcctagatgggattaaaaatcgtttcaaaataaatatgtaatatatagtctaacatatagacctacataaacagtggtttcaaaaatctacataacactttcatttaaccattgtgtaagaaaaatcattaacatagatgatgtctacagttgttggagtaaatgtagatgggatatttaaatgattttgtaagtcatatataaatgaaaattattaatgtttgtagatgtcaagaaattaaataattaattgcatttggagaagagggtgagatttttcatccttacaaagcaataccttgaatcttttgagaatctcaatgtgagtggtttggaaaaattgttcatttttctcatgacaaagttaaaatagagcatatggaaggatatattccatatactctatccttagtacagaaaaaataagacaaccttctcccagttatttaccaaaattcacagtgctatgaaccagcccccaagggaaagagtgaatttgacctatatggaattgacaggtcaggaaaggaaattccctgctaagctcaatcactcaaggactatgatgtctgggacagggactgcacaaggagtggtcaagtcctaaggtcataatgatgccaaaggaacaaggaaagaacatttgaaaacgaggcacatgttagctggcccaatctgaaaattagcaaagtaaacaacctggaccatcctctgattttggggagaggaactgaaatgactaatatgtcaaagaagaaaatgtttaaaatattaagtcttgtttgtttgtttgtttgagactgagtctcactctgtcgccaggttggagtgcagtggcgcgatcttggctcactgcaacctctgcatcctgggttcaagtgcttctcctgcctcaacctccgaagtagctgggattacaggcgcatgccaccacacccagctaatttttgtatttttagtagagacggggtttcaccatgttgtccaggatggtctccatctcctgacctcatgatccacccatcttggcctcccaaagtgctgggattacaggagtgagccaccaagacagagatcaatgcagcaaagctttaagcgttgctgtttctcgtaggcattaaaaacagggtatggactgtgttttagtgtattaactgtgagaattctgggtgcaggagatgataatcagtgggtcccaaaggatataatacgaacaacgtgtagagaggttatggaatcaaggggaacgcacgtgttactgaatcaacaaaaacggcactcacaatgcttagatagccaaagaggcctctcaagagttgaacacattaagtgcaggacaggggaaactgttctcttccattctctagaaaccaaacatatactctaatcaagccagtttcctgccctcggtatttcgcctacattcctctcacctcatgccgagaaatctgagcctgcagctcctgtatgttactggtggcaacaggtttatcctcaatctctctgtgagctccttctatcagttgctggagatgtttcatttcttgctcatattgttcatattgtaccacagcttcctttgaaaaaaaaaaaaaacagaaagatagacagttttttttctctaccaataactaggtaagtgattctgtagtttaactcctatttacctgtacaggtagggaataaagaaatgatgggtaaaattcctagatggtttgaattcctcactttatgtagatatttcagaactttctctctaaaatgttgtagcaaaattattgatggaatcaaaatagttaagtggttaggattctttctctctcttttccctactgatatcgtcctgaagatggaacatgacggtcagaaagggtgaagcagtgtgggaaacattatttcatttttccatctaacaaatactgaatatataggtaagacacttatctaagtgctacggtagggaataaaaatacgaattatgggctgggcgcagtggctcaagcctgtaatctcagcacttttggaggccaaggtggctggatcatgtgagcccaggagttcaatacagcctgggcaacatggtgacacccccatctctaccaaacaaaagtatatacacatatgaagtatgaatgacttttagcctcaggaattttctgtccaacaaattacaagataacagggaggaaagggtagttgaccaaatgagccactagtgattttagtgagatgctattgatacaatttttggataaagcaagaattattagttgaagggagacataaggtaaacactgtcatttcttcctggtaaatgattttctcttactaggcaaagagactaagaattatacttgagtgcatttttttaggcactcaaaagaaaatggatttaatgctttaataagctgaaatatgaaaaaaactctgtaacacaagataacagtaaacctgtattatcagtttgtagatgattctcaggtgaataataagagataaaaacatgtaattgcatagaaaattaatctttacaagttatttatttaaaaatatcactaaaagataattttcaccaaggatattttttatatagcattccccaggcttttgtgggtgatccaaatgacagcattttaatctccttattttataaaaccacaacagcctgtcagattcaacaccctggatgtgttttgatggctgagcccacacaatgctaagaaaagaagcccatgattcatcagcaattgctctactggtgtgggtaccctgcacctgcctgcatgatgttacactgctggatggcggtgtgctgcagccggctggcctcttcctgcagccgcagagcagcatgacagagaggtaagctggcaaccacatcctcggggatccggagggcactctggcagagctgcactgcttgcaccttcggcttcagtgactccatctcagacaacaaatgctgaaaatgcaatttcatagttcaaaaatttaatatttaaatcatttatttcataagcaaaaggcactaaattatagttacgttgcaagttataaacattttgcaaaaaaaaaaaaatgtttaaaacagtgttgagtttaggggctggacacagtggttcacgtctgtaaccccagcactttgagaggctgaggtgggtggaccacatgagttcaggagttcgagaccagcctggccaacatagggataccctgtctctatttaaaaataaattaaaaaaaataaaacagtgttgagtttaggaggcatttttccttactatcctcttttaaaaatataggtccctgtccctatttactccaagttagtttggcttacctgccgatgagagagctgctccttgagactgagacgtccaacttctggagaagtcagtgttgcctgggcttgctccaaggcagcttgtaactttttcaactctgcttcaaattttttcatatcctagagagtcaatatcaatgtattgtacttgaagttcaaagccataggggaagaataacatcacagtcaagaaaccacatcacaggtgagcactatttccatagtggcattgccattttctttcaatgatagacatttttttctgtttcttttttttttctttttttaccttagctgcatcttggaggttctgcaaacgaattttgatcatctgtcgcaactcctcagtctcccgtcccagttctgccacttgctgagacattttttctgtacagtacacgctagtgaggtactgtaatttctcagtcattgcttccagctcactgtcaatttctttggattcttctagcagggtctagagtgaattgtcaatattcatgacattgacgggcaggtagagggatatagatattcaatatagcttggcataaaatgccctgtgtaagttctgtgtgtccgttattgtgtttaaccttcaccccccatgaccactttctacttggtagccacttactattataactatttcacagaaaaagaaatcacagtttaggaactgtaaacaatgtgcagaggtcacatgtcatactacgtgtgggaccatgaagctcctgctcggtcaagcccaagctgccccctcgtgagaacaggacataggaattctagcagtgaaaaacccaaacatactaggtgtcttatttgtatctctgggtctccattttctcatatttaaactaaagaatcacttttcagctctcatattctatacgactgaagttcatatttgtctaagaaatgaaaataagaacaagagcattacaagcaaaaaccttggctcacttgctttaagtgagacaaaggggtagaagatacgtgcaataactatcaagagaagcaaaaacatccctgatcattcagagtggtatcatctactgggtctatcagaaatacaatggataagtaaccattcaatgtacagtctatgaaaagtagaacgaaagagaagccagtgtgaagagatgactgcaacttggggaagattgggagaaggtctccgggaagaatcacatctgagcccagtcagaaggacttttgggatctgacagatgagggggaagaggaaagacatttcagacagagagaacagcatatgcataggtacaaagatgcgtgaatctagaacacacagttagtggggtgtgtaatgtgtaaagaggagaaatgaggaataggatattattcttaggcaatagactatttatttatttcttttttgagacggagtctcgctctttcgcccaggctggagtgcagtggcgcaatctcagctctctgcaagctccgcctcccgggttcacaccattctcctgcctcagccccccgagcagctgggactacacgcacccaggtgcccgccaccacgcctggctaattttttgtattttttagcagagacggggtttcatcgtgttagccaggatggtctcgatctcctgacctcgtgatccgcaggccttggcctcccaaaatgctgggattacaggcgtgagccactgcgcacagccggcgatagactttttttaatgaagtactttcttttctcacaataaatgtttataaatatatatttaacagataaatatttatctgtatatgatatatgatatgtatttatacaagatatatttatctttttttttttttttctgagacggagttttgctcctgttgcccaggctggagtgcaatggcgtgatctcggctcactgcaacctgcatctcctgggttcaagcgattctcctgcctcagcttcccgagtagctgggattacaggcatgagccgccacgcccagctaattttgtatttttagtagagacggggtttctccatgttggtcaggctggtctcaaactcctgaccttgtgatccgccagcctcggtcccccaaagtgctgggattacagatgtgactcactgcacccagcccctatacaagatatatttatttttaacacataaatatatatagtaaggatatatatatataatctgttaaatatatatttaatgtaaatgtataatttaagtatatttattaataatttaattattttaaatgatttaaatatatatttactatataaatatatcaaatagaaaatatatgacttggaaaatattgaaaatataaagaagaaaacaaaatatctcatcactttataacccagaaataactttaagagttaactgctgatacatttgggcacatttttaggtattaataattgaggtcataacatgactatagttttccatctttctttttcacccgaccttagcgttaccggaaaaaggtcccaatccagacctcaaaagcgggttcttgaatcttgtgcaagaaataatgtggggcaaatccagagtaaaatgaaagcaagtttattaagaaagtaaagggatgaaagaacggctactccattgacaaagcagggtgtccccaaaagcaggaaaagaaatgcatccaccttaggtacaatgtctgcttatatataagacaacaaagcaaaaaatcacggcggagatatgctctgcaagggcctgtgacaaaagattgttgatctttgtgtaactgctgtcttctataagaatctatgttaaaattattttttaaatatagatccaagaatgcttttgttcttaagataccaggatatcaggacattgcctgagtctgttatttcccagatctattaaggcctgggtatcttcagttagcattatcaacctgtctaaccataattattctgtgactaagaatgcctgacgtgggaatgctacccaataggtgtcatcctcatttacccagcccctattcaggcccctacgaagtcactctggttctcacatctctgacattagaaaaaacacaatggattttcttttctttttttttttttttttgaaatggagtcttgctctgtggccaggctggagtgcaatggcgcgatctaagctcactgcaacggctgcctcccaggttcaagcgattctcctgcctcagccatccgagcagctggaattacaggcactcccaaccacgtccagctaacttttgtatttttagtagagaatggggtttcactatgttggccaggctggtctcgaactcttgacctcaagtgatccacccctcttggcctctcaaagaacacaatggcttttctcacagtgcactctttttaaataaacacaggctgctttacttcctaaagggggcacgtgagaactcaccaaaagagtctacagtctgcgttctctcttcagcttctgagccagatcatctcaggacctggtgtctttttcactgtgccccatgatgcagtcaacccaccctactgctcgagtcatagaaacctgggaatcatccttgactcctccctgtctttcatcgttgactcctccctctctttcacccaattcagtctccaaattggagaattccagctgcttagtatctcttgactttgtcttctcctcctaatctccaaagagaggccttgtcatcttctactgaaatactgaaaccatcttttatattgtcttactgtcctcaatgtgttttccaaaggctgctaaatttgctttctgaaaatacaagtctgaacttgtcctttgcaggcagaatatcagtttcagaggcttcagagtgacttcaggataaagtccaaattcccaacagacttttaggatctttttcttatctctctattcttatctcttatcccttgtaccagcaccagaaaacactcctcacatttactgctaggatttcagcatacatttttatctaaacacattccacaagtaggctgtcatgtttttcaggactcagcccatcatcaccttttcctgagaagcctttctgcactttcctcttaaacccctggtgggcggttgggttgagcacactcctgtgggctccttcagcacctgggccctctgtctttgcacaaatcacactatattgtactgtttccttctatctgtcccctcccctaaataatcaactccctggggtggggacagggaatatcctttgtaccctaaatgcctaaccaaagtcctagtttgggaaaggactgtatgtttgttgaataaataaacaaacgcttgtattcccagaatttggggatgccaaggcgagtagatcgcttgaggccaggagtttgagaccagtctggccagcatggcgaaaccccatctctactaaaaatgcaacaattagccaggtgtgatggcacgtgcctgtagttccagctattcaggaggctgagggacaagattcacttgaacctgcccaggctgtagctcagtggcgtgatctcggctcactgcaatgatgacgaggttgcagtgagctgagatcacgccactgagctacagcctgggcgatagagcgaaatgctgtctcaaaaaagaaaaaaaaagtcatgataaccttaaggacttcattatattttattatatgcaaatatttacttggaaaaaaattatttcacatttaagttttctttaaactttcactacagttattaatactgtggaaaatattttctatattttggattgtagccataaaaaggagtccaaaaggagccaacaggccagagtagtaacttttttttttttttttttttttttgagatggagtctcactgtcacccaggctggagtgcagtggcatgatcttggctcactgcaacctccacctcccgagttcaagcgattctcctgcctcagattcctgagtagctgggactacaggtgcccaccaccatgcccagctaacttttgtatttttagtagagatggggtttcaccatattggccaagctggtcttgaactcctgaccttgtgatccacccacctcggcctcccaaagtgctgggattacaggtgtgagccaccgcacgtggcccagagtagcaacatttttgacaatcaccatacattttgccaattatttttcaaagagattttaccaggataccagcaatgtttgagagctctcacttccttaaatatgaacttgaaagaaacagtatgaatgtgacagttaagtttgtctttcttcctctctttttttgctgaaatttgcatttctagacttctaaggatgttggctttttttcattgttttcaaatcagtggtaacttaagtcctgtctgttcatatctaagcatatcttaaagcaaaagattggagttgcttaagaaagacattgtgggaagaatacgcaagattgatcagagaagaaagactgtgaatatagggaaaaattagaagctgttaaagcattccaaaaatggaaaaatgaggctttgatctagaaccctgtaaacaagaatggaaacagggattcatttaaaggccacaaggatacataaataatataagagacaaaaatctagaatactcgatacccatgtaactcctataaaagtcaccctatattttattatatgataactagcctattaactatctgtgtctaatttaagcttaagttacaaaaggatgaaataatttcctggatgacgtgactgacagaaaaggaacatttttctcatgtaacttcagaggaaatgaactaacatagccagcatgtgatgtggactcatggcttgctctgggctgcccgacctcctgtggaaggccagatgacaggcctgggtgagggctgagggaggaggcgggagatctcccactgagcacctgcatgtgccaggcagacgtttgcacgtgtgtaccttaaaccacttgatctcataagtctgaaatacgaatattatttacgtcttcatacaaatgatgagaagacagaattcagagaggcaaagcattctgctccaaatcacacagccctgcatggcggagcttggttttcccaccagtctgagtgtggagtctagaatctttccacacttcattgcatctcttcacaggaaagaatttcccaccagatccctgcagataattatttcaaagaagctacagaaaatgagttctacaaggctgattggtttgggtcttggtgtaaggtaggtttagggaagatcaaggatatttatttattcaatttcatgaaatttcatgagaagctcctttctgtccaactactgaacaacttaggggtaccttagcattctttttatctggtagctccaaaaattttacatcacagccctctaagtgttgtgtcagtctacccagttaaatcaaattgcccttggttactttttaaagattatttttcctaaggttacctgatgcaaaatatattgttcccgaagctggcttgcagaattccatgcaatagttccatgagccaagactttagctttttcaatccacttcaaaattaattcaagcatttcattgtattcttctaaatgtgatgctgcctgaaaaaccagtaacattaatgtaacaaatgtaaactcctcagtttcttgagctataaatcagtcttctctctctttggacacaacagtcttaggggttgatcattataatacctatgatattcaatggtatcaaaagatcgtttccctgttaaaatctgtcaaagctttctcagtgaccttaggataaagctcaagttcttaatatgattgaattattcctctttttctttcttttttcttttttcttttttttttttttccaaggtcttactgtcaccccggctggaatgcagcagctggatcatggttaattacagcctcaatcttacgggctcagcctcccacctcagcctcccacgtagctgggaccacaggcacgtgccaaccatgccctgttaaatttttgaatcttttgtaggtttcaccatgttgcccaggctggtctcaaactcctaggctcaagtgatccttctgcctcagcctcccaaagtactaggattataggtatgagccaccatgccaggccttcctctatcccttccttcaccctcccctgggtaaggaggtggcaagtggggattctagcaggcaaagtttcaaactataattaatgggttaccaactcctggttttaacttgtccctgattatattaatcgatttcaaaagtctagtctatatgcaacaattattacagacgtgcaatctgaatctattaagtcaacgtaagctgatatatatgtagcttacttaaaggtacttgaattcaccccaaactgatttcataaaacacgttaatgggtgaatattcattctacaaaatacttctccattttacaaaatattcactccaaagtccatttgtaggaccacctttgtcagtgactttatcatatggctggatataaagtaagtgctggtttatacctaagtcttaggatcacaagtgtagcatgaaataagctacacctaaactactctctcattgtccattttatctttttatttatgttaatttattttcaaaagagaaaagcagaacatggaagtttctgccttacacgatttggatttctggcccggaacacatacctgattgagcttggagagccgattctcagcttgtctaatggtctgctggtgaagttcagtcagttttcctatcttcttggccagtggcttacccagttggccattctgttccaagaatttctgtactgctgcatctaattccattaactttgaattacagccatctaattcctctcccagcaccttgatggtcaccaaaatgaaagaacattagagtacagaaaataaatttctccaggtttcccgagatcagactgatttttgtcaaagccaaatattataatgaataattctactataattctactatgatcaggtcatttttgtttcttcggttggaaaggcagggcaggatatgttgtaatgctggtgtttatttcctatgaggctgagtgagaaggctaacattttccttctgccccacccaaaaaggattagagtccctgaactcatcaacagaggaagaacacagatttagctaccaaggacacaattcagtttggaatttatatacttgtattcctaaatcatcacttagtcctttgacgctcttctttcgtacacactcatgcatgtatatttattaatactgttcaattataatgatcaattatgtaagaggatctgtgttgcttcagttacaaaatttctttaccacctgctgttactatttggttttaaaaaaggttcctaaaaggtttttatcctatatccccaagtaaaactgactccaaaaactatttaattcattcagtagtaccctttaaaattctacttcttaccttttggtcagttttagcttgaactacattatctgtcttcgctttcagcttagttagaatagttgtgaggtctttagctaacttctgaatttgccggctgagttcctggctcgtggccttgctctgctcaacttcttttattttgtcttggatctaaaaaaatcagtaagaacagcaaaacaagccatggttaaaagtgaataatagatactaaaaatctcaaatgatgttgacaagacacattttaactgctttggcattgaaacacctggtcacaccagcgatgtgcgattagttacaagccctcctggctttccctgacttcactatctttaagtatttactgcactccttgtgttccagcaaagatacaagcaatgtgtgtagagaaattcacttattaaatatttacagaatactcattatagatggttgtgtagacagctgagtttgaatcctatcttctccattaactaacgtaatgaccttgagcacacaaactcctctaagcctttttcttcataagatggaaaatcctcccaaacagttggaagcacactgatttgtttccaagcaccttttaataaatgactcttaatgatctgttaactctttttgtaactttccgactacagctctatagtatgccaaccaagcattaagtacatccaatggaaaggaaggtgaaaaaagacagttcgcatttacaaatttccagtgactttggtttgatttgataacaaacattcacactgttgcttagaataaaatgccgaagaaaagacattaaagagaagaaacatttctttatgtagttaaaggtctttaaaaaaacctctttagtagggagaaaacacaccattaaaagagagttaatggtgtgttttggccttcattattttgagtgtcaaagtaaatgaaatacatatgaataaggctatgataggaaaattaatccagagaaaagcttaaattttaactaaaaaaacaaacaaacaaacaaagaaaaaccatggctgtgcacagaggtgcacacctgtaatcccagcactttgggaggctgaggcaggcagctcacttgaggccaggagtttgagaccaggctggccaacatggcaaaaccttgtctctttttactaaaaatacaaaaaattagccgggtatggtggtgcatgcctggaatcccagctacttgggaggctgaggcacgagaactgcttaaacccaggaggttgcagtaagctgagattgtttcactgcactccagcctgggggacagagcgagactctgtctcaaaaatataaaaagaccatgaacttgccaagtcatccttcccagtagatcttccaatgtctaagaagaaaagccaaatatatcaattaaatacttaaaatagtaaagagcatttatcagtagtttaggtcaaagtcatgatgcagtaggatcagattttgatgagatttttaaaacactttgcatcatacattgaagattccaaaagtagagcacaactgtatgagttttacagtttgtacaatgggatattactttctatttcatgtagcaatttagaattgtagtatgtcttctctttgtctcatatagaagggttttcattaaactttaatagctttagcattaagccaccaagagagtccgaaaaatctattatatttccatacagatgatatttgagcctattttcactacatgaaattgtgctcttcatgagaccagagacagaaatctcactctggtctcaacaccaaaaaggactatgcatttcttctcaaagaaacaaaaatatttgttttttagagttatagacaggattatgtttctatttactcttttccttgggtgtttagaagctagggttaaaatgatggctcttctctagcaacattaggggacccacccgcatgcattttaggaaataacttcatccctgccttgatcttatttttatttctttgatttttccctttcctccaacatcttcacctacttaactgacattttgttgcactgctgaaataaaataacagctggaagagtccctggcacactctgggcattcactaaatatttgttgaacacatgaaacatatcttactttttgtttctttaagtctttttttaaaggtgaggggaagcacaaaaattatctttaattgtatggcattattggtcatatctatgatcatcttgcctatgaaaaagacttctaatttaatattattgttttatagccatctattttttttaactctgtctccaagaagacattattgtgaaaatcaagaactctcacacaagaggactgaccctataaacaaaatggaaagacactctttcttgatcataggtttacctgatctcggatctttagatctaacgccacttcagccaactgaagggagagttcagaaggtaatatggtataaagacctaagtacttctccttctgttcttctgccattttttcaatgttctgtcggtgatttgtggcttctgttaggagaatctgaagaaaagatcaaaataagaaatttctgggaaccttctaaggggactgttatagacaaggctgtatatttttcatcaacatataattaagtgtggaattagaaaaatatcttaatacaacattgttcttttgtctctgaatataaagtatgttcactttaaaaaacaaaggaaaatcccatgaagtaatactaaatatcttttatataacacacttctgaaattttttaattcaatattcaataaatacaaacaagtatgttcaactaaaatcagggcaattgtttttgaaatgatgggtaaagagaatgaggagacttttttgtacctgaagttcttcaagttgagcatctatttctattgttggattccctaaatattctttcgtttcctgaacccaacatttcacagaattgatctgagtctccaccatttctcggtccttcagctcttgcttcaccaactttccattagtcttcactttctcctgcatgcttcagaaacattacagggataaaacagaagtgaagtgaaaggaaccccctaatacttggcaacattttatccaatacatatatagaaatgggaaacctagtatcttttttgaaagaaaagacacttcctcaacactgttaaataacactgcagttcatgtataaatgtcatataaagtaaataatttatccttgaaaaactgagagttgactgtctcacatgccactaaattgcaatcaatttcctatttaaagtagcctggagattatttcattatttacttcctctttggaaatctcctaaaatggtacatttaaaagtaatgtgtaattggaatatatatagctatctaatagaaagtagtctttaaagaaaaaaatcaagctttggaaatgtcataattaatcacgttaataatgtacaaatttcaagtctttatttgaattaatgtaaatttggtaagaagattttaaaaagtgttaggttaccttgacatcacctataagggaaagaggtgaaatgcaaggacatgaatgaggtaatatttgtaaatgtagaaattaaattatcaatgaatatttttttctctggcccaagaagtgagtcagggctggttatacatcaggattaacttgctctttctactaaattcactgctagtcgatggctattatttacctggactgcgctcctatatccctgtcaccccagatggccaatgagttctcaagcttcatcaaatctaagttcttaatagctctcaatggtttccatctcatgcttcatttctcttgaatcacccttcccctccccgcatcacccaaggagctccttgaaagtgacacgtttattcctttcttacatgtcatttccctgtttgcaaaactcaatgcctagctccagcccgctcaggcttctgcttcaattccccttctgaagggatgccttctttgacccctctcctcggctgcttgtctctgcttcggattccctcagctcccttttcacacttgactacaaaggctgccttagttgcctagctctctgcggcttgactgtaaacggcatgaaggtagacactgagtctgtatggttcaccatcgtatctctaagtactatcagatatgtatttgtcagacaaacgattgaagagttaaggaaacggaaaagcaagagtgatgggaacggatccccacattttcaaggtggtgtgaaggagcaccttcatacttcataacctacttatcccaaggccaagttcagtaacagaatgaaagtaggggccgggcgcggtggctcacgcttgtaatcccagcactctgggaggccgaggcgggcggatcacgaggtcaggagatcaagaccacggtgaaaccccgtctctactaaaaatacaaaaaattagccgggcgtggtggcgggcgcctgtagtcccagctactcagagaggctgaggcaggagaatggcgtgaacccgggaggcggagcttgcagtgagccgagatcacacatttgcactccagcctgggcgacagagcgagactccaaacaaacaaacaaacaaaagaatgaaagtaggtgcttaattacttcaggcaccgatcttgcatggcggtgatttcctgcatgagcggaggctcttccccaggggttggggcggctccatcctggagcatgctcagggtttgctgccgcagcatgcccaaggccgactgctgctgctccagctccagaacgaacgtgtcgtggtattcaagaagagttaagagctctgctttcgatgctttctctgctgaacttccaggtaacttatcttgcagctgatcaatcatttcagtggcctttttaacctgatgacaaatgtacatactatgaagttcaataataaataaactgaaaaaaatagggtaactcccataaaagccacacactagtgtatgaagccaattaaagatgatgatataaattccacatgttaggaaactggaacctgagcaaccttcttaacatgaaaggagatatcacctctatacctctgggtttaaagctttaatctcaaaataatattaggacaatcagagactatacttaatacagaaaaagctttaaaaaaaaactaagcaaacaaaatactctttccaatatttaagttaacataaatgagtgcctttaaatcataaaggaaaataatggcttaaaacattaaacctttaaagatggaaaaagctgccaggcatgtggtggctcgtgcctgtaatcccagcactttcggaggccgagacaggcagatcacctgaggtcaggagcttgagacaagcctgacaaacatggagaaaccccgtctctactaaaaatacaaaaattaaccaggtgtggtggcgggtgcctgtaatcccagctactcatgagggtgaggcaggagaattgcttgaacccagggggtggaggttgcagtgagctgagatcacaccactgcactctagcctgggcgacagagcaagactccaaaaaggaaaaagttgaatatacaatttgggtaatgagtcaaatttctgctcattttcaggtttcatggtaaagaaaaagtatctcattctttttcaaggccgttaagaaagcaaatgggccgggcgcggtggctcacgcctgtaatcccagcacttggcgggggctgaggcgggcggatcacgaggtcaggagattgagaacatcctggctaacgaggtgaaacctcgtctctaataaaaatacaaaaaattggccaggcgtggtggcgggcgcctgtagtcccagctactcgctactcgggaggctgaggcaggagaatggcgtgaacccgggaggcggagcttgcagtgagccgagatggcgccactgcactccagcctgggcgacagagggagactccgtcaaaaaaaagaaagaaagcaaatggggcaaaatgggcttgttctcctttcacaatttaattgcttggtttttctcattgaaataatttgactgtgacttgggactaaactgcacattgcattttgtactttgtttcataacttaatttttatgtcactgaaacagattttaaaaagcctttattactttcataaggctgacttcaaaaaggggcaaaatactgtgtttcaaaatacattataattagtgaggaaagaaaggtgagcccatggacagtggaaactaccttgttgttaaagcccgtccactcatccactgcatcttccaggatcttctcctggtcctgggccacagctcgaaggcgtgtccagcgctgccagacggtggtcattgacctgctcagggtggctttgctggcatcatttccggttttctccagttgtgaagctttttcctcaagggccacaattttctcatggaaagagttaaccactgacactaaagcctagggttgggggtggaggacggaagagaggagacaagggagagatcaatttaattttataaagttctatggatcttggtaaagcccaaaattcctgcaaaaggaaatgtttctacatacgtttattctcctctaggtactcttacttttatgtttattttttaaccagagtgagtcttaaagctttttaaagaggtaaggtgaatattatttatttattaaaaacaaaagtgtattttgctacttgagatgacatttttttcatttttaaaaagcagcacaaatgcaagtgaaccaaatgcaatattttagtatgttacattttttccttatattgctctgataaagggagactcagttattaacgttttagttttatttaatctgttatcaacaaaaagtattcactgacatttattaagtgccacatcttatcggaagcaaattgctctgaacatcttagctatgcatttccaatgggaatcctaaaaggtaatagcatttaataaacttaaaacttctataaaatgttgttaaatgcatccttatcacattgaaaaaagtccaggtagaaatgaagatttattgatcatgttgcaaagactcattataattatagaaaaaggattttttttaaatggcccaaaactctgaccttgtgttctgacaatttttcttccgcttcatgactagacgaagtcttcaacaaagaaaactcagacaatttcttttctgtatcattcatcaattcaataacctcttcccttgctttctggtaatcgtgccattgagctgtgcatcttgaaagagtccaacagaaactgataagtagcacgaaatcacgtatttctacacgaagctctggtgtcagtatgtctaatgatactcagggaaaaatgaatttacgtgctaatgtatatcattcgtgtattactactttcagtgtggaaattcatttcactaaaacataaaacacaaaacatcctgaaatacctctgcaagagatccacttgggcaccagagtcccggctcatcctctggctcctgagttccagagaagccactttctgttctaggtcttctttgccggttggcttgatgagtgggtccagggtggctaccaggctgtggagctcctccaggttactatggaactgatcctctgtactgaaaaattccatgtggcttttgagattttcctctgcgctctccacgtctaggccattgcctgccagctgtaacaattcttgggcatcctcaagccagtcattggctgcttgaaatacctgataatacctttgacactggctatatatttcagtcaaggtagcctgaaaaacagcaattgcaaacataatcaactctcctttgcaatgtgtttgcaggaaagagttttattcactcatttgttttccagtccttagtctcatgggcgtatgtgtgtaagtgcattgataagttagtggaatatttttgtggtgccatcatcattatccttgatttttccttctgctattcttgttataattttattactgccattaaattaaataataaggacagaaatgggatagaaatttatgtcagtatcttgactagttctgaaacttccctctctaagaaataatatgatgcttagtaatatgtggcagactggatgtttatcaaagtgcagtaatgtctccgttggttagaagtataacaacacggccaggcgtgctggctcatgactgtaatctcagcactttgggaggctgagggaggcagatcacttgaggccaggagtttgagaccagcctggctaacatggtgaaaccgtgtctctactaaaaatacgaaaattagctgagtgtggtggcacatgcctgtaacagctacttgggaggttgaggcacaagaattgcttgaacctgagaggcagaggttgcagtgagctgagatcgtttcactgcaccccagactctgtctctcaaaaaacaaacaaacaaacaaacatggaaaggaaaagaaaagaaaaaaaaaagaaatatagcaacatcaaacttccaaactggcatttaccagaccacagagccacagagtaatttctggaagcgaaatagtaacctgtgagtcttgtatacagactaaaatagaaaagttgaaaagtttaagtctggatggctggtccattcaattccagaaggaaaagaaacactctaaccagccatcaatgactagacaagataagccgcaactgtgcaagcgaagatgcatagaaaaggtagagaaagtacccataagatgagcaccaattagggaaagaacagggacagcaaagcatagaatcagcggagggaataagaaatgccccaggaaccatgacctttagttatttggaccaagataatcaataagacaagatggcacaagcagagacatcttagtagatttaagagtttggttcaaaactcaccaaaagaagcaagcttacctgacaaatgtttttcaagaatgaaaatttctgctaacttctgttcttactctacattctagattctatatctctatttatactaatagcgctagaaaaatagtttaaaatttgtataagcaatagccttgaatcaacatgaaaaggttaaagtgtactagtttttagtttaaaaagtcagaattttaagaagtttattatgattttatccaatattaaaatttttactatttaaagtgttaaccttaacctctgcagaaaatatagttaaatgagagctaagattcatctgaggttacttcgtgtcagacccaatgctaagaagataaacctaataaaagaatcattaatatctctcttctacaaagagggacagagccttataggatgtcattttcctgagatcaaatagctgccattaaaactcagatgtgccctcctcccaggctatagctgctgtattatcctgacgaaagctatcctttacctaaagggttggttgacatctcctagaatcacagggactaaagacagacatggagaaaatgggccaagaagttaaaggaagtaatcctctaggcactatttttctcttcttattttattttatttatttatttatttatttatttatttatttatttatttagacagagtttcactcttgttgcctaggctggagtgcaatgtcatgatctcggctcactgcaacctctgcctcctgggtttaagcgattttactgcctcagcctcccaaatagttaggattacaggtatgcaccaccaaacccagctaatttttttttttttgtatttagtagagacagggtttcaccatgttggtcaggctggtgtcaaactcctgacctcaggtgatccacccacctcaccctcccaaagtgctgggattaaaggcgtgagccaccgcgcccagccctcttcttatttttgaatgcacagaacttgcaagccccagagcaagctgcaattaggccaatctgggaagttttgtacatgctcccatttctttttgttatccccaagtcaagtaattacgagtattctagtctttcttctgctgtgctacagggaagcaggagaaggacagcactcatccccacagagggggtgaagagatggggcaactaatgggataccccacaaaaatgtggcttattggcaaggtcagggctgcattgtctgcctctctccatttagactcttcatctagcaggtgattttagaaataccagccttcacattgtttacaaagggcatcactaattattcatggttaatcagttgtactatccatgtactaatatataatattaattatgttactaataccatttatcatctcttttaaggtgagaaatcactgaggcatcactgttataagcaaagtgaagtcaagatggaaaccacacaaaatgaatatcatgcacataaacaattaaaatcacctggccaggcacggtggctcccgcctataattccagcactttgggaggccaaggcaggcagatcgtttgacgtcaggagtttgagaccggcttggccaacataatgaaaccctgtctctactaaaaaatacaaaaattagctggatgtgatggcgggtgcctgtaatcccagctactcgggaggctgaggcacaagaatcacttgaacccaggaggcggaggttgcagtaagccgagattgcaccactgcactccagcctgggcaacagagcgagacttcgtctcaaaaaaacccaaaaaacaaaacaaaacaaaacaaaacgaaaaacaattaaaataaccatttaagtcactgctgaagatgcttctgtgtagtatttcgaaagaaatatttaaagaagcaattataaccaagcaaacgaatttcttgtacctgtttacaaataagcagagtggaaaaaagagaagtgaagtcctattatacccacctgtctggtgcgtaaggcttcctggatgtctccatccagctctgagagctcagcgaggctgtgttctaaatccgcagaaatcagctccttggcctttgtgaacttctccttttccttgtgactcagcgcattcatgattctcaagctggactggacctcttcctgatgaatttggatttttctgatttcctcttggatgtcctgcaggttgaggtctaggtacaccggcccactgagctctgccttcactctcctcagccagtccagggagcgactcatctcagtctggaagtctatactctgcaccattcggctctcacattctgtcaccgtctcaccaatggcagaagtcaacagttttaactccccttgccaggactggatctgatgcctggctttctcataagccaaggggtcaaggtgtggggcaagatcttcaagatgtatggttactcgtttcagtacaatccctgagtcctggagacttcctgccagggagtgatacattttgagcttctcctctgcaggcagcgtttcctcattcactttggactgctcctcttttacagacttcagttgtctctccagctgttggcacatcttctcgtgttcttggtaagcactggtggtgtcttctaataagctaaccctctgttctgtttgtcgcttcagcctgtgatataaggtgacaaggtgcagcatcttgtctggctgccaaggctgacctgtgctgcgaaaaccttcttttttctggttcagttcatccaccgcctccccaaggcccgccacctcgtccagaatggctctgcaaccatcttgcagagaaagagcctcctcaacggccaggtcggtgggaactttgctcatcctcaagaattgggcttcaagttcactcagagactgggttgtcaactcaatcaaggaagcatattccttccgagcaagaattgcttcctggactttatagaacttgtctttagccaaggcaacaattacattaaattgtcgaggcaaagcatttagcttttcactgaggtaggaatgatcgacttcattcagcgatggtaatatggtctgcccagttctctgcagcgtaagtagaagattttcatattctggagattgttcaagaatgttttggtatttagccagttgtgtatgaagctcagaactctcattcattaggttgatttcaggaaatgtaacaatatctgcttgttttagccagtggcaagctttatcaaaatcttccttaaaatgcttcctagaaaccaaattcttctctagttcttgtaaccggtgactgcacttttgtaaaacactgtcatagacactctgcaattcctgaagcttccccagcacttcactcttttcctgctctgtgacttccttcattagttcgcgaccctgggcccaaagtccagtgacttcattttggtaagtcttgaggctggcttgtgcactcttacatgttttgacttgtttgctcacatcatctggtaacagacagatgtgttcacggaacattatctttcgctcatgttgctgaatttggctggtggcctggaacactgccatgagaaactgggttttctcggacaaggctttgtttaagtactttcttcgctggcccactaagtcactgagacaattcacgtggctttgtgcatcagagagagccttctggatgacctgtcgctcattgagaccaagatctgccatgaccctgtctgcgtcctttataagcgatttcaggagcatctgcttggcctccagttcactgcagatggccaggtgatccatgagaaggttctgagccatatctggaggagggctctgcttaagggcctcggcgatgttgggttgttgctcttctgcccactccattagctcctgaaatctggactgcaccacatttaactcctccaagttggtgactgacacttggattttccttttaatgaggtcctcaagctgaaaccaacgttgctctaaatgactcgtctgttctttgactaactccttgtcatctaaattcagatgctctatcattttctgcttttgatctttcagatcttcaatagcatactttctctcctgcaatgccaatgctaactttttcaaagcttccaggtggacagctgtactctctgcatcagatctgaaaatacatggaaaggtataagagcaaattagctgtagtcaatatcgatgtttgttcatactatgctaaattacacttcaccattttctttttggagactgagttttgctcttgtttcccaggctggagtgcaatgaatgctctgatctcagctcacggcaacctccgcctcccaggttcaagcgattctcctgcctcagcctcccaagtagctgagattacaggcatgtgccaccatgctcggctaattttctatttttagtagagacagggtttcaccatgttggtcaggctggtctctaactcctgacctcaggtgatccacctgcctcagcctcccaaagtgctaggattacaggcatgagccactactcctggctgacacttcaccatttctttaagtggatcttctgagcttagaacaattgagagtagttcaattcatggtttgttgacagaagtgctataattatggaatacaagtctcatcagaagtcaatactagaagttgaatcaaaccaagttgcctacttctttctggctgataatgccttccaatcaaatcagaatatgcttttatcttcctctggctcttatcaactgagcagaatctatatggtaacaggatccttggatgttttgtgtaatgttaaacagtgagaagcactgatctagtgtactctagaaaatgatactgaaagaaattaataagtgatgcatgatttatgtgctttcttttgtgaagagggtccaacaaacaatatagttctaggtagtacaatctgtaaggtataaccaacagatctaatggctacttaattgtgtacttggatattttttgcttatcattagtaatctttagtaataagtgtgaaatgtaaagaattctcatccctttgactatgaagcacacataaaaaatggaatattgtagtcttttttactaaatgatcagttctgaagtatgaaaagcagggttgggaggcagtatgaggagttctgttttggacctgttaagtctcaggtgtctgtggggcctactgtgagccagaaatatgagttgttaatatttactggactaatcccaaagacgagtaaatgttaagtatcaaagaaaagcaaacaaaccagaaaatggtataccaaaaaaaccccaaatccccactatgatttcatgatatctagaacaatatttgcagttttctttgctgtaaactagtaaatcggtgcagaagaagtgtagattttaacaattatagtgatcaaaagtatggaatggtttcatataatgatccagtatgtgtgtgtgtgttcttatttttcaaagaagaaagctaagaggggttcaataactacaaaatcacaaaagacacaaattaactgaatttctagactcttgtaagaaaaaaacctgactgaattacacagaatgcattcattaccttatagacttgataagaaactagggagcatataggttcaagaaggattcatttcatgaattcatagatgatatcccataacttgtaattaaacaaaattagaaatatttttagaatattctttgaggtcacagagaaaatggtaccattttcaaacatttctcttttacccactggttaaatcaatatcgagctaggaaaaccatgactctatatccatttgaaaacgttaggttcataatgatgttctacttaccaatattaataataataaacaatagatgttatacctaagacattttattttatttttttgagacagggtcttgctctgtcacccaggctggagtacagtggtgcaatcttggctcactgcagcctcctcctcccaggttcaattgattctcctgcctcagcctccgaagtagctgggattacaagcatgcaccaccacgcccggctaatttttgtatttttagtagagatgaggtttcaccatgttgtccaggctggtctcgaactcctgacctcaactaatccacccgcctcagcctcctaaagtgctgggattacaggcatcagccactgcacctgggcacattttaaatttttatagatattaagaaatgtctggcttagcattttggtgacccatgggagaatttctgttacctggccaagttatcccattctgtagtaaatttttctaggaacacttcaacaacattcatacagtcatggtaatctcttgttctctgaagatcctcttccctttgcaagcacaggttgttagactgacggcacaaatcgagccactgatcatttaaatgatttatttccttgtgttcaggcgattcctccttctttgttaacttattcaccttttctattatggtgttcacggatgcctgtttgctctgtagtttcttaacaaaatcctaaaggataacagcaacaaaaaatatgtaatgtgttaagaaatgcccaaataaatatagagagcaacacagacataagacctttaaacactctaagttccttaatatgaaaaaaactgaagaatgtataataagttatgggaaacaaagagaaaatctaaaaatcaccatacctctttatgaacgttaattcccacgtgtgcaagattcagggtagctgtggtatattcttttattgtactattccaagaggcataaagaaaaactaatacatgtgaaacattacagtcattaatgaaaaaagtcattatcttaccttgaagtgcggcctttgttttctaagaatttttaaggagttcatgtttttcaaaatttattcttaaactaagggtgcttttattctcaagacatcaggacattaggacatttcctaggtctgctaagtcctggatctgtcaagttctggatctgttcagtaaacattattaacctgttcccttaactaaatatcctgtgactaagaatgcctaactttctgggaatgcagcccagcaggtctcagcctcattttacccagcccctattcaagatggagtcgctctggtttgaacgcctctgacggaaaccttccaaatgtcagagacaaggcaaagtagcttgggtcaccaggtgggcagtggtgttatgtacagagttggggaaggctggagtacattcgcaaagtggaaaggcaatggtttagattcatctactccctgcatacacagcaaaaagaaacctctaagataccatctctgccagcccaatatgtggccagaggatcatttctttggatagtgtttcctccaaggggttggttcatggacttccatacttccccactgctcactcccattgccatttactcccactacccaaaaaacacctcttaaatcccctgactgatatatgaaattttgtccttaaagctaggttcaatcacaattaaaatgttaacaagagtatcatcttgaatgtttttattatgtgtatatctaaaacaaatacagcaaaatattggcattgtttattatctctgaatggtagtatcataagtgattgtgatttaaatttgcttattaagacatttctgtattttctaagccttttataataaacaaaacttttcttataaaatacattttaaaaaattaaatttctaggatggttcacaaatttttttaaaaaagagttcatgcttctgagaaaaaataaatcttattatcccgatccctattctcttttttctctgtacttgcaaacagcactccagtagacaatatattattattgactcataatcacagagaaaaaacatctttaagtttatttaaaatctgacccaacttccaattaagttaatacacttataattttcttttttcccttttttttgagacagagtctcactctgtggcccaggctggagtgcagtggcatgatcatggctcactgcaacctccgcctcccaagttcaaatgattctcgtgcctcagcctcccaagtagctgagattataggcatgtgccacgcaaggctaatttttgtatttttaatagagatgtggtctcaccatgttggccagcctggtctcaaactcctggcctcaagtgatctgcccacctcagcttcccaaagtgctgggattacaggcatgagccaccacacccggccacaatttcctatatattttaaattatttaaattatatataaatatgtaatacaaactgcatttatattatactttaaattaattacatatagctcaaatatataactaatgaattgataagcttacagtcctacagttttagcataatatggtgatgaaaatctaaaaaaagaataatgttccatgtttgcttagtcacagagttttctgactaagcagtctactctgtagactaaatcacacctgcttttctcaggaataatgtagagtatgaatgtcttctgatgaaagtggccatctgaagcttcagtaatatatttgaatgtctactttataatctgttttccctggcaccaaatgatgtttgttcagatttgctattccttaaagcagcggtccccaaactttttggcacctgggatgggttttgtggaaaacaatttttccgtgaatggggctggagggggatggtttcaggatgaagctgttccacctcaaatcatcagatattagttagattatcataaggagcatgcaacctagatcccttgcatgcgcagttcacagtagggtttgcactcctatgagaatctgatgtggcctctgatctgacaggaggtggagttcaggcattaatgcttgctcgcctcccactgtgcggccaggttcctaacaggacatggacttgtgcttgtccataacctggggcttggggacctctgccttaaagagttgtattaatgtctaaggattgacagacactcaggcatattgaagtgaatacactgaacacatttcaggttttctactctgttggcctcttttatctcccttgggggcaaattaattcccaccttaacttgtgaaaccatgttctgtgcaatgttcagctccagctcagagtgcctcctcttcatgttctgcagttgctgatcagcatcttgcaggtaaatccagagctcagacttcaggtgcttgatctcttcccagccctgagttaagttctgggcctggacaagcttttgttcaatcttgagaaaacacagagataaaagttagcaaccatacatggaaacatttatggttaatgaatcagagatggaactttccagctggcctgtgcactcatttgacacacacatacacacgcaaactcacacacacaaatacataaatttaaaaagtacttctttatttgcttcaggaaaagcagattttttttaaaaaaatgtagggttcctaaagactttaaatgtctacaagttatgctatatggttttaatcagtgttgtgaaactctaataatttttttttttttttgagacagagtttcgctcttgttgcccaggctggagtgcaatggcacgatctcggctcacagcaatctctgcctcccgggttcaagtgattctcctgcctcagcctcctgagtagctgggattacaggcttgcgccgtcacacccaactaattttgtatttttagtagagacagggtttctctacgttggtcaggctggtctcgaactcccaacctcagataatacgcccgccttggcctcccaaagtgctgggattacaggagtgagccactgcgcccagcgaaactctaataagttttatcaatgtattaggtctaaagctgctctgatggtttttcccattgggcatttcagtagattcatctgtatgactcatgaatttggtgttaaggttaactagaaaagacttctgttattctctgttgcacatttgttcatctgtcttacaacatgctgaattattaatgttttggatatgtctttgatctgcttcactggtttttgaagctgtgtaatttgtttcaataaatcatttctgtaaaaataaatgggttacattggctgggaatggtggctcgtgtctgtaatcctagcactttgggaggccaagtcaggtggattgcctgagctcaggaattcgagacccacctgggcaacacagtgaaaccctttctctactaaaataccaaaaagtagccaggcatggtggtgtgtgcctgtagtcccagctactcgggaggttgaggcacaagaattgcttgaatgtgggaggcggaggttgcagtgagccaaaattgcgccactgtgctccggcctgggaaacagagtgagactctttctccaaaataaaataaaataaaataaatgggttacatcgtcttttgtaaggatttaaaaacagatttgataatattaaagagaaaaaccttattattttgacatttttttcctgtgaatcattttactgttctgtgaatatttaataaattaaataccaaaactaagtcttatttttcttttaaactcaagtgtgggccaggcgtggtggctcatgcctgtaatcccagcactttggtaggccaaggagggaggattgcttgagcccaggagttcgagaccagcctgggaaacacagcgaagccctgtctctacaaaaagtataaaaattagctgggtgtgatggtgtgtgcctatagtcccagctattgggaggcggaggtgggaggatcacctgagcccaggaggttgaggcttcagtcagtgatgataacgccactgcactccagactggttggcagagtgtctcaaaataaagaaacaaacaaacaaacaaacgagcaaacaaacccaaatgtgtttcatggaagagtttaaggctgcagtggcagcagccgggaaaatacgcctccagtgctgccatctgtctgtgtgggccggtactgctagctcatcatagcccagacagtttcaaaatccttctgaacaccacactttaccaatgaactagaaggattgtgacagatggcatgctctttgacatccttgatataataaagaaagggtcaagagcccctttcatattaagtattgcctaaagaaaaaggtggaaaaggagaaaagaacaaaaaaaggtgtggcaagataggaaaattgagagaatggtcattaaggaggagaaaaaagaaaggttctaatgggcagcgaatgaatgggactaagtgattcagtcccaatctgatgtcatcaatgtcaggatgtgcttaattttctatgagttagctgaaattcaaatatctatttattataatggctgtagaaccattacatacagcaagaacaagccaagagctattttctttcaatctcacatgaaacattcaagcaagagaatataataaaacaaacaaattcaatgtgatttttcattttcttaccgtttgctctgtttgttgaatgtcttttgctgtggttttcaccgaagcatttgacaggtcacacatggagcaaaggagatctaggtaggtccttgcctgctcttgcaaagctctgaagtgtttgacctggaaaaggcagttatcagagtgaaagagatgcatcagctatttagatagcaaatacttgtatcatttggaatattctgttgacatttcaaaaatagtcttgctatgctcagtgttttcaccattgtgttcaagtgacatatattagtgactcacaggaaaaaatttaaatcaccaatggggatttatttgtccaccatttgcttctccttgtaagtaaagtattctgtatggtctgggaaaggggaaaacgcaagaaacttctataatctttccagattatttgctcacatgccagcttattttccattccagagaaagaatttgtagcctacgctgtcctgcctcttaacatgcttttgcatatcttagagacagaaggcaaaggtccgtgagttggtaggtttcattggagtgaggttaaaacacagatgtctgggcttctttactttgcaggagattcatcttgtattattctctttccacaagcccaagaaaggcttctccaggtggatctttaatctatttatagaaacaaagaaatgtgtttctttgcagatgcgcagattctactcaggctccattttagatactgggcatagagcagcccataaagcaaaacccttgctcccagggagttgacattcttaggaaggagataaataatatataaataaacaaacttgcactgggatgtttagtagttttaaatatcatgtgggaaaatcaaggtgctaagcagatagcgtatgaggaagaaggactgccacttcagggacagtgtatctcccaggcccctctgaggaaacgacctgaatgcatggcatggcataaggtaagaacattccaggcaggtggatgtggtgggtagagagacagcaaatgcaaagccctgaggctggagcagagtgaatcaggtgtgagcagaggtcggagggtgggcgggggcaagtcatggagccccttacaaggagagctgaccatacatcccaatttgctgggttttgtctctagtctagagtttctcaactcagaactattgacagttgactccaaataattctttgttgtggggctgacttatagcttgctagaacgtcagcagcatccttcgcgtctacccacttaatgccagcagtgtccccaccactcccagttgtaacaaccaacaacgtgttcagacagtgccaaatgtcccttgtaggagcaaagtcaccatctcctccaccccagttgtgaaccactgcgctagtcccattggattatgtaaagcagactctgtcttatcaagaaggttccatttgagaaaacaaattctataatcagcctgttcataagccgtggtaagaaagttggaatttaagtgtgatgggaaaatatcgggagcatcatgatctgaaacaggctttcaaagactccctccgaacatcacgtggagaacggcttgccacaggggtggcaggcagctatggtgtccaggtgttaggctactgcagggatcagatgaaccatgaagatggcctgacagggggtggtggctgaggtagtaagaagtggttcttgattactacataaatagggataaataaggaaggcagtattgactacaagttgcagggataaagttgacttccaggattttcccaaatcatagagtcaatcatggtgcctgattttgtgactccaatctgagtatttttcctctgcactgtgtggattacctagacatgctgtgttcctgtggatataataaacacagatcaatttcccattaagtcaggagtagcaccttttcaattgaatgtacaagcgaactatggtattgtgagtcatcagccactgtgcacaagtaccacatcatgcacctatgacccagagaaagttatttgtctcaaacaacttttggatatgagaagagaataagttgtcagaatttgtattttatgaacatatttaattgaaaggaatgatggtatgatttatatagttgatctgattccgaaagcactggaagcagcatatagagtgttagtgaccacacagctgcaaacgatgtttgctaaaatcaactttacagaaaaatcttatagtactttttcccattccctaaagttcacattttatgccttctaaaaacatatagcactctgaacggaatcgaatccatgtgccattttcttgtggcagcggggagtgtattatcttcacatatgtattgagggtttattgggtttactagacgggtggtgttggggatacacactgcatcttggtaccatgcccattgtaagcggattctccagtcacatatccaagctcaccagccactaagggcctggtcaattttacatgaacacagtaagtcctcatttaatgtcgtcagcagattcttggaaaccgtgacttctttaagcaggaagttgtataatgaaacaacttttgttctcatcaatgctataacaaagctgcatattgaaggacatgacattatttgaggacctgctgtacatggttttgcttacagtttcagtttctaagacctaccgatggaattaagtgaggacttattgcacttgccaagggaaaaactaaaacaaaagaaataacaacaaaaaataaaaaataaaaaaagggaacaaaataaaaaacctttcctcctcagagtgactgtagtccaagtgtctccaccacctcgaactcccttctctggctacttccaaagaccattttgagagacatgtgaaagaggcagaaacaaggaaccatacagtcacgtaatctggaagaaggatcagtatcctcctgtgaccacggcttactctggtatgtgtaggaaatctcttcctgctctagcaaaacatcactgccattaatactttcttctccctttatctcttttatttcttttttggtaacagaggagaaagattaagtgttggtctgaattgttctgaataaagtgcattggaaacaaacagccacaagacaaggtggcttgtgggtcaaggaaactcacagtctaataaaaaagtagaatataggcagtctttaattcatttttcttgattcaaggagaactatgtttcatttgtcctgattctattcttataaagtaaaatatgaacacttttgtgaaccattgaatgacaatgtaaatcattttagcctttagaaagtatacttcgggggacaaattaactagacacattctttatgtggactcagtgatcaaatacattatgctattctaatttgtgctaaaaaattaaattattaaatactgttaattcgtatctggcagcaataacctttataactaaattcctctaaaatattttcccacggagtcaacactgcatacaaaagctgcttagtacaaaagtttaaaaaaaatatttcccacatattctgattaagtctcagcaataacattttcagcatgtggatgtcaaattaatatggaatagaattcccttcacatgataaaaactaacatttcattcatcatccattcaataattatctatgaagcaccttgtttttgccccaaaactatgcaagaagctagtattacttttctgtttataaatcacgtttatctgtagtgtgatatttgcatttcattataacttttagaagtaagtatacttataaatgtcacttttgatagtaggaaactatctcgaaggcttggagaaattaagcgacttacccatggtcccccaacagaataaatattagaattaatctttggttacagtgcccattctctttctttcgttttcttttcttttttttttttttgagacagagtctcactctggtgcccaggctggagtgcagtggcgcaatcttggctcactgcaacctccgcctccacctcccaggttcaagcaattttcgtgcttcagcttcctgaatagctaggattacaggcgcctgccaccatgcccagctaatttgtgtatttttagtagagatgaggtttcaccatgttggccaggatggtcttgcactcttgaaactgtgtggtcggcccgccttggcctctcaaagtgttgggattacaggcatgagccactatgcccggccccattctctttcttttttttttttctttttaatagtttattttcattattcttttattttattttttatttttattttttaatttttcaagacagagtcttgttctgtcaccaaagctggagtgcagtggcatgatctcggctcactgcaacctctgcctcccaggttcaagcgattctcctgcctcagcctcctcagcctcaggcgggtaggtaccctgctacctcaatcccagggtagctgggattacaggtgcacgtcaccatgcccagctaatgtttatatttttagtagagatggggtttcaccatgttggccaggctggtctcgagctcctggcctcaagtgattcgcccgttttggcctcccaaagtgctgggattgcaggcatgagccactacgcctggccccattctctttctagtctaccaagttggcccctcagtatcatgtccatcttctggctggcacatgaactccactagagccaacctcagaccttcttcctacttttagattcccaggagtcaatacagtttggcacatcataggtacttcacacattttcactgacgctctgaatgattcacaagaataacacaaactttcaggagtttactacctgcttaatggcttctgccctactaagaggtggttgaggacttggctctaaatccggctggactgcagaaagccaggcctggcactgctgcagggtgtcttgtcggctgacgtgcttctgaagttcgtgttccaaactctggtacatctgagacaatacaatcatgctgagattatgagaactgctttctacctctataaagatcattcaaattcaatgaaacatgaccagtacatctaaatggattttccccccaagattctgcaatttcatctaatatctaaggcagttgtatgtctccccagatgttgcaaaatgcaatgcctataccccagttgataacttctcggaccacacatcacagtgtaatatccggattaggggaagagaacatgagcagggtaaatataaccgtagaggcatgctagaatacataaaatcattgaagttaattgtcataaacataagtcagaggtttttgcagcttctcttcctatggtataaatattgcactttttgtttaagctagcaactaaaagtaaaaataaaaaatgatctcaaaaaaagataaccaatgtttctctaactgagatgcttctgcaatagagatagggtaaaatttgaactaaattataacatgaggagtggagaggtggatgtcctcacttcatcttagaagttatgttccagggcaaaaataatccagaataattcatacattttctgatatgtctatttaattaattaatccttaacaagccaaccaattttcattttatccataagacatattaagaaaaattatgtgtctatttgagatcaagagaaaatatatctgggatgtttccatttaggaaaaaggaaaaaagaaggaaattagtttaacctggcatttctttcattattgagacaatagaagcaatcattgaattctgcttttctctgtcatcttttaaattcatcactttcgtctgacattgggtttatcccttatttattcttattccaagcagaatttttaaaagaatggtgttttgttctctttatcacttttgcaaactttaattatgaagttctgattatgttcttagaatttcatccactttttaaattttaaaaattatgttggcttttccaacatccaccaattaaaacaaattaaactgtatccctaatacaaagaaaatgtccactgtgaaggaagacagtgtgcaagaaatctctgttgaatgagtgaacgaatgaactcaccagaaagttctatgtgtagcctcattttctctcttcactcccccttttctccccttgtcatcattttcaattatttattagattcttgtagtcctcttttgttaacctttgaaggtgatttttttttaagtctaggaagttgactaatgtcacccagaattttttttattattatggtgaacacggaccattctaaccacatcactgatgtatcaccagttctttttgttaacctttgaaggtgaatttttttttttaagtctaggaagttactaatgtcactcagaattttttttattattatggtgaacatggaccactctaaccacgtcactggtatatcatcagttcttactggctagtccagtaaacaaaaatacacagaatactaagtttaaaggcttataaaaactctttttagtgtcatttaaaaattctagaataatagaaagcaatttacctattttagtaagtttttgttaaaatagccattcttacccctcttacacttatttctaaaacattaagaattctgttttagtggaagtacacccacttaagtgtaagtcatatttgtcagttactcgtttctcaaattctatatgaatgcaaacaaatattgatttagattagaacccaggctgcatacagttaaaaagaaaataattattgtgaaaaatatgaaataaatttacttttgtgctacaaaataaatggaaaattagaaagtattgatcgtgtgcaaagaaaaacacatcctctattcaaacacatcaactatttttttcttttttaaatttcctcaaattccttttaccaacaaacaaattaactttatttatttatttttatttagacggagtctcactttgtcccccaggctggagtgcagtggcgcgatctcggctcactgcaatctctgcctcccacgttcaagcgattctgctgcctcagcctccggagtagcggggattacaggtgcttgccaccacgcccaggtaatttttgtatttttagtgaagacggggtttcaccatgttggccaggctggtctcaagctcctgacctcaagtgattcacctgctttggcctcccaaagtgctgggattataggcttgagccaccatgcccggcccaaatcaacttttaacaaaccttttcacaatcaactcatggaataaacaaattggataaaacaatatctgaaattcgctcacacctgtaatcccagcacgttgggaggcagaggtgggcggatcacgaggtcaggagatcgaaaccatcctggctaacacggtgaaaccccgtctctactaaaaatacaaaaaattagccaggcgtggtggcgggcgcctgtagtcccagctactcgggaggctgaagtaggagaatggcgtgaacctgggaggcggagcttgcagtgagccgagatcgcgccactgcactccagcctgtgcgacagagtgagactccgtctcaaacaaaacaaaacaaaacaaaaaaaccaatatctgaaattcactgcttagtcacatcaatcaaatacaaaatatgttagttttgtgttcacatagcaactgtgaaatttatcctcgtatttcctgtctggcaacacaccaaaacgaatccaaagatttgagcatcgattctatttgtaaaaagtctctagactgcacagcctctccccataattccttgtcactgtggaatgttctgggggcactcaccctctgagctgtgctgcagatcgctgagtagctgtcctttgtgccctgcagatgagcatgcacgttttgtttaagtttcgcttgcaggtggtctgcacattggccaatcaaagtatcacctttcatttgaagattgttcaaacggtcttcaaaaccagcaatttcttccatcattgcctgcaaaagtgaaaccaatacagagttttcagaattctacttttaagtaacttatccatcaaagtttaagatagattatttcactgtttaatattgtttttgaaagaatcttgcaatttaccttagttatatattaaatgaaaacaaaagcacatgtatgttttcagggatactccaagaggaagagtcaatgagtttaagagattagttacataaggaatgatgaagtaacctttaacactagaatgtgttcatggctggtctcagagagataatactccatggtattattaccagacaaaaagatgtccctatatttttcaggttaataagttataattctggcataatttttatctaaaacaatctaattactatttcatcaactttatataatatcttatttctataaggttggtgcaaaagtagttgtgttttttgtcattcttttttttttttttttaagacagagtgtcactctgctgcccaggctggagtgcagtggcgcaatttcagcttactgcaacctccacctcccaggttctagcaattctcctgcctcagcctcctgagtaggtgggatcacaggtgcccaccaccacacctggctaatttttttttttttttgtatttttagtagagatggagttttaccatgttggccagctggtcttgaactcctgacctcaagtgatctgctggcctcggcctcccaaagtgcttggattacaagtgtgagccaccacgcccggcctgttattacttttaatggcaaaaactgcaattacttttgcacgaatataataatctaattctagtttctgtaataatgtaatatctaatttttaattcttgtaatatctaacttacatctactactgtttataataatgaaaatagcatttaaacttatcatttattaagtacctgctatagtccaggaattatatataagcctgacgaatgtgtattatcattgttttatagatgaggaaactgaatcacagtgaggttgtacaacacagtcaaggtatggcacagcccccaggctttagacacagctcggcctgatttcacctcacaccaccatgtccacttgcattctttagtgagcattcttatagatgactcagggaagaataacttattttttaaaaatcacgttctggccagacgcggtggctcacgcctgtaatcccagcattttgggaggctgagactggtggatcacctgaggtcaggagttagagaccagcctggccaacatggtgtaaccctgtctctactaaaaatacaaaagttagtcgggcatggtggagggcacctataatctcagctacttgggaggctgaggcagaagaatcgcttgaacccaggaggcagaggttacagtgagctgaggttgcaccattgcactccagcctgggcaacaagagcaaaactctgtctcaaaaaaataaaataaaataaaaataaataaatacataaataaataaaatcaagttctagtgttttttttttttcctgttatatgatgctaatgacaagtgacacaatccaacatagggtagcctgggtaacccatcattatatctataggaaacctgggtggcccttcagcagtccagggtctacaaacagcgctgggctagcagttatcatatatgctcagttgaaaagaaccactctgtctctgagttggaacagaaccactccatcatgaggccattcatggggtagactaccttctggattgtcatctcctcagtgcctaccagaaggtattgtgtagctacttttttattcatatttgttaaataaaatcctttcttatagacagaaatgttgcagcccagaggggctaactggctttcctaagacgcactgtcagacactgaccacatgatgagtaaacttgttttccattaagatcacaaatcagttgctccatgaaattgtgaccataacgtctatcacgtggtaaacacgattactaaaaatacatattattaagttcttatcttgatagatttaaatagtgcttttagcctatcacctatatcaaagataagaactcctcatattagttttgtactttgtgatttacaaaatgtcttcacaaatattatctcctgtgattagcacaacaattatgagatgggctggtattgttatcatcctaaaggagaaaggacagactcagataggctaagttgtctctccaggaaggggaagagtccagcctagaatccagactttctgatgcctttggctgcattttctaaaatagattccataaagactaaattctgagataaaaattattagctgggggaaatgcagcaatgtgttcagaagttcaacgcgaggattcaactcttcttgattcacttgaatatcaagttcaattgttgtcaattgtcagaagtgcttgagactcagaccttcatatggtttggctgtctccccacccaaatctcatcttgaattcctacgtgttgtagaagggacctggtaggagataactgaatcatggggacagctctttcctgtgctgttctcatgatagcaaataagtctcatgagatctgatggttttaaaaaggggagtttccctggaaatgctctcttctgttgtctgctgccatgtgagatgtgccttaacctttcactgtgattttgaggcctccccagccacaaggaactgtaagtccaacaaacctctttcttttgtaaattgcccagtctcaggtatgtctttttcagccatgtgaaaacggactaatacagacctgattctctcagtacaatcattataaaccagagatgcacctgtgtgtgcacccccacacatgcacacacatgcacagacacatgcgtacacacactggtgaagccatcccaaaggcagccctttaaaggtcaggggtaccttgtggtgggccaattgctgggtgattgtctccaggctgcttgtctccaggaggtcaggtgccaccagtctgccagacatctgcagcagccacttttcgacctcttggagctcactgttgtagtcttcatggtctttgactttcgcctccagactgaagacatgctcctgcaaaaccaggtgtccatcagagatgactttcaagtgaaaaacctactcaaaactgttttgtattacaaaaacccagtgcaactcacagggtagttagagctacttagaaaactaccaggaatggaaaacaacatagtcattatgccaattaaatatccatctgaataaaaaaaaatactaacccgtaccaggccttaaaattacatgacagagagaaaggagtcagggcccacattttggaaaataaacccttttacggagtctttcatctctccttacctttcctatgctgcacaggtcctggtaatcactttgaagttgatctattttgtcctttaaagtgacgtcctgcaccagttccaaaagagcttcacccttctctctcactgactttactgatggttcatgggacagcaccgtttgttgaagtgacttgaattacaaagaaaaaaaaatgagcctgctcatctccgtggacaagatgaatacatacatattcccatggtatgcaagagatgatctacctcaaagaaagattgttcatatttatgaagcaataggtgcaagacattaaagagagagtgatttattaagacgaatacagtttctaaatacaacagcagagtcacacatcaaatggcccttcctatgtggagataaaaggatgggaaatagttatatttgtctaaattaaatatagtttatatttctggcttctaccttattcctttcatcagagaaaaaaaatctcaacataaaaaggccactatcttttgattttgagttcatgaagttagttccagtttgagctatttatggagttagaaagaacaattccagttgtgaccttgctgagataggctaaaggcactatttaaatctatcaagaactcagtggccaggaggaagaggttgtgattcttatatggcctcttcaaagacaagttgtcgggcttggcagagaagccaaggatagaaatagacattggctggaagaggccgtcacagaagcttccaacagggaaagctttggggtaagccagcacactgtaatccttaaaaggtatcactcaatcatccagatcaaatttataacacaaattattccacatataagcttgcataattgcttcaaaaatttgagtgggtgaagtacctgtgtctatgtcatgtatagctatagccacatcactatttattctttcaaaaatcagtttctaaggaacttagctcgagtttgttaactagaacttattttcttataaatatgatatgtcattttcaatttaccataggtcagtttctagccttaggtaccagaagatgaagggaagcctcaatatgggaaagatatgggatcctgatgccagcaagattttacctggaggatccaaatacctggctcacgcatcagaaaaggtcttcattgattgacagatacgtacaatcaataaatatattgatacaatctttgagtatcagatctctgaatgcaaaaataactctgaggtagtggatttaacccaataaatctccataggtcatggcatcactggtcagctgcagaacggacacatgcgggatgcattccagcagctgttacgggtgacacccagcaagaatcacctccctcccatttggtctctgtgtgacctctgcatgcatctgtcaatgagtaaacacactaccttgtatttagataactgagcttttttctcatataattccattttgggttcttcaggaacatgtagaatttcctggtattctgctatccactgtgtcagtgctttgcatttatctgagaattcctttgctaaatgaagacctttttccagcgtcatgtgttctttccggacagtgctggtcagttccttcaactgctccatgtgatcatgaatctcctttcttaacctctctgcctcgccttcctccaagtatttaacagccctctctcctttctcccgggctgatttcagcaaactgtgacctttctccatgtctttgagcaaaacctgaaaaagagagtgagtaggagcaaaggtagtcttgtttcttttcttttctttcttttttttttttgagatggagtttcactttgtcacccaggctagagtgcagtggcacaatcttggctcactgcaacttccgcctcctgggttccagcgattctcctgcctcagcctccaaagtagctgggactacaggtgcgtgccaccatgcccagctaatttttgtattttttagtagagacagggtttcaccatgtgggtcaggctggtcttgaacttctgacctcaagcaatccacccacctcagcctcccaaagtgctgggattacaggtgtgagccactgtgcctggccatttcttttccttttaaagaaaggtttctcaaggcctgtttttaagtccacctatttccctttaaaataagttgttgacattcataaccagatttgacgtgccaggaatcaggaaccttggcttctttatttcaatataggttctaaaagtcttgatcaatatatcatttccaaatcagagacttgaaaaagaacttgatgtttctctcatccttagcaatctccttctaaagacctgagtttaaactctttacaagcactgggccattaatttgagagagaaagttttctcttaatattgaagtgtcacactggaattcagtgaagactttcatgggtgtccatgtgtaagtcattctgataacaacacatcatcaataagtgaaagctagcttttggccttaaggagccaacttagtatttcaagtaaaatgatgagctcaggatcaccaatcataatggttgggatgatcacctgtgtttccagtatctatgcaggagaatggggcagcttggtgaacggaaaggttggatacaaatctgaagtatgcgtgcctacctccaacgtcttcaatttcttccccatcattactgtatctactttgtcaatcttggtagccacattcttgaagtttttatgagtagagccataccaatcagaataggaactgagggatgattctgattcctccaaactctgaatctcctcctccaggaattttatttgttcctatgaaagaaaagagaaaattgaatggtgaagtaaaggcctgtgccagggcctttgttgatgaatatgtatcttcactggatgttagtgaaaggaaggctattttggctggcgaagtttgctggtctatgctgagcacctggtgacccactcaccagcacttggagaagcagggcctggtatctggaagtcagctgggtggcctggcaacccattctgctgttcacgtggctctcgtccagtatctcctgagctctagctcccacttcctcaacttcatctctgtatgcagtcacttcttcgtgccacttctgaaatgacaaagtatcgaagggaaagattcaatcttagccattcgaataagccaaatgtatatcttcttataggaaatggtttcagtgtaggtttagaagatgtttattttgagatttaattttgaaaatgccatatgttatcttcataaatattatattacaacaatgtgatacaaactgtacacttgagttggatagttttctgtatctattacacttcaattcaaaaattaaaaatgaaaacaggccaggtgcggtggctcacgcctgtagtcccagctgcttgggaggctgaggcaggagaatcgcttgaacccaggctacagaggttacagtgagctgagaccgcaccactgcactccagcttgggcgacagagcaagactctgtctccaaaaaaattaaataaaataaataaacatgaaaacaaagtggcataattttttagacctcctattgtacctagatcaattttaaaatgggtggataatgaaaataaattcctaaggctcaagcattattttagatgtgtgcactaaaattgcataaaacttagaataaaactaattctcaagtactatttcaatgaactatattggagcaatttcatatcagaaccataaacttaaattattgtaatacaagcattcatgtatcttcacaaaacaaggtaatagggtatggaaagaaaatataaaatggttacattaaactaccttgtatcaaagactaatttatgaaataattgctgtaagaggaatgctccattgtgatttattttaactttctaggtaatcaaaaagattttgcaaagcctaagctttggataaaagttactaaatatcttaatgaaacaaactatgcaaggtaactgtagctttgacaaagatcaggaatctacatgagttgtaccttcatctgatgtaattgtatctccttggttgccctgttagactgacgtctggtcctgggactaactttctcctctgctgttttgagccattcatctacttgctgaaacttttgctccattagcctcaatttgttcaccacgttattgaactgagttcgagtctcggacagcctgtgctggtaagcctgccagtcttgccggagagactctaaagcccggtcctctgcctgtgggatacctgatgggatcacatcctctctggtgtgcagcactgagttcaacagggcctgcccctctgcacagtgtacctgtagctcctgcagagaaaaaggtatggctgtcactctcaatcatatttcacacttgcatgggttagcatgtcttgcccaagccaactgtgcccacttgaacttctcattagaaaaaaatgattttattattatgccctatacaaaaatatgtccctaaccatattttctccgaagtcagaaggattcctaaaactttttcaattaaaataatcaacatacacacacacacaccccaatatttttctcaatcaacagtttcccaaatttgactttttagctaacaggcaaaaacacttgtgaataaagggctattgtttaaaagaatgacctaggcttattatagctcataatctgcttaaagtgacttaagcttcttgctttgacattgaatagctcagtgctacatttgtgactgagaaagaaacaatgaaccttctgcttcctaaggaggaatcttttgccaaagctgtactctaggcattgtggtggccaagaaaatttgaaactggagagtgcagggcacacaaacttgggaaattggttcatcacacctgcccaccaggtgctctgaggtgcaaataaatttcctccaccaaagcctaaaccccaaagatttaccctacaaatttagtataaatcaagttttgaagagcatatgctattttttataggacaaaaagaatcttatatccttaaagatattggtaaaacaacatggcacacttatatttctggtgataaacataaatctatactgtcacttgatctgatcacccaaagtaaaataaatcaagtcaaatcccatcaacaatgttaaaaatatcagtatatgtagttaaaacatagtatttctcaatactatattttaaaaaccacttaagattgctaaaatatttttcttacaaaaataacattctcacatggtttcaactaatagaaaatttttcttcaaatatgatgtcacttcaagcacagtataatgtaaagacatatgcacatggaaggagaagaactatagatatacatggtaaaatattaatcaaattggcaacaaatacataaactttattctaaaattcttagactttttttcaagataattttttataattattttcctaattcaaggttggcaaactttttctatgaaaggcctgatagtaaataatttggatcttgtgggccataggtctctgttgcaatgacttaactctgccattgtagtatgaaaaaaaccacagacgatacataaataaatgggtgtggctgcattccaataatattttatttaaaaatacagacactgtggccctggacagtagttgactaatctattaatcttctcaacatcttttccatagttcataagtaaccactttatctattatccaagttaatattctattaaataaattctcatatatcccaaatttcaagtctgtattctgaaggaaaaaatagttcaatatttaaataaatatatatataatattgttaaatatataaaatctataagtaacataaatgtgtgtatataatatattaatatatattaatatattaaagatattatattaaaaatatataaactatatatatgttctatgacccaaactaggccttcaggttatacaaaataatttctgaatatgttccacattactggccaatccctacaccatgtacatgctacagaacatcaggatcctgaagaaattctgctttgtggttgcagcatcacaattctccaccactgcttcctgccactagcatcttccttcttttttaacctttgtggtggctcacaatagaaaatgtaagaattaatgcatggtgaaatcagggggaggttaggtttgcaccacacgaataccggcttaagtgaaatattttcttttgaccagagcaacagcaacatctgctggtgatgggtaactattgacttagttctacacaaaagcacagggagctcagcatttgcttaccagtgatgttggtagtgtagaactaagaagggttatgtaaagaaaatagtcaattctagtcaaataaattacaacagctaaacctgtggatcctactctttggaggcaggatggatgagacccttaagtaagctaaggaaattgtgacccttctaacttttagtatttacttacttcatgagtagaccgtatatttaaataagattttcttccatttcggttaatccttacaactctgtggatgaaattgggtcagagaagttgtctcttgcctgaagtcacctagtgttgggtcccatcaaggattagagtcccaacttcccaatcccaaccccattctcttgccattatacaatttccaagaactagtagaaaaagccagaaattttatatgtgactgataatcatgatggtccctgattttcccaccttgttcaagctgtaggtaaaacttacccaatcctgaaccaactctgatcaggactgatggcacatttgtaagttccaacacatcactggtgggacataaagtggtctcattggccttcctccatcttctgctgtttgttttgtacatggtggccccttcttggtgaacttccttgattcctacctattccttaaggtaagtttatgggcccttctttgatgctaccataagaccccttacattagtctactaatgtcctcgccatattatttataatcatctttctatgggtttgtgttcctcatcagatttcaagtttcttgaagacagaaatcatatcttaatcatctttgcctgaagtagctagcaaagtatctgtactgtattaagtatccagtaaatactgaatgagtaaataagtatatagattgtgaccactttctccaccatgtctggcatctcaccgtgaattatggcccgctggcctgggcactaacacttatttttttttacttctgtaattccttcttctagaactctgagcccgaaccggtaccatcagcaatgtggcaggttttgcttaaaactacatggttcaagatattgccactagtttgactttgtgtcaccttctaatgacttctgccgctgtcccccagatctgatgtgatcccttagggagaaacaggcaggtaagccagaaaaccccatcaattagatctccagccatttgtcagggccaccctagcagctccatgaatcccccaagtgctagtcctgtcctacctaaattgcctacaaaatgatgtcaactagcgcatactgctgaggtctcagaatgttcttgatcaaaccttatggggattgcacttaatgtgtatcaactagccactggactcaaggtttctattaacttcctattgcctaaaataataattccatattcagaatgaagattcctttgttttaggataaaggaggccttacctgaagatcacgcaatgttgtctcatgagtgtgggcatcaccttcaagaactgaatactggtcgagcttttcttgttcttgccccaaccaaacttcaaatgcctttaggtctctctgatactcttggtgcaggcggacaagtttttcagacttggttacggcttcctataattagcatttaaaataatgaagttaggaacacattactttataaagcatcagtgtgctgtaattcacttttgtaattttagaaaagtataattattgagacattagaatatgagttatttcctagaatcatgaatcttcaatatttatgtaaaaatataaaaacctaatatttcaggaataaaagtgtcattaattattttgttgaattaactacatgatctctgaacaccttataaaatgtaacaggctaagaaatgaattcactttactaatttcataaaaattcacttttgctaatgaagaaaattgaaattcttatattgtgccttaaatgaagatttggacgtactgtggattaaattttccatagtagaatgcgctctgaaaaagcatatttattttctttgtgaggactaaatgaagaatgattaatactatcagtgattatttcccaccttagaaaactctcatcatcagacataataaggcatttatgagtcttcaattgaaggtgtccagaattttttttaagttggtacctttctaggaatttttagttgaaaattatcttactttcatagctttcataatactaacaatatttgaaggtttttgattttgccagtaattcctttaaaatattaaaaattcattttgcttttgttctgttttcccaagcctgtcattcttgaacataaatgagtctttaaaggagcacagctccaaacactccccttttggtgagtctacaaggaaagtgctttgccgtaccttggccctctcttggatggctctgtatcgttcctgtagatcctggagttctagctgggtgacatagtgttctgtcatgccagcccctttgacttcgatggtctccagcaagctgctgtaactcagcacttcttcatttaataactagagagcatttaagaaaaataaagtggccattcatgcaccatcacatcaacgacactgctaaaatcaagatattttaattgtacagttgacaagtgacctcaggttatttattcgtccactcctccatcattttatctatttgacacagatatgtgtgtgaatgcatgggtgtgtgtgtgtgtgtgtgtgtgtattttatgtctggtccagaactttctctaacatatgaattaccaattaactactttatatttctactcttaacatttcaaactgattatgtccagaaatggacccctgatgttcaccctatccctattctaccccagcccccatgaagcccccttctctttccatctcttttcaaacagcaaatgccatgacctcccacccagacggtcaacccagaacatgggaattgttccagcgtcctctctagctctccgtcctctaaaccattaggaaatcctgttagctctacctcctattatactgcgacatctgtccccacatctcctgcaaactccccagcccaggctgccctcctctttcacttggactttgcagtggtatcccaggcagattcctggccaccaattctttccctgtcccttatttcatgctccacacagcagtctaagtgatataatgtcttgcaattaaaagttgaatcgtgtcgcttctcagcttaaaacctggattatcgtcccaatgctgccgggatcaagtggaaaatcctcagagcagctggcatggcaatggaggatcaggctctgtctctccatcaaactccccttgcagcccctccctgcctactctctgctgcaacaacacctgcctgtttcctcacagctccccactgcaccaggatatttccctccacagggcccgaggacctgctttttattctatccggaatgctggttcctcaactcctccccaggctcatttctctggcttaaattctttagtgcatggactatatgtctgctgtttcagagaggcctttcctgtccctctcccttggcctcaaacaagctgtatgagccttttcaaaatgattctctctcacaccacactactttttttttcttcatagtattcagcagttaaaattatttatttgtacatttattactgagtgcatgcatccccactaacatacgcttgactgtttttactgctagaatcgggcacagtccctacatgtagcaatttctcaataaatgttgattgaatagatgaacaatccaattaattaagcaattaattattataacagataatacatgcaggtatttatgaagcagataattataattatattattttatggatgcataaatgagacccagaaacattaagtaccttggcataggtcacataagatcatttagtcatttaaataacttttattcagcgtgtgttctgtgtcagacagagagccaagtgttgaggatataaagaaaattaagcatctctattcactgaaggagagggacatgcaaatatatatgaaattgataaagagctttgaaccaagggctatgagagaacagaacaatgaatcaagcctgagcggtggtggtgtagcatagctaaaatgacttcaaaattcattcagaaagataagtaggaggttgccaggggcagagacagagcaaggaccttctgtaaaaagagaagagattatgcaaagacacagaattgtgaagattgtggcatgttcaggagatagtgtgagattcagcaaggctggagagcgcaagggaggaggctgggagcatgaaggaaaggagcatggcagaggagtttatttccattcttacaaaccaggtgacggagattgagcttatcctgtagacaatgggaagccaacacaggacctcaggcaggaagtgagacattcatctttataggagataacaatagatggaggcaagaaacaaggtgaaaaattaggagtctgttccagttcaggtgaagaggatggatcagtaggacctagtgccagatgcaaagtggcaatgagaaagaaggcactgagaataatgaggtttccaatgtaatatattcagggtgaggtgatacaaatgagcaggaatagagaatgtgagaggttaaaggatttctgtgtagaagatcacaagtgctgtttaggataatggtaagggggtgatggaacaggctgaccgatgatcatgccctggagtgaggctgcagctataaaccaaaggactgtaaaacttcatgtttgaatactactgccaataagttttaagaacatgccattatttatttatttaaaaaaatctttccatgtagtactgtactaatgtaagcattatgacgaatgcacaaaagataacacaaagggatgtgataaaaaaaaaaaaaaaaggaagacttcctaatgatgagcaggctgaagacattaaaagatatttcatggtgctacattttaaatggtttgtatcataaaacatggatctacatggttttcctggaaggaaaaattttcactcactaataaagtaatcacaaatgaaagtccagtttaagaagcctttagagattatactaaaagccccaaacgtaatttgcttatgtgcactgccctagggtacacgtaatcccatttttgtctgactgtggcattctaaagaagcctgtgagaaaacacatggaatctgaaatccagctctcaccttggcttttccgagcatcgttgttttatcccgcagctccgcatgctgcctttctgattcattcaggttggcttccatactatccatccaaccggagaactgtcgaacgccatcctgataacttgtccacttggagagagctccttcgagttggctgaaagggatttgaaaggacaataaatccacattgagaatccttaggagtctaaaatgtcattgtgtctgctccatccactccagtaagcaaggggtcaagagatcaggaagaagcttgcttgggagtgagcaggctgcccagggcttaaggacactgagtccaggtctgaagggcagcctcaggaagcaaggaacatttaaacccaggccaatatgcagaaacatggaactagctatcaactcaagagtcagcggctggggggacacgagacactgggggagcctcaaaggcaaaactgagagagatcccctgagtgggtcttttctggagccaaagctctgggcagggagagaagcaacacttaactctatcaaaccgagcaggacattgagagcaggagagaaaagtaagaacagtaaccaccttacgtgagattaaatatcagaaaatcgtaatgaaataaaaggacaatatttcctgacttggtctaaatagtaaaacttaattatttattttatcgataagttaagcacttcccttgtctcaatacacatgctagttttttttttttaagacaaagtcttggccgtctcacccaggctggagtgcagtggcgcgatctcggctcactgcaagctctgcctcccgggttcacgccattctccttcctcagccgcccgagtagctgggactacatgcccccgccaccatgcccggctaatttttttgtacttttggtagagacagggtttcactgtgttagccaggatggtcttgatctcctgaccttgtgatctgcctgcctcggcctcccaaagtgctgggaatacaggcgtgagccaccacacccggcctacacatgctatattttaaatttcattaatcaggccgggcgcggtgactcacgcctgtaatcccagcactttgggaggccaaggcgggtggatcacgaggtcaggagatcaaggccatcctggctaacacagtgaaaccccgtctctactaaaaatacaaaaaattagccgggcatggtggcgggcgcctgtagtaccagctactcgagaggctgaggcaggagaatggcgtgaacccgggaggcggagctcgcagtgagccgagatcgtgccactgcactggagcctgggcgacagagcaagactccgtctcaaactaaataaataaataaataaataaataaataaataaataaataaatataaaaataaataaattccattaatcatttctgcctaattgtactaccaggttttgggtccttttgtagcagacactgtaagtgctccatccatccacacccccggatcacaccactgcagcacagtccagttggacttctaattgctcctagatctcttagcttgaagacattctctagcccctgatgtactctcagtttgagggcaatataggcacaggggagcctcaccctgaggggcagccctcaactgctcttctaattcatatgagtttgtctctaaatactccagatcccctgcccttggatgggataactggggctcacactgtataccagctcccagcattgcctgactggattaagttgcagttgctcacaacggtgggcaactcgcttgataacatacctgatatggttaagctctgtgtccccacccaaatatcatcttgaattgtagttcccataatccccacatgtcatgggagggacccaatgggaggtaattgaatcatgggggtggtttcccccatgctgttctcgtgatagtcagtgagtgttcatgagatctgatgattttataaggggcttttccccttttgctcagcacttgtctctcttgctgccatgcgaagaaggatgtgtttgcttccccttccgccacgattgtaagtttcctgaggcctccccagccatgaggaattgggagtcaattaaacctctttcctttataaattacccaatctcaggaatgtcttcctagcagagtgagaacgggctaatacaacaccctttacttactgccctccccctgcctgccatttctttcccactcctctatttgtatttcctgggtttacctcccaagtccactacttggttttaatccttatatttttacattatgaatctttttttttttgtatttttatgttagcaacaacaacaaaaagaaacatgcatttttagttatattaccacattggcacagtattcaggtcaatctaaatgtgagattacatctgccagtttcttttgttctaataagaaaaaagaaagaaaaagaaagaggaatcaagagaaaacagggggaaggaaggaagaaaggaaagggagtgagggagggaaggaggaaggaggaaggaggaaggaaggaaggaaggaaggaaggaaggaaggaaggaagggaggaaggaaaggaaagggaagggaagggaagccggccacaggaatggtctgttcagtagtattatattgatcttttagtaatagcttccccagtgcttggctgtagtttccctcaccttttacaacgaatccctgcagacaaaagggatgcccacatatccttcacactctgcagctgctgctgaatagtgggaatgccttctggagaagtattctgaaggacagattctcccctggtcactatcattttcatctgaatctctttttcctgtttgactgataatagagcctgtgaaaacacatacagaagtcctttgtcatttgtatgtttaacattgctggctttaaatattgcagagctcctaaagatcacagaataatatgcaattgtgcccagccctggagctcccagtcggctgagacagagggtggggaagtggcttgctggtgaatgccagtcaccagctacccgctggtttttactaagtggccttggtgttgaaggtctgcagtcttctctgaataatcccttccttccaatgaagttttactttactggttttaacaagggaaaaatatagtacagtagaattcatgatttctcaaaggttataggatgaagagcttataaatgttatggtctctataaccaaaaaaacccatagaaatagattatatatttcatgttcttcataagtactattctttttctatgtgagaaggaagtttcttcttttgctttttttagagacagagtctatctttctctcccaggcttcagtgcagtggtgtaatcatagttcactgcagcctcaaacccctgggatcaagcgatccttctagctcagcctccttggtagctgggactacaggcatatgctgccatggccagctaatttaaatgtttttttttttttgtaaaggtgaggtcgatgcccagcctggtgttgaactcctaggctcaagcaatcctcccacttcagcctcccaaagtgctgggattgtaagtgtaagccactgcgcccggccagaaggaagttttaattccaagttataaaactgataatgttgcctaaaagacaaagcttcatctctttttataatgtggttcttgccaacttccaaagcctcagcttcagccacccattgccaccagtttctgctgtggcaataagcaactggtagaaatttctcacacactacgctgttctttcctctggctgttcctcacacttttcccctctctgccaccattcccaagtctccacccagttatctttgccaaaataattctccctatcattcttaaaaacttggttttgcccggacgcggtggctcaccctgtaatcccagcactttgggaggccaaggtgggcaggtcacctgaggtcgggagttcgagaccagcctgaccaacatggagaaaccccgtctctactaaaaatacaaaattagccaggcgtggtggtgcatgcctgtaatcccagctacttgggaggctgaggcaggagaatcgcttgaacccaggaggcagaggttgcggtgagctgagatcacaccattgcactccagcctgggcaacaagagcaaaactccgtctaaaataaaacaaaacaaaaaccaaaaacagaacaaaaacttggtttatagcagggcgcagtggctcacacctgtaatcccagtactttgggaggccaaggcaagaagattgcttgagttcaggagttcaagaccagcctaagcaagaaggcaagactctgtcttaattttattaaaaaaaaaaatttaaaccccacacaactcgggttacctatcacacttcctaagaaatctctcccaactttcaaccccatcccttctgcacggttccactcctgtgtatgtctataacaccataaatacatctgcatctgtggttgttgtcttctatatttcgacctccaacttcagacagtaaaacccctgaggaaaaagactatgttattcacctttgattccttggtgtcaagacagagtgccggtctcctagaaggcacccagtatacaaatgaatgcagactcattattttcttcacaaatgcgaaaatgaactcataacttgggatgggaggagaattggctaaatacaggaagacaagtgagtggaaaaagatggaaaatgttttgccctataaaatgtttcctcaaaatattttcccataatgaatatgtctgtgatctcatttaaaactagcctcttaacaagtgatcacacaagtaatcacattcgggctttattttattttattttttggaaaacatccggggtcagatgattcaggaattctctggcatgtgcacccaaggcagacagcgttgcactcacaaagcatctgagatttatcatggagagaatgtgacatcatcaccccaggtggatggagacgggaaattttgagaaaaacaaattctgtaggttggagatatttctgtgtaaagatgcacacctcgagcttgagcgtcctgctgtccagcacacttttgtcggatgtcgggtggcagtatgaatccagcatgtgaatcgcatccgtcatccagtcttgtaattctttaatcccaagagagaactgattgtgttctgcaacgattctatccagtcttgacactttctcctggaaatgacagaaatggttttcgagctgtccatcccacagagacaaactgcaaagctaacagtttgtttgaaacaaaggcaatcagtcatggcttcatacgctgcacagatacgaggcaagtctggcctaaatctatgagatatgttaaagatctttctaaatcataaaactattagaataactgggtcaaaagcaaaaaaaaaagttacaattttatgcctctccaattctttatgactatcatgattattttaaatcagtaaaatttctccctaatgccttgtctgggagactggtcaaagtagtttctagttttcacatatcacattaggctcacctgacacaacaacccacatgacctacattgtagccagagttctaaaaaaaaaataatctgagatttttgtaatatctctaaattttaaaacatgggaccatacacatggttttgtttatcaattataggttatatctaacacagtgaagactttgcaagaataatctacagctctcaaaatattcatatatcgattacttttggtatctaagtaaatacaaaggaatggaaagatgttcttcattcattctaagatgattcattccttatcttaacttaggtatgtgccagattttataaaaacatccaaaataacaatcatagaataaaaatgggtgtaaacatagactatttactcccagacctaagctagtgtgactgcttcagtgatgtgtattgaagacccaaatgagcagaccctctgtaaatgcacacttacagaacagatgaggccaaattaaagactaaattataccagtgtccctatattctaacacctgaaagttaaaaacataggaaacaaaggttataagccacataaagctcaagataggtctgcaacacacagttcaaaatgggtctacgttaccatctacgtcaaaatggctgaatgttctaaatgagattgtagtaggattccatttattttcttctaagctatttgaaaagaggtttaatcagttgtctgaaccattgccaattttgagctctgctctagaatctgaactgaaactctcaatcaacacatccttgactactatataatgaatgcaaagattcagatgaattttttaaaaatatcattatatttaatctaataaaatttaaactgtttagaatccatgttttttctaaagtaatttaatctgggattatttagaacaaaaactctgggattatttagaacaaaaaaaatcatgtttatgatttgagtcttccaaatcaaagccctgggaaacatatcatttcagtattaaaaggaatatcttgtgcaataatgaagactgaaagtctcctcaatctttgaaacctccttcggccttttcagagagccacatcaagcttatgcaacaacaatgatgaactcagattgcaaggctaaggaaacagcacacacgccccttactgctgacctggagacccacactgtgggcgggtcaggatgcaatgcacaccctgcagaacctgctgcaactccaattttgcgacatcagtatcacactcacacacagcacgtgccaggcgttacctttgttaaattgcttagcgctagatactgagaagacagctgcgacactctgtgcctaaagctcttgctggcagcttgtccttcccacagctgctgagctttctctttcagcctgttgagctgaggctcgtagcagtgtatttcctcaaggacagactgaaaagcacaagcaagttactattcagaggctggggaaaagcacatcgcggacgaagctttggcccagagaacatggaaatcaacactggcaggcagtccgtgtaccctggaggctttattatctccaatctacacaccgtggagcacaaatcatggaaggaaacaaatcatacttccaaggaaagtcagaaaacataaaatccaccagaaatggggaaaaacacactatgtctcacggcagcacagtctaactcaagggtgctgagcatgcatctgtaaggtcgacagaggacggacaaagactaggtcagatggggctacggggaggcgggctcatcacctggagcttctgctgctccctcctctttgctggcagatcatagaggcgattgctgctttcatggaccatcttctcagttttactcagccagtcctggataggctcagcacttacttcaaagtccttcatttggatctttagattctgcaaggttttagatagtgtccaggacaagaaaatattttaatagcaagtccaaggtccttcacttggcattcaaagtccacccaggctgggcacagtggctcacgcctgtaatcccagcactttgggtggccgaggtgagcagatagcttgagctcaggagttcaagaccagcctaggcaacatgatgagaccccgtctctactaaaatacaaaaaattagccagccatggtgggatgtgcctgtaatctcagctactcaggagtctgaggtaggagaattgcttgaatccaggaggcagaggttgcagtgaactgagatcatgccactgcactccagcctgggtgacagagggtgactctgtctcaaaaaaaaaaaaaaaaaaaaaaaaaattccacaaaaaaaaaaccaagcccgctccaaagtctgaaacactccatcttttaccttggcacaaacacaatttttgaatatcctttaagaactttttagggttctccttttgaaaatagaatttttcccccctaactctctggcccacttctgagatcacacccatttctcaacttctagagcatttgttgtctataccatgcctatatacttcatcatagactaggttggattgtgaattttcatctgacacaggtgtgccttgtctccagaactagactgcaagctccatgaggggagggcctgggtctgacacttccggagacacaccatagtaccttacaggaatgtaaagaaatgttagtcaacatttggttgattttcattaatgagggtacaagaagtagcatatccatgtagtttatgtgattatgttgttaataaataatttattctgatttatcaagtgataagaaatactaaataatgttatgtgcttatcacataagaatgtcataatactttcacagttactatgtagtaccctaggtgtaaaatgtgtttgataaagttttatatggtactgtctaactttagcaaaggtgtctgcatctactgtctcttacttataaagtggtaggtggacgtgaatgtgaatttgttatttatgttaccctgtgagtcaactaaaggctgtaaaaacaaccagtactttaggtagtattgtccaagagggagtacataaaggttagctgaagaatctaagtggcaagagctaatgaaacttatgagagaatagttcaaggttccacctgtatctggtctgggtcgtctacaatatggggaaaatcacatctgccttactcacctctgagggatatgggttagctgtaagaatcatttgaaaagttagtatctcacaaatgtaaaataccaaaataacttctggagtattctaccaaaatttaggttgcatgaaggcagggacttggttctgttttattctctgctatagccccagagcctagactagtccttcacaaatagaagatgctcaacaaatatttgttgaataattaaattcataaattcaaggtgtttccatcttcctgttactagagcctcatggggccacttgatatggtttggctgtgtccccccccaaatctcatcttgaattgtagttcccataatccccatgtgtcttgggagggacccaatgggaggtaattgaatcatgggggtggttacccccatgttgctgttctcatgatagtgagttctcatgagatctgacagttttataatggacttttcccgctttggctcatacttctccttcctgccaccatatgaagaaggatgtatttgcttccccttctgccatgattgtaaatttcctgaggcctccccagccctgcagaattgtgagtcaattcaacctctctcctttataaattacccagtcttgggtctgtccttataacatcgtgagaatgaactaatacaccacaaaacagggcaaatgggggaccatgatcaggaatttaggttctaaaaagaaaggagatgagaggggaggggaggagaggagaggggaaagggaggggaggagaggggagaggaggggagggcaaggggaagaggaaggcagagagagaggggaggggaagggggagggggaggagaggggaaggggttggggaagggacgggtagggagagagggaggggagaggaggggaagggaagggggaagggaggagaggggaggggaaggcagggaagggaaaggaaaggataagaaaggacaggaaaggacaggacaggacaggacaggaaaggaaaggaaaggaaaggaaaggaaaggaaaggaaaggaaaggaaaggaaaggaaaggaaaggaaaggaaaggacaggacaggacaggaaaggaaaggaaaggaaaggaaaggaaaagaagagaaaggaagggaaaaaggaaaggaaagaatcaagtaaaacagatagatacctattctgaggggaacagcagattaagaaaacaggcaattcatgacctactcacctactcttgggcatctcttgaactagataaccttgtaatcaatgctaaatatgctacactcagcagctgatgcttcagagctcagaccacatagcattaacgatccctgaaggattaaagaaacatttctaggcacaatggttatcactctgttaaatggaggatgctggccacgaaaaaacagtcaccattacaaaacagagatcaatggtcttggatcaggaaataattgaggaaatacacattttctcttactgaatattatttctctatcattatctttttccaaccttcattaataatggtcacaaacaaatgaaggatctattctgccaaaaagtgttttaaaaggaaaagataccctctatgcctctaaattttcctctgaaagaagagtcgatacataaaatagatagtctcagacggaaaaaaaataattatattgtggcagtaattattttatggttataatagattcatcttctattgtgtgtggagaaaataaaattatataaacattgtttctgcatacttaatgcctaaaaacctactacctggtatttgcattagttataatatacactctcatctgcagcattttgcagcttatgtagatattcctgatcattctcctagaccaccttccagaaatgagacagttcacatgaaaggctaagtgttctgctgaaatgtaaaactggctgttcctgctgggagagtgcaaggccaagtcagtgacaatagaccctaacatgcaggaagctacttaattcttcagggaggctcccacttctagcattgggctattccttactgttagcccattgtcttcttatgttctgagaggggtaaccaaaatcattgacaagggggctttgatatacagaaactgtgatttcactaacaacaacaacaataacaaataacacagaatgcttccatgtggttggctatatatacctctagagcagattctttttggtggagatttgaatgaaaatttttccaatcttcttttgcagctgtaactttggcctggatccctttcgctttctctttggtcagcagggtactcagaagttcccctttagacagcatcatgtttagcttgtgctgtccattttcactttctgacaaaaactcctataaaagaaaatatagaattagccataatgaaaatattgtgtgttgtttctattttttcttttcttttttttttttgagatggagtctcactctgtcactcaggctggagtgcagtagtgcgatctcggctcactgcagcctccgtcttctgcgttcaagcaattctcctgcctcagcctcccaagtagctgggactacaggtgcatgctgccacacccagataatttttttgtatttttagtaaagacggggtttcaccatgttggccaggatggtcttgatctcctgaccttgtgatctgcccaccttggcatcccaaagtgctgggattacaggcgtgagccaccacacccaccttctattatttcttaataaagtcaaagaaaaggaagtaagctctttttactgtatacgttaaatgacccaggttatcctttaatagtcaagttgcaaactactttatttaccaatctaaattctgacttgtctcaaaaaggtggtgagcaatctcataaaatattaaaaatttgataaaaataatcaggagaagaaatgaagaccaagggaagataagagctgtaaaataaaataaactctggctaagactcgtttacaaaacaaatgccttgtagttccatatagttggtggagctggattatgattttggctctgaggatcctagctgccgaagtgaaagagtaaacacaaccagggacaagactcgcagagcctactggataaaaacacataatctgctcagcagaagcacaattctccctaggaaaagacagcagatgaatttccgtggggaatcttattcaaataaatgctattaaatggagcagattacattattagtagcagcttatataaaaaaataacaagagagtgtttcatagggttgtccttatgaggacaagtcaatgacctagtgccaaagtgtagtttaataaagtgtagctacagtatatacttttcctttcatgtggctagagctcaaagaatagtcttcctctagaaaaatgggtagattctgtattctacagtcgattctcaatattttcaagtgctaaagaagaaattgaaagcacaagctcaaagttatttattctgacaagaaacagaagcatagatattttgtcatagattttgattaaagaaactttgccaggacatttgtcttaatggatggccatccctgtccatggaggcatgctgtggtgggagggtcagagaaaaggccaaaggctatcctctaaaacagtactagccatgtgtggtggctcatgcctgtaatcccagcactttgagaggccgaggcgggcacatcagttgagcccaggacttcgagaccagcctgagcaacatggtgaaaccccttctctaccaaaaatacaaaagttagctgggcgtgttgacgcatgtctgtaatcccagatactcaggaggctgaggcaggaggattgcttgaacgtgggaggcagaggttgcagtgaaccaagatagggccactggactccagcctgggtgacagagtaaacacttttctcaaaaataaataaataaataaataaataaaaagaaaagaaaaatagcactgtgtttctccaatatagaaaaataggtgattgagtttctgcagttctacccaccagcctgaagcaaaacgggaagaattttacattttatttttagtttattattttattttattttattttattttattatttttgagacagagtcttgctctatagcccaggctggagtgcagtggcgcaatcttggctcactgcaatctctgcctcctgggttcaggcaattctcctgtctcagcctcccaagtagataggattacgggcgcctgccaccacgcttggctaatttttgtattttattagtagagacagggtttctccatgttggccaggctggtctcaaactcctgatcttaagtgatccacccactgtggcctcctaaagtgctgggattataggtgtgagccgccgcgcctggcttggaagaattttaaatggagcaaattttcacaggcagagttgtcctgttatattaagttattaaccaagaatttaaaaaggtgaactacatatgaacaatactgtttcagagtctgctcctactagagacacttcaagcacgagtgcttacacacagtgttctacatacctgtgccctctgaaagaaactcaaatttcataaccaatcactcagaactgctgctatgtgaaatgagcggacatacaggtacgaaaagcaatttcaataactgtgcttaaaaagtgctgctattgaatgaaggtggtatgtgaattagcaccatgaagttacagttaggttaaaaaaaaagactagaaaaataaacccaaatgaacaaacataaaatataaccgcagctctggctatcttaacacaccagctctgtgacctcactgacgcttttaccctattgtacactgacagtaacaaatttacatacctgaaatggttgttgtgaaaattaaatgagaaaatccacttaaagtgctcaggaacaatgcttgtcacatagaaaaaacgttttattatttcctggatcaccattaatatataaaaatagtgtgcatttatataaatgaactggttcctcttcatatacagaagcaattgttttaagtggggatttatttgaaatttgaatttcttacgcaaaacttttatatgttctgcccttctgaaaagatctagagaagcggtccccaacctttttggcaccagggagtggtttcagggaagacaatttttccacagatggggtggggcaggggggatggtttcgggatgaaactgttctacctcagatcatcaggcattagttagattcttagaaggagcacacagcctagttcctctgtgtgcacagttcacaatggggttcaggctcctatgagaatctgatgctaccgctgatctgacaggaggtggagctcaggcagtaacgctcattggcctgctgctcacctcctgctgtgcggcctggttcctaacaggccagggacctgtaccagtccgcggcccaggagatggggacccttgatttagaggttaactttagttcacatcagcactgctactagaattaattgataacacccttacctgtattttctgaagactagttgaaacttcacttatattttgaggtatatcaaaacacttggcggtagtgatttttgcattaaccaaccactgctggaaatccctgaaggcctttcgaaatctttgctgtaaaatctgttctttattctggcagcccttggatgcttgcaaacaaagactgaaaaggtgacgcaaaaatttaatggcaggaaaaagcgataaagttgatgaaaatcatgtttgatagaatcaccagttcttagaatgtgcacttacctcacttagtaatatatttaatgctgaactaatattattttgaaattacaccttaaaataaacttctagcttctaatttgtataaaaatatcttgaacaccaataaggttcatgctcaccaattatactctttaatcaagccagaaacttttccactgtaggtactcaggtctctggaaaatcgacaaagttcattcagctgagacttgagatcctctgttctaggctctgctttttgcaaagcatccagtatctcctgttcagaaataatgagacaaagaagcgagcacttacattgggtgatctccatatcttcacactatacatgcatcaatcatattataaattattagtgagagaagaaccaacatggtagattcaatgaagaaatgaagcctgttttcaggattcctctgacaaataatagcacctggctcatttgtcccttttttcttgccatggatagacactctagcatcaaatactgcaaagtagttaagtgattaagtggtgaaatgacttaaaaataagacaagaaaaagaaaaaatagcctacattgtctataaatagttggactaggccatcaggagatatgtatattgtttaaaggtgaaaacaaattattttaaagaaaagcaacacttattttggattaaatatatatattaagggccgggtgtggtggctcacgcctgtaattccagcactttgggaggccgaggagggtggatcacctgaggtcaggagttcgagaccagcctgaccaacatggtgaaccccatctctactgaaaatacaaaaattagccagttgtggtggtgggcgcctgtaatcccagctacttgggaggctgaggcaggagaatccctagaacctgggaggtggaggttgcagtgagccgagatcgtgccattgcactccagcctgggggacagaacgaaactccgtcttaaaaaaaaaaaaaaaaaaaaaaaaaaaaaaaaatatatatatatatatatatatatatatatatctccaaaattgaatcctgtttcaattgattttatgttgtatatacagttaacttttacattaaaaatttcttataatccatgagtctggtttaaatagtaattcatttatttcatagtttcattcataaagtcatcaaatatttgctaaatgtttaccgtgtgccaagcattttgctggattctgggacccaagtccccccacgaataaaggtaagattcttgttcttgaagagctcacaatttaatagatgagggagacacatgaatagctacattactgtgtacacccaatccaaaataaagccttaggacttgaaaagtacacctctgaaatcgaggccatggtcatctgagttacacaaggtgctttgcactcagagtgttcctctcataggattgtcacaaggaacaaatgaaatcatgaatgtcaaatacttagcacagttcctagcacactaagtgtctaattcataaaatcagaaggagaatgactcccaaatatgtaaacactgtggataacagtagcactgaagcaaaaaaacaaaataaattaaggaggaggggcaaaaagatgagtaactactcaaatagctttgctgtgaccattattgtctgatatttgtcaagagatggcccagatttgtaaagaaaccacatccctcaacaaaccagccctgtgcttcattcctcgtcctggtaaatggcaccactgtcccccgctgatgtcaatcagaagattaagcatcatccgggcctctccctttgtttcctttctcactctatgcaagagatatccaggctagcttattctgtgtcttagctcctttcatcattcccctctttgcctctgcacgttgactttcacagacccacttacatattcattatttcttttgggggtggcactacatcctcctaatctgattcctcctctctaggttcctctcttgtgttttctgattcctcaatgatcctgcatcttgatgctgttcctctacctcacctgtcaggtcacattttaattatacctcaagactcaactcaaataacaactcctttaagtaccccctgccctccttcccacctcttcgggtttctcatctgaggatacacaggaccttgcagacattcatcacaaggagtatccacattggctttatgcttgcgtatctccccacctaggctgtgattatgagagcaggaatgacattctcttggtttgtcaattctttatttaactcggtgtctgggctggaggagtctaagacatttttatttacaaaaattcatcaacaactaaacaatttctctctgaaattccaaacactaaactaggaccaactattttacaccatatggaaccttttacttaagacagaacattgtaagaactaaagaaacttagcattcaacaaaaacataaaaatactggagattcaagtcagttacttatgaatgggatgacattaaaagtgaaaagtttttgaccaaaacgttacatttaaaacatttctataacttcatcctaaagtatgtcagtagagtcaatatataaatatcagcttatgtatttctgattctgttaagttctagaatgcatctttccaccttatacagcttaagaaaattatttccaaagctaatatcccaaaggatattaagataaatgagtttcgcaaacatagtaaatagaattatttttacaatattatattatatactttatagatcatctgtttttatgttttaaagaatttcttgagtattgtcatctaattgcataaaataaatactttaattcttattgtgatcatcaacaatgacaagtcctccctaaaagcaaaacaatgccctaagaaccctagcatatttactattttgttaacattttcttacatattcattgtgatagaaatatctccacttttagataaaatgccattattagaaataaaagaaaacatgaatattgagaagcaatgtagcattgtcatcaaaagcattgaccctggagtcaaatctggaagcagacatacacagagggctgtcacatttgaactatttaacacaactgaaaacccatatttactactgcattctcatgtatatttttataggcctcaaccattatttttactaataatatcaacgtaaaaataatgaacagaatagtaatgtaatctaggcacagccaaatctttcctttttaaaaatttcactctgtgactggaatagaaagaaagggaaagaaaaaggaaccaagaaagtgtaactgattttttcatattataccatgtagagcaattatcaacttctttgtccctctgtgacagaactgatttctatgctttattctggtacataaatctaaaggacaggaaatggaacagaataacaaaaacaaacccccaaacctagaatcattataaatagagtagcataaagaggtagaaagctttattttatggcatgctgcatttgtttcaaatacttgatttaaaaccagacactgctggaaatactacatgactttcttactggcaggagctattttgaaatgattgtaatataaataggagcagagaagtttactaaatttccttttaaggacatccatgaatcagggcattataaaactggaaatattgaaaaggctttcaaagatactgtttaacagtgaaagaaacgaagaagaggttacactcttgctcattcttcggtctcccttgtaggcttccctttctcacattctaaagaagctgccattagcttcaaaaaaaaaaaaaaagtctcgggaaggtgaccagggagggtgacgtagagttctgttaacaggctaattcaagaacagctgtcaaaaccacacagaggagagctaatcggggagataactatttgctgtgctgtaggagattaccaagtgagtcttttaaggctataaattcaatcatttagttgtatgaaatagttaactggcaagaaaacagctatgactctctgtctatttatgcccctgcccacaggccatttttcagactgaatggctgaatacagtattacagactcttacaccataggaatgaaagtaaaatgtctccactaacaacaaatgtttcctaccgcaaataataacccaaatctttatttttacaaaagtttgatatataagaaaaggaaacaaatcagactttgcttatttaatgagataaatacttcttccaagtgtgcatgttgcgtgtttttagttagcaagattttttttttaaggaatgatgaaagtcaaaacattttttaaagcataaccaccaatagaaaacaggaagccaacttacttgtcctttgtgccagcattccactatctcctcatccgtgttcttgccttccaggagggttaactgctgagcccaggttttcagaagggcactgaactgttccagggcctgctccagttgagccacttggcctgagaattcctgctccgaaagggccatctggctgaccaggttctccaaacagctctgcgtttggaatacactgtcttcccactgcttccagtcggcacgcagggcctgcatctccgtgtgcatgagctcacacccactggcagttgtgttctgtttcacttcgggagccagcgactccactctgctgagacggcttgcaccaatctctctggaatctatcagctcctgtaatggaatatcaccatggtaactgaagagcctgtgagtcacttggactgcaagttttcaactgtgtacacagggggaccctgtcctgccaggaagttttaacaagtgtgccacaaggacccagaatcaattcatctgtccactcttaaattataatagcgggagttgtcatcacgagtgcctaaggcttatggcaaaaaaatcccgagaatcctcaatatcctgaaacagactaaacagagaccctgaaatcaggcattattcgcacacgtgaaaatgtttagtgactcaagtgtttgcctgtggtggattgctcctgtgaatgattaaacccatatttccctcaaagtggatgctcaagtaaataaagatcgtggcagaactgtgttctgctcacggtctctatactcaattcatcttcttcaacagggtggtggcttaaatcacacttccattctactaggaatcaagcagactcatcacagcaaaagaatgagccctactcgattccaaatacctcaatactaagtaaacatttttgtagcatataaaatgaataattcattcatagactgacttactcaaaagtttaaagtaacctctagactgagtacatttattagtatttttttaccttaaaaaagtcactagaaatttaacagtttagctatagccaagttaacaatttagctcgatcttaaagcacacaaatactgtaaaggaaaacaagataaaattaaatcacattgttaaattgatataattgcagcatttctgagaatagattctcttactaaaatttttcttggtgaaataatcatccgatgtttatatatttacatatctattgctaaaggcaggattttgttaatattattacaaaattatgactttactaccggattaaatagaaataaaagataatcaggcacaaaaatgttcaagaagaaaatcaatgaccaattagcaagtaaagaaacattggaatgttaagtatgaagcatgcttaataaattatgttaagcataaagtatgtcttaactagtctatataatatagtttgcatctcattaaattaacttgaaataaatatatctgttcataattatatacaatagagccatattttaatatagatcatttgaaagtatttagtattcagttgtgcagtagtctaaattacaatgacatgaaaacccttacacacagcatgatatgtatattcaaccttctcagcagcaggattctaaaaaccatcactgtttattagtgtgtatagtagttatttgatgaagaaaaaaatctaactttttaaccagtgctatgtctaactaatagaccttaatacttgtaattattttgcctttgtgagcaatttcaaatttgaagtttcccaaaatactctcttatgctttatcccaattttccttagcatgaaaatggaacacttcaatatttgcaatcagaaatctagtcattcagaatttgaataaggacatcatcattgtcaagagttttgaaatggcttttgcatatattttcttatcttgtatttacatttttaaacatatgatatacacatacacacatatgtacattcccgccctcacacccatatacattttgctttagagttgccttttctcagtgattattcctgtggatgtgataggtatggtgttgaaggacagaggaggtgctttatgtatttcctccaaggtttttaaaaccacccacacactaacctacattcaggctggacctgaacttctgagaggcagtttctgatagtcttcactttctccatcccaatttctttctgccaattccttctcccatattccttgtctttatggaagcactttataaaggctttctcaataaaaaagagtatttgtcaacccaggaagcagcctttgtgaaagaattatcttactttctcttatttattaactttttgaaacattagtccatttctgctatctcctcttcctcacttgccatttactcctaaatccatgtaacctggtttctcaccttcccttgctgtgcaaatgtttctcagactggttgcccaacagcctcattgtcaaacctagttgggattctttagtattcctcctaatggcagcctcctgctgtacctgtgatggcgaccaccttctctacttagagcctcagtggcatcacaccctcctactcttccccttcttgtttttcccctcctttttctctctacctttcaaatcattttctcctatggctcattaaatattggtagtacccagcttttggtcctgtgcccattgttctatttgctctatacataggtcttggttttatctgttttagtggctttaacaacaaattagacactaatcactttcaactccatgtcttctatccgtcttcttaacctgaaattcagtcttgaatttacaactgcccccaagacattactactacctggcagttcaaactggatctgatcatcaatgaacagctcatgtcttcacctctatcaccaggctcctccgcatgcaattattttcctcaggtggtaatagtcctgtggattctaggcaaagacttgaccatcatccttgactcttcccaccttgtcatgctatagcccattaatcaatcatttaccaaatccactggattttcttattgggtgtgttctatgtgccaggcatgatgctacaggttttatgtgtatgatctaatttgcttgtcaaaacaactttatcagacaggtactattttcatgtatgtattttttaaccaattgagaggtggaggcttgaggacatcaggtaacttgctgacagacacggctagaaagccaatagaaggaggatgtggcattgggtttctttgattccagagcctgaactctaatagtacagtaagctctcattacattttttgtattattttataaagaccagtttgtggatcgctgttcctcactagactgcaagttccttagggaatgcacagtcctggctgaataaatggatagatgggtagatggatagatggaaggatggatgaataaatcagaatattacgaagaaatgtatcaaagaagaattttaaagaataacacacaaaaaaaggacttaaaaagtggttttatgtgattatctcagttaaaacatacatagtcataagatttaaataagataatacttttaaagcacttagaagcagatcttcagggaccgggcaccatggctcatgcctgtaattccagcactttgggaggccaaggcaggctgatcacctgaggtcaggagtttgagatcagcctggccaacatggtgaagccccgtctctactaaaataaatacaaaagttagccagacgtggtggtcagcacctgtaatcgcagctactcgggaggctgaggcagggagaatcacttgaacccaggaggcagaggttgcagtgagccaagatcgtgccactgcactccagcctgggtgacagagcaagactccatttcaaaaaaaaaaaaaaatagatctgcaaaatgtggttacaattgtaaccatcagctataatttttatgacttttatgttctgatcttggaatcaaaacacaatctgagttttaaattcctggccacaattacactatttattcctaacatttcctcctctaaaactaaaccactgaggatttcattgctccttcattttaatgttaaaatccattttccatgggggaaaatgattacaatttaatatttaagcaactagaaatttactaaaagataccagagtctgaaactcccccagaaaggtaaatttctgttttagaaattgtccttatgcagagtaaacgagatgataattttaaggtcctttgaagtactcccttctattatgttgttggatgtcgtctagaaaagcagaacaaaacatccagaatgacattttcaggttattgttagaatacatttaactaagttactatataaacttttcttctatggtgctaaacaatagtatctggttttgtcagcccaccaaattagccatttcctagcctgtcatattacggcaacaagcacatttgcatacagaaatgtaaagacaatgttacattgtgctcataagtgtaaagtcttttgaattcttctcatgactcttgtttatgtgtagaatcagtgaggcatcaaatagaaaacaggaaggaaacattttaaataacagaatcttatctacaaaatctttatcaaaagtactcaagaaggaatgaagcaatgtagatatagcatctgttcatttcctgaccttaatttttgataactttttctgggtggctgatgaatctccagacatatctgaccaccggtgaagttcttcctttgctgaatggagccaatctgtgaactcgtggaccgcatctaaatacattagatgatctttcacaatctcttccactttcctcattttttcctagtaaacaaagaaaagactaccttaacagtggtccttttgagaacatgaactcaggtaagacaacaggcctgatagaggtctcttaacacatctcagaaaatttcattcttgttcttgaattttctctgagtttaatatcttaagaagaaactatcaaatttaactaaatgtcaaggctttggaaaagcaactattttcctgtaagtttactattttctaccttagtatggaaatcatgcttaattcatgttggctaacatccctcactaaaaatcctcttaataattattatcataaccattctaattaaagcaattatttgttagcttggtgtacagcagtctgttcagcactttaaatgcatttggtcatttaatcttcataacagtcctgtgaggaagatactattattattattatcttataggaaaagacactcaagcttagagaggttaggtaatgggtaattgtggccagtcacacattcaaaagtgtcaaagccagaattcaaacttaacgtctttttgacttgagtcatagctcttaatcattaacaagatgaaaacgaagataaacaagcacatctattaataatcataatgtcaagaagaaaagagtcagttcccaagaaggcaaaccaaagaaaagaaaaagcagcaaacaacaacaactctctcccttaatttctataatatttacaaatatgccaaagaataatcatgaaggaaatgaaagattcatatagagaattggaaagatatttttgatattatataaaggagtttatactttggaaaatagaaaccgtttttactaagatgagagatgaacacaatatttcgtacacgactgaatcttgacggtaaatagacttgcatttaatataacaaatataagtgtagcaaaagaaaaacaactttaacggcgacatttgatgtgcaaagtagagagattaactaaaaaagcggagaaagagaaaaataagcaataaagaataatcccaagattgtagaaagagaaaaatgaataggcattcatagtaagaaatgatctttatgtcatacccatttactgaatgtacaaatagttttagagcagccaattctccaacaatttaatccacagtttcttctttacctgaccttggcaacagtcattatattattaatataaatcaatatattgtattaatgtattataaagcatctactttcaatataaagcactaaccttggcaacagtcattatatcattaaactgtgttttcagctcctcttgagctgtgtccttgaaagactcatcctctgtcttttcgtagagctccctggacttcgcaattagacggtgaagggctctcgtgtgatcttctgcctcagacaggatggactggaggtggtcaagcaggacgaacttctctttcagacctggctgtggttgtaagggatgttctattttttgatccactgattccatccactgctccaactggtttttcctctctacatagtcattccattggctaatcacagactctaaagtgctagaattaatgtcacatattaacaaaaatgaattattttgacatctctactgaaaaccaatcacaaagtcgtgacatccatgccaattgttttattgaatgctactggaagtgatgaaaatgttgcttttgagtgcagggagaaacactacttctctgatccataagatccttaccacaggtcctttgaacaaagtcaatctatattaaaacatgaaataagaagttgtggtcatacatgcatctggaatttgtcttccaaatgctaactattctaaatgagcaatatacatttatatgttatgttgtttaaaatcagcatgggaacatcaatgaaattttatttcatatagatcagttcttaattttcttggaattatcaatagtttatcttattaaaatcagatggtgattatttgttgactggaattcaaaattcaaggtatccttcctgagtaaatgatctatcattaggttgattttcatttggggacacacacacacacacaatatacagtgcttttgtgtcgaatgtgtgaatgaatgctcaagtatttataagaaaaatagtcacaaatataatagctttctccatagtcaaaccaaacgctctccagactggcatttaagaaaaatccctccattattaagcattacaaactattctaaactcatctgcagtgatttccccagctccccctgcatacaagcctatgagtctgaaattaaaatcctgtggtaaatgaacttccagtatttgctcaaactgttgcttttgcatctttgcatccattgatccattggaacctcatcatgcaggctttacagtcctacctgttcctcaaataattttctaaaaagcaccccccgccttttttttttttgacagggtcttactctgtcaccaaggctgtagtgctgtggtgcaatcatatagctcattgcaatctctgtgtcctctgatcaggtgatcctcccacctcagcctcccgagtagctgggactgcaagtgtgtgccaccacgcctggctaatttttatattttgtttctctttctttgaattttgactgtgacttcagataatttttgcatattttgtagaggcatagttttgccccgttgcccagagtagtttcaaactcctaggcttaagcaatctgcctaacttggcctcccaaagtgctgggattacaggcatgagccaagactctgcattcttctacaactccacaatgtgttttgaaaatggttagtaacatagtctgagtcagagtattccaaaatacatcctgtgctggtgtctgagcttttagagggcaaaaacctttctgttttatttcattattttaatgcaataatttgaacattgctatcactcaatatgtcactgtcaaatttaatttcttgctgaaatagtggagtcaaggaccagagtctgcttcctgcatgtaacatcttattctaacatctgaaaaatatctacccatattcctatgaagttttaggaaactggcctaagccaagcctctggaagcttagttcacgctccagcagtctatgatatagagtaagacaatgatagcatctgattttttttctttgctgaccattgtgagttattactaagatgcaaaatcctgctgactttgagagtcactgcctatgctccatattaaatgaaaaaacaacaataataacaacaacaaaaaaaccctccaaattgttagttgtaaccagggatttttgttcacattgccgtggataactgtagtgttatttttgttttgctttgtaatgaacttgaattttctttaaatatttttaaaattttattgtaggttcaaaggtacgtgtgcagagttgctgtataggtaaactcgtgtcatgggggtttgctgcccagatttatttcattgcccatgtactaagcctagcatatgacagttatttttgctgctcctctccctcctcccaccttccaccctcaaggaggcaccagtgtctgttatccccttctttgtatgaactttaatcttctattcatctattttgttatgatcacattgggcacccagtgtgtcaatgatctaacaggatatataaccatcagaatatggctcttttttactgtaattcagactgatggtcatttgtccaacaaatgagccagattatttatggatactctgagaagagggaggtagggagaaatctctcacttataattacaacaaaaacactacctggtataacaatcaaggacttccctgcttcctcatcaacatctggtacagatgattttcaacagaggctctacggctgggctctattctggatggactgactcttggttgtgggagaatgttccacactttgtaggatatgagctctctgtgcctcagtcactaaatgccagggatattccctcgtcactgtgacaatcaaaaccatcctacacatttcctataatgcaaatgggcgtagtatgacttctagttgaggaatagatttacgactaagctcaacagctgccaatagcttaattttccatatgttccttaagctaaaatgtattcaagttattaaagaaccatatattcttgcttggatggcttgaaaggagatgttttgctgagcccatgtcacataagattccagaagagataataggtagatttaaatatttaaaaaatgcaagtaagaacacagaaacaaagcaataacaagcaaaaaccagtcatcgccctatggaaaacacaacttagacaaagacaggcatgcctacaagctacagtaaaatgcttgggaattccaccccaggagacctcagtactgctccatcattttactaagtcactgcattggacttaaacaaactctaaaaataggttctgtacctttgagcgtggacggaggagctcatgatgtcagcccacacttctttaagggtctctaactgagtctgaatcaccctctgaccttctttgttgctacttctcaaggcctgttcccccttgccaatggccatattcaacttaacttccccttcacctttcatcaggagaatatcctgggaaggaagaaagaatactcatcagtaggcatgtaaaaaccttcttctattttaaaaaaatggtagttttccataagaattgaagtaggaatactttacttaccttaaaatgaaaacaacaaactctgggccctattgcaatataatattgactcaaaattaggtatctgggagtctaggagtcaaagattaattccaatataaattcttagaaaactaggaccactagcctagaaagtataattttattgacttcagtttcaaagagtgaaaatacattcttttgaaaatgaagacacatctgtctaaaacccagcagtcccctacattaattggctggctaatttctctctttcaaggtcagcttcattggctatagtctgggttggtgatctcctctgagctttcaatatacccttgatggctttaatcatggcccctacacacggactgtattgaaagtaacaatttacagattggtgtcttccctagactgtgaactcctagaaaatgggtcctaacttttatctctatattcccagcaacttgcagagtgcttggagcagagtagatattcagtaacgcttgctgaatatttactaaatcaaatttaaaattatttaaagctattaaaataacattttcctcttacaaaggggaaaaatgatgcctctgtatccttttttgcccaatttctccattttgcccacacaatcctcatttagaggcttacagaacaattaggacacaacacaagcacttgtgaatctaatcaaattagcattcagcagttgtcagtgtctggctggtgtcgcatgtacctgtatttgtgacagccgtttctccagggtgtctttgctcccaagagtgctctctgcacaggccagtctgtcctgaatggccttcacccagaaccacatgctttgcagtgcttcctccagggcttcgtgctcctgaagggccacctggcagctccggagtttctctttggtcattctaagtaggttctggtggcttgtgaggagctgggaacacaggcggccctcctgcccagcaccgtggccttcttcactcagaagctgccctctctgggaaagcttatcaagagactctctgaaaaaaaggaaaaaaaaaaaaaagaaaaaaaattaattctgacatcctggagtgcaggggagtgacaaatgattgttgatattggagcagtaaccagacacaggctcatagctgacatgccttttaaataaagatgctgggaactgacctggttatttcattctcttatgatctctcctaatgttgtcagtacctatcaggggataacattcagtctgtgctgtgcctgcatccaaatagcagtggtggagcctactgtattacttactgtatttccagaaatttaattcagaaaatggtcccagctgcctcttcaggcttctccgtagcatctctgcattcctatttaatggtcagatgaggaaaagctccctgaaattctcaaaacccctgctgtcttgtatctacatggagattcctcctttatgaaaacccttctgctcagcactgttgcattcctagttgcctgttcaaagctcggcgcaggcatcacatccccaggagcatccacaccaattcagggtgggtggggattgtgggacctctttgtgccctctgctccttgtcttgctctatcgccatgtatgccgactatctcaatccaaaagcctttcactttctaaaagctagggccattatattcatcttatgttcccaagacccaacacaatattgtgcagagactaagtgcaaaaaaaaaatgttctttcgaaaagctgttgtaggagcacttatgagctttcttgttatatcttgtgtattgagctcatcttagtttggagccatgttaattagatcaaggggaaaacgtaagcactatgtggcttggttggttttattcccattttatagagttctgaattcttatctgcacatttaccaggaaaaagcccaggatatcagagggtagcatgggatgtcttaacataaactattgtgactactagaaaaagaacacaaagcaaatctctcgtggaaactgaatgtttcaaatttttttggagtggctgttatgcaaatatatcctatgggccaccctgagatctgctaagagttatacaacaagacacctactctgtaacaaacttgcacatcctgcacatgtgccctggaacttataaaataaaataaaataaaaacacctactctaaaagacatttattatacttgttatctgtttggtgagacaagaaggtggcttaagcaatgatttgagttaaataataattcaagaaaagagatttcccttcttactatgagataaattgcttaatgcatgataaaaattcaatgagtcttaagctgaggtacttttatatagggcatttccttaaaatatttcaagtagtgaaatattatggtgaaaagaaatctagaagactgggaggagcaagcagcaagccagtgagagaagtcaggtggccccgtggagaacctgaatgagcagaacagtgtgttaggattgtctgcagaagtggccaggatggagagaaagcacccagaaacaagcacactaagatctcttagcatctggtcctggaatatcagactgaaactgcaagaaggattgcatgcttatcaatgcgaaaaagtcgcaattattagaaaaacaatgaggaacataaaagaccttgaatttggtgttgaagtatatttgggccactttctctaacgcagttttggtgtaatgatggcaggagaagcagatacagaggaaggtaatgagcagcctgtagagacgaaataaaagctgagactatggaaaaccatttaaaacatctggaagaagggaagtaggtctgggtgtgttatattgtatctagacacgagtcaacatttaaaaagcaaaatttaagtgcaatgtagttttcagaaagttatatggttgcaatgatgctagtattctgttaattcagcaaacattttctattttctggcactatactagataatgaacagaaatgatatagatcttaagtcactgatcttgagaaactcatagctggaaattggggttcatagagtaaatgaagagcttacactatagtaagggctcatagagatgttccaatgtatttcagggacaatttatagcagtcatcaaactagcataccaacaagtagttatcagcatgggttcttttgtgcatttgtttgtatgtttgtttttcaagacaaggaatactgggcatgtttgactaaaaagaggactcagtggaaacagaaaatgactatgatctgaattctggaatttctttttttatttttattttactttaagttctgggatacatgtgcagaatgtgcaggtttgttacataggtatacaagtgccatggtggtttgctgcacccatcaacctgtcatctacattaggtatttctcttaatgctatccttcccctaagcccccatcccctgacaggtcccgttgtgtgatgttcccctccctgtgtccatgtgttctcattgtttaactcccacttatgagtgagaacatgcggtgtttggttttctgttcctgtattagtttgctgagaatgatggtttccagcttcatctatgtccctgcaaaggacatgaaactcatcctttttatggctgcatagtattccatggtgtatttgtgccacattttctttatccagtctatcactgatgggcatttgggttggttccaagtctttgctattgtgaacagtgctgcagtaaacatacatgtgcatgtgtctttatagtagaatgatttctaatatgattgtttctgacttatttgataaagtagagtgggtgctatcctcttctgcttcttatgtagatgcactggctctttaagaggacaggtaatgagcccaaggagccaaagccaagctgcacttccctgtggaaagtatcctatcttccaaaggagagcaagcaaatgaaaatgccaggggtggagcacaaatttgggagcaaagccctcaatgtagggtcaaaagcacagatcagggaactttgcctgggaaaggagccagaaacgttttctcagtgggaagcaatgaagaaataaatactgtagttgggaacagggaccacaaagaaagtcagacttgaccataccttttactttattaagattacaaggatgggtgggtgggaaatggaactggaagctgaaatgtgtgaataacatatggaaattgacatatacagtactcttttttttttctttttcctttttttttttttttgagatggagtctcactctgtcacccaggctggagtgcagtggcatgatctcggctcactgcaacctttgcctcccggattcaagcaattctgcctcagcctcccgggtagctggaattacaggtgccctccaccacgcccagctaatttttgtatttttagtagagacagggtttcaccatgttggccaggctggtctcgaacttctgacctcaggtgatctgcctgcctcggcctcccaaagtgctgggattataggcgtgagccaccgcacctggcaagcactctttttttcttttttttatctttacagtcactgtgaatttgtggttttctttccttcatatcagcttcacattatgttaattgatcctcaaaataacctcagagaggaaagtacagtattattaacacaatgtttaaaggctaaaatcaagagcaacaggagataagtgacctgcccaatttcttgaacaaacaggaggtggatctggaatgcagatgagcttcttacttccatcctgcactctcaccagaatactgcactgctgcaaagagtgcagcatagtcctctgtattccagacattcaaggacagcacaaaccactacccacaaaccaactaactaaccaatcaaaaccaaaccaaccaaccaaccaactagtctaaaacatggtaagaggtaaaggacctgttccatttctggaccataccttgcagccagcagttctcccaaaaacatttcaactttatgaacttcatttttcttctcaggaatgtgctgtttactctctcccaagttttccgtattgaacctttcttccatttcatggatccataagttcagttttctgtgctgatcttcaaagctaagggaaagaaaatgccttagagaaattcttacatgcttgttatgataaattacttttaatagctgaggtcacaatgtcttttaaatggcaattaagacctcatgaatgttcaagtgacaaaaacaaaacaaaacttaacaactaacccacccaaattatcacttattttaataacaaagtgaaaatcatgacaatttcttttgagatccaagcaggaaaagaatcatctcacctagctgaactgatttcatagctggtaattgccaacaagatcacattcccacgtcaatgagcacttaattttgtgtcttactacgaagacccctgaattggggccaatggatatgaattgatttcatagctggtaattgccaacaagattacattctcatgtcaatgtgcactttaattttgtgacttactacaaagacccttgagttggggccagtgaataagtagggcagtggagtccctgggaagagaagggaaagtggcctctgtgtctttgtttcttaagggattttcaaatatatctcaagagctctaagttttggaaacaatgtaagctctccaagaaagctgggcaagagtcaggcaaattattctgccatcagaaagacaatttgattctactgacatcttttctcaccctagtcataggtggctctttctccccttctaatcgtatattcaccatatattacttattggaatctagatccacagaattcaatcattgttttctgctatgactctatcccaaatgaagtggatacaaggaaaaaccttgtataatctaaaaattgaggtgtcagaactttatatattggtgaaccaaataaaaattatatgcatttatataattttcagttactagtaaatatagtttgttttctctatattaaaaaaagccaagtcataacttcagagtccgaaaaattgattattgccctagtatcacctgtatttatgatcaaagcttattataatttaaactcacagtgtcaaacgttatttatttattcacatgactcttttctctaagcctttaaaaacacacttggtgtatgatgaaatctatgtttgttaaactaacctaccttccaagttctgaagcacagtcttgaagagcctgcttatctttaaggcattgtttcagaaatgcttgaaactcttcattggcctttgtgatttgttcttgaatgctactgacaatttgtttagacaaatgtgcatacaaagtttgtccttcttgagtcactgcatcaagtttgctctgcccatcactgactgagtccaaaatgttctgtttcaggaaataaaggtaataggtccatgggactatgcattacaattgtgagctgaagtagtaaagcaggagaagaaaaacagagtccaaaggaaaatggcttaacaaggctggagtaaaaatgatgcatacaattgggcacaaccaaggctcctcattgagaatggtgtcagccagccactggaaccactgaggacaaagtgtaaacaaggctgagctggaaccgaggacgttctcaccaaggtcttgttctcagtctctccccattctcactgtcccaacatggtccaggtccaccatctctcagggttcatgtgagatcctctacctggttagctgcctccagcccctcccctgatccaccctgcatgcgaaatcctcaggccctttcttttcctggtctgcatctctttcttggaaaatctatgcttggacagggctttgacaaagcaaaagaattccagagtccaggcctagccctgcctctccccagagctctagagtggtatgtcacctgttactcaggcatttccttgtggcgtttgctacacctcaagcttaaaaggagacaattctacatctgaattctccacacctcctgcaaaaccagcttcctttactataacgatctttctatcgttaacttctaatctaatgaattttcaacatcatttttatcccccattaggccacaaaatcctcatggttctcattagcttttaaaaatgatttattttggccgggcatggtggctcatgtttgtaactagcactttgagaggccaaggcgggtggatcacctgaggtcaggagtttgagaccagcctggcctacatggtgaaacctcgtctctactaaaaatacaaaaattagctgggcatggtggcacacacctgtaatcccagctacttgggaggctgaggcaggagaatcacttgaacccaggaggtggaggttgcagtaagctgaaatcatgccactgcactccagcctgggtgacagagcaagactccatctcaaaaaaaaaaaaaaagaaaaaggttactttttagaatacttaacatagtgctttactcggattagctgcttgacaagcttggccaaaacctaacttgagcctattcttctgtaaatcatttcttaactctacttcaccatggccttctccttcctaagctcatacattttcagtcagtaaaacctataaaacctgtaatatctattattttagtttgaatatctcctatctctaactatagaccataaattactaaaaaacacaaaccatgtcttcttctttttaaaactcctccacaatagtcatataatacagatacaattattatactcttattgttataaaaattaaaactaggtttagtttagaatgaatttcaaagaattgtcaataggctaaaaaaagagaggaaagggatctggaaattctgtagccccaacttgtttctcaacatacttatcatgttgtctatttccttctgactcaatcagcctaattctgttagggacgaggaaaagattggctcagataagatttgggaaatgagataacttaggtctgcctgcaggcacctgagtacattttggggaagaaggaaaaggatgtcagcttctatacctgaagatcatggagctttgcttctagaactttgctgtcaccggtgcgatctgatgattcttttgctgctgcctttgctcccaaaaaccattcttggaattcctgcatagactcttttgaaagaaaaaataaataaataaaaataaaaaatcagaagcaaatccaaaacattgaatgggctcccaggattaccacatgaattatttctggcctttagctcatctcctcttgccttacaaaatattccacaaagaaaataataatatataaagtaatacagtatgatctacagccatgaatgttcatggtagaattgagaagttatctcagaggaaagactaaaaagaaatgtatgttcctggaatgtctaatatcctgttgtgttttctctttgggtcaagaaaaataattaattgcctgaatatgtaaaaagtgcaaggagagaaatgctccagggacattaaagccattttgatggcacagggaggaaccacctcctcttttggggagtcatggtggatccatgtcaggcacagctgtgtggaaagcagaggcagggccacaggatgggcaatttcctggaccctatggctgccctgtttcatggcttctaccaacatctaagtttattgtgtcacttcatcatagcataaaaaatttcagcagttgtttggacagtggctgctggccacttgagcagtggaagtaattttccacacacatgagctatatatagaaaatgcagatgaaattcagaatcatcaagatggtgaactcttgctttcttgggaaaaagaggaaaaagaaagaaaaaattctgcatagggtgagagcctccagcacagcacttctattgctcaaatcgcaaagcacaaacaaatttgaaatgacaccctggaaagtttcctcaaacttttgctggcagtttctaggcagcatttggtttggattctttctcggaaacaaactactcatgctaaggcccctcagaactcaccactgaagtgtttttccagagattcctgcaggctggcctgggttttggagcacaactggctcacggcttcatgtttctttatcagaccagtcattgcacggcccaggctctccaactcagctgagtggtacttgcggcacaagctattgagattttcttgggtagagctgatgttgctttgttgactttgaagttctttttgtatatcctacagaataaaagtatattatgaaggatattcataacttgagagaaatactccatttacttcactatggtactgttttacaatctgaaattgacattgttgaatccactccatggtgtatacattttggtgcgtttttgagtacttgtactagatctgtactgattctttcagaattttgcccagttctccttgggaacaaacagctgttgggaagtagttaggaggtgaggtataatttagcatttcaagcaaactgaataggtccttatagattccagtccatgatcttgggtttagtcaattgattagagaccatcgcagttcacattcttcaatgagacacttgaactttgtttcagagtcacgtgctcaccaaaagcaccagtagttaatttaaaaaaaaaaaaggaaaaaagacctcagtttctagtacagtaaggaaatatgctaaaagagaacaaattgcatttgttgaaaagtcaactcagtgcttgtcctttacagatagctaattaggaatgttatctattaatatggataggaaacatgaaaatgggccaggtgtggtggctcacacctgtaatcccaacactttgggaggctgaggccagtggatcatttgaggtcaggagttcgagaccagcctggccaacatgatgaaacccatctctactaaaaatacaaaacttagctgggcatggtggtgggtgcctgtagttccaactattggggagactgtggtagaagaatcacttcaacctgggaggggaggttgcagtgagcccagattgtgccactgcactccagcctgggtgacagagtgagattccatctcaaaaaataaaaataaaaaaatagaaaacatggaaatagaatgttttctcaacttcttctttttcaaaaaatatacattatctggatgaaagaagtcacagtgaccaataaatataattaagtgatgaaaaactattggatactcaagtttgaaaatttgtggaagtcacatagttcttccagaggctccacccttttataaaaaagaaaaaaaaactttgaacaagcatagactctgagcaggcactacagcaacacatgctttctattttcaaggtattcatttttgatttctgaacacctgcacccagttcttcacgtgttgcttactttgctgtgttcaatgtcataaataagttggtctggtgttcatatgggtaactgagagcagaggttatattttttattatagtcaccacaaaacagaactacaatcaccatttgaatggaagcacttaatgatagtttattacctaccttgacttttttcaatgcttcacaagtctcattttgggcacagttcatcaacgattcttccacttttgtgaaccatgttgttatgtcattaataaacttctccacttgtgtactttgagccgtgaaatccttcagggttccttttgctacttcagttatttctttggcatgctccagtttctgcattaagtctgcttctataaactaaatatcaagcaagatttcatcaatatctctgaagaccagaagaatactcattcagtagaaattctgttcacgtgcagcttaattgtcaaagccacacaagtctcatcatggaagccagctccaatgttaatatgcctttccaagaaggaaaatcagtggacacagttgccaaacacatgaagtgatgggcaaatagaaagaggaaggattgtgttaacactgggtgggagagtggaagctctaactgaggttccagggaagatgtgagagggcattctgaaagtagagctagacctacccagaattcccaggtggtgaccaaaaatctgctcttgattctccctggaaatacccattgtctgctcagatgtaacactatctggggcaaacatcactgtaggattttatcataaaacaattttatttttgtccccactgttgctttaaaatattgagtggggctagttattctcttttccctggatgatatagctgaggagggtcgacttctatggccccctagttagtcaaaggacatatagtcactatacattgaaaaacaatctcaattccacaattcaaacatcctggcctatttggtaatgaaaactttgaacttaacttaaattgaaggcttctattcttacccccacctcagatctgctgggagcaggagaccaacagtgtggaagggagtaaatatctttctttctcttccttcattttatttctattctgccaccctgtgtaaggcttctttctcccataggctcagactggcaggaggcgggtgaggcattctgactcactggatgggcatctgtgccctctaggccaggcaaggtttagcattcattcctcctcccataggccttggtcttgtgtttttctgacttttttcatgcttggacttcccagtgaagttccctagacacgacagtgcgctgttctttggctctttactttctcattcctcagcctggaggcctttctttaacttctcattgctaaggtctgtttatcctccagatagccttcttaggccacctataatatcctcatatggtggtctcttcctttcttttcctctcctggttcatatttgggccagagtgacctctggcatttacctccaactaactttgaggtgcaggaccccacaagccatcatttatcctttggcaaatatagcagcagttagccagcctgtctgtcacttttaggattctttgggggatagagatcagactcccatgcctgccaaatgcaggggacaaatatcctgttcttcaggtggcactgccggaacccttctgccttgaggtaaggtaagccaccccctcacctcttccttgagtatacataggggtgcatgtatgtgcacacgtgtgtgtgtgtgtgagagagagaaagacagagagagagagaaacagagagagagagagagagaaaggaagaaagagaagactagagtacaccaataactctctgaagatcctgctcaactctgtaaaagtccaactgttaaccattgatatccccaacacaggcggcatgcataaggactctttatcttttttgcatatggatagcacctcctttgtgtcttcttacttcacacgaaacttctagcattcctgtgcatgtatatcatccctaatggtactgctgaacaagcagtctcaggtcagagcaaaagcataactgatcaactagattgattgcttagcccaaagtagcaaatcaaagagaaagcacaagaagaagaaaggaaatgtagagaaaatcaacagaagcagcaacacatatggaagctaaagggatgcagcagaaacctgagcctggagccagtggggctgccagccaaaagagacccaccatgctggatgcttccagggcttgggcactgaagtagcccaggtgttctgaccagtgctgatctaccctggcctgcttcatggttcccgtggatttgtgccatctgaagggccgtgaagggaggtttatagtggtgatccctctaaacccagttattcagtaacagcattaggaaaatatcaataagaacatcaacattcataagaagggtttctaggctgggcgcagtggctcacacctgtaatcccagcactttgggaggctgaggcaggcagattgcatgagctcaggagtacaagaccagccttggcaacatggcaaaacctcctgtctacaaaaaatttaaaaaattagcctgccatggtggcacgtgcctgtagtctcagctaccagggaggctgaggtgggagaattgcttgagcttgggaggcagaggttgcagtaagccgagattgcaccactgcactccaccctgggtgacagagtgagaccctgtctcaataaacaaacaaacaaccaacatcaaaaacaccaaaaaaagagggggttctgttcctgtctagacatgaaatggtccatgaggcaacttggctgaaatgcttccgaaattcagtaggcaaaaaaagaactacccttattataatattcgagttggaaatatgctattaatactggctgaaggaatgtggaaatatattaatattttgactcccatgtctgatacaatccacatgtttccttggaattatggtgatgatgataacatcgaggacatataaaggagatatacatatatatgatatatatatatgagatacatatatagatgtatatgagatatatgtatcagatatagatatatacgagatatagatatatgagatatatatatatacacacacacacacacacacagagacagagaaagtctagtatatggtagtaattacaaaatggatggaagtctagtagttattacaaaatgcttacctgaaggtctggcggtgtttctagatttttagttaattctttcagatcattaactttggaatgcagttcttccaatctcaatgctttgtttttaacttcagactgccaaaagggaagaaacataactaatcaaaaacactgacatgctatatttggcatttaataatttcaagaagagctaactttgtcgaaataccccaactttaagccagtgtaaaaaaaaatctgtttcatttttctgagggctgttatgatgtacaaacgtggaaaatgttacaattaatgttcactgggaatgtgaaggagtgtgcagaactttgtttttctccactcctttgtattaggaaaaaaaaacctcctggaaaaaaattaaacactgacccaaagtcttgagtcagtggggattttcaataggctaactgtcatttattcattaactttaatattactggttactatggcagcatgaaactcttgaagaagcatttcaaagcaagtacacatcaggagtgcctagttattatagactatgtgtaatatgaatgaatcgtttcaaataaaaatttaaaggatattaaagcagaaacagattcattacgatattgatacataatattttgcctttttttgcaccaacagtaacataaagaagaggaaagaagatcaaagaattatgaaacaaatgagatgcttgtaaacttcattagttatatgaaaccacaaaggggcatttaataaactattcctctcaaaaatggtattttggtgctttgtggacactagcaaacctcctgatgccttcaattcagaaaggaatttccttactggaagacgtgatgagctgtcagggcctctggctttctccagaagctggccgagcaactgaggaatcttgctacttacctacactcactatactgcagcgggaatggccctgtgggcactgggctgaatctgattcactgattttattagctagtgtgtcacacagacagtgggtaacataaagaacccatctctgtgagtaactgaacctggtcatatctaatgtggctcggaagcatattgaatcattggatttctgaggtcaatagtagttgattactttaacaactccctctcaacctcctacaaagagccctgatttgtagcatttaccaccatggtaagctacaacatgacgtcacagaacatggagttgaagacatacacagcagtacattgttctaaattatttcaaccatgatacaatagatgtcaataactcaaaggcctacgtaacagtagtgatatgtagaagaataatgaaaagtgatatgtttttagttgtcattacctttgaattcaatggaacttattttgtaaatttagttacaatttaagttttaataatggttgtttttaacagtggctcccaaaattcctgaacatttaacaattgacttttgcaagctggtataagctggatccagcacaggtcactttggagctgtaatgttagtttagcaccagagataacagctgaggacactgcggtatccatcacccctgcctgtacttttagtctggataattttttctccttctgattgccctcagagattggaattagataataaaacatttagaatgttctttggatcagagacaaataagttaggtaatgcaattcattcatgtatatttttctggaccaaagtcactatctccttactctatttctctttaccctactccacttttatcatagcccaattactacttgatattttatatataatatatattgtaatataaataatgcaaatcccacgagggtaggactttctgtttttccattatattttcaatgtctaaaacagtgcctgacatatcttaggtgctcattaaaaatttgaagaatgattaacaaatgattgcaagaaataggaataaaaaggtttaaagtgaattggtgactagaactttaaaaggtcagggactctttgtggaagcctgtgaccctccaatctccaattttcttccatttttgaaaaggaagtggaagaaccccactacctggcataataagagcacatggtaaggactcagtgagcagtttgggatttttttgaataaggaaaaatagatactaaacattactaaattacaaacacttccaatttggttttgaagtagaaggatgccatatcccccgaagaatgggaacaattaacttttacttttctactaatgatttaaagagccctaaataagcatagataaaaatgcaaaaaaaaaaaaacccttttattcataacctgttcaaattaaatagcaaaagatagttaagagttctctaatgctcttctatgtctctaaaaagaagaataaggtctggaacagtggctcacacctgtaatcacagcacttcaggaggctgaggtgggcagatcacctgaggtcaagagttcaagaccagcctgaccaacatggtgaaatcccatctctactaaaaatacaaaaattagccaggtctggtggtgcatgcctgtaatcccagctactcaggaggctgaggcaggagaatcgcttgaacccaggaggtggaggttgcagtgagccgagatctggagcaccactgtactccagtctgggtgacagagcaaaactttgcctaaaataataataatataataataaaataaaataaaaaataaaagttaaaagaagaataaacttttaagaaagactttttttttttttcatattctggtcaacaatatgccaccagctgccatatgtcaacacagtcaatttacctcaaattctttaagcagttcttcagctctgaggtggttatccaggttgctgatgttttctgccatctgtggaacgcagttgtttgaccatccctcaatctcatctctagttgacagtacatcatcccaaatggacaggcttactctcagcctatccatgttttcttcaagtttctctgatacctaggagagaaacagaagccatggcattcatagtcagaggcgtaagatgatcatcccccaaccaaagtaccaatgcttcttttatcagaaaagtatattctgacggacaaacagttccacaaaaattattgtaatctaataagtgcacccaactcacgtaaatgctaaccaatacatagattgcttctgtcattgggagagttgtttgaatttctgagacattgcattttcatttgtaaattgggatactaacaacaacaggtccattggaatctactataactcaatataaggttgaattctacaggacaaaggtccatcaagaacagtgttgtatttatttttgaaagcattaacaataagcatttttatttctaatgctgaggtataattagcattaattagattcaaacatatttataacataacgcatatgaaagcaaccaattttgcacattaaaataaaatagtattgcttatcactcttcctataatgatatgcactaaaatcccaaaagctataaataaaacaaaaatagcatgttaaaaaaaataaaagaatgttctttttttttttttttttgagacggaatctcactctgtttcccaggctagagcgcagtggtgcgatctcagctcactgcaacctccgcctcccgggttccagcaattctcccacctcagcctccacagtagctaggattacaggcgctcgccaccacgcccggctaattttttgtatttttagtagagatggggtttcaccatgttagccaggctggtctcgaactcctgacctgaagtgatctgcccacctcggtctcccaaagtgctgcgattacaggtgtgagccaccacgcccagccaaagaatgttcttttaaaagtggaagcatgtagggttttctgcagtccccaaattattttattatattacacaaatatcaaagtctaactggtaaatttagcttaagtaggggaaccactgtacatctgaaactagattttgatagaaggagggcaacagaatcactgaattttttagctggaaggtaatgtaaaatatttatggcttgatatctatatttccagaaaaatcaagtgacttgttctgtggtcacgtagctagtaagtgacagaacaagaactaaaacccaaagatgtaaattacaagtgcaatgttttccaatgcaaaattatagccttattacttaaaattattatatgttatggtgtaatattctatagaatgttcataaattcttcttttttatctataatttcatagtttgggaaagaaaaacattcagagttataacttgttatgactgaggctatcaagtgaaattcccaaaagtctgagaataagtttttacaaagcagatacatattttattatttctaaactttatgtgagcacggtttttcctcagactctcattttgcatttagtactaaatgttaaaagtaaaattcagctgggtgcggtggctcacaaatgtaatcccagcactttgggaggccaaggcaggcagatctcctgagatcaggagttcgagaccagcctgaccaacatggagaaaccccgtctctactaaaaacacaaaattagctgggcatggtggcgcatgcctgtaatcccagctactctcaggggctgaggcaggagaatcgcttgaagccagaaggcagaggttgcggtgagctgagattgcgccattgcactccagcctgggcaacaagagtgaaactctgtctccaaaaaaaaaaaaaaaagtgaaattcacatccttgaataacgctttgtccaaaaatttgattggggaatgtgaatatttaaatagttcacagaatcccaggtgattatcttacatccagccatttgtccacggtgctctccatgtctgttttcaccaagctgaaatcactactgtgaattttcttcagctcagataacaagtgttttcctttgctggtaaagttatccaagtctttctgtttgtaattcattttgttcttggcagtttcatgctgtggataaatgatttcttaattaataaaatagtcagtgataagtcatgagtttaaaaccatttgtctctaagaaatttaattcataattgaccttatgcagaaattagtgatagtgagattaattaactatatgaatatatataacaccattttcttgaattgctagaatcctagaatgtcagcattcctaggggaaaaaaagttgagctcattagcatgaattacccacatctaagtatactgataagaatagtgcagataactgctttatgagtaaaaaccagatctactaaagcagaataccaacataaacacattttgaattttaccttggaaaaagcccatttaagatcctcctgatcttttatggtagttctggttacaatcacactgctggcattttctaagactttagatacagctgatttcaggttctgatattctctcattaagtcaataagtccacagcactgaccctgactgtaatgattaaagaaaatatattatttggtgtcatgtatcaggaaaagggagagttgcctgcaattggacttgatgtttcactacgtaaaggtattaatactcatagacggattcctacatactgtcctcaaactagtgctgctggttaatcctacttactccaatgtctaaaatattctccgtgaatgaggtatgcacgcaaccactgaaacaaaatctatgaactcaatgaccattgaaacaaaatctatgaactcaatgacaaagaagcaatatatgttcttgccaactcaaacttacatagatgagtcatccaaatatatatatttttaattgtctttttccatgttgttttaattatttcataatggcatatgttgtgtgaaagaaaacaacaataaaacaaaacatagcccaaaactaacaaataaaaagattactcaataattaaagtatatatcagattttctcttccatctcaatgtaataaattctcattggatatgactaccctgaagactgtcaaaaggagaagatagctgttgtttataaaaataaggtagtctgcaatcctatcagcctgaatgcactttctctcatttgatcttgtgaaggtaagcagggtccagcctggttagtacttggatgggagaccctctgggaatattggaagctgtaggcttttttttttttttaaacaaacaaacaaacacacacacacacacacaaacaaaaaacagctgggcgccatggatgatgcctgtaatcctagcactttgcgagtgctcaaggcaggctgatcacttgaggccaggagttcgagaccagcctggccaacagggcaaaatattgtctctactaaaaatgcaaaaatcagcctggcttggtggcgcatgcctgtaatcctacttaggaggctaaggcatgagaaaggcttgaactcgggtggtagaggttgcagtgagccaagatcacaccactgtgctccagcctgggcgatagagggagactatctcataaaagaaacaacaacaaaagaataaaatgcctttgagcaagcaagtttacatctagagattttccaaagaaataaaattatgtgcactaagatttaggtaaagtgatattcttcataccattatttgtaataggagaaaatatagaaataaccaaaatgttaaaaacaggtcaataattaaataaatccagatatattcttatgataggacactgtgcaacctctaagaaatcacaatgtaggataatgtttaataatatggaataaagtttgcacaacatgattcaatttaaaatgcctacagaaatagtctacattatataatgtgctccgaattttgtttaataggtctttgtacatgatgtaaaatatatgttgagggtcattttttaaaatgcatatgaatgtccaattgttctagtaccatttattgaaaatattattctttctccaccgaactttctttatatctttgtcaaaacaattgactgtatatgtctgggtctatttctggactgtgttccactcgtttatatgtttatccttcagcctgtaccacactgaaactagctagtataagtcctccaatcctttttcatttgttatttatttatttacttacttatttattttaggtaccagagctgccagcaaagtcctccaattctttttgaaaactgtactggctattctagtaggtcttgtgcttttatgtatacattttaaaatcatcttgtcaatttctacaaaaagtctgtgggcgttttgattgggattgtataaaaagacctcaataacaaaaaaaatcacccaaatcggccaacttgaatatttaaaaagacatacagattgcaaataacttaacaaaatatgttcaacgtcagtcatcagggatatacaaattaaaaacaaaatgtgccaattctgagcacagtgcctatgagttagttagtcctgctccacaaggagcacttaaagtcacacacacacacacacacccccacacacacacacacagagatggctctacacatctagcagaatgtcaaccaagcaaataaacaaaaatgtcacaataccaagtgttagaaattatgtggagcaactggaaatcttacacaagactggtgtgagtgcaaaatggtgcaactacttcgaaaaatagtttggcaggttcttataaagttaaacatatattttgctatacaatccagagtctcacttttagattatttacccaaatgaaataaaaacttacgtacatgcaaaaacttgaatgtgaatgtttataaatactttatttataatcatccaaactggaaagaacccaattgtccatcaactagtaaatgaataaactgtagtacacccattcagtggaatatccagctataaaaaatgaatgaactggatgggtgcggtggctcacacctgtaatcctagcactttgggaggctgaggcaggtggatcatgaggtcaggagatcgagaccatcctggctaacacggtgaaaccccatctctactaaaaatacaaaaaaaaattagctgggtgtggtggcgggcacctgctatcccagctactcgggaggctgaggcaggagaatggcgtgaacctgggaggtggagcttgcagcgagcagagatagcgccaccgcactccagcctgggcgacagagcgagactccgtctcaaaaaaaaaaaaaaaaaatgaatcagctattgacgcacacaatgacatatgttgtgctagataaaagaagccaggtcacattctatgtgattttgtttataaatgattctaagaaaagacaaaactatagatgtggaaaactgcttcctggttgcagggggcctaagggcaaggggaaaagataaggccattttttaggtggtagaactttcactgtgaaatttaatagttacacaactgcataagtttgtcaaaactgatagcattgcgtatgaaaaaaagtaaattttagtgtgtttaaattatacctcaattacaaacaagtacaacaaaacaaaaaaaagtagaaaattaaaagttaaggctgtcatggtagtacttcataactgttgacaactcctgctttaagcattcaatttcacatgtaatttttttttttttttggtgagaaggagtcttgctctgtcttccagcctggaatgctgtggcgcaatcttggctcactgcaacctacacctccagggttcaagtgattctcctgcctcggcctcccaagtagctggcattacaggcaccctctaccacactcggcaaatttttgtatttttagtagagatgggatttcactatttggccaggatggtcttgaactcctgacctcaggtgattcgcctgccttggcctcccaaagtgctgggattacaggcatgagccaccgtgcctggcctataattgttatctcaaagcaaccttctcaataaagttctgtcgaaataagtaaattttcaatgttatgaaagtgacacagaatatctaaaatggtaaaagatatttaactactgatcacatcaacacaaaacaggcaatgtcccaatgtcacataataagtgggaagctaaaaacaagaactgggtgggttttgacttacttttcatgaattagtcttttggtatcatcccaggtgacctctaagcggtttatctccctgtcaacttcaggtgcaaaagctacatctttctgggcaatttgcttggctttgtctttcaaccaacatagttcatgctcgtgagaattcaattcatcttctagctgattaaacactcttaacctgtgaattaaaatgttattttcctattaatttactaaaggtagtaaatgaatatttcttctccgtaagtatatgatgagtccataaagcactcatttagacagctagaaaaacttttaacacagaaattaaattaatgtttatcaatggaaaaagtacttttaaagttaattttgcaaaataactcagactgtacctcagaaaacattgaaagtcattcttactactcaccatcaaccttctattaagtttgtattttctttctactttgctttgatggtagaagattttcaaaactaaggctgatctcataggctaactaggtaaatacttattgtaaaatctttggtaagaaatgtttctgggccatgaggttcaatccatgtaaataatagtgtttaaggattacagttgtttcattcaatatcaaattagctttactgagctctgcagaatatatatatatatatatatatactttttttttttaaacttaaattacctactttgttgaaaagattaccataaggaaatgatcatttttgtccctaatctattagtatctcagcatttataaaaagtggccatatcaccagccacagtggctcatgcccataatctcagcattttgggaggccaaggtgggagaactgcttgagaccaagaattcaagaccaacctgggcaacagagcaagaccctatttctacaaaaaattaaaaaaaaaatttagctggctgtggtggtacatgtgtatagtctcagctatttgggaggctgaggctggaggatcatgtgagcccaaaagtttgaggccgcagtgagccatgattgcaacactgcactctagcctgggtgacagagcacaaccctgtctcaaagaaaaaaaaaagtggccacaaagaggcagccatttactcttcattcttacagtttggtataggactgtagagttcacacaatgagtctacatgctttatcccatttaattcctaaaagatggtggctgggggcaggtgttcttattatccccaccttacaagaagagaagaggttttcccaaggtggcacagtgaagcattagtatggctggaatttaaataagtccattaattcaatacaacattttctgcacccgatgtgtgactttggtgagtgcagtgttgtgggtactgatgtggctcctgagctcaacctgggttttctactctggcaatttgaggatctcctgtctgcttggtctaagaaggccatgacaccctgcagcaccaatgatactgctggcatccagggtgagtgacactaggcaccttgttctctctttattctggaggctattttttcttcccaagtatcattcccttttgtaaatttattcttaaactaatcagataatttattgcctataaagggtataacctcaggagcccagtcccaatattgactccactatcatctgactaaatcctcgacataatggttgattctggttaaaaggaaacaaccagcaatggtctttcaggaacaacataatctttaccaattatgaataccttggcatgaatgcatttcagctgtttctttgcccactgaaaaaaatggaagagcaagtggccctgaaaacaggagtcagaaggttctattaagaagaaaaaaaattgaaaagaaggctacagttttaagaaaacagttacttttcaaatttactaagggaacttatctttgacccgtttgcttctcaaatgaactcacctgacaaaagctcagctttgcttacttaaacccactcctctgcctctccatacctctaagcaaacagttaaaagcagttgtagaaaatgactctgccaagctgattggtttcactttaaatgaacacagagctcaaatgacagttcatcaccttcctaagctcccctctacaagagaactgtttcacaccattttctttcctccaacatctgccctctcctctgaactaatgagcttgcaccagtctctaccaagaggctctcagccaccaaggaggaatttcctcatactttttaccaccaaaactactaggatcactacctttctcttctgccttcattcttgttatagaagatgaatcccttctcccatcagtaaaaaaattgtttaaaaacagataataagatctacatattctttgctcataaactgactttagggaaatccaaagaaattttagtacgtctcaagtgtcaaattagtcgttaatcttatcttcaaagtggtaaaaaaaaaaaaaaaaaaaaaaaaaagaagaggaagaagaaattgctaaatatggtactatcaaccaaaaagtatctgagacaggtctcaatcaatttagaagttgattttgccaaggttaaggacatgcccggaagaaataaatatgaaattacagaaacagtctgtggtttatacctttctccaaagatgattttgagggcttcaacacttaaaggggaaaaatgggctggaggggaaagagacagaataaggttaatccatgtgttgcaagagaaaagaagcaggcagggaatagtcaattacgaattcatctcgtgctcagtaaatcagcactttacctaagacaaggtgaacatagagtagctacctatggaattatttaatcttttctctgtatctatctgtttaggaacaaaaggaaaggcagctgcttgcatgactcaactcagcttaatttctttcttttggcagagtgaattggggtcctgagtttttattttccttgaacagtactaataaagttttgcataaaagttaattccagaacaaatacaaaagaaaagagacaagtggccgtgacagtttcctatttacctctgctgaagagcttggcgggtaggttctttcaatcgctctttgtcagtcctttcttcaatgtcctcaatgcttttcagaagctcctctttctggtcttggaatgcttttttcaacactgccagagcatctgcctcactctgcttggttcccagaaggttctggatcctctctacctctccacagagctgatcagccgtggctctgcaggaagtcctttgctcagagctcccgattttcagatggtattgggctttggaaagaatgccatccagactgacggcagcagattctaatgctttagcattttgaagagcatcattgaggtccttttctatcaaatcagactcgttcttattcatactgttggttgcttccactgtttgcctcagctggcggagaatgccggacagagaggcatggctctggaggaattctgccaaatgggacagggcaagctgccgcctctccacaacctggctggcctcctcaaacagctggaagcagtcctcagcctttccctgcaggaggtggaggtcctcagcacggcccagagaacccaactttgctaagtgaccctgcagactctgcaattcgccctttttgctctctacttctgctgcgtggtcctggaagggaagagagagttattgattcctgagatacactacagtctatggcagaggtattttacaggatttgtgatgtgaagatctattttaggtgccatggatagtatagtacttaaaggtcatctacagtgaatcttagaaaattcacaaaattttctgttttgctgatccacatttgttaaataaaacacaactctgggccaggcgcggtggctcacgcctgtaatcccagcactttgggaggccaaggcgggcagatcacgaggtcaggagatcgaaaccatcctggctaacacggtgaaaccccgtctctactaagagtacaaaaaattatccaggcgtggtggtgggcgcctgtagtcccagctactcgggaggctgaggcaggagaatggcatgaacccgggaggcggagcttgcagtgagccaagattgcaccactgcactccagcctgggaaacagtgtaaaactccgtctcaaacaaacaaacaaacaaacaaacaaacacaactctgttttggaactatgtaattaattctgtgaaaaaaatttctttgtggatagaaattgttagttaaaagaaataaaaacattggaagattcttaaagatgcttacatatattttacattttaattttaacattttaaagatgcatatatgtatacatttatatacaaatatttgtatttagatatctcatatttttaatatttcaactttaaaaattttaaattttagaagatgcatgtatgtgaaaaaattttaaatttaaaaatttaaaagatgtatatgtgtatacatataaatctttaaaaatctaaatgtttaatttttttaactaacaatttctatccacaaaatccatgaagaaatctttttccattaaattagttccaaatccgagttgtattttatgcaagacttctgtataggaaatttgactagctcacaataaatcatgtttaaaatctagcagaaaattggcaacattctcagtggtttccattaaatagaaattatcacctatcttaatcttgacaacaatgactttaagattcctctgtttgactactaaacttcagataggttcctcttgactgcagatcctgaccttttcttttttcttagagcatttactttagaaaacttgtaattgtaaatttattctctgcccctttgagatgtaactcttcttaaagctctggccagttttttctacctccgtaatatttttctgaaggacctgggagccatctctttgaaatgtaatcatcagggaagatagctgctctctctcagtctgtttggatggtagagcctaaattcactgagcaccttcccccaagatgtaaaactatctcctgtcctgaaggtaggagaaagttgcttttccctgccacagaaccaattagtcaacccagcaaggagtgaacactcaataaatatgaaatattctattgttaaatgttgctatatgcgtactatgtagcttatctccattatttcaatgctttatgatcaatatcggaatttttgaatgttttctggtgccaggatagatataatgtgttggggagtcagaaaatgataccctaaaatatgtcactttggactttaaactgagagaacctgaggagcagcaaattcagagaagagcttttcctgatgctcccttatctgactaaggaaagttcctccagaagaaatataatcatcaaccagggaggaataactcacaggaaagtcccttaaggtctgacatctcacttggaaagactgttagcacaggctgccatctgtaattctgaggtgtgctacctgagaaactttttctgcataataagacagcctttgttcacagtgcatttcctcccctcaccctcccatagcttgtccctactaccctcctgaagccccagcccctatttctttctgtataacataaaaactttagtcatctggttattcttagagtctcatattttgtgggactcccatacaatatgcacataataaatgtgtttgccatttctcctgttaattggtctattgtcagttcatttcatagactcaaattatttgaacgttcagagagcagaggaaagatcttttcacccctccatatgcataatttataaataagggaaataagctttaaatcattttaaagctgaatagtaattcagaaaaactatatccttaaagtatttgaattcagtattagttttcagttttgaaataaaacaaactgggaagcttaaaaatggacattcttatcactttatcctagcaatcatttgctccactatgaagagaaagtgtcttaagatggttgccaattttatctgaagtggctttatctgcttaattggtctgcataattcattgccttaactcatatgctcaattattaaaacattttcatataaataaaaagttaaattctcaccatttaaacttttttaaaatgttgcatctctttttaattcaagaacttttttatgaagaaattcttcttcaatcttaaaaaaaaaaaaaccactttaccttatgccgagtaagggctacttgatggtccattatgctaatctcagaggtagtttgtaattcactgagaaacagtttaatccagacagaaaaggaaagcagcagctcatcaaattgctggtgttcagcaaccacagactgaagaaaattaatcctatgtagacaaagtattaaagttaaaatgtcccataagtaaacagaaaggattaatgatgtattttgggaattaagcttacccaagggcaaaagcaatgttgtcacacatgaacactctatacctcttgatattttttacttcccaaaccctgctttactcacaatcttccctgtctcagtgaacattgccaccattcaccctgttggtcctatgaggcactcttcatcttgtcctttctttacgagtgcatctaatctatggataccctctcagcataacatatgttccaaaattgaatgaaattcctgtaattctgatgccttagtatatgttatcagtaataattatcattatgttcaattgttgtgtgccacagaagtaaccaaagtttttaatcgtgtctttaaccatggctagcctatgacttttgtcatccatagacaattattattttacttttattcttctcaaaaagtggtttacagtcagctgcaatccaaaatttgctttttctttaaggaaattcatggaaaggactcttgcaagtattctaaaatacagatttctgataactttggagactatactattgaactaagaaaaaacttccatggctaggtgcagtggctcatgcctgtaatcccaacaatttgagaggacaaggcagctggatcacttgaagtcaggagtttgagaccagcctggccaacacagcaaaactccatttctactaaaaatacaaaaattagccaggtgtgctggtgcacacctgtaatcccagctacttaggaggctgaggcatgagaattgcttgaacctaggaggtagaggttcctgtgagctgagatcatgccactgcactccagcctgggtgacagagtgagactctgtctcaaaagaaaaaacttccaggactctaattaaaaatacattcgtgagatttgctaacccaacattaagcagaacaagatttaattacataggactgaactaacagaggcctgaaatactttttttagtggtgttttgtttgaaacattgctgattctttttatgttttcctttccaagtcaagataacttttttttctttgaattgtctatagcttacaacaaattgggcaaactacacttctgtgagcaaaatttgtagtatattttttctctctacttgatttttccagaaattggagactatttgtgagcattcttaatgtatggtaatatagttatttgtataagttcaatatgttttgtcacaggacacaattggaaacattggttattttaccaaggctttgactggaatggcatattttcagatatgatcagactgctttgaggaattcagaaaaactttatagaaccaatgaaaagcccttgggaagattggccttatacttttctatgtgatgcctttataaagttcctgacctgtggtaagtaaagaatgtcactttctgacaggcccaggaatctcaagttatattaggacctttagaagaaaggaattcacccaattcatacagattatctgcaggcacagataaaccttttgtttggttaatgttgagagacttttgaaagtctaatctgagatttcttatgaaaaacgtagcagcaaagccaatttttaaaaagcctgtatggccaatcactaatcttgctgcactttatatggataattaggccaagtataataagactaaaatttatcttgcaaataagttgatcctactgtgatttgtctttggtagaaattgggggctgaagagagaaaaattatgttttaaaaaaaactacagtatgtatgttactagaatctaactttgttcattgtttttgagtttttattatgttcccataatttggactgaatcctgaattgtttcctggccgcaagtttccaaactaaggttttccaaatcttccttccattttccttattttatttatttatttatttatttatttatttatttatttatttattttttggagatggagtttcactcttgttgcccaggctggagtgcaatggcgtgatcttggctcactgcaatctctgcctcccagattcaagagattctcctgcctcagcctcctgtgtagctgggattacaagcacctgccaccacacctggctaatttttgtattattagtagagatggagtttcaccacattggccaggctggtctcaaactcctgacctcaggtgatctgcccacctcggcctcccaaagtgctgggattacaggtgtgagccaccatgctcagccaaaactgctttccttaatgccccacaaactgaagctaggcaactaaactttgggagaaataacagaaacttgtaagtaaacaacctatgtgcctgttgatgtattgacttctcagaaaattcactcgaccattcatctgaactgaactacaatccagaaaaatctgttcagattgctactgcaatctgaagatgcttcacaaactctagaaaaacaagtctatagactactctagatattaaactttgtttttcttctgtttccttagaaatgtctcttattaaagatctgtttgcctgcatcatatgtagaggcccagcccatttgcaatgccactttctggaatgggacacagctatttaactgaactgatctattctcaggactaagagactgactaaagaagacatgcaacaatatatttcagtttgctttttttctgtttatcttaatttgcttttccactcctttgtctatctctatgaaatagcctttttttttctttttattttattgagacaaagtatcactctgttacccaggcttcagtgcagtgctgtgatcacagctccttgtaacttcaaactcctgggctcaagcaatcctcctgcctcagctttctgagcagctgagactacaggtacatgccaccatgcctggatacttttttgaaaaaaatttattgtaaagatggggtcttgctatgttgcccaggctggttttgaactcccagccttgagcaatcccctcaccttggcctcccaaaactctgggattatgggcatgagccatcacacccaatctctatcaaacaaactttaacacaaatctcttcaaaactttccatttagcatttcacattaatacgtgaaatgttttttaagtttcaaaatgggaactgaaggaaatcaaaatattttactccaaaatatatttctttgacaaattctgaaatggccctgcaaagctgtcttttggggaataaacttgcttctgtagatctgtagagaatctgcactaatgcagctagccctgcctttgtccagatctaggaaagatgaactgagagtcaaacaccataaagacctgaaaaagacctttaccatgtattctctttgagggctatacctgtgaggtttcatctacataacaagaccagctttgctagccaagcctcttcctttctccctccaataacctgtcttaacatgaaaacctgttttgggccattttctgagctcacaatctttctgtaacctcaatatggcatatattctgtatgtcaaatgtatggagtttggatctccatcctgaaggctcctgtgtatatacattaaataaatttatatgccttttctattaatctgcctcatgtcagtgattttctaacctctagggggccaagggcctcagccctataatccccccactcctccctccccaccaacacacactatacattgactctgcactcttctctccatttgcactgctctcatcctggtctaaacctcttcagttcttgcctgaccttcaacagcctcctaactggcttcctccctcccacctttgcctacttacaatatactctctagataataagtaaacatgatttcaagtgaacagggcattccctgtccttaaacactaggtggtttcccattgcacttaagaaggcagaaccccaaactccttactgtggtctacaagaaacctcacatcatctacttctctggtctcatctgacacagctctgccccatattcccactgacttcctctctgtctcccaataaaaccaactcattactgccttagagcttttgccatttttgctccctttgcctgtgtgggtctgtttcctgcacagcccacagatcttaatctgatgtcatctccccagagaggtctcgcttgaccaccattctaaagatacaccatcctgcagtccctgccatgctaccctgttttgttgtcttcataatactgaacactgcctgaaatcgtcttgtttgttcacttgcttagttatgtatttattttccgcccagttccttcctcccctctctccacaccatggacctgccttgcttactgctgtatcctcggcacctaaaaaggtgcctgggatatcatcagggaccaatcaatgaattagttaataaataataggtgattggagatcagaatccaaacatattaaaaataatcccttaatcaaaactagtatttattaaaatggtttgtatccaaagttcaactgttaaatcagctttcacattttaatacttataaaatcttctacacattatccttatatgcatacattatattttcaatgccttcacacattggtatcactttaaaagtcccttactttccctctaagggataggcaaagggcagctactgctttgttttacagaaaattgctcacctttcaagaggtggcatcaaatctttccgtaaatttctgaaaccattcaaatgtccctttttttgatcctataatacttcgtgttcacccctcattattcccacactaatctgtcaattatttggggttaggttttgttcatttttatggcttttggtgtctgatatggtaccttgtactcagcaggcacctgatatatatttgttgattgattgaatacaggaataaataaataatagaataaatataagctccatgaaagcaaaggatgaaactctttattgctgctatttccagcacatagaagagtatgctactcattgtggaaagtcaataaatatttgctgaatgaattaattttttaaatggtcagaaaggttaaatgcctaagatcacatgggtgatcaataccaatttaaagagaaaatttgttttctggtatattggaaaggtatagatgccaattgttaatcacctagttaattaagatttaatccatttttgcctccatttatcaataatctcccttgctctctccagaagatctatattaaaatgaaatggactagcatatgtgtataaaatgcctctggttgagaaatgtcatgtgagataaaattttaggtaccatttttttcctatacaaaaacagcttaagcaataaataatacatacattagcaatcctaccgtctttaatctatttcaactggtttaataacttgcccttattttaagactaaattttgtattgggattcatcagaaatgctcagttttgtggaccttgattttcaaaataaaagttttcttcccttctgtagttatcaggtgagtagttgagttaaataaaagtaaacaaaactatgctttcttaatttatatgctcatcatttaaaaacaaatgaacaatattagaagatttatcttttagaaccaaccttttgttaatgatctgtggtaaatctctccatctctcatccaactgctccaaatgtagtttcatcattttcacatcatctttggaggctactgagaacaatgattccttcaattgcaaaagtttgctatagaatgaggcctgggatacaacttcattttgcagtgcctgaaaaatacaagacattacggatctcatcctaacaggactgaaaagtaaggaccatgcggcacaggcggctgttgtccaaaggattcgcattcttgcaaaatgcaagtcattcgggacaggctgaagagagtttttattacttgatttagaaatggatccacttaaccttttaaaggaatttggttcatccacttaacctttaggggaatttggttccattccattaaaggttaagtggatccatttctaaatcaagtaataaaatgcgactaaaacctgaataagttttctggagtctgagttctaagttaggcaaatctagaagctgtagaatttctttcacgatgaagagactgagtaggcaaagagaatcaaagaaaaactattgccggagagactcagtgcacagctaacaataagagagatgcaattctagcctgggacatgttctgcctttctatttagagtctagattaggccaaactggagaacttaagggctcttcattttacttttaagcaacagaactccttcattttaaaaatgtaatcagtcaacgaatctcttaagtgctgtgaggtgcataaaagttgtggctcctacctaacaaaagataaaatataaacactccaatagataggtaataataataaaaaaatattaagtgaaatgataggtatggcacagcagatagtagatacttgtcaaaatgctctccttcccttcctagtgaggccacataggtgatacaagcaagattgctaaagggattagaggaaggaatacacagcctgtggatgacaggtgagatcataaagcagaactgcgacttatgctgggtacaagggaaagaaacagcgcagggtgcagagccaggaggtaggaatgcacaagtcaggtccagcccacgaggcgaggctgccttactgacgcaatgtcaggatgcaggagtaacagagtctgcagtcctctcagtcatatggcacttagtttccacgtggagatgggcagcaacagttttacatgcccatgtagccttgagtcagtgtcttcatttataaggaaaagagctgtgaagtccctcccctctgggaataccccacatgtatttgcaagaagacaggaaccagattgtagatcaggattgccctttatggtcagggcgggaaacagtcagtacaggtttctgagaagggactttgtggaagatgagtgcagacaccagtgtttaataaaccagaaaggcaggagaaccagaagaatggagtaccccccaagtcaaggaaggagaacatttaaaggtggggccacagattccgatgctatagacactggtgacagagttttcagagaagcgattacaaaaggcaaaagaacgtagcttcctcttaaacgtcttataaaagttgatgggagaaagttggagtataaatctgtaatacaataaatcttttttgagaagcaattttgactgttgaattttccagcatagacagtatcatttaaggcaagttattaatctctagaaatcagtaacattgcctttagcttcaattatactcaacgattttctttctttaagtttaaaaaattggcttcttcaagtatgaaataaactttgtctttctacctattacctacatttgtgctcattcatttttttctgtcttccataagaataatcattactgtgacttctttctacattctattacttatttctttaaaagaacaccctttattgcccaaacgtcatataattacaaaagtagagagattatacctatttccagcctcagaaattatgaactgatagccaacctctttcatctatattcctacccatcctttcctcaactcctttgccaaaccatgttattcagatgccgggcattacattacaggattttctaacacatcatggaaattgatcatcacaaagttctcattgttagtttctctccctttcaggtcatggttgctttcttctttttggaacaccctgatgtcaaatgatgcttcaggaatcacaaaaccaaagcaagaagggaggtacaagtttatttattttattattttaaataatgtaactgtaacaaaaagcattttattttttccttcctcacacttccttgaacttgcctgtattaactgaagttcaccttccactttgactctgtctgcagaaatgtccatttctggggaactggctttagcttcaccccgctctaaccaggtcaaaaaggatgatagttctttctctagcctaaaggaagcagagagcagaaacaaatttattgaaaattatcatgctagcagattaaacctttgtgaagttggagggtccaacacaaaccatagtaaatacagcctcagttatctcagtcttagatatgccagcacaaaaatccctccttttattttcatttgtgtccctgcactcacatttatattggataatatgtaaagacccatatatatcctctccactctcaggaatctttgccttataacaaagatcaagagtttcctacagtagacccacaagttcacgtcttttgcatctgggataactactccccatcactttaagaactgctaatccagaatttcctatttagtagtgcagcaactcaaggaaaagtgctgctcacctctgccagtgggccagcagattctccagcgccgtctgtctctccttcgccctccttaggatgtcctcgtattgctgctgtagagccgcagcctcctgaacacaggaatctctgttcacaaccttcctggcactggctgagaaggcagtgatcgcgctgctcagtgactccagggcctggcagagatcctaagaagagtgcgagaagaatgcagtgaaagcacaggagccaacgaggcctgcatttttctttgacaccgatcatcgcaaaatattttccctcagtcataataaacaggaatagcactaagaatgggtacaaatatacagtttgatagaagaaatgagacttagtgttcaatagattagtagggggactataggttacaataatctatcctatatttcaaaatagctagaaaatagtttgaatgtttcttgaataaataaaacacaaatattttaggtgatgaaggtcccaattccactgattttacttttacaaattatatgaatatattaaattatcacatgtgcacccccaaaaacaaataagagttatatctattttaaaaggtctgtgcccatgatttgcagcaagacatagtgaaaatgagaagaaagtgacttcataaatacagaaatcaaaaacgaaaatggagacacttcttcaaataagaatgcactgctatttatctaaaaactttcaactttcccttaacaatttaggtaacttgtgaagattattagtcattttatgctaaatacgtatttaaaaaccctattcttaacttacaaaacccacatgtaacatgctataatcactccaaaaaatacatataaaaagaattatggctgaagaagctactgtctatctcaatagtaataataataataataataataataataataatgacacagtgcctcagaatgtggcaggccctgcattacctgcttcccatgtattgactcttttcatcttcctgagaaccctaagaggtatgttatttcattaccttcattttacagattaggaaatcaagacacagaaaaacaacttgctttaggaaatctaaatatcggaaaagtagaatattagcctctttggtcctccattattaacttagttgtctataaaaataatttcatcacactgaattctcctacttttcctcattttttgtattaagaaattacaaataagtaacgcaaaagtgtattctcattatcaatatttaaacaatagaaatctcactccctcttccagatggcctttgtcaatggcttgttttctattacatacacctttataaatgttcgtgcacacatgaacatgcaatatgaatcatatttgtatttttgtttattaattaatgtacggtagtatttctttgtacgtaattatccccctttgttcctccccctaaattctgccagagccatctgtctgtagccttgcagaagattcgcaatgatgagaaaaaccaatcattggaaacagatcagtgaggatatattccttaaacatctgagtacagtgggttaaaatatgaagacagctatacacatatatttttccttgcacatgtacttttttataatgctggcaagaggtaacagggttgttaaagctaagctctaaaaatgttactcatcctaattaaaagagagaaatgtatttgaaatgaatactcctttaatatacatctttaatgaaaatttattcacatccttacatgtcttggattatataaagtgaatacattagatctatataattactcaactaatataaacatttttccaatttcaattctcttaaaaagtttactgtattttcttttcaagtgggaattatcaaattttaagttggtaaatagtagaaatgttgaagcatactcttaccatatgttcttgaagaactttgtatgtttctgtagctgaagaacatattttaattggaacagcaagtttatcttcaaattcagacacagattgctggatctaaaacattggtgcaatataaaaataacagtgggaaagatacatagcaagacaaaaaaaaaagttactgagaaaatggcatacctaccttttatggataacttttaatgtaattataaaatgcattctttaaacatctaaaatcaacatgtcccattatttcacaaattatgtctttctcttattccactatttgtaaagtatttattgcacttacccacaaatacaatgtgaaatatgtaaacttaagtataggtggatcaattcttacctttctaaggttctcttcaaacttttgctgctgagataaatgtcccaggattgttccttccagacactgtgcatgctctcgaagctcttccccgtatcttcttatttgtgtcaacttggctttaattcgagcagattctccagtggtaacaaactgagcaaaagactgggcttcttcttctaatcctacaatgctgctgagcttactttctatttcctgaattgtgacctaatagttaaaacaagaaaaatgacaatgtaggctgagcaagcttgccttcctgaaatgatacaattatctgcaaagagggaatattttcttaactgatatttgaagacttggatggttagagcgcagctgtgagcaaacaccatgtgtttggggagatgagatatgccgaaaatgtctgcaaaatacagtgatgggttggggggtgcttgctggatagagcatacggagaaatagctactcttgcttgcagtgaagtaagcaaggagatgtccctgggacacttacagtatctctgaaggtacagagaattatgtttacgttatgaattaggcgttttaattaactgagctggggaagcattgtgtttcagtaactcattagaatgctaaatactgacattcacttatttttctaaaattcagttgagtattttatatgttactaaaaggtttaataactgcacacctacctaaaagtagttttcctttttcaaacttatcatctattcttgatgccagtggtttccaaagctagaatgcactaggaccatctggtccctattctccgggattcagacttactaagtctaaggtggggctcaagaattttcatttctaacaaatctccagctgatgctgaggctgctgatccagggacctcattgctatgtacttgacagagaaaagcccacatactgtcatttcaatttatttcaactgggggaagaaaggacattttacatgttaaccaacatctgaaaaatactgataactattaaggaagtgtgtgcatgtgcacatgtgtttatgtgtgtctgtggagtgtctctcacaaacatagaagcttgtttgtatataagaagatgaaaattatttctctgagaaaaagggccaaattattcaatcaaaatacatcaaaaattcagccaagtctctgtttcagattatttaaatggaaaatactattgccctaggaaaaaaataaagttttgacttctgtctagatgagacaccatagtcagaaataatttctgcctagttgaggcaatcagaaataatttacataaatgtcggatatgcatcatttttatttttcatatgaatgaatgaagtggtatatctcatcaatatttgttatttgagcatttatacaggcttcctttgttttgctgttttttaagattatattttttagaaaaattaatcataaattcaaaaaatataggttgtctacaaagcactaataattgttctagttgcttgtaacacatcggtgaaacaaacttagttaagaaccgagctcttagttattagagtaatacttgccatcaacaaattcatatatacgaatcactcaatcatattgttggattgtggtaaaaataaatccatccaggagaagaagatggaagacgaacccagcatatgttcttatcatttatcaattataagttaggaataagaactcagtcatttgaaatggcatgtaataatgaacaaaagtgggcttagtgtatttatcttccaacaaggcaaatgcttcattacttttaatcctaagatcgttttaaaggaaaaatattacaagtgttactatattttaaacctttcctataatgtagtcttatgtttggaaataaaacatgaacctaatagaccaatttccataggacagtgtattccactgtaactttgcttatttctagcaaatatctttttcctggtattcatattcacttacatattttagatagttttaaaaatgccttattggacgtattgaaatgtatttctagtctgataaaataaaaatagacaattgaatatatattttaagaaaacatgtaatctttttttctggagaataacaatgagatgacattagatagttgatatattccagaagctctggaataagggtggaaataatagtaaatgaattatagaaaaaataaatacgttgaaaaatgtgtgttaattttcaaaaggggacatttttgagacaaaactatttaaatgtgctattcttttttcttagaatttagtgaaaatgattaaatgacaacttttaaaaacaattttaacaattaaaaatatttaatgaatattcttccatggcctcacatctatttttcctggtataccaaagaagacatagcagactgtgtatatgaaactccatgtatgcttgattgcaaaagatgtgtgagaagcaaggatgatctgcacagcgggtaatcttatctgagcaacattgcaccctcccaccctccacatggtaacgacttgttctgagccacagtgtgaaatgttccctcaccttggtatttattttactatatttaattgaatgaaatagcagagggttttcccattccaaaaaaaaaaaaagctgaggtagaaaaagtggctgaattttgaaaatgtgtggtataaaattgtataaaagaaagagaaataaacactccaagcccctgtaagcccatttttcttcttgaactgtctgaatgaagtggccaatgatagtctatccacctggtcattttagagctgggagaggtaaggaatcagaggacctctgtccatgctccaaggtcataaatgaaaacatcataaccatggagtagaactgcttcacttaagaaagatgcttttcaaactcctccttgtgattggtgtgggtaagtaccactaatacttgaactagacattgggaatgggattttagagttgtacaggatgaatacatttcatgttgtataatgaaccggcagagcattctattgaggttaattcaaaatcaaggaaaagaattaatgtaaccataaaaatattttaatgatatttcacacaatattaactttgaatgcacaagtcagacaatgtgaatacataattccaactataaatgttgcccagtattaatccagacctcttagcttgataaaatgtatgaatttaattttaatagtcacattgcaatgaaagtcttgtcctgggaccgaacagcatttgatgaaatgtaagaaagtagttcttaaaagctagacatggattataaatataatgtgtgagcaggtcaccttaatttggctgatttgcatgtccatggcagatgacgaagtttccaaggcattgagttctttttctttctcagttatccagacggacagagtctcaaaattactgccaaaatgatcccacttggttttcaccatttccatggttttaatactaaaattaaccaaattaagtaaataaaactcagtattttaatagagaacaacaacacattttccttgaaatcaccaggtgaagagataatgaagacatttgtgaccatttcaaagttgaaactattcacgctaaaaaaaaaattgcacagttgttctgagtagtttatcaggttttcctatcttctctgagaatgaacatttaatgaggcagtatctacactttgagtgaaactgcactttgaacaaaacattgctgggtccaaaggggtttgaatccaggtagaatctaattaaactctgcatgtgaccagttgttgccaggacttatttttataaactatgccagaaaagatttcagtgtacacagcttttcaatagtcctatttccaaagaaatgttcttcttacacttaaaggagagacactgcagtgatgctttctatagaaatacctttataaactgcatcttatcaatcaagacagagctcgtgatctcaatcccatgctgccgggcaagaactgtttctattattagagctaatcctgcgatgtataatctttgtgacttcagccattttcataaatgtcttatggtcctgattccaaaagacatttataaattattgtacatgagcaccctaactacttttagacaacttataggttttatttgtaacaaatctagtgaacagaatttcaactatagatttctaatttgtattagctatgcatgtataaccaggtgactatggctttcagtttagaaaaagactaagaaactaacagtatataattgaactagtaagtccttgggttaaaaaaaaaaaaagtgaaagaatgtccctgtttaccaaaaggcacttgaagacatcaagaaaaatagagtggcatcattgactgtcaaattaaataatattgcagtctcaaatttataccctgaatgtgcctaatgctgtcagcagtacaggtaatgcaagctgtgttatattgcaactttttaaattaaataaaggttaaaatggctattcttaatagaagtaaattcctttctaataaactctgttttactatttccataacttgatagagaatatttaatgtaatataaagtcctcaaaatttcaagtcataatttgttttaaataaaatatgtatcaaattttaaagtttaggcaaatgtaaaatgttaattttaagctgttaatagtattaaaaacacattttacattttaaaacccaccttagaaatgatggcctgtcccttaataataatatgctattatgtatcattgatttgccactaaattatgttaaaaatagaaatgtttagccatattgttttgaataatattggctgtatcctcatatgtttttcccctccaaacttttttgtatattttgggtatataacaggatatcaataggccaagcagtttttttttttcagataaacaaacattaaaagtttaaaaataaaatattttaaagttaatttctggaaagagcatattagtcaggataacttgaataccgaggcactgtaaacaagctccaggagcttcttcaggttggagatatatggtctatgtgatgtgtatttaggcctggaatctacactaacaaaatatctccttttcgctctaaatggtgacagcagaataatatagtaaaaaaattattttaaatattagttctttttcaagattccctctacaatgtacaaaggccacagaatagaatagatatggctttctcatgaacatgatcagtttaagatgcaaaacccacatcctttatattttttgggctctgttatagatattggtttctgtattagcgatactttcttttgaactgtgagttgtttcctcaaaacatgctgaaatacacagacactttgagattttaaaagagtgttttgaatacaaggtacaggaaagattgtatgaaactttatctcagagaagaaagtttaggacttgtcaatcacatactcttcttcaagcgtgtcttctaattttttgacttgttctttgattgacttggcctgctgttgaagcagctgcttattttggggcccaagcggtatctctgaagcttcctttacaaggttctcagcctggactgcaatactttctgtccgtttagaaaactcctagaaaaaatattatgatcattaggtaggcactttatattatttatctctgccctcaaataaagtgcacatattgcatacagaacagatgggtggatgaagacatagagtcatacatgtatggatcttacattgttcttaacaataaatctgacttatttccatatggccaaaatagacactttgctaacagttttttattttatttctttttttttgagatagggtcttgctcttttgcccatgctggaatgcagtggtgcaatcatggctcactgcagcttccaactcctgggtttatatgattttcctacctcaacctcctgagtagctgggaccacaggcaggcactaccacatctggctaattttctgatttttgtacagatgaggtctcactatgttgcccaagctgatcttgaactcctgggctcaagtgatcctccagtcttgacctcccaaaatgctgggatcacaggcaggtgccaccatgcctggctaactttttaattttctatacacaaccagctatttgccttcatagttttccaataatactcacaaaaattgtttctcctttgtttcctggttttgtctcattgtttagaattcttagatccattataataattaatttattcacaaatatgcttacttattacaggccagttcacaaaatcaatagtgattgatcatagacataatagatttctaggccaatgaatagaaacatttatttatttaatgtaatatcttagtcaaaagagactatcaatgatctttggccaggcatgacggctcatgcctttaactccagcattttgggaggctgaggcaggaggatcacttgaggccaggagtttgagactagccttggcaaaatgggaagacctccatctctagggaaaaaaaaaaaagtgaccaggcatgatggtgcatgcctgtagtcctggctactcaggaggctgaggtgagaggagatagaggctgcagtgagcaggcataatggcgccactacattccagcccaggcaacagagcaagaatttgtctcaaagaaaaaagagagagagaagtaatcaagccattttgttaactagttctctgaaaagagctataatctaatcttagtgctgttaaatcttatttattacatacacatgtatcacatgatggaaagagaatataagttttgaaccagtcaagcctgggctagaatccaggatcactagttgtttgactttggtgaattattttcaggctctttcatgtaaaatgcagatgataatccttttcttagaaggttactgttagcattctattagcaatcttacttttaaagtgcctaacactcttggagatactgattattgttttttatgtctctcatacaaacttgaggacaaaatgatttattaagccaatatacttattttaaatattttaaaatagttgaaaatacttattttcaactattttaattgaaaagttgatttagtatgtatgtggctggtaaatattagatgttacctgaattttgtcaagtaattatattgaatgctgaattagaaaaggtaaacccagtaataacctaagtgaagaaaatgtacttggtatctcacttcttctcatgtaagagaatctcacaggaggtttaaattttgatcaactcccttctcctaaatgaataatgtagaaatataagtatttttccaaagtcagcttttcagtaagagcatctcctagaacatagtaccatataagatagagttactaaataatactattatatcttcatgtttaaaagacttaatgttctcatagaaatatcacgagttcggccaacaaatatcagtgttggccaagattgtgccactgcactccagcctaggtgacagagtgagactctgtctcaaaaaagaagaagaaaaaatcaatgttacttcagagaactacgttgcaatttaagagaataaaaatgaataagtacagcttccttatggcatagagatttatagtacactaaaatatggtagttgctaatgtcacaacattaaattctttggataaaagcacccactgttactatatctgacagtcatggtagattcaattgtggagattacaaatcaccacatgatctcttagaatcccatgaatataatcagaagtgaaaaataaagtgttttatttttttctgctagtgtttctcagaacccaggaaaaacatggaaaaagtaatgtttgaaaatgcttatatacattcaattttagagctttttatgtgagctatgtatggaaaaagcataatgcagagaaatcgaaagagcagaatgatggtgataaaaaaacaaaattaaacaaaaacagaataacattgtaaggccttatctctaacttcttagaaaacatatgagtggcaggcagcaggatgcatcaggtaaaaattgactcacattagattgatctgggatgaaacctaggctccaaccttcattagctgagtgacctttggccacatctctctgaattttcctttcttcatcactaaagccatatcttattttcaagattaaacatgacattgctatgaaccctctatcacacacaccagtacacagaggacactcaagtcccttagcataaccattccttagcacaactactcaagggctatcaacttgaataaaggtttgtaataacaaagcaaaatgagcaaagaactacaggagaacaatgattctagattggcagtgagcataggcaattagtaaaatggctctgttttttgaatgaaaaaataacgtagtgactaaagatgtgggctctggaaaaggaccttttggattgaaatcccaacctcactatttagtgatccgcagatcttgagtgagttcatcaccaactttgtgccttatgtgtccttcctcatataacacgattgataatgatacctatttcttaggactgttttgaggattaaaggcgatgataaacatcaaataattaattcggcatattatatgtgtttgataaatgtcacctcatattattacatcaatcccaaagcatagaagaccatggacaaaggagaatttgaataacaagactcaaaagattccatttgtttcaatctacaggtacttaaactgatccaaaggaattagtgcaaatggaatcatagggggtcagaaactctggctggaacgtggtcagaaacatttaggaaattaacccaataaacatctttgtatttataaaaggcacctgatacgtttttaatacacgaaataatttatttattttttaaaatagagatggggtattgctatattgaccaggctggtctcaactcgtggcctcaagcaatcctcccatctcagcctcccaaagttttaggattacaggcatgagccatcgtacccggccaaataatttaaattaaaaattaaaataatgttctatttaaatgactgatgaatatcgtatagacttgaaagagtctgtggtcttagaaaacttcaaaatcctcagtgagtttttaggagaaacaaaaaattagcagtatgggagagagtgaagccttttgcaggtaagaaaacagaaacacaaaggttttcttgctaaaggctagggaagggtgggcacaaggctcttctttctaagacaccggttagttcatttctctactaattcagtctttctataaaccccaaagaggcaccacaggaacttcaatgcttggtacaaattggttggtctgcttagagtgtccaaggtgtttgagcttgtagggttgggttcaccaagtacacctactaaatacggtctgtttgatgccccattggagtctcaaaatcgctacctccaaaatgaagttggtcatcttttcccatgaacaacttctcgttcacatcccccatctcacttccattgtctccgtcagactcaaaacctcaggtatcaacattttcgtcactcactctgtctggttagtttccctatcttcctgtgaactccacatcttttgtatctgtttctgtgtaacacctgccaccccaccgcccttatttatgcccatattaactcccatatgcccatatgcaataacttaaatggatcccatgaccccagtctttcacactttcagtcacttttctacacctgcctaaaaattcatccaaagcccagctctgatcgtgtggcttttccttttaagccttcaacaagtctggctccatgttgcctagaaagtaatgctttaggtcttcaagactctgaaatatgggccaaatttcctttacaaattcatttcccattgttctattttacaacacagaattcctattcagaacacttgtatgctctatgccattccaccttccaaagaatgtctgtattttgctccaaactctactaagttttactgacctttaaggttcagttaaaaaatattattgcctccagatttttttttttttttttttgagatggagtctcactctcttgccaggctggagtgcagtggtgccatctcggctcactgcaacctctgcctcccgggttcaagcgattctcctgcctcagcctcccgagtagctgggactacaggtgtgtgtcaccatggccagctgatttttgtatttttagtagagatggggtttcaccatgttggtcaggatggtttcaatctcttgacctcatgatctgccctcctcagtctcccaaaatgctgggattacaggagttgagtcacagcgcgcggcctgcctccagattttaaaaactctatacacatctattagggaactaaccattttccaatttgataaaaatctttgttttacttcttgatgtttaatcctacttatgttttcattctccaatatgttgaaagaatgggtcatcaataaatagtaagtattgattaaattaacaataacaattaatagtaataatggaggagaaatcattttgtttgttttgctttgttttttctgaatattgggtaccaaggagccataatatacctttgtttgttccagttctgaagataaactttccaaactgctaaaactcaagaagcgttcatgactggaacctgtttgaaaaaggtatcttactactgtttctttgtttgtttcaaatcgctcccattttcttaatgtgacctaaatttgaaaaaataaacaacaaatgggttacaaatgtcacacaatactatcatattttcattcgtttgcaaaactgtcaactttcagcgaattctcatttcaaatttcacacagtcacaatgaatagagatgattctagtatcttctgtaagaatttcttttctctatgttaatgttttcatctacaaaaagagaggacacatggactcagatgatttctgagttttttataatttgtaaagtcttagaaatgtaaagatattacttaaaatgtagataagtgacaaaaaaataaaaaaggcctctcaatctgtctcaaacaagaaaggaagcacagaagaaggtagggagagggacaaggagatgaagagagagcattaagcagttggcaaaaactcagaaacatttttaaaggtaatgtgtcaacatcccaataaagcataaaggtggcataaatgtgtggctgcatggcttcctggaaaagtgaaatggcatgatcaaatttctggattcagaaaagtgtggatgaaatcctggctttattattgatcagtgctgtgtgatacagcacctagtcctcaaactctttcttcttaagcatccacacttgcaaaatgtgcaacttccaatatccatctctaaggctgatgtgatgattaaaagatggttcatgtacagaatttaacacagggctgaaacatcagaggcggtaacaaaggttcgccttggtgttatgaggcacaaccggaagtgaacactgcccagcctctgtttaaatggcccctaacttccggctcctacctggatgcggcgttcctgcctctcccggctgcgctccaggccatccagtgtgctctccagcttccgcagctcctcgtggcctcggtcaggcagccccccttctccctgctgcgcctgcgcgatctgctgctgcacatctctcttctttgctgagatccgctttgtcttttgctagaagcatttattcaacagatggatataaattgtgctctctaaacagctaagtagggacatcaacacccacgcttaacagaagtacagaaaggtgggcccgaaatgtattttaaagctaagattaacagttgaaatggtagtcggttgctatattagtcaaagatgaacattatttataaatattgtatgtttttaatggtaaacaacataaataatttggctttcgtgttttgtgtgcaaatttggagaatatttagcattttgtgcaatactctaggaagagtctggcaaaacaattcatctgacatgattcttcttaaataattattttctgcttaaaaacacaaagtcccaactccaatttttaaaaattatttattttattaaaatgcaaatattaagagatttatggccaggggcggtgcagtggctcacacctgtaatcctagcattttgggaggccaaagctagaggactgtttggggccaaaagcttggaacagtctgggcaacatagcaagaccctgtttctacaaaaatattaaaaaattagccaagtgtggtggtacatgcctgtggtcccagctactcggaaggctgaggtgggagggtcacttgaacccaggagttcgaggctgcagtgaactatgattgtgccactacactccagcctgtgtggcagagtgagacactgtctccaaaaataaatgaataaatatttatttcctaagtatattcggaatggttaatttgctgagattttgtggggggaaattgtcttaaagtaaactttttattgaagtataatcttcaaatagaatagtacataaatctcagatatgcagcttataaattttcacaaagtaaatgcacccatataaaaagtacctggcctaagcattttaaaatattaacataaatatctataatcttaaatttattggacctaaagtaaatggaaacccaaaaaaccatttcacaatgattgagaacaatgtaacaccaaatattaattttttatactcagccattttttagacagagtcttgctctgtcgcccaggctggagtgcagtggggcaatctcggctcattgcaagctccgtctcccgggttcatgccattctcctgcctcagcctcctgagtagctgggaccacaggcgcccaccaccacgctcggctaattttttgtatatttagtagagacggggtttcaccacgttagccaggatggtctcgatctgctgacctcgtgatgcgcccgcctcggcctcccaaagtgctgggattacaggcgtgagccaccgtgcccggcctatactcagcctttttataattattaagtaaatctagaaatcctgaaggctgggattttaaacatacttttaatgcaacttccgtttttatatattacagaatatatatgtatataatacacacacaaacatattatataaattagctaccattttgctactgtgtatcaggttagctagaatttttcattaaaatattttatttgaatcaaatttccatttatattgcgtttaacaaggtatatattccttttatgcaaacatttgtaatgtgcactaccagactatcagaaattaagttgattaaaatagcttcttatcagtatatataccagaatttctttatttctagttctaatctttataagagtgtacactccaggaaggtctagtacttcaagtaagtcatcatttctcaaactaaagtgtgttcagcgttgtaagttgaagagaaagattttaatataatgacaaaagaacagtgatctcaaataggaagcaattggtccatctatgcctttccatctgttttgaaaaggagaatctagcacgttttgtgcagtttttcatagctaaatcaattttctctccacagtattccttgaactttttgatgtcatcaagtcactcggtctggaaatttatgttgcagaatatcctgaaatgtttaatatttaacagagaaagcaaaacccagaagcgccaaattcttttagccattcaactcttccttcccatgccccctcacccactctctcaagccagtggttgtattctttatctctctggttctttcagtagcaaatcaactttacataatcttgttggaagaaagaggcatttttacctggtgatgaagaagtaactgctgtgcttcaaacagattttcagtatccaagatcttctcagcttgttcctggacttctttagagccagaaattaattcttcgagagaatttttgactatttctttgtactggacacagtccccaaaattgcttagcatcttttcaacctatattttcatgaaaaaaaaaaacacgtaaatcatatgctacttgttgaagtttgtataatttttttggtaaggtatgattgacaaataaacattgtacatatttaaggtgtactacgtgactgtgaaatgattctccacatcaggctaattagcctgtcatctcacatatttctccttttgtttttttgtgagaacacttaaggtccactctcgtagcaagtttcaagtatacaataggtaatattaactgcagtcaccaccagaactttttcatcttagaacttaatgtttgtactcttcgatcaaaacccccctgttgaagatcatgtaatcttacatattttaggactgtgcacaaagtctacctcaaccacttgacatataaacacagatctttaacttttattctttctcatattactcagccttattccattatcattaaatttcataatcatttatggggcttgcaggttttattcgatatggtgctctggggcatattaaaaacccattcaacctggtaatcaaggaaggataacaaaactgcatatattatatatatatatattgccttttaggtctctttcattataattgcgtgactaaaacctaattataaaagtgccttacaagaaagtgagtccgtattatttaaaacaaataggaaaacatttgtagagttgaaaaagagaataaaagagtatttgttataaatgtgcttccaatattcctacataaaaataaatataatttacaattttgtagtcatctaatggattctcttccttatcatttccctaaattttgaattttcttgtctaatttctgcttcctctatttcagttttaccaacatcctttgttttcgaagcctatcctttatcttcactaagatcctcctttttacatgttgtcatttgttttccacagaagccttccagtttcttcttcttttatcctatcttttttctttgactctcttctgatctaagtttttccaaggagagcaatctgttctccaaacaagcagcaatgagaccttacgaaaaccacaaactcccaatttcaatataaatcagagcaaatctattgaaataatgactcttcactgtatcttgtgcatccacccacagtctttttttttcttacactggacaattgcaaacacattgtgttcaacattaatttaaatactaaatgaattattatcaaagaaaggggctgaatgtgccacatccatctcttcatacaaatctatctgtaaacaaaatgtgtttttctcctttcctctctttctgctttcactaagtaagtgatcaagtagtggaaaagggtattaatataaattatgcagaagtttaaggcagatgagtgtgtaaaaaattaatgtctgtatgaacattcattagagagagattcttactataagtcctggggcaaaatcatgacagtacttggaagataaagcaaatggccttggtaaatgttagggaaactactgacttctaactttaaagacagtcaattttttttttttttttttttggtgagacaaaatatattacaagcttgtctgtgaataacgacaagtatttgtttgatcttggctcaaagatcaccttcatgtacactaactttttagaatgttgtttttgcttttcctgtcaccaaaagagggaaggaaagagcaaaacaggcaactggctaaatgtggccgttgctttgaaagatggataatcaaaggattgaaataggttatgttccaaaatttgattaatcatagaactattttcaatttgtcaaaaactcatagggaaactctaatttatatataaaaattctcacataaaactaaaatcgtaagcagttcagagtatttttggcttatgtaaattcagcactagagtctcaagcagatttaaatggattaaaaacatgaaggttaacagatgaattgttagatgagaaatctctgtggagaatttcagattttcagaaacagagctttgtggtcattttcttgtaatccattaggccatttttccatgcaagtttctacttaaatgatttcaagaaatactggtaaatatctattctactttacgttcttacattatcttccaaagcacaaacttagatttatataaaaacctggtcagtaaaaatatttttgctgatggtggaagtggccctactggaaatgaagtagatgcgtttgtatattttaatctataaaggaatatagaaaaacattaaaatgcatatcaaagcactaggaagagaatttcactggcctgctgattaaacactgaatattttattattactaagaaccagctattgagcatttactctgtttcaggaactacactatgtgcttaacatacattactgcatttaattcatgatacttctttttagagtgagtatttttaaccctgtgttataaataaggaaatcaagacctagatgttacgtaagttgaaggttacctaggaggtagggtatcacatttaaactctaatcctggatttctttgaccctaagccttattcttagcctccatgatttatcttaagctgaccataaaataacaatgctttttataagagtaaaaacagtggatttgacaagttttatatttcagatataggtcatgaacctgaactaacatttccaataatggcacagaccatacatcaaacatcctcttcatctttcccaacaagcttcatacaaaaaaagcataacaacaattctgtttcaactatggtttctttataaaattacttgctaaactacaaccagaagaaaaagaaccttccagatgcctcactcagaactgtctgtttagagtgtgagtaaatgctgtacctctgacagcagcgtcacaagagccttgaaagagctggataattttgccagctcatctccctgcttttgggcttcattctcagaagaaacttctgtcaaaactttcagcctggatttcagccagctgagggtctcaccccttttggtaacaccatttctgatctcctgaaatgagagaacacttttgatgaacacagtgcaattgtgaaatcataactttccagcaataaaggactcagcctaaaaaggtttgcaggtggagcagaatagagccagacatcattcagcaatacagtgcctgcttagtttactttttgtatgtacttttaacaaaagtccacaagtgcttgaaagaaaactgttgtctattcttgaatcagcttcataattagattggttagatacttatagatatgtccttgatgggaaaaaagatgattctaaaaatactgtagaaaaatatgagacgccacaattggcaactataacatacatacactttgttatctcacttcctttgagctggaaagaagatgatattttgtgaaaaaataatgaaagttctttttttcaaccagctgatttcttttattgaagagtctacttgttgaatattgttatggatgctctaaagatttattttaacttcattaacttacattttctgctgaatttttattagcttttagaagccagtatcccatatagcaagaagtataaatgggagcacagctctaatttaggaagcgaggctttattgataagaaaatgctagaaagactccagggcttcagaccttgaagggctgctgactgagggagtggtgactggagcagcctgtcctccctacagcagttctggggtggctcaagagcaggggtccccaaccagggccactccagggctttgccagggcaaatgcacaccagccaggaaactgttggttccagaccccagtgatctcttcattctaggatgtgaatttttttttgtgcgatgcaagcaaccagtagcaaatgtagatatccttccatatgcataccatgatattgagcaccactagcatttaaggggattgtataatttaattgaaaaagaaatgggccaagggcaatagctcacacctgtaatcccagcactttgggaggccgagcagggcggatcgcttgagcccaggagtttgaaactagcctgagcaacatggcaaaaccctacctctacaaaaaatacaaacattagccaggcatagtggcatgtgactacagtcccagctactcaagaggctgaggtgggaggattgcttaagcccaggaggtcgaggctgaagtgagctatgaaggtgccactgcactccaaacctgggtgacagagaccttgtctcaaaaaacaaacaaacaaacaaacaaacaaacactcaaaggacaggaacagaaaggaaatatattctccccaacagcaactatgtggcaactttgtgatgtgcaagggttaaaaatgttcaaagatgaagactttttacaacattatgtgtctaagagtgagagagtgccatttacagaatgcaaactgtgtttgagcctgaggctctgtggccctggtggggtttttcaggctgtacccacactgatagaggctgaaatgaaccaatccagcttaatgtcacatagaaaggatgcctagagaccttgcccagctccctgatctttctgtgacctgccttttgcatggctgaaaatgtattgtataaaagcatacagtgttcttgttttccatgatgattcttaagtttctactgggttatacgcccatgcatgcaattttccactcaggactccccattagttaaagatgcatttgtggcaccacggagcatgactaaccctcaaagctaccaaggattcaataggaaaaaactctacatgctccacagtaatataaggggacttattttaaagacaattttcaagaacttattttttttccagaaagaaaaaagcagagaaccgttagattctctaacattattcttccactatgagaaattttcctctagcaaataatgaccctgaacttacttcaacggcacgtttaacctctccgtggttggcagtatcgatggcctcacccttgatcccctttaattgtgtctcatttgtagatatccaagatgagaactcagagaatctgaaataacataagcactttcttattaaagggagaacataccagaatgatcagaatatgttttctattttgaattcactcatggaaatttaacaattaagtgattaccaaattgattaataacttttctggaaactattcttttaacatgaagctcatgttaaagggcaggggtggccgcctctatgctcagttactaggggcagggtgatgggggagctcagctaaggaaaaagatgtgttctagggaatgagcacctgaaaagaaggaagggaccacttgaggtctggcctcgtgtgtccccaccagggtgagacacgaacctatagaggaagaagccaccctttagggatatgagattatacagtttggctgtgtcgccacccaaatctcatcttgaattgtagtttccataatccccacatgtcatgagagggacctggggggaggtaattgaatcatgggggcagttaccccgctgctgctgttctcatgatagtgagtgagtgctcacaagatctgatggtttcataaggggcttttcccccttttgctctgcacttccccttcctgccatcatgtgaagaaggacatgtttgcttccccttctggcatgattgtaagtttcctgaggcctccccagccatgctgatctgtgagtcaattaaacctcttttctttataaattacgcagtctcaggtatgtctttattagcaaagtgagaaaggactaatacataaggatattggggagaaagggattggccaactttgcctcaaagagataacatctgggtcacttggaaacaaagtgcctcaccctgattctgactaaaatccattccttttattaaatgaaggatttttgtacgagaacatgagcaagaaatatgaaataagttatttcttgttttgtcatgatctccgaactaacagaattaagtttgactacacccctctctggaggccattctgaggctacctgctagtgtagtccttccacttgtctgggtcttccatgagcttcctgtaggtgctgtcaatggcagctctgagctctttgagagtcacgtgacaggttccaggtgtgtcccttactgggtcccgcactgggagtttcacacagagttcctcgatgagctgtaaccttttctcacagagatgatgaggacctttgtcactgaagaaaacctaatgtgtaataaatgtttttataatccctgtgagaagccacacagtacttctacattttcacagaaaaaccaaaggaagattcccacgcagactaccaaggtagagtaattaagctattatttttcagactcaaaccaaaatattagtaatatcctttatggaacaatgtgacttgacacggctatccacattgtggtgtgggagacgtaccctgtgctctttaattatcttttcactgccttcctggggcatcagcttggtctctcgatccagctcagttctgcattcttctacagaggctaagaacctattcttctccacatcaatcttcagatgaagcaaatgataaggggcttctccttgaagatcctacattccataggaagattcagaaaattaggatgaagttcctgattatgtacattcccaattgaagtggcaaaaaaaaaaacaaaaaccataacatattccttttagggccagtgtgaatgggtcactactttccacacctggtctctctactttgtatttttccaagtaccaggaccacagcaaatcctttcagtctgctgtgggttaggtgtttcctcagtgattacttgatttaattttcacagtagccctgcaccgtatttttttttttttttttttttttttttttggtgagatggagtctcgctctgtcgcccagggtggagtacagtggtgcgatcttggctcactgcaacctccacatcctgggttcaagcgattctcctgtctcagcctcctgagtagctgggactacaggcagcaccaccatgcccagccactttttgtacatttagttgagacagggttttaccaagttggtcaggatggtcttgaactcctgacctaggtgatccacccacctcagattcccaaagtgctgggattataggcgtgagccactaagtctggccagtgctgcacagtattaatgttcttattttacagattacatcattaagtctcaggggtaagtacaaaagctaggattttaccatagatttaaatcataccctttcccctgtatgtgtcccttttgattttgtcaatgaccttgtgaggtaggaggggcagctattatacccacttcaaaaagaaagaacatgaggaaagcttattactgaaaaaaagttttaaaaagaaaagaaaaaaaaaaagaaaacatagcccaggctgctgaccacctgccatatcctcttttccttagatcatacattgagaaacaagcaagcaagcactcaaacactacataacatttcatgttcttttaaatgataaacataagcttcatcattacctttagtcccataattaattttaactaacttctatcctatggcattttaaaggattacctttgaaacagaatactaagatgactgatgagaaaaatgaggtgggcctatggaaagtcccacctagattaaatcctagaggtgtgtgtgtgtgtgtgtaataaaatacaaccttcagttatagtctttattccataatacatttacaatatgatatgcttcaaagacatctaacaaagcttggatttctttaagaatcctttttttaatgaaaaacttgaattttcaaatttagtaatatagcaagtaaaaaggatatttctttaactgtgtttttcttgtgcacagggataattatttagcttatgttactgagatcttaaaaatacacaaagtgagacaacctgatggagagagtttcagctgccaatcttctgaactccaaaactcctccatgtagcgcatgtgaaatatcacctcaaggtagtacacactcacctaaagctagagctgtcttcctcctgtctacctcaaggaagacagccttccatgggtctccactgtgctgcagctacttccagaatctgacatgcagtctgaagtcagcctccatgggacagactcagctcatctcccatggttcttccacagcccatgacacaaaagtcagacggaagcccgcgggcccccgtgtcccgcttcacgctctcctgctttctcccttctgtgctgttgtgtcaccccctgcttactcccatttctgcttcttctgtaaagttctggctcaaaactagttacctgattcgctgttttccaatttccaagtggttccacctccctctttcaaagctttcataaatatatgcacatttggatttatcatatttatacttgtattatttgcaactaattatctcctttactgaactcttaagctcttggggggaagaggggtatgctttgttcatcattgaattcttgactacaaaatgttttcatttatattttttgatcatagctatctcaactagatgataaaatctttggggggcagaaactatacatacatgttttatgatttcagtaggtatacctagcaagatttattcagcagagagaagcttatgaaatgttgctagaataagttaaatgttcttgcaccctggattaaaaaaaaatcaggaaaccaaaaagaatgctcgagtaataggataaaattgatgctgataataaataggaataacacaattctatcatatattatcaggttttatttaagtccagttttttgagtttttaaatgagcgaaatagttacagtgactttccaggaatttctaaatttctcttacatttggaccttaacacgctcaagcttctcccttcattgaggatgcacggtgtctccgtcctgtcctgactcaccttccattgtttgtggagctttcgaacagcttcctgcagcccctgctgctcctgctctggaaggatgtcggtgagttcatcacaagctttcaggaaagcattgagcaccctctgatccagctgactgaaaaactcctgacatggaaggggaaagtgggtaagagtgttggacagacgaaaaggcagcaccaggcacaatcagcctctaagcctccaaacaagcctctcagccagctgctgccctcttgcagacttccaggcacccactattgttttttaaggatgaactatgtgcacctatagttatgaatcagaagccatcatatctgaaattctactagtattttttattttttagaaaaattctttgtgattttcaaatttggtagaatattccaaaaggaatatctcatcttccaaggggagatgccaaaaccttgattctgtagcgatagagcttcggttcccctttggtgaagtcagaagaacagaacagaagccaggactaagcttcataattccacattccccaaccacagtgcttcagggcctgatgcttcatcatgagccattgtcacattcacacatgtgcacacagaagcacacatgtgcacacagaagcacacatgtgcacacagaagcacacatgtgcacacataggcacacatgctagcaccaaattgtgttcttcttcagactcatatggtatttggagatgggaactttggaaggtggttaggttcagatgaggtcatggggatggggtcctcatgataggattagtgcgcttatgaggagggacaccagaaagcttgctagctcactctctctgccatgtgagggcacagggaaaaggtagccatctgcaagccaggaagagggccctccccagaaccctactatactagcacctgatcacagatttcccttctccagaactgtgagaacataagtttctgttgctttagccacccgtctatggcattttgctctggcagtcaagtagataaagacaatacacatgcacatattacatatgactaagtctcacacagtctcaggagtagacatgcagaattattttgtaaaaacggtgattcaaaacaagaagtaccatactgtagaggtgaataaactgaatgagatattttgtgttttgtggtcacagacattaaccctaaatctagtctgcagaatcacaaatacattgcatatatcatttgagagtgtggtttatacaaatagccactgaaatgtcaggaaagataactcaaatacatgttctcagagtgctggttatttccatataccattcatgaacattatgactaatattcccaatattgatattgagatgataaacatgaagatggcttttcatgataaacatgaagatgataaacatgaagatactgggacaagttgtgtatcagccaccagacttcaagtgacacagtatctatactatgatatggtgaatgtataaaatgagcacaaaggacttagctagtcacctcgagttatctgtttaaaagaatctttagttatagaagaatttgcaagctaaataatgaattagtaatttggataacttgaattattctatgactgtctactattctggggacttaggaatggccaatgacaagtcagctcaccaactctcttgaagttctttttgctcaccatatctttgggtctcatacctaaaaagtctctgcttccctgactcatctgcccgctctccttctgtatcagatcagcatgccttttttaagctttcctccaaggttgtttgtccatgtattcaggtcaagtgtcccctaaagggtggactcacagtgtgtctccgcaggagctcctctggatcccccttttcctccaggccctcctgagcaatccgcagtaccttctccaactctgctcgagactcctcaaacttcttcatcaagcgactgttggtttccacatgcttcttccaatctccagttttctttaccatactcttgatgtgaaaaacaatcataatgtgatgctgctttctcattactgaaaggatcattttgttagagggtattattcatttaaaaagcacttggaaaaaagacatttcatcatcatgggaataattaactcttttcaatattaattaatattaggtaaaaaagtaggacaatgattggcttccaaacaccagcaggtaaggcgttttagcaagaccaaaagcacgagtgatggtttcttgtcctcactctgcattttccctggctcacagctctaaagcagggagagcaaattacctgaaaagcaacatgaatatctgcaatctgtctttgtagcctcgtctgatcaaaatgctttaacacgttgctcaaggtcacaaacttttgaacactttgactgcctttctcaataagtgtcaaggttttcttacagttttcttgacaagctaacagttcctataacgaaatgaaaccccacaacaatgttatttacaagacagagtgagagagaaagaaagagagtgaccattacagataataagaacaacattatatagcttttaggcttctaacaccaataagtaaaaccaaaagtatggtggaacatttcaaaagatctcaattttaaacaatcactgaagtcagtgctttcttatataaggcatttaaatgttacaaagagtttttttttttgagatttttaaatacctcatgtacattttattgtcattaagaaaatgatagagcatcaaaagttgtctaggtctgcattcctctagtaagatgataggcctgttgtttattgagagaacaatcatgaaatcaatgaatacatatcaggttttaatgtgactaaacaaattgagcatcaatgcacattcactttgctgaaagagatgcactatatatatatatatagtatatcctaaatttataatatttgaaggtgtacaacctatcagccttattaatgaaatggtagggttcagatcctaataaaaaaaggcagcagaccgatgcacttggggaagacttgcaactgctgcacatctgcaggacaagatgcaatggtgacttacagacacctccacctctgacttgtagcctgcaattgtgattttggcagtagacagcatggaaatcattgagcccagcacaaggcagagggtcattttttggcttgaattacaccatttgcatttcagtatcctcaactgcgttagaaaaatacttcaaactgctcatttggatgccatttttggatatccagatgcaaatatcaagagcatggtttttttgtttgtttgttttgggaaaaacagaataaagacatactttttccttttgaaaacttaggagataaaagggtaatataagtccaaaatgtattattagattttattattaataatgctatgaacattattttaattatggaaagattgtataatgacaacttgtacaaatttagaaatgtaggagatatcaccatgtctaaaaatgaaagataatctctatccaatacaatgagaatgcagtttggtggtataatcattgtggcttcactacagataataataataataatgctatcagtcatatagtgccacttattatatgctagtgacattatggtgtatctaatgtaatatctgcaataagctttacactcaggtattgtagccttcatcttaaagtgaggaagttaaagctaatcaaagcttcctaatttgcaatattagatctaagatctgaatatctgtcagactcatttcagacactctcggctctttctactaatgatgctaccttcctcccatgaacctatgtcaattaatgcagtggcaaaccttttgtacattagtgtctctctcctctgatggacaggttcattataataaaccaaataacccaattaactacaacactcagtaggagactgttatgcatacaatctgtttactaaaaatgagacaaagaaaaatgattatcacatcaaacacatttccagagtttcaaggttgtttaaactgtcatatttcaagaagcaaagtaaagatctcataagtcagaggttatggatactggatgaaaatggaaagcaattgtttttattatatgtatataaatatatatcaaattatctgtctatctatctatctatctgttttcaaagtatcaagaaaagaaggcacgtatgcctttttaagtgaaattaaccatttcgtcaatcagcaaggcagcaggtaatgcctaaagctatgtgtgggaagcaacagtaaatgattctccaaaagaaagtcaatataagaaggaaaatattatatctgtatatataatacaaatatttatatattttatataaatatcctctctgtataagttttatacatataaaatttatatatatttatcttttagttatgtaatgtagagacaggatatttatttaattttcttatagtgtctttctactagcaaacctagggatcacgtttcatgaacaaagcccataaaaagtttaatgtaaataaattcttatctgtatttttaaaaggatagactatatgtggtctattgctagtaggcaggaactctaagaaaagtaaataaatacaaagcagagaaataatagaaagtcctttgattatgggtacccttaatgtttgaagttagagtggcggatttggctccatctctataacacatcccttatttcacagagacattgtgaactttgcactttctgtagttggggctcaggatgcatggcttacgcgtgcacacagcagatgtttataaatgcttgctgagtattgccagatcacaatgttgctccattgatagaaaggggagctgggtgctcaaaacaaaccattttttctaactttgctcaactcagtgaacttactgattcagatgaatgagcctggtttgcacctgagtccagctagaccattccctggaaacaaacagctcacatagcccctgcactgacagtgaatggattttcatctttggacaagacatgtatttttgttttgagttagtagtactattctagaaaaatgtttcttgtcctcactgaatttctattcctgtaagcaacaccctggtcttgttacacatgctttagaataattgtctcctgaaaaggattgttctcacctgatgtttttgtttaaaaagggcactcgattgtgcctcacgctcaagaactgtgataatttcattgattttcccaagtgagtcataaaaggacgtcatctgcttttctaattcctccaacggaatcaacagctgctgagactcataaaggagtggggagtaacattctttgacctttaaaaacataaagacaaaaattccatgaaagaccattaagtgccactagctcagggaacgttcatagctctgaggaacattttctttagtgacatgatcatttggtgcttacaaatatccaaagacatttctttaatgatatttcctctatattgtcaaattttgctgtgaaaaataatagtgctgtaccactgagacaaataaatggctactgagttttctcatgaaaattcatctaaatcgtccatctggatagcactttctcatctaaatgattgtttttagtgagccagatggcatcaaattatacttcataaaccatgcaactcattttcactttggccttgaaatctgacctaagacagtcatgaattattattatattacctagaccaacctgtgtcttccagctttgttttcaagagatcgcctacttgaacccttgactgctgataaacttagaaacctgttgactcactcttcccagacaggcctgtgctttcctgcctcccaccagctccatgctttgctgctccctgcttatcaacatcctactcatccgaagcactaaagtcacaccaatttattcatgaagcttcccatgctaggggagggctctgtagtccaaactgatgcagcccttacctgtcacttgtcttgtaaaacatgttttagtttatagacctgcattgtcttaaagatgaggccactagctcctggaaatcaagagctccaggaggtgtctactcttcatcctccaagaacttcccacctcttctcatactttcagataaccagggaaaggaaattaatcagtatttgttagtaagccattctttgtttttcatatagtataaagacaataatgttctaaccagatgaggcatattccaaaaagtaatccttgaagaaagtgggagagggcaacattttgctctactgttaaacatagaattatgtatgaagaaacgtttttatgttctaggatatactgcctgaagtatacactcatcaaaagaaagttaccatcctgctactgcaacaagactctgatataattaccttgaacaaaaccaagagagtctactaatgtgtatacaaatcagtgtgttttattgatctctcctgggtagaagagaaaacctatcaagatgctgcatctgaaacagtaaaaaggcaaatgacaatttgctttctcaggggttgtcctgaacacctaagcatggctcaggctaagatgtgcaagcccagctatggccctgaaagctgctggggagttatcaaattggaaatgttgacttcaaattgtacttattgtttagcagcttttactagtagccaatattatcattattgcccacaacctttaaattataaataattctaacttgaatgttaaaataaaatgaactgaacataaacattctcatacataccatattgatagataaaattttctcttttttatggtcatgatttttcctattttagctttttgaatgcattctttttcattaattccctaccactgatgtcacagaggttattctcttcctttctacctttctttcctatttaacagggtcttctactttgtttctactttgttttcccattcttcattttaaaatatttccattcatttattataatcacttctctcttttactagaaattaattacccaatctaggtggattttgcaaacaataccatcttcctaaaattcatatttggatagataacaaatcccaatggaacttccaaagctcttaaggaaaatcactgaatagactagaaaatgcttatgactagtgcttacatccatctagttccctgtacagaaaaggtataaatgtatataatctttttttttttttttttttttttttttttgagacaaagagtctcgccctgtcacctaggctggagtgaaatggcgcgatctgggctcactgcaacctctgcctcccgggttcaagtgattctcctgcctcaggctcctgagtagctgggattataggtgcacgacaccatgcctggctaatttttgtatttttaagtagagacgatgtttcatcatgttggtcaggctggtctcgaactcctgaccttgtgatctgctcgcctcggcctcccaaagtgctggattataggcgtgagccactgcacctggcctaaatgtatatattctaagcctaagtgagctccatgagatgaggaggtcagaatttccacagctttgtggctatgcttgcagaaaattgcacaaataagtttggagtggagatatatcaaacaaatcttaaccaattctcatttaaatttatgatcccctcttcttcctcctcctcatctcctttttctctttatctctctttccctctcttggttttatcacatgtaaccgttccccaaaagtatctaactttctattaaaatatagctataatacttctaaattaacagaggtaatacttggtatcagcatcatagttttattttttttaattcatgacaaagttactaaattgagaatcccaattagaaacaaaagcatcgttaacaagtaaacactttgcccatggggagaaggaggtagcaagcaagctgaaggcactgttggtgtcacacagcctattgtgcattaaattattttcgcaccttggttagctgctctttgagctttgacatggtcgcaaacatttcttttccttcttcttgggggctttctttggtaatgaggtgtgctgtctttgtaattatcttgtattgggcatccatcacaggcaccctctgctcaatatcctgcatgaatcattgaaacagccagattcatacatgacacatttcctcttaacttccggattccacagaaggcagaacaaaaatcaatatgcactgtataaaatccaatacttacactaaactttcgacgattccagtttttgcttcccttcattactaataaatattggtaatattatatagttaataaaattttcctttaaaagtgaccaaaacatcaagattagctgaaatgatctttgtactttccaaaacaaatcccatgttaatgtagtatggaaatataaaataaaatgtaaatgtatatttaaaatgtgggggaattctgactttaaaaattagactggttttcgttaaaaaaaaaaaaagtaactcattgccattataaaaacttataaattagaaatattaggataatgacaatttaaattacttatagtcttctcccacagtaaaacccaaagccaacatcttatctatacatcattaagtttttttttcctgtgtttacacccattttaaaatttttacaaagacaaaagaatgatactgttgtttgcttttctcatgtaacaatatattgcaaaatcttaccatgtcattaaaaattcttccactacttcatttgtgagagctgcaggctattcaaaatatgcaaataccacagttcatgcaataaatcctttattattgaaagtatttaggtgcgggtgctatctatagatgtctcctgttttttcctaatactttttaacttggttgtagaaaaaaaaaatctccaaactgagaaacaatttgaagttactttatatgatcaagtcatgtcttttttatgttcaatacatttttttctgacaggtgcaaattgggacatacagacatgtcaaaatgatgcccaggagacacagaaacagcttttgcaatgatctgaataaacttgctgatctttcctctcacaacagagtaggcttttcattttgattcagaaacccctcacctccaagtcttgaattaatagcttgacattcataaaagagacttctaagggttcagaaagtttcttatgggcttccgttgcaaaagcagacagggtaacaacacagtctgtgtattccttcttcattctgtccatctcatcagcttgagcatactgttaaggaaagggaggagggaacatcgtgaaagccatttagctgcgaccactggaaccacaactttcactttcacatattcgctggaattgttatccggtaagaaagactctaatctttgattctcattttagataaatttgaagtaagtccaattagtttgaaagaaaaaaagaaactagcatgaaaatgaagaaatatgatttgaaacgagaatcattccatataagtaggctccatatgtcaacataatccttaatcaaactaatgcatttgtgtaatattcctccattatacatggaaaagaatgaagaaccaaccataaaacacaccggttttaaacatatctatgctttgccttaataaacccgtgctctaaaaatagcattctctctaaacagactacttatcacatttgtaacacatacacgttgaggtgtatatagacttgaaagacatacttgcttgacttccataaacaactccctccaccgcccatttagcaacagtaattgctgcttcaggtcacgggaaaccatctcatcacaggtttcaattagaaaattgccagcatcgttcatggcagtatgctgctgaatccaatgaggtaaatttcgaaaaaaatcctaaacaataaataatgcacaatatcataaaccataaaccaaatatcagtgactgatatgaaagtgactaaagtaggaaaaatatttttgttttaacattcatgtgaattttaagataaatcacaaatctctttaaaatgcacatttttgataaaaagtttcaaaatgtgagctagagatactgtctttttttataagaacaattgtgccatatcatttgccgaagacaaaacaaaacatgatgaccattttctgttatttctgttttacagattaaaaagctgaatttctgtaagtgtaagagacctgtgcataaccttcaggctagtaaataccagtgccagagtcatataaaaggcataatacattagggaaatatatagcttccttttttatttgtataaattgatggggtatgagtacaattttgttacatgcatagattgtgtggtggtaaagttggggcttttattcctttttaaagaaagaatagctttctttaataatttctttttgacctgctacttttgatttttaaatttcagtgtagtacattaagataattagcaatcatggagataaaccatcgaagcaaaaaattttaaattaaatatctgagtcaagagcacttagtacaataacacactttcttatttatttaagggttccctcttggcaatgaaacagtttccaactcattttaaataaagcgtatgtgtgcacacgcacacacacaacacacatcacagtgaaaaacaaggataccaaagataattcaaaatccatttcgtaagccttgtgtgggaggactttcctacatatataaatagattagaacacttctgtttctggtggttatatttcttttgatcaaattaacatgtatgacatccactagggcactgccagtctaatcagaaaagccaaaatctgtatgggtacatagttattgcctccctcagctacacaagaatagttgatctacatgaaatatggaatggtaaaacatttaaaagtgatacatctacttgtccaaacaataatagatgaaccaatcttggatggcatgtggtaattctaatgcatgcatttttagtatcacttacatataaattgattttccatgtaaaaatgccaggctcccattaggaagtatataagcagaaatcagtccatttcatgtgacatttacatataagtgacattaacataaaacagtaactctcacaggcacacacacatacacacttataactggccaaaaaataaatcactcctacccagaatgagacccttgcttgaaggttgataaaatccaaaacagaatatctaacgagatacaaatgtcatggtccagttgttcaactggcgtatgctaccacatagatccagtagtatgtgtttcagcactacgtgaaaacaaagttgttttcatcctctcttaaatcaggaaatccatgaaggctggggccctagacactccccttcatagacagacttcagggtaatatagtgccctcccctttgctgcccattggatttactcaaccctccatcagcttctattaagcagtgtatttattggtctgttgctaacctgaaagtgcaacttttcaggcaaagtcaagattcttgagtgacacttgtaaatatatgcgaccccctagtgagctacgctgtaaaagtctctcatttttacatacatcaaacgtcttttctttttgcatgaaccaatcttacctttttggcattttctgattgattgagcattttttcagcatcctctagccaggcttgcagactagccactgtattgccatagcgatcccagttagagatcacttcttccagcatgctcctcacactcctcacttctactgagagattcctccactgagcggtggtttcattcatgaatttcatcacattctcagcttcttccactgaaacagataaaaccaattataacccttatctcatattttaaatcctctacacctttttttctatggtcttatacattggtgtgcaatagtatccatcacaaatgccagagttcatttccaacaaatatgacagacataattacaaatggaaaacaaatgtattttacaaattgtgtctttacactaattaatttctcatttacttgattggtaatccttaacgtattctatgcttttgcctttaatccttagatgcaatttagaaaatgaatgcttattttgttctctcttagaagaacacatacacacacacacacacacacacacacacacaatgattatgcaggttaggcattgtacaaagccaagggaactgaatccagtatgtgttctcctggccaatggcaaggtcactcaaaaattccacggacagaaagaatgatctgatcagatagaaacctgcaggctctaaattctactgcagtctacgttgcaacaaattctgtagtatgttttacctgaaccatctgctttgacatacatctcagctgtctgtttcaagatctggtatgtcacctcatattgttcaaagaacttgctattttctataaaagactagaaaaggaggaatggttagaagatagcaaacattaggctcatgtagaatgccaaagtcaattttcttcagtatagctataagcacagtttacccaaatttgttaatctcagtcttcttgaaaacataaaattaattccactgctacaaattacctaagatcattctgaacacataaattgattccacgcttttgattctaacccagtacaggactgagaaaatattctatttcttcaccaaccaagggtttgctttttgaagagacagaaatttctccagagaacttgggtctaacatttagaaagcactaaatttagaagaacattttaaagtgtcccactgtgtctcagctgcggaattctgttgctctttgaacattaatcctggtgaatgactgctctgaggaactccagattataaataaatgacggtgcacaaatgcttcccttaaaataaaaagtcagtagaaaaattggaaataattacatattctatccatgttatcaatggtctcacatttcaatgacctattacagaaaaattgcagtaagacatgtttatatatctatttgtaatttatatatataatagaatcactactggaaagtgaatactataaaattgagaatagacaaaaaagttcttaggtaaatgttattattgttcatttttaggaatataaaataatgtgcgtttcaaagattattattacttcttgaaagtagaaaattaatgcaattacagttaagaacatatcaccaaaggctctttaatttcttgcgatagtataatgagttcctatgatttgaatctattaaaatacttgataaatgtcacggtcataaatacaaaattagccttcaaaaaccagctgaattcttgtatagcacgctgatgaatgcttaatatagagatgcaagacacttgtgtgcagaggaaacattattcatgcagcaatttcatagaaatctctggatttttattgataactgttttgagataacattttaaaaattgtatctataacatatttcatatcattttatgtttataaagcatttacttataaattaactattcttcagggataaagtgaatagagaaagctggaatgagaggttccatgatgaatactacattcaataactttaattggctttattttatttgtttgagaataaagtcagacaatagtattctgattaattcactatttagccttatatcttcttattacaacccagttgagaaaagaataatttactagaatttaaattttgaataatttaactaaacaagcaattcattatttgatcaaaaatggaaaattatacctaatgttcaagatactgcgtaagaaattgaagaaataattatatttggcaaagtttagaaaagaatctgcatttagtattggtacaaatttcaagaagctaatagcaaaacaatttttctaagtgtcaaagaaatgggaaatagtgcatgtggttcataggaagacttaaatatgcttttcctagagaagtttacaaaataattaaaaatgaacaagtgagaaaatcttatttccaatttaatttctggtccacgaggcaggaaagaggggagaatgttttcagaaagaatgttttataaatgctgtagacactcattaatgtatttttgaatttggctattaggaagactggatgattaatttttaaagaaagatacctattttgtattttaaatttgtattggtccatttaatttggtcctttttttctgaacatggagtaaatgcatttagcaatatggattattttatctattgaatcactttggcagaactgctaaatctccattttactgtaagctatttagacacacctgtcagaaaaatacaaatgcatgtttaaaataataataacaagattcatttatttctttcaaaatgaggttgaaacttggatcccaagttcaacaaataagccattttaatcaggggacttttaaagttgatggtgcttcaagaaaagtaaatggcatacttatttttggtatttaactttagtgttagtgaccgcatttctactttcacaagatgagtgtaaatataataaatatgaagctcatcaatttcacttgaatgcaactatgccagattattcgagatatttaaaattaacattgaggagaggtttatcaagactatttacattaaaatataattatgaataataaaatgaatattcacactatgttgcattcacacagtccacaatttcaagagctgtttttttttctttcatgtgaaagattgaaatattagcctcttttttccatggtgaaatggaagcacatgttttggtcattgtcaacaattctgacagcaaggactaaaccaattaccttttggtttgcattacagcatgcaatcacttaccaatggcatgtggcctaaattaatgatagaaaggatttgtgaagtattttccaagaattctttaagcactcagtggctgcatatctgagttggatgtacattctctttctctaacacttaaaaaaagtattctttcttttttgcaggacggataagtctgaattgagaattatgactaaggaaaatataattacggaaaatttatggcctgaatattactttggttattagatgatgtagaagcatgtagcttattataatactttatttttatttttatttttttgaaatagggtctcactctgtagctcaggctgaagtgcagcagcaagatcatagctcactgcagccgtgaactccagggctcaagccatcctcctgcctcagcctcctgagtggttgaaactacaggtgcacaccatgacaccaggctaaatttttaaaattttttgtagagacagagtctcactatatttcctgggctggtctcaaactcctggcctcaagtgactcttcaacctaagcctcccaaagtgctaggattacaggtgtgtgtgagctgctgcccccagcccttttttgggggagtgtggggggtgtaaaccaaggaaagaattgcacttacaaaactgactttggtgatttgtgattttatttgaaagttttcagcctctttgaaatagcctgttctataatgaatgattttccataacactctaaaaggataagagaggctctatgaggtgttaacatagaataaaaacagtatatgtcagtctttgttccctagaaaaattcctaccatttcattattattattattatcatcatcattatcattattaaacactggggaaagactaagccttctagaaattaagttattcacagacacatgggtgctcagtagctaaaccatgaccaaacacagttctagtggctggtatctgcacttcatcagttccccaccactacaaccatgctgcctcatatataactaatagcaactatgaggctttcacagtacacttacaggtatgtaagtgtaaaatattgtcaggtatggaccaatattaaattgaactgatatttatgtgaattacattctttagatcactaagacgtaagataccatatcaatgatttggtctgttaagttaaaaattttttttacaattttttttagattgtgatattcagcacttaagctcaagggcttttgatttggaaagatatggattcaatttctgattccacaatttaccacctggagcgtgtgccgccaggagcaagtgacttgagtctatggaacctcagtgctcctgcactggctccttggtatctaaaacaatgtgaaacccccagtctgtagggccatcactgagatgaaaaatgatgcatgtaaaacacttggcatgtgggaaatgctccatactccacggttatcaaaactattaaacaaaattaccttaaaacccttcacagaaaagaaacacgagtgataagtaggtattcttcagtagcagatgagagtactaggaaatgttaattaaagcatgctacgtatgtaggataatcagcaattttatgaatagttatgaaagttacaaggcagtttggaattagtagctgagtgaacttgatgaagtaggcagggagtactaacgtttttatcattaataattgtttattcacatatcatttgagaaaaagagaattattaatatcattgtgttggaacattaacctggtggaatagtcttattagctgtttaaatctgattggctgttctgaaatatccagaacaaagactgtgtctggtataaataactactgggctgagagggtatcatttggcatgactaaatctgaaaatatacatgcatatttgtatttcatatttgaagaactaacgtaattgcttgaagcttaaaatcaagtttttcataactttccaaaacaactaaaaatgagtaaaggaacataacagattttgcattttggaacaaatgtttcctagacaattttagtaaatctagggaaagattttactgtaaagcagttaaatcatttttttctcaactgtatgttgttcacccgtcacagaaaatgaaattaaaatgtagcaaaacagattatagttctaagatgcttcagtgaaaatatggtttcaataagtacttcaagcagaacatgttttagagtcactgtgactaatcaagttacaaatgggtttatattttaaaagatcattgatttatcatagtatttgtgtttaaacataaatgaaacagtacaagactaagatactctattaacattaattttatgagcaaatttgcattgaaaattaatttgtaggatggccatgtttaattaactaagaaataacctgtctttagtatctataatacactaattacatgtaagtgaaaactgctagttacagagcaaacaaattctttcatcaatgcaggtctatgattctagtaaacatagaattatctatattgatagcccaaaatgtgagataatccttaaaaattaagttggtacagagattcatagataaaatgttactcttccagggtgcacacaagaggcaatgaagcccagggaattacggtaaaaaaagacacagtggacacaatctaaaaaaaatagatagttcccatttggacacttgagaatggttctaaactagtcatagttgaattttaaaagacatgaaggtaatctttaagtattttaatgtagttgaaatggtgacctccaataaaaaatgtgggtatgcaatacaaaaactttttttaaaaatcaataaagccagtcaggatggtcccatatgattaatgcagcaaagcattaaactaaactgaactaggggattttaaataatcaaattccaaagaaataggtttagatttcagataattctgaaaagctcataaacttgtatctaacccatttaacacacgctatctttatgtttaaattcaagaattaaaataacaacatcaaagaaactgaactgtgttgctaaatccatggctcataggaattctctgtcaaagcacgggggactcaccacgtagttttgtagaagctgctccactgactctctcctcccgtacttaatgatccaagacttcagctttgactctgcaagaaccagcagtgagagcagacggtactttaattctaaaaattccattttcattaggtgtagctctgatgtggaggaaacaaaatgaaacctagaaataaaacagggagaatttatagaatgtaactaatagtaacagaactgatgcttacttaacctgttacatgtcagccttaaatagaatgcagccacaagctcttctaactctggctgatcattttctggaaatccgattccttttctagctctggatttaaaagcaaagcatgaatgattgaagtcttcgatttagttctttcccctgccaacacatctctcgtctgtttcttttataagctgtttttgcaatattacataatgttccttacagtactgaacaaaaatacagcctctgaagaaaccatttctgtgatttctaggctgtggataaattcagagtcactcttttcagttaataatacattagaatggtggcattcttagcatgtcttatgggagcccgctttctatttaccaaaggtaggcgcctctgttaaaaaaaaatcatgaaaaaataaaagaaatataaaaagcgtccacctagtgttttaaaaagagacttcctttaaatgcagatattctcttacctctcggccatgtcctctaattgatcaggtggcactggaatcccgttaacagacctggtccggtagatttcatggaatgctcttttgtgggcatccgtgttttgaagcagatcctaagatacagtttaaaaaaaaataaaaaatgaaaaacatgtttcacagagggctaagaagcataatttccagcccgcaccgatgagtcaatgtattcaacaatttgatcccgctgccacattcagaggcagcttggtgcctgtcaaaggctcttaccttgaataggagctgggtgcttgtacttaaaacactatgctggaactgcatctaataattatgcatcttttaaacacacatgacacttgcacagcaatgcattcagacgttttaaaggcacatgatccaaaggaaaatgtaattactgctatgaaatgattttagtattttttgcctttctggatatgttggtttttaaaagcttaaaactgagcatgacaaattgaaacctttaatggcaaaagagattaggctttctactgttattttactttgaatgcatgcagactattataaagtggtatttgcttgccatctaaagtaaatcaatcatattacaatatattttgaaatacccttttgattagaaaatttcaaacaagtgcagggaataccccataggtaacacagtgagaagattaaatgtgatgttaataaatattaattatagactgtatagaactccacaggtttgattcatttatttaggttaatttgaatcttctttgatttgtttgctgtgtttttcatcatttacaaactaatttctaaaaagatgtacatgtattttacactccctcaccaatttctcacatagaagcaaggaagaagtcaggtgaaaggagattcatgccttaatttctagagcttagtttgtgtcttgattgcagaataaatacagtacttaaaaatgtgtcactcattgaaaaagtaagacatattagaccaccaaaataatacattaaaattaatatttttatctcatactaaaatttagcaaattagagaaattagtagcaaaaccagcctaaaatcaagagacacacttggtgggacaagtgaaaacttttctattataaattaaaatgttcaggtttgtatatgcttgcccacatatgacattttaacatggtagaaaaaccttagggccaaactatttctaacctgatatattttgctatgatcacattttgacctgctttgactctgaaggtaagtgcagagatactcacaagtcatgtgtgcctcaagggagggtattatgtgaagccaagaactcatcacaggagggtagagaacaaacaggtgttcttagagcagctattgatgatgagtattctagccattctctacctcctttaccacacacagacacattactgtagcttatggttgggctgaaactttcccaagtgactgcagagcacacttggagttatcaccccagctagctctgatttgtgacagtttttaagtatctactatattgaaaaagtctttacaagctacccaaacaaaaacattttcacacatatgataaaagaaattcttaggccgggtgtggtggctcatgtctgtaatccccgcactttgggtggcggacactggtggatcacgaggtcaggagttcgagatcagcctggccaacatggtgaaaccccgtctctactaaagatacaaaaaattagccaggcatggtggcgtgcacctgtagtcccagctacttggaaggctgaggcaggagaatcacttgaacccaggaggtggaggtcgcagtgagggaagatcacaccattgcactccagcctgggcaacagggtaagactctgtctcaaaaaaaaaaaagaacttcaacagttggcatgatgtcactgattcctctgaaaggccatctcactataaagcagctagatgctgggcaaaatatatgattttaattcaccttgctgggttcacaggaagtaaatgaaatattttaggtcccccattcttagtaaaacatgacccaaaaactagatcacagacctgtaggcaaaaaacaaatagacaaatccagattgtcctgggcaaatatctacaccactgctgagagagattgagtcttacaatgtgaacaggatgaggacactgaaatgagatctcctccatttagtcagaaccctcaatgagggctaacatggccaggttattagcaaatgcaaatacaataggaggaaagcagagaccacgaaccacaggaaacaagccaccatgagtgagaaccagcagaaacaacaaacttatcatgctagaaaaatgtcaataatttaatacttgacaacaatgtgtaagataaaaaggacagtggtttggttaaagtattcataattacttatattgattaagagggggttaagatatggctaactttcaattttgttaaatatctaaggtcaaattttgagggcaatcatactgtacaactagagtttataactttcttgctagtagaaataaaaccatggaataagaaaaatgaggaaggagacaaaaagcaaaacctccttaatcaacttataaatagcaagaaagtagaaaagaagaaaaagtagaacagttagaaagcaaagactcagatgctagaaacaaattcaagtatatcaataataataaataaatgtgaataaagtagaaatttactagttaaaagacagagattaccaaattggacaaacaaacaaaacagaactatcttctttttacaaaagatacacctaatcattaagaacatggataggttaaaattaataaaatggaacacatgtcaggcaaatactaagagaaatctgatataaatgcattaatatcagacaaaatggatttcagaacagaagcattataagtacagtcactccttgactcatgatggggttatgtcccaataaaactcattgtaagttgaaaatgttgtaagtcaaaaatgtatttaatacgcctaaaccaaccaaacattatagcttagcttcaccgacattaaatgtgctcagaacactcacattagcctacaatttggcaaaattatctaacataaagccaaattttataataaaatgttgaatatctcatataagaatatcatatctcatgtcattgctgaatgtatattgcttttgcaccactgtaaagtcaaaaattgtaagttgaatcactataagttggaaaccatctataattaattgcataaagattaaactttcaacttactagaaggtacattattcctgaacttgagcatgcccattaaacttcaaaatatataaaggaaaaactgatagaactgtaaggagaacctgaactatcaacatcactgtggggtttatcaacatgcctctctaaatgagatagagcaaaggaagcaagtgttatagcagcttgttgggtaaagaagggaaagggctgcaggaatggtctttataagaacttgtggtgttttgataatggaagccaactaggaattttgagcagattggtgaaattatctcagctgcattttaaggatcactgtggcaattcttctgaaaataccctatcctccatacgtttgcttcccgtggcttctaagacaacactgtagctggatttcctccaacttcactggttgctccttctcagacttttattggttcttctactcttcaatctcttaatactggattccctccaggatcagtccttggtccctttctcttctctgtatatacttctttatttaatttatccagtctcagagctttaaacatccctctagatgccaatgactccgaatttttatctccaagctgtacttcttccctgagctctcttacctattgcttactccacatatcctcttggatgagaaaaagactcaacatgccccaagctgaattcctgatctttcctcccaaagccgcttcattgtctcctattcttaattgatagaaactgttttttcagttgcacagcccccaaatcatagtgtcatttatgactcttcttctttcacggtatgtatctaatgctgaaaattgttctgccctcacaacatattcagaatctgtccatttctcaccatctctacagctacttcccttgttcaaagcactctaactggatgatggaaatggtaccctggcttctggtctccattcctaacccagtctattctcacatagcagccatatcatgaaaatactgtcattcctttgggaaaaaaaaatggggctgggtgctgcagcttatgcgtgtaattccagcactttaggagggtgggcagatcacttgcacccaggagtttgagaccaggctgggcaacacggtgaaaccctatctctccaaaaaatacaaaaattagtcaggtgtggtggcccatgcctgtagtcccaccttctcgggaggctaaggtggaaggatcactggatcctgggaggcagaggctgcagtgagccatgaccacaccactacactcccgcctcggcaacagagccagaccctatctaaaaaaaaaaaaaagaaaagaaaagaaagaaataaaatggatgaaaaaagaaggttagaacattgtggagcaaatcaacaatgccaaagtgtgattaaggaaagtgaggcagttcaaagaaacaatattggggaaatatacataggcacagaaaacaccacaaaatatataaaacaatattctgaacaattttatgctaataattctgaagacttagtcaaatgcacacatttttagaaagtatgcattatcaatattgacccaattgcaattttgagagcctgaatatggggagacaacagtgaaaaaaaatcaataactcccacttttatggagttgacattatagtgcagaaaatcaagcaaaagataagataaatgattaaaactggtaacagttgagatgatgataaatgctaaagagaaacatcaaatgggaaaggggaaggggagtttgggggaagttgtaatttcaaaagaggtggccagaaaagggtggatgaagaggggaccttttagtaaaggccttaaagagatgaagaagaacacaacgggaatatcagtaagaggatgtttcagactgagggatgagaacattccagaaggatggcaagggtaaagacctcaaggtagggaatatgcttgcctgtttgatgtcatcttttcaatgaggcttcactgacaaccctatttaaaattgcaacaacacctaatatcccatgtccttttactttctaacctaaatttacttattttttatatttattacctttatctgcctcctctcactagaaggtaaattaagggaagggatttttgtctgttttgcttacagatgtatcacaaatgcctaaaacactgctttgcaactgagaaagctcaacagatatttgttgaaagaatagggaagaccagaaaggtacagccaggggagtaggaaggaaactacaagtggcacaatcatagcttacccactgcagcctttaattcctgggctcaagcaatcctcctgcctcagcctcccgagtagctgggactacaggcatgcaccactatgcctaattttttatttttattttttgtagagacagagtctcgctttgttggccaggttggtctcaaacttctggactcatgtgctcctcctgccttggcttctcaacatgctgggattataagtatgagccaccatgccttaaagaaagtctttcaagggtaaagggacaactatgtgaaatgtttgtgacaggtgatgtaagaagactgagaactggccattggatgaggaatgaggcaaagcctggtaaacttcacatggtagatggcaagataaaagcttgattggaatggattttagaaagaatgagagaagagaatttagaaagaagaaagagccaattctctcaaagagctttgctgtaaaaggaaggaagaaaattggacagtagctgggaggggaagtggggctaagaaaaagacttttaaagatgagttaatggcagcatatttgtatgtggatgagtaaactccaacaaagaaagaaagagaaaaaaatagagaagggaggaaggacaggaattaccttttggagagagggtgggatctaatgtacacatagagaggttggcctcggcccagagcacagatggttcacccatagtaacagaagtgaagagcgtgtattcgggcacagatgcaattgcgtaggtgggttgatgtggccgtgggagctggtggcaattcttttctgattgcttctattttctcaaagaaaaaggaagtaatgtcatcagctaagagtgaggatggggaggaggtgtggaaggtttgaagagacaagatatgaaatagttgtcccagaaatgaagagggaatggagtcgggaaatgccttctgattgccaggcaccattaagggcccacttgggttagtcatcgcgcctgggggtgtgtttttttccagccacagtcagctacatgtgtgtgggcatgaactaggcaaagagctggctttcaccggcattgtgtttttaccaggacactaaaacaaagtgaaatacggacaaggcaagcgaggatgtggatgagtggggcttttacattgcatttaagcagagcacaaaaggagatggtaaagagaacaggatacagtgaaaaggtggtagggtaacagattatagggcacagaggagatgaagccttgtctgactggagaggaaggtacttgacaaagagcttgtggaggggtctcatttactggtgatgagcattctaggctatgactgtggagtgagtggctagggttgggtgtaggacaggatcctgggggaagaggtcaagaacctgagaggtcatgatattgggaggatcatctctaggttactgaagttattaagaattatgacatgcattgtcatccaggaaataaaatcttcaagaaaggaaggcaagtgacctaggtagggttggtaactgcaataaggatgtgtagcaggtggcagagcctaatggctactttcatgattccttatgactgaaagccttactttgccaaatcaatactaagaataataaattagtcagtataatcactctacaagtatgataagcaatagctttgtggtcacattttaagcctagtgctgaagacaacctggctcatcagctatgtgaccttgggcaagtcacttaacctctctctgcctacactttcctcatcagcaaaaaaggataataatacctatctcacatccgtcatgttaagtgtttggtaaaaatcaaatacttaggactgaaacatggttaagtcctccataatagttggctatggttattgttatttttctagataactgaacattagggtaactggaaaatagaaaagataatacaggtacactatgttttgcagaatacataagttcttacacatatatacatatatacgttaatttttcagaaatagtaaaacaaaaccactggcagaaccattcacaaagtgaactctcggaaacacacctttaaaaaatgatctgaatccaacttgcaaacgttgcctatgcattaagtgttgaaattgtgttatttttttaaaaggtgtgaagaatgaaaaaaaccaagcattgtaactttgatagcttgttcaagttttcttgacaaaaaccagaattactttttagaccaagatgggaagacaatattcccaaacattcttgatcatacatcaatgattcctaaattgtgattttcccaatttattgcatctccaagtgagcccaatataccagcacagaggtgttacatcaaatcgagagactgagttggtgccattgaggaaacttataatttttagttgttttaataagtcaaacttggccaggcgtggtggctcatgcctgtcatcccagcgctttgggaggctgaggcaggcggatcacttgaggtcaggagttcaaggccagcctggccaacacggcgaaaccacatatctactaaaaatacaaatattagccaggcatggtggtggatgcctgaaatcccagctacatgggaggctgaggcaggagaatcgcttgaacctgggaagaagaggttgcaatgagccaagatcgcaccattgcattccagtctgagagtgacaaagcgagcctccatttcaataataataataattcaagcttttcaccctcaaagcttagcttattataggctcctaatatatatttttcaataaatgagaattgattttaaaattgacaatttaattgttttatgagctactttaagtacccatgcccaggcctagtagaagttcctacctcaatgaaaagatcattctaatattcaccttgaacctggcctgagcccctgtcgctgctttttacctttatctctttattacattccttagttttctcttcagtctagtcctttctgggtttttgtttgtttgtttgcctcagataaccattttctccaactcctgcccctctctctctccctgatccacttcatttctggtttctatgctttgttcactagactttggcagagagattgttctagctgtattcttgggggttggcacagggtgtctctctctcactgtctctcaagggagctagaagggctcatgaagggcctgaaatcatatagccattgaaacacacagatagcatgtgcattggccaacttaggactcactcccccgtaggagatactactgtctatagtgtgccttgaattaatatttctacaaactgttataattaactagtaaatagcagttacattgtctggcattttctctgtggtgggacatttaagtcaaagttaaaggtattatacaaagaacaattgtgtagatgcttctcagacctctagattggaggcaccacaaacgcctggacctcgtctgtgcccctcacctgttgccctggagctgaaaacctgcacatagtaggaatatttgctaccatgcctatttgctgaattaacgtatttaattctcaataaatatacattctacatttcatttaaaattctaagttgacttctttagtatcaaatatttacatcaattaaaatagtttcatatgtaggtaacaggtacactagaatcctaatccccaccattatgtaatatactcatgtaagaaacatgcacatgtaccccctgaatctgcaatttaaaaataaataaataaacaaatgccagttaaggtaaaaaaatagtttcaattaagttttccatgaaaaaattattgtgtgttatatatgcttagttgctaatttgctaaagatgttattgtttgtgtaatactattttcacacttttctctatttttaatatactggggtgattcaaaattgacatggcccaggaaactgattcaatcccaggaaaattcttgtgacttgatctcgtatgaggcctgaactctgggtcccttacggcatagctgcccccactttagggcactaaggcacagataagcaggccccgcttttatttgtgagtatctgcacagatgaagaagaccccaaagtcatgcttgcatctgagaagccaaatgacagagagttcagtgtgtgtgtttgtctgcgttggtgattgggggaggagaggagctaagagatcatcagcaactttaaaagtgtctaaaggcactgagtatcagaaaaggccaagaggaaatggaggcaggaccctgagtgatggcctctgcagatcatcaaatcttgccgtggccatctggtttgatgagcttgtctgaggttgagtctgtcaagttgaaatggccaagatcggcaatggcatcacatctctgtgtctctgtatatctagctccaaaagtaaagccccagagaggcataaaataataaaaggcaataaaatctgttgtaaatttgctttatgatcttgtctagaatacaggacagtgtatttccttggggtaatttttcaaaaatatcaataatttggcagaaaatatacatgggctatacattgcccatgtgtagtcaggagtagaaatctctatttttcacatatgcaggaataccccaccacattacagcaaatgaagtatacaaattcaattgcataaaatgcaagattgcattaatgtgatgttaatgaaaaacggcatttttagttaggcctgtaatatcacaaaacacaaagaggaaatatattggaaattataccatatacaactgatcatatactaagtttaaaacatcccaaatgactaagagaccatcaaagcctaaccccaccacttcctacagcctccattccttctacccccaccccacagcaccaagacataagaacttctgcctgccttcctttgagaatggaggcagaaatgaggtctggagccaatggccggccacattattatgtaaatgcataccatctatgcttatcttttgaaaaataatatataacaacagaaataacaaagatagctgcagatgaaaaaaataccacacaggtatggaaaatatctcaggaagtcaacccactggaaccgtcattaaccagtgtaagaaagaaacaatcaaattagagaactctaagaaggtgtgacgtctccgatcatgtagaattaatatttggggcgtccccgccagagcaggttgtaactaggctacctctccagaccacagtagggctgttatgctgcaaggttttccaaccagaatttttaccttatgttgctcaagtttccgttgtatcgtgtttgctgtttcctcgtggacctgttgaacggttatttcctctctcagggccacctccgctctgtacagccaggcacctatggtgcccagaggtgcaggaagagatttatcaagctgtatatgccagtcaaagagctaaaatttaaaaagcagaaaagtaaaatatctttaatacagatggcaatttataaaattgcacccaaataatagtaaagcatacataaagctttaagttaatgatttcaggctaagttaataaatatcaaataagcaaatgtctgtgttctgagtttgacactttagggatggggagaaaattacagttaaaagcaaattttgaagaaactgaaaatacatcttaaacatggaagaatattatcagaagtgtaagcaattttcctcttacaggagtagcatgaagcacccactgattttcagtgtggcttttgctgaaagggaagggatcaggtttggtgacatgcttggaggatgcagcagttatacacctggcacatgtgtatcttggtcgtcggaatgagaatcccattaaaacctcccacgtgatcagaacaagttcagaaaaatgaggattatctaagcagctctggacaaagatgggtttaaaggattctttctataatcctatgattgtctacccttctctccatctcttccattttacccaattctcagacacatttcctagcttactggaaagccaggtgggatgagttgaggtgcttaggaactagcctattctttaatggagtcactagaaaaaatgagactatcaaaaaaaaaattaggctgggtgcagtggctcactccagtaatcccagaaatttgggaagccaagatggatgagatgcttgagcccaggagtttaaaaccaccctgggcaatatagtgagatctcatctctacaaaaaaaaaaaaaaaaaaaaaaaattagccaagtatggtggtacatgcctgtggtcccagctacttgggaggctgaggtaggatgattgcttgagccaaggaggttgaagctgcagtgagctgtgattgtgccactgcactttagcctgggtgacagagcaagacactatctcaaaaacaaaataaaataaagtaaagaatatatggtaagttcaagacaaatattcttattagtgatagaagtgttccaggggtttgaaatcttggcctttaagcatgaagaatatgaatatgaaagatactgagcaattttccttcagattcatgatcagataaaaaaagatgcttgaattaaagaatgcaaaactgtatgtcaacacaggaaggtcattaactgttgatgaaacatgattttagaatacaagaagttgctgtggctctactctggagaatctgctacaagaccagagagtcacctcttctaaaccacccagaaggaagttgtgtaaagtgtgaagtgatccagatggtctcaggactttaatctatcatctagttaattgctgatatcacatagagggaagccaaggcaagaaaatagctgttaaaccaaagacttccattaacttacaggaaaactagacaaggaggcaaagattctcccatagttaagtctttctagcctcagacagaggcagtagaacctgttgccataccactgtgtagaaatagatgatgaaaaatattcttttctaaatttattaagctcagtataactaattgtgggagaacttaccctggaggtcactctatcccaagattgttttaccaatgcttggtcaagtgacaatttaccgtctctgtgtaatggttgtattaaatgttcaatctgtttcctcttcatttcatattgaactctgaagtgcttaaatgactaaaagaggaaaaacagcaacagtatggcaatgagtcaaaaaaagcaaaagcaaaggaaagcacatttcctaaataacaatcttttctatttggataacactcaatatatgttgttgataataataacggtagttatgatactaatagcagctgtcattcatcaagccctgacatagcttgaccctgtgctaagtgctttcttcatattatcctctctggttctctccatcaccctacacatgcattattattctgaagcccagaaatgacttatcaaggacaagtagtagaggtaggactaaagcctaggatttctcatttctagtaaagtaatttgtgtaccagtatatgtttgtcaggaaatcatagtaaacaggagtataaatcttagctaataatcaagatagttgctttacttcaagtaccaaacaatttacaaatagaaattgcatatatcaaaataatgcagaattaaagctgtctagatttgtgtttaagtaagcctgcataaagaggtttactttaggggaccatgtttacatgataatcctttgctttaatttcatggtattaaaatattaagtatatcacagtacagttgacatcaatgtattatatgtagacttaactataagcttaatgctaacattaaaacaatttttaaagttttatattttacattaactaaattaacccatcctaaaatatgactccaaatctaaacataaaatgaaaagataattaaaatgtgcaattatgttacaggagaatggccccacaaaagttagcagataacacaactaaaagaatttcaaaattataaacaaacatgtaaattcacgtgaagaacactggggggagatagtgaactagaattttatctacaaggttttctttcattttctctaactgaatggaattttaaaaataccaaaacataggctgggcacggtggctcacacctgtaaccccagcacttttggagatcgaggcgggcggatcatgaggtcaagagattgagatcatcctggccaacatggtgaaagcccgtcgccattaaaaatacaaaaattagctgagcatagtggcgcatgcctgtagtcccagctactcaggaggctgaggcaggagaatcgcttgagcctgggaggcggaggttgcagtgagctgagatcacgatcatgccactacactccagcttggcgacagagtgacactctgactaaaaaaaatattaaaaaaaacaacaaaaaaataaatttaaaaaaaaacaaaacatcaaatcaacttttaaattttattccacaggattctgagtgaaaaaactggaaaatgcagcatttgctacagattgaaagagatttaaaatgctgattacagaatgtaaagatgaaatgaaattttccctaaattcagatttcagagagactctaaacccatttttatgagactagtgatcaccttcgggctgaaaggaggatttctgttttctgttttcctaagcctttgtttccctcatgaactagcatctgtataacagatagctttataacttggaatttattttttgataattggtgccaaacctaaacctcatcagtggactaaataagtatattcactctgttcttgcaattcttttctccatttactggcttaatcattttttaatggatctcagcccagaaaattttattttggggaaaaaagcttacactgaatttcaaagcaaaagagtacatgcatattaaccacatatttattgctttgctaagtttgacaaatataatattgatgctatcatccacctaaattcaggcatattttaaagatacaattatataaaatcactaatgccatagataaatcttttgtctaccatgttgaagttctcacttcatttgacctttttctgtagcagaaatgactgaaatatgatgtcgagtagaatatattacagaatataattcagaatatactatatttaattttgccactaaaagggactgatgttttacattgggaaaaatgataatgctgcatcaaataaatcacaatttttattaatttttattttttctccaacttttattttaagttctagggtacatgtacaggaagatttgttacataggtaatcatgtgccatggtggtttgctgcacagatcaacccatcatctaggtactaagcccagcatccattagctattcttcctgatgctctccttctcccactcccccacaggccccagtgtgtgttgttcctccatgtgtccatgtgttctcattgttcagctcccacttataagtgagaacacgcagggtttggttttctgttcctgcattagtttgctgaggataatgacttccagttccatccatgtccctgcaaagggcatgatcttgttcctttatatggcagcctagtattccatggtgtatatgtaccagattttatttctccagtctacattgatgggcatttgggttgattctgtgtctttgctattgaaatcacactttgtaaatgggaataaactgtgttttgtgtcttggaagtgaaaatcagaagcagaagtccaattaatgacactgtagtcagactggagaaaaacattaactctgagctcaacttgaatgcaatggtgttggactaggcaggtcgcagtcgaaactgatccctttaatggaccctccaatactcatgttgcaatcctttgttaaattcagtttattttatactaattttcaatttgactcaactctttgttcttggtagatttttgggttaggtgagatctataagatcatgagttctggccgggcatggtggctcacgcctgtaatcccagcactttgggaggccgaggcaggtggatcccgaggtcaggagattgagaccatcctggctaacatggtgaaaccccatctctactaaaaatacaaaaaattagccaggtgtggtggtgggtgcctgtagtcccagctactcaggaggctgaggcaggagaatggtgtgaacccaggaggcagagcttgcagtgatccaagatcacgccattgcactctagcctgggagagagagtgagactccgtctcaaaaaaaaaaaaaaatcatgagttctataaacacaatgactctgcatttgttttccaagtcatctataagactgagttatggaaaagtgatgaagcctcagtgctccatatatagtgtggacacaatgcaacttaagactatctacataagttagaaatacaattattaaattatatgcaaacttagggtaatgaatgttatgtctttaaagacttttctcattaatgtaatttgaagcattaaatggagatcaaatgacatatataaatattagtcaaaaatagcttttgaaaaattcaaaaatcttctccatacaatacctgatatttatcctgtaaatttgattccaccatctgtgctcttgtcaaatctctctcaaattgttctatccaaactttcatttccttaaaaattactctgtcttctctctggaaatgaggagacattacaattttattagtatctgtgcatttatttaattgctgattaatacttgactgattctagaagagacttaatatttagtaagtcccaactgtctctgaaaaatttcctttctccttacccccacctttaggacagtaagaagcaaaagttaactctagaaaagtatcttagttatcttattgaataacgaaattaaccaactccattttttttttgccaagtaacgctaatttaataaagaaaatgtgaccaggagggaatttcctaagtacacaaataataagagtaatagctggagtagaaacacagtcctgtgggttgcttcctacccaaagccattggtaacccagaagacagttctagatgggattcattttgactgaatttgaggagttacacccagaataccattgggtgacttgtctatattactatttaaactgatattaggtattacaatctccatgtggacagaaaacacatttatcttgttcaacacagtattcctagaccctgggaacataatacctattagagatttatcaagttatttggtgaataaatgtatccaggtcaccactcatctcaaaaatgaaaaataaaattgggattttcatacttattttcacaaataatgacaagggccattctataatagcactgatttagtgaaaatatcctaacttttcatcaagatgtagtgtctcataagaatgccaagtattcataatcataccgtacatgatttttcggcatttacaaaatgcaactccagcatctcacttgctgctgacagtgctgtgacacaggtaaaatgactgtcccccttggcaggtgatgtttccgaatggaaagaatgccatttatggaggcaggctaaactgggtttcaaattctggctttgccatgcattagctctgtgagcttggtgtgtcttttttttttttttttttcgttaacctctctactgtcatactacaggatgtactaaagggtgtgttaaatcatcacggaccctttcaattgttttgctgagaattagaggtaatctatgtagcatgtccagtacagaggttgtcacattctcatgatccatgccttctctcactttcttgtcttgcaaaagcagttgtcttctgcctaaacacttaccacattttcccttggataatgcctttttcagaactcggctcaggcacaacctactctaggaagattttctaacccagaagtctgagtgagggcatctgtttcctatgccagtggttctctcacttagtacacactagaaatcatctgaggggcttataaaaacacaaattgctgggcaccacccccagagtttctggctgagtggatgtggggtagagccaaaaatccgtatgtctaagttcccaggtgaatctgatgctgctggtgaaggaatcatatattgagaacacttctctatgatcctgtgacaacctcagcgctaatattcacccaaatgcattatataaagtcagccctctgttttcttagattcaatcaatagcagattgaaaatattcagaaaataaacaataaaaataacaatacagcaataaagataatacaaacaaaatacaacacagtataacagctatttaaatagcatttactttgtgttaggtattatacataatctacagattaaagtatatgggaggatatgtgtaggttatatgcaaatactacactattttatatcaggaacctgagcatcataaattttgctatcttgggggtcctggaaccaatcacttgtgaatatctaggaacaactacacaaaatccttgtcaggcctctgagcccaagtctgcacgtatatatccagatggcctgaggcaactgaagaaccacaaaataagtgaaaatggctggttcctgccttaaccgatgacattccaccattgtgatttgttcctgccccatcctaactgatcaattgatcttgtgaaattctttctctggacaatgaatctcggaagctccccattcagcaccttgtaacccctgcctctgtctgcaagagaaaaaccccctttgactgtaattttccactaccctcccaaatcctataaaactgccccacccctatctacctttttcggactcagtctgcctgcacttgggtgattaaaaagctttattgctcacacaaagcctgtttgttgggctcttcacacggacacacgtgacatttggtgctgaagatctgggacagggggattccttcaggagaccagtcccctgtcctcaccctcactccatgagaagatccacctatgaccttgggtcctcaggccagcccaaggaacatcttaccaatttcaaatcgggcaagcggtcttttcactctcttctccagcttctctcgctacctttcaatctccctgtccttccaattccagttctttttcctctctaatagagacaaaggagacacattttatctgtggacacaaaactccagcgtgggtcacggacttgggaagacagtcttcccttggtgtttaatcaccgtgtggatgcctgccctgatcattcacccacattccactggtgtctgatcactgtggggatgcctgcctgattattcacccacattccactagtgtctgatcactgtggggatgcctgcctgattattcacccacattccactagtgtctgatcactgtggggatgcctgcctgattattcacccacattccactagtgtctgatcactgtggggacgcctgccttggtcattcacccacattcccttggtggcaaatcaattgtggagacgcctgctttggctgctcacccacattacagcccagggctgctcaccacccccttctctgtgtctctacctttctctttaaacttacctccttcactatgggcaagcttccaccctccattcccccttcttctcccttagcctgtgttctcaagaacttaaaacctcttcatctcacgcctgacctaaaaccttactgccttattttcttctgcaacactgcttggccccaatacaaactcaacaatggttctaaatggccagaaaacagcacttttgatttctccatcttacaagacctggatgatttttcttgaaaaatgtgcaaatggtctgagatgcctgacatccaggcattcttttacacatcagtccctccctagtctctgctcccagtgcgactcatcacaaatcttctttctctcctgtctgttccttcagtctccaccccaagctctgagtcctttgaatcctccttttctatggacccatctgacctctcccctcctcaccaggctgctcctcaccaggctgagccaggtcctaattcttcctcagcctccactccccagccctataatccttctatcacctccccctcctcccaccctgtctggcttatagttttgttccacgactagccctccccaacctgcccaacgatttcctcttacagaggtggctgcagctcaaggcagagtcaaggttaaccctcctttttctttatctgacctctctcaaatcagttagtgttcaggctctttttcgtcaagtataaaagcccagcccagttcatggcctgtttggcaacaacccttagatgctttgccgccctagacccagaggggccagaaggccgtcctattctcaatatgcattttactactcaacccactcccaacattagaaaaagctccaaaaattagattctggccctcaaaccccacaacaagacttaatcaatctcgccttcaaggtgtacaataatagagaagagtcagccaagcggcaacttatttctgagttgcaattacttgcctccactgtgagagaaaccccagccacatctccagcacacaagaacttcaaaatacctaaaccacagtggccaggcattcctccaggaccttctcccccaggatcttgcttcaagtgctggaaatctggccactgggccaaggaatgaccacagcctgggattcctcctaagccatgtcccacttgtgcaggaacccactggaaataggactgtccaacttgcctggaagccactcccagagcccctggaactctggcccaaggctctctgactgactccttcccagatcttctcagcttagcggctgaagactgacacagcccaatcacctcggaagcctcctggaccatcacagatgctttaggtaactcttagagtggagtgtaagtccatacccttcttaatcaatacggaggctacccactccacattaccttcttttcaagggcctgtttaccttgcccccataactgttgtggatattgatggccaggctgctgggccctttaaaactcccccactctggtgtcaacttggaaaacagtcttttatgcctcttttttagttatccccatctgcccagttcccttattagatcaagacattttaagtgaattatctgcttctctgactattcctgggctacagccacatctcattgctaccctttcccctgttcaaaacctccttcatgtcttcctcttgtatcccctgcacctgaacccacaagtatgagacaactctactccctccctagcaattgaccacatgcccattactatcccattaaaatctaatcatccttaccctgctcaacaccagtatcccatcccacaacaggctttgagaggactaaagcctgtccaggatcttcaccttatcaaaaaaattgtcttgcctatccaccccgtggtgccaaacccatatactctcctatcctcaatacctccctccacaaccccttattctgttctggatttcaaagatgctttctttgctattcctttacacccttcatcccagcctctcttcgctttcatttggactgaccctgatacccatcagtctcagcaacttacctgggctgtactgctgcaaggcttcagggacagcgcccattacttcagtcaagccctttctcatactttactttctttctgtccatctgcttctcaccgtattcaatattttgacaaccttctactttatagcccctcctacagatcttcccaacaggacatcctcctgctcctccaacatctattctcaaaaggataatgcaactcccccgtcaaaggccaaatttcttcctcatccattacctatctcagcataactcttcataaaagcacatatgctctccctgttgatcgtgtccggctaatctcccaaaccccaaccccttctacaaagcaacaactcctttccttcctaggcatagttaggtactttcgcctttggatatctgtttttgccatcctgactaaaccatcatacaaaaggaaacctagctgaccccatagatcctaaatcctttccccactcgtctttccgttccttaaaaactgtcctaaaagctgctcacacactagctctccctaactcatcccaacccttttcattacacgcagccaaagtacaggactgtgcagtcagaattcttacacaagagccgggactgcactctgtagcctttctatccgaacaacctgaccgcacagttctgagctggccttcatgtctgtatgcagtgacagccaccgctttaatacttttagaggccatcaaaatcacaagctatgctccatttactctacagttcccataactttcaaaatccattttcctcctcacacttgatgcgtatactttctgctccctagctccttcaactgtactcactatttgttgaatctcccacaattaccattgttcctggcctggacttcaatctggcctcccacattattcctgctaccacacctgacccccatgattgtatctctctgatccacctggcattcactccatttccccatatttccttctttcctgttcctcaccctgatcacacttggtttattgatggcagttccaccaggcctaattgccactcaccagcaaaggcaggctatgctatagtatcttccacatctatcattcaggctactgctccgccctcctccactacctctcagcaagccaaactcattgccttaactcaggccctcactcttgcaaagggactacacgtcaatatttatactgaccctaaatatgccttccatatcctgcaccaccatgctgttacatgggctgaaagagttttcctcaccatgcaagggtcctccatcgttaatgactctttaataaaaactcttctcaaggctgctttacttccaaaggaagctggagtccttcactgcaaaggccatcaaaaagcctcagaccccattgctcaaggcaacaattatgctgataagacagctaaagaagcagccagtattcctacttatgtccctcatggccagtttttctccttctcatcagtcactcctactcactctcccactgaagtttccacctatcaatccctccctactcaaggcaaatagttctttgaccaaggaaaattcctccttccagccttacagctcattccattctatcgtttttcataacctcttccatgtaggttacaagccactagccctcctcttagaacctctcatttcctttccatcatggaaatctatcctcaaggaaatcacttctcagtgttccatttgctattctcccactcctcagggagttcgcccctgcccaggattggcagattgactttacccacatgccccgagtcaggaaactaaaatacctcttggtctgtgcagacactttcactggatgggtagaggcctttccctcagggtctgagaaggccaccgcggtcatctcctcccttctgttgacataattcctcaatttagcctcccgctctacccagttgtcccatcaatccccattacaacttctaatggctgctgccctagctggatccctagtgttagatatgagttctaaatttcttttcaaagaatcaatatgtcagtaggttcaattctttgccttctacttttaaacttaacttcctcgtaaagcaaactttttcaattacctgctccaccctgactcatttcaatcacctgctccaccctgactcattccgattacctgctccaccctgactcattctgattacctgttccaccctgactcattccaatgacctgctgtcataaccatttttcctgccaaaccactcaccctgtcactctctttaaattagccaattgaaattagtttagcctgtgcggtctaaccctagccaataggggaaggacgcagcagcaggggccacgtgcatcagggataagaaccccttcccgtcccttgtccaagtgtgtgctcaccattgctccatctgtaagggtgcaaccttctatagaagtaacttgccttgctgagaattaaaaagaaaattttatattcgagtgctatttcttttgtggcacagaaacttcatatataatactaggagtctgggtacaagacacctcttttagtgctctttctcattttttcactttgcatttccagtgttgcacaaggtctcttcttctgtgactcctctacctacatgtgtctacctgctaataggacaggcacgtgcacactagttttccttactcccaaaattcaatttgcaaataggactgaacagcttcctcttcccctcatgacaccaacacttcaccactattttgttttatttttcttattaatatagaagacaggaataggcctcgacttactgctgaaaaaggagaactctgtatatttttaaatgaagagtgttgtttttacccaaatcaatctggcctggtgtatgacaacataaaaaaactcaaggatagagtccaaaaacttgccaaccaagcaaataattacgctgaaccgccttgggcactctctaactggatgtcctggttcctcccaattcttagtcctttattacctctttttctccttctcttattcagaccttgtgtcttctgtttagtttctcaattcacacaaaaccacatccaggccatcaccaatcattctatatgacaaatgctccttctaacaaccccacgatatcaccccttaccccaaaatctttcttcagtttaatctctcccactctaggttcccacatcagcccaatcctgctcgaagcagctctgagaaacatcccccacaaattttcaatgccccaacacttcaccactattttgttttgtttttcttattaatataagaagacaggaatgtcaggtctctgagtccaagtctgcacgtatacattcagatggctgaggcaactgaagaaccagaaaagaagtgaaaatggctggttcctgccttaaccgatgacattccaccattgtggtttgttcctgccccacactaactggtcaagtgaccttgtgaaattctttctcctggacaatgaatctcggaagctccccaccgagcaccttgtaacacctgcccctgtctgcaagagaaaaaacccctttgactgtaattttccactacccacccaaatcctataaaactgccccacctctgtctccctttgctgactcctttttcaaactcagtctgcctgcacttgggtgattaaaaagctttattgctcgtacaaagcctgtttggtgggctcttcacatggacacgtttgacactccttatgtatctttttaatctccatcatctaacacagtgtctggcactcagaatcactcaatatatgattgcagaataagcaataagttagaaactcagttaaaagtagaaagaaatggaactggagcccaagactacaaagcttcaattcttcccaggatgtcttttctgaatgaacaggtgaatataattaaggtacatgttttattatcagttgattctcatgcccagaaaagcattgataccacattcttatgagctcagagagaaaacttgttcttgatgtgtacccaaggtaccagaggtcagtgtggccaccagaagtgacccatctaacagtgagcacaagacttcattgtgagcctgaggacaggctgctcaccaacttctggatttaaaaagcacttgactgccctgaagaggagctatttgttatacaaagtcatctgagagaaaagggttatgttcttaaaataactttattagagcctatttagtaaatgactttctaatggttggaaagtgtctagcagattgcaataaggtgagaaggatgtcgctatttatatactcaacattctcctttctaagagaaaaatgaagtacaaaacaatatttatagcccattagtctagggcttttcttcaactgataactttcacacacattcagaagacgtggcaacctattgcttatatctaaattccaagcagctatactgccagcattctctctactttttctttcactttattgtttttctttctctctcattcactcatacacacacacacacaaacacagacacataagtcacatttacatttgtgtaccatgttcacatatacataacctcatactttatggagcatgatatttaaaaaatttactatctgatatgaaattagttgcttctgatttttctattccaatgttgatataaatacaaatatccttaacctgtggcctagatggaacataaagaaaaacggaaaagctgaaatatgggacatgcattcaataacttggatatggacaggaattcataaccattcattctgctaatatcttttgagcacccatgacatgtcatgaattttactaaaccatgagaccgaatactgagcagaagagagtgaggaaactcagactgacaagctgatcgaatacttaccttgttcattgattctctgctaacattttaagatacaaaactaaacctttattttgtttttattttctgtgtcacatttaaagacaccatacgtagttactgtaagtcctttttattagtgttattaagtattataaagaagaaattaattgatagataccattttataatgaaagattaatgggcaagtccatgggagtagcttagactatcactaacatttggtaacacatatgtatgttatttgttctgttagaaaggaaacgcaaatgatgtgattaaagtattaagagaaatgtatacataaagacaaaaacatgcaagggaatgactaaaatgctacagaatgcaggatgtttgaaagaggtcatcaatgcaagattacttaaatcttaccttaaaattttgtacagaatttgcaaaagatgggaaacctggaagtatttcctaacaatatgaaaagataatatatagaaatataatataaatcagggtcaaaaattatttagaaaacaagaataaaatcaatggaaaggcatccgcctttagagaaataggcaatcatttcaagggtatatttactttaagacattttcatagcttttgaaactacaaaaatattcaactccaataaggcaacatcatttcctagaatatcacatttttaacttgaaatagtcatatgtagctatatattttgtaaacatatctcgaaataacattaaatattttagaaggtaaactatgtaaagaagaggtatatggactcatattactttccctataaatatacacagcacacatgtttctttgtcctcataagaattaagaatgtgttgtgcttcttagggcagtcaggaatgtttgttgcaatggaagaacagatgggtgaaaaaataaatgaaagtttagaaggtgaatgagataagccaatagacctattttatttatttatgactgagtgctaattattcaagaaatatcttaaggggaaaagttcatcagttttattggatgagattaaaaaaacccatggtgatgtcgattttcagtaagaaaatcatatttaaaatggtatcgataaaatacttaattcaaataaaatcacaaaggggatatataaatcaaatacacacaaaaatgaaagcctggtagatatgttcatgccaagaatttttaaaaaaatgaattaagagagtaagagctgagtgacaaatactgagtactttgaggtgagggctcaaaactaatacgcatagtttacaaaatattaaaggttcactagacagaattaggttaccattaactgttaaatataagccctatgtcataacaaaaaaatacattattcaaaatattcagttttagatgtttatgtactacatgacaaatgccactaaaaaagggcgaagcttccaatacattttcctcaaaattaatttttgagataataagcctgaataaatcatatgcatcctctttttaggaaagggatagagggaatttttttaacgaccagaatttattttctggatgattaaagtaacctctgaaaataataaagcttctttagtaaagtatattaaaaagcctatatcaatagattgtgtgtttcgaatctctaaggatttttgcattaaactcctgctcatgagcattaactaaagcatctccttttgtttttttagatgcttccagccactcagtttactaatctggagagatgattaatgtcagagactctaaaacagtaaaacctcagacaccaaattagatataaatccatctgggtaatataaggacttcacgtataaaaaccagatggaagtttggatggattttctctgtgctatatgaggtaagtctaatgtgttttcttatagagtttcttattcacacagcaatattatcaaaacccagcaagccccagatgactccaaaatatttgcatcaatccatgccagcatttgcacatggagtctttgctttagccatttgtggtgctttttagaaacaattactttactagtaataactatagttaagtcacgctggtggccaatgtttgtgccccaatcctggcaaggaacaaaagaggttccctgaacttattgtttttaagaagctaacatatttctatcaaatgccaaattaatttcatttagagacctaggaaacagtagttacctctattttgcttattcttttatgaagtcactgatttctaactattggcgtgatgtctacttgtaagcttttggttatgctccttagcctttttcttctttatatatgtttctaagtctatttagaaaacatattgaccaggtgtggtggctcacgcctgtaatcccagcactttgggaggccgaggtgagaggatcatgaggttaggagatcaagaccatcctggctaacacagtgaaaccccgtctccactaaaaaatacaaaaaaattagccgggcgtggtggcgggcgcctgtagtcccagctacttgggaggctgaggcaggagaatggcatgaacctgggaggcggagcttgcagtgagccgagatcgcaccactgcactccagcctgggtgacagagtgagactccatctcaaaaaaaaaaaaaaaaagaaaacatattttacattttttggttttcttattactcttcattgtcatctcaaattgctctgaaaactccagttgagacctgaacagtgaagacagacagtttttcacacatcttgaaaattccatttcttatttttcctgatgtcatttgccttataattatttttttcaggaagaaaggagaaaggaagaggaggagcaacttctaattaatttaaaattccgcagtgaatccacctctctatgtaattaaaaatagaatacaatactacttcaaaaatattaaaagaatggtcatgtccgttgtttaaaaaaacaggaaaacaggcagtctggtgtcttggagtgtgaaataggacaaactttctggttggagtgtgaaataggacaaactttctacaaggcaacacgaaaaacatttttaaaagcattaaaattttgtatgccctttagcctaggaattccacttctaaagaagaatcttggccaggcgtggtggctcatgcctgtgatcccagcactttgggaggcagaggcaggcagatcacttgaggtcaggagtctgagactagcctggccaacatgtgaaacccaatctctactagaaacagaaaacaatagctgggcatggtgatgtgcaactgaaatcacagctacttaggaggctgaggcaggagaattgtttgaacccggctggcagaggttgcagtgagccaagattgtgctactgcactccagcctgggcgaaagagcaagactccatctcacaaaaaaaaaaaaaaggaaagaatctcggaacaatgttttattacaagattgttcataaaagcattgcttataacaacaaaaattataaattaaaacaagattgagtaataaattaatgtacatacataagttgacctgcagaattctttataatgttcatggaagaagaaaattataaaattgtatggataccataattctatttttattaaaatattgtatgtatctgccatatataatacaaatgttgggaattaacatcaacatattaatttttctctagtataggttctctctagaaggtcaaatacagaaaattttttccttttcctttttttcttgatttaaaaaatttatgacaattaacatatgtaatttgagcagcatgaaaaatgttaatgttatttaaattatttaaaggctgaaaaatctaatgacagtgaataattagaacttttacaaattgcgtcttacttccatatgtttgctgtcaatagatgtaataaaatccaaaagtcaaaattagatttgatcagatcaaccagagcgaggggattaaagatctagatgtgcaaatgctatgacagaaatacaattacttcaattctcagatcactaagatggagttcccaacactgctatcttttctcagttttagtgtaccagcatcacataccttacatttgttattagcaatgctttctctaatatatccaacatacaaaccagaaaaaccctttcctctaatcatcaccccatttggtgatagctttttaaaatcagttggtctcatattaaaatgcattcaaatttaattttttgagaacagtatactcaaaaagctgagtcactgtcattgcatataccagtgatacttgaagaaagcaaatacctacatcatcctcttgcccatcagtgcttgcattgtggatgtcaggataatgtttcagaaactgggctacataggtcataatagatttctcatctggtttatccacatcaacgtctgaaaaaacaaaaaagaaatgtgaataaactaattagcattcattggattttgataatacaagtttggtatctagctatcacaccaaaaacgctaaacgcagaaggaaaacagaagtactatttagaattttggacggggaggagggtaaaccaaatttagtctggatattacatgatgaaaattatattactcagaaagatgacacatttaaacaaacagcgtttaagaaagtagcatatgtgtcatttaaataagacatacagtatctcatgagacagtatctcccaaatgggtgagatacggtatgattcctcatacagtatctcatactagttctattcatactagtgaatagaacacaaataatatgtaaattttagaactggcataaataggaagtacaaaaatgcttacaagtgtgacactgaatgacatatatatatatatacacacactatatatggccaaatatagacaagccccctctctgcccccacaaatttcactttagaagaaaggcagatgccttatattcaatttcctgggcagcctcctctttgtggagcattctctccaaattacagtgctttgagcaatcaagcactcttcgagggaaactcttcgagggcctgagaagccctcaatcactgtgattttgaagcttatagatatttatctaatacaaatggtaaaaatcaggcaaataaattcatacagatttagtaattatacatggaggtaagaatgcataagtaaaacgtgttgtaaacaagtcttttaaatatcaattttaaaggcaatagaaatgattatatcttacagagcaatttatagagcagaaagcaaaccaaattgccacaatgaagtataaaactaatctaatctttcgtaaaagttctttttgattagaggtataatttctagagacttgcaatatagggtttaaagagtgctgcaactcacactatttaaaaggaagcgaagataatgtattctgaaatttgttaaatgactcaaaggtgatgagtcaaaccgttgagtaaaacttttttttcaggaaatatgaaagtggaaagaaaagcaatatttaatacatgatttaacatagtatatgctgttaactatatatgtaaatcataaaataattattataatagcttttggtctacctaatctgtattcctaaaagcttatacatccaagttggctaaataactttttgaaggggaagttctcattaagaaattagaggaatgtcttatatctaggatagccttgtatttaggcaacctcagtttctaatcatcaaagaaaatattaagatcttctggtctggtggatatgaaagaatcatgcatattctcctttcatcccactctaggaataatgtcagctctgatacatcctctgaagtcgatggctggaatatgtgtttttcccttgatttatttttgtgcagaaagaaggcagaaagccctttgatatcctagtgaaagtggggtgggggcagagtgggactcaaaaacagaatcctaaaatggcaaggaatctccatggggcccttcatctcagaggaaacctaactgggtctctgtaacttactcttggaaacacaagtctatcctctttgttttagagctagggaagttcagtctgaaattccatctttaaaaataatttttggtggatcccatgaaaacagagagtagattggtggttaccagaggccaggaagggtagggaggagaggggaaaaataatttgctttcactgtatatttacatttctgcattcactggtagaaatgtccataattgccagcccaaataagaaattatctgtgacatttggaaacttcactttgatacttttgtttcaacataacaacttattagtttataaaagtttatcaaaggcatctaaattgtcttttgaaggcttgaaagagttcactccatttccaaaaagtcttagcactcacgcccttaccaaaaaacgtgccaaacaattgaaatgacaaatattagtcaaacatttgtgaagtttgctgattgacaccaaaacactgcatggttaacaacatttctaagtatgaataatctacatctttcagacctctgagattatatagagtaattatattatcctgtcacctacccctcatacacacacttctaaaactttcattccacccttaagtatattaagtccagttcacccgactgacataccaatgccaaagtgctgtttggagcaatgggatcatattttaccccaaccatggtggtagatatttatccagaagaaaattgatgcaggaaaataccattacttgccacttttctccagctttctggcctccaatagaatcttggaagtcatgtgtatttctgggtttaagacataaaaaccctccgtgttaaggtatataacagtcaatgaatattcagcctaccttcaggatctagcagtcttgggatccccagttctgtttcggcgatagtgaaagcatcctccaaattttctcggttggatctgcctttcactgtctccaagtccaccaattccggtcgaatggcatgaataactgaatgaaaggcaaccccgcttctccaactcttcccaaaatcttttacttctattccagtctgcctttgtgttataaaaacataaaatgatgtcacattctgaatagatacaagcactttcttcaaggcctcatgcaaaatccagtgcttttcaccaacgatatgcagagagctgtatcagttcattgtatttgagaaaaattaagggaaacaaaatttttagggggcaacaagataagatgtcgaaattctggttctatatttagagatttctatgttggatttttcagcaattaagatagttaagttaaagcgtatttttacatttattttatactcaatcccctacagtcctccgctctaccagctgagctattgaaggatgtttacatttattttataaagaaaaatcaatttagagaaaaatgtctgaaaaaattttaagaaaccaaattataaagatgccaaaagtgacagtaattaaccactgtaaatttttgtagaaagagctaacacgtttctaatgggaagcagcactgtgttgtacacaggttatcacagactaagataatgtggctgaatactttcaaatgcagtagaatagacaaatgcaaatattgcaattatatctcaaagtgttcacaaaggaccctgtattccacctaaatgcaaacaataattccaattactccaccaataaaattgtttttaagctcctttttggtaattgtcttgagggcaaagccgtggtggtaaatcttttttctttgatggcggatttgattaactcaaagccagttattaagaaactgaatcaagttggtagccatattttgcccttggaaaagagaagcgaggcaagctcacaatgaatgattttttttcctacatgtaacttatcaattataaaggcagttccgaaaacagagttgtaaagatgattttgagcatcggctgcaccccttgaataagtggagggcctgcaaatatgatcacttaactagggaacattcaatggataaagtcatctagtagcttctttttaaaaagttagtctcattaaccttagagatgtctctaactaaagcaaaaatattgctcaattaatttttactagaatctcaaaattttcatgaaaaaatacaacctgaatggtatgctgattaatataataagtttgtaagtgtccattattattattattatcattattattattattaagacagaatctcactcattctgttgcccaggctggagtgcagtggcacagtctcggctcactgcaacctccaccccccaggctcaagggattcttgcacctcagcctcccaagtagctgggatttcaggcatgtgccacaatacctggctaatttttgtattattgaatacaaaaaatacaaaaaatcaataagaatacaaacattttgtattattcatcatgttggccaggctggtctcaaattcctggcctcaagtgatccacctgcctcggccccccaaagtgctgggattacaggtgtgagccattgtgcacagcctatccttaaattttattgtagacaacttatcattcactttaaaacatgttttaccaatgtacactgtttgcataaaatatattatgcatcattgagcttgatcattggcttcatcaataaatatcctaaaaacaattttatgagactccagaaattgtaaagtaatcttgaatcttctctaattttcaagcttgtctctggtagtacagatataatttttttcagcagacagctgacagtcatgcaggttgaacagtatgtcctttctatctactcatttgtaatccaactctgacttcattttatttttctttgtccacatttcctcatttaaaaatgttttttatcttgttaagccacctcaaattagtttttaacaaaattaagtggggtgtaaataaataattagctaataaatattcaccatgtaattagctatttctaattttcttgaacttatgtattgttttagacattttcaaagagaaatacataatatgcttttctaaatatttactgtaatgaaataattaaaaagtttcagcacattttatttcttctatatttgttgaaaaaatatatgtaggtatgcacacacacacatacacacacactgtttcctattgtaacagttaaagtagtaggtaatattccttaaaagttttagttttagttcaaacctcttatttgagaattttagatatgaaccaaaagaaagacacagcatttaaagaagtgatgaacagtgcccaatttataagcatttctgacctctaatatgtatttacttcaagctgcttttaaataactacatatatgcatatatttatttattttgttaccttactaatttttgtcagaaaatataattgttcttcttataaatgtgacaatagttatgcaaatgtaagatatgctataacttaaagcttttatttctgataatatgtattgatagtggatgaaattagttttagcaattagagggcttaactatcttatgttactgaaatcatttttaaatttatttctcaaatatttttaaactttatacgaaaacagtggatacatcctgataactagtctagtgtttactggatgttttatcatttcccaccatcttcaatcttatgagtgtgatgaacttccaaactagagtcccacgaaatattatgattttaggaataacatcactcatacctcaaaatggatacagattctaaagtcttttacacatgttagataataagttgcttgaaaagtacatactgggatagtgtaaaaagcagtttttagaaaaaattatcaacagtttggtagcatcatggaatcatgtgttcattacagaatttttatggcagagaaaagtcatcgccccaaacctctacaatttatgcagctacaaaagaaatggattttattgcttgctcacgggtggagaaccctcaggcccaggattctggacattggcccagataaggaaagtaaaacttccactgatgttaccaacatataagttgtagcaatgactttgagctgtcaccagactcttgcacatctttgaaacccaacatagcatgcatgaaactaaattaaatgctggataactccaacagcattaaatttgagtttacttcaagctactgttttattaaaagaaaatcaatttgtttttggttaatttaatgtcgtgtgaagcaatggaccacagaatatcaccttgacattattacaaagtttaattgcaatagcatcgtgacacatcagtgtgcagtcaccagtcttctccctgcccagttaagttgtaagagagattagtaatgccactgtggatgcaattaaacagtgttccagcaatgtgggaagggttttttatttcatttctacttcagattctaaagagccacaaagctttgttttcagaaatatatttgactacaacttgaatcatgaaaacatagcccaaattagaaaaccagcaacacactttaaaagttaaacaaaacaacataaactagcaacactaattacatcctttgtttctctttttatttttttatttttgctcttcaaacaccttaaaaatagaactccctatgtttagtacctcaatattttataagtacttgtttacaactattttccagaagtagagaatcaaatttagattacatttaagcatgcaaaacaagataaaaaatgagtaattttacatgttgtttaggaaaatcaaacaaaagcatactctacatgaaaggacttacccctgatcacatcagactacaaaatacttatataatcaactgaaaactccattgaaattgctatgagaaagtactttttgagagcactctttttcttttttctttttcttttttttttttttttttttgagatggagtctagctctgtcgctcagactggagtgcaatggcacaatcttgatctcagctcactgcaacctccacctcccaggttcaagcgattctggtgcctcagcctcccgagtagctgggattacaggcacgcgccaccacgcccagctaatttttgtacttttagtagagatggggtttcaccagattggccaggctggtctcgatctcctgacctcaggtgatatgcccacctcagcctaccgaagagctgggattataggcatgagtcactgcgtctggctgagagcagtcattttctatccactattatcatataaatgtatacacatgtaaatttattatgcctagaggaaaactgaaaactagatgcaaattctcagctcacaaagctagagttgacaaaaaaatctacactctagataaaaaatgagaccaaagggaaaaaatttaaaaactaaaattgctagaaagtttcagaacataaaaaaaaaatgtttttggaatgtgtaccttagttcacacagttcttaaatagaacataatagtctcatgaagagataaccgagtttaaacttcaagtttatttatataaagattatttaataggagcagaaactctaaacaatgacctaaatagaattatccctcatgctactcaaagtttaggattagtcagtttaattaattaggcccaattgcatgaataaagaaaaaattaattttttaagagcattttcctagagtattagtggtgatttgtgtttatatctcaattcaaggcaagagtgaaataagcgctaaagcaaagccattcattcaaatgtctcttcacatttcgcaatcattagaagttgcaattagtaacattcataactcaatttaacggtttcaaatttagacaaactcttgatacttacttgccagctgtgtactgaacccactttaataaagccttcttagcatttccttggatcttggtggtcaccttccgtttacttggtgggctgggagtctcagagctaactatgctgtccacggaggatgcgctgctggacaaagactggagctggggcaggttgctggtcaactcttcaatctgtttgtgagttaacagccagcaaaaatataagcattatctttgttattatttcctcagatgttttacttttccagcaacaaatgagttatgttaacactcttgacattcctgacaaaatgcaagctcttaaagggcatgattgatatcttactcctctttgtacttcccattgcacccctagtgtatcttacatacaataatccatatttgtagaatacatgaatgaattaatcaactaaaacctaatggttagaacaattattctgaatagaatggcaagttcattcctccccttcatgtctaaaaggagtttagaagtgctcctttccaaagaaaaaagaaaattttcctgagctccttctgcaacaatatttcatctccatcttgaggtgctcgcttttcagattgggcacctctgctggagttcttcggggtgtgaggttccacatgcaacagctttgcaagggagaagaggaaattctcctaccaaagaaacaacgtatgtgtgaaaggtacatttctgctaagttaaggatcaaccccaaagatatggcaaatgagagcattattaaaatggccaccatgatctccctctgagacattgcatcaactgaaagaggaactgtagcacaatacctggaaatatagaataatggtccacatcaatccaagaactattgagggtcggccatcagctatatcggtggagttaatgttgactaatttaatctgtttaaaaaagagaaactgtactagtaatgtactagaatattataactcatttaattatgtaacaattaggcctttagtagacatcaataagatttgatcatgcctatgtaatagtacatgggagtaagtagagtgaggcaccgaaacaaacaagcacaaggtttcagtgaaaatttcagggggatttgttaggtgtacaaagtaaaaactataaaatggatttcagaaacttcttttgtttaaagttgaaaaaatataacatgcaggcaattaccaacaaaaatgtcaaacagaaaaaaaatgttattatttatatttagaggttgactggagcttaaaagaaactgcaatgagaagtttaagaagatgcacttactttgaagtttgttaccaaatagcaggtaacttatgttcccttttacctataaaaatcaggagttaagaattctaaaatttgtactaaccggtgatcctctgtgcatggactgacatgaaaaacaaagggagaagataatagatatacataaatcatctttcaaaatcagcattatttgttcaaagggaataaagaggtaggtagtcagtttagaacctgactgtggtaatacgttttaaagaaaaacaaaggaaaggcaagaaatagcaaaacagagcctattagcattcagttccctacttttgggtgatgacatataaagcattaaggagagacgtcaatctatgtacaattgacccaaattattcatgctaatgtttttcatccactacaaagttgtttgctaagtcccaacaaaatggacttacatggttaagtctatctcattcaatttctatagcctaccatcaaaaacatccttttaataattcctaacaaatgaaaacaaataataataaagtacccttcagacctctagctcaataattctcagccaagatttcatgaagtgtgttattaataaaaagctcagatgtttgtacattttttttatttaaatttgtgtcagatgcaaaatcatttcacaaatactttactcttgaaagtttaaatttactagttttacatcacagaggtggagtaaaagctagcacaaaaatcattgtaaatgatttgagatatacctatgggatttttgtctcactggtgaagttcattcatcaggttcaatgacaaaaaataaaaattgagaactggtatagattacaaacttgtatatctacttcctttgaatcaatcagtataagacgtttaagatatctttatggaaaataaagaacatcaatttttttaactttttatgaaagaatctactatgatctctaggatcattttgagagcttcattttacaacttctctagaattttctccacatccattttagcatacatacacaaaaaatttataatatatgctaatatccataagattaatgaatttcacaggggaaaatttcttccttttccttgtgcatcattttttaaaaagtgctattgaatataatttgattatcctacctcgacccagttccaattgtacttgaaattgtacattgttaacatattcaatttattacagaagctaaaggatcttttgcctaacttgtgaagaaaaatgtttttcatgattatctgccccaaaatgtgtttcacaatgagtttagggagcacaggttggtttgtctgtttatttaacctcccatctcttgcaaaatcctattgaacttacaatacattcttagtagcctaggagggtaggatgggcaatagagacacatccaaagagaatgaagaatttccagaagccagaaggaagatgggaccatattgacagataaaaccagagcagaaggatgttgagccagatgttctcaaagggtgattcccagagtcgcagcaagcacgtcacctggaaacttgttagagatatagaatctgagacttcaccttggacccattaaaccagaaactaaggaagtgagcctctggaaagtgtcttaaaaccttcaggtgattctgatgcacattagtgcttgagaatcctggactagaccattgtacctggcccatgtaatctggagaagtctgagttataagacagaggcttgaatggaatgaattattatttgtgtccctccaaaattcatattttgaaatgtaactcccaatgtgattgtatttggagaatgagtctttaaagagataattgaagttaaatgagttcataagcatggggccctaatctaatcagatttttcttttttagattagtctcactctgttgcctaggagggaatgcagtggcacgatcttggctcactgcaacctccacctcccaggttcaagcgattctcctgcctcaactgggattacaggcatgcgccaccacacccggctaatttttgcatttttagtagagatgaagttttgccatgttggccaggctggtctcgaactcctgacatcaagcaatctggccaccttggcctcccaaagtgctggtattacaggagtgagccaccacgctgggcccagtgagattagtgttcttaaaaaagatgaagaaaaactatcatcagagtgaacaggcaacctacagaatgggagaaaatttttgcaatctatccatctgacagagggctaatatccagaatctacaaggaacttaaacaaatttacaagaaaaaaacaaacaactccatcaaaaagtgggcaaaggatatgagcagacacttctcaaaagaagacatttatgaggccaacaaacatgaaaaaaagctcatcatcactggtcattagagaaatgcaaataaaaaccacaacgagataccatgtcacaccagttagaatggcgattattaaaaagtcaggaaacaactgatgctggagaggatgtggagaagtaggaacgcatttacactgttggtgggagtgtaaattagttcaaccattgtggaagacagtgtggtgattcctcaaagatctagaaccagaaataccatttgacccagcaaccccattactgggtatatacccaaaggattataaatcattctactataagggcacatgcacatgtatgtttactgcagcactattcacaatagcaaagacttggaaccaatccaaatgcccaacagtgatagactggataaggaaaatgtggcacaaatacaccatggaatactatgcagccataaaaaaggatgagttcatgttctttgcagggacatggatgaagctggaaaccatcattctcagcaaaataacacaagaacagaaaaccaagctctgcatgttctcactcataagtgggagttgaacaatgagaacatatggacacagggaggggaacatcacacaccagtgcctgtcacggggtaggggactaggggagggatagcattaggaaatacctaatgtagatgatgggttggtgggtgcagcaaaccaccatggcatgtgtatacctatgtagcaaacctgcacgttctgcacatgtatcccagaacttaaagtataatttaaaaaaataataaaaaaaaacaatgaataccaaaaaaaaaaaaaatgaagagacgccaaagattgatcttcctctctacactcacacaaagaaaatgtcatgcaaggacgcaaagagaagggaactgtctacaagccaggaagagaagcttccccagaaaacaaccctgaggcaccttaatcctggacttcttgcctccaaaacgctgacaaaataaatttctgtagtttaagccacccagtctgtgatactctgctatggcagccaaagcggactaatgcacagctcacagatgtttaaaaaaatatttgagaccaggcgtggtggctcacacctgtaatcccagcattttgggaggccaaggcgggcagatagcttgaggtcgggagttcgagaccagcctggccaatgtggtgaaactctgtcactactaaaaatacaaaaattagctaggcttggtggcgcatgcctgtagtcccagctactcgggaggctgaggcaggagaatctcttgaacctgagaggtggaggttgcagtgagcctagtttgtgcctctgcactccagcctgggtgacaaagcaagagtctgtctcaaaaaaaaaaaagaaaagaaaagaaaaaaagtaaaaaatttgaattatttggaaataaatttcaaaaaactctcagtaaacatccatgttactagcttttcttcataaatttgaaaacttaatgaataaatccattactgctttccactagttgctttctacaatgaggtatcaggtacctcattctcaacaataatgcaagtagtcaactgcctgccttatttaatacacaatttaaaggaattttaaacattaattacattttaataaaagtccagacaactggctcttctttgtaaattagaaaaccagggatcacagttcttgcagttcactgaggttactttagttggaactatttgctcccctcttccagacaggacgcaggaccactcagttctcctgttaccacagttagcctggaactcacctcattcctttacatcacctttctggacctcacaggaatctgaatttatgtcccctgtctgcactatgatggtcagtggttggctctctgtattactgtgctgaatgatctgcctgacacctcattggagaaagaaacttgtggcaaatggtgatgaatctgttcaccacagtcacatttacacatttctcatcagattcttacataagttttttcaatagccctgcaaataagagaaaagctaaggacactgttagggtttccccagtaaaatgaggaataccttcattattccctaagtcaaactaaataagaataaaaggattaaataaatgtcctgttatcaaaagaaaaaaaatccaaatggaagacaaagtcagtacaaagatcaaagacaaatttctaaaaatatgattgagacataagttttaacttgtaaagatcaatgctaagataataagtgggagggcactaaagaaccctccaaaactcattacttcccacaggcaaacattttgtgaggccataggatacagaagtgcaagagagtgtggccgacaagaatgtttcagggagatgtggggaggaggtgactttaaaaagattaagagacttgtggggaaaaaagagaaattctttcattttgttctgattctcaagacactacttttggtgcttagcaaatatatttaaactttattttttttactttgggttgttccgtgaaaatggacattgtgaaaacaagtcttctttataaacaatgcctttcataggtgaagttgttaaagttttcgccaaggcttccaagttaataagaggaattttgtttttgtattccagccaatcaatataactcagaatgaagtaggacactgttgtcatacagctgaaatgggagaatgaatgacctgaaaaactctatctttattttttatttttattttttttaagagaaagagtcttgctctgtcgctcaggctggagtgtgatcacagctcaccgtagcctcaacctcccaggctcaagagatcctcccacctcagcctctcgagtagctgggaccataggcgcatgccaccacatctggctaatttgtttgtttgtttgtttgtttagagacaaggtctcaccatgttgcccaggctgatctcaaactccagggctcaagccattcacctacccttccctcccaaagtgctgggattagaggtgtgagccactgcatctggtcctgaaaaactctaaatatcctgtttaacaaggcttcattcagctttcaatgaaaaattaatgaagggtgagcagaaagaagagaaacccttcaataagaaagagattagtgtgatctggaaacactgcctgatattgcataagaagctaaaattgttttgcacactatcctaatgcctggaatctctcttgggcatgaaatttgcacaattgactgaaatgtatactgattcattgcattaccaacttatcaacaatgtagattatttaagggctagaatctaagttttctgtaaatttgtattttctagagttcctgtcttatagaaagtcatcaattatgcatttgtaatctaattaattcagtgcatataaactgagaaggaaataactgaatgggtctattttctaggagtatctggatctccatttataaaactagttttggtattactaagcacaggcttcctcaattcccacaaattagaaaaggctaaatgtaagaggattggtgcaacccttttggagggaaatatggtaatatctaccagaattacatgtgcatttaccttttgacttagcaagcacacttctagaaatttacctaggagatacacctccaattatatggaagcacttatgcacatagttattaactgcatcattgtttgtgttttaaaaatactagaaacaacccaattcccattcataagagagtggttgaataaactatggcatatctaggcaatgggacactgtgtaactgtaaaaatgagtagagaaatcactatgaactgatgtgggatgatttccaggacatattgataagtgaaaaaagcaaaatgcatttatggtatgctatccttcatgtaagaaagacggggatatatgaaaacacatcttatttgtggaaaaaatgcaaaatgtatgtcagaaactagagagactggttatctaaaggtaggaaatgcagttagaggcagggaatgagaatggagtagtagggatgagaaaggagtttgacttctttaaataaaacgtttattattttagaaccataacaatgtcccactctttaaaacaaataaaatcgaccaggatgggggtggggcacaaaatagaacacaaacaacaacaaatgaacctatctctataacagataatgacataatcccactgacggggatggggaagaatagaactaacctaagaacatttcaaaaatagttttttgactggatactgtaatgctaaagacaaaaagaactacacacaaatcctgttctctagtttgtaaatctgtttctcacaggggcatgggttagtgacatactagatgtgtatactaggtgatatagtttgtatacatgtccccattcaaatttcatattgaaatgtgatccccaatgttgaaagtgaaccctggtgggaagcgattgaacaggagggcgagttcttatcaatagtttagcaccatccctcttgggtaccctccacacaatagtgagtgagttctcgtaagacgtggttgtttaaaagtgtgcagcacctcgccccttgctctcttgctcctgctctggccatgtgacgtccctgctccccttctccttccgccatgattgtaagcttcctgaggcctctccggaaactgatgccagagctatgcttcctgagcagcctgcagaaccatgagccaattaaacctcatttctttataaattactcagtcttgggtatttctttatagcatgtgagaatggactaacacactagggttgaaaaaataagtaaatatattgtagatgagagtaagccttctcattatcagagaaagcagaaacaaggacataaggccagagtaaaacttgcagtgtttaacttgaatcagaggtattagtctgaactaatgttttacccacacgtgcgagaagctacatatgtatatgtgtatatacatgtacacacatacagagatagagagagagagaggagagagagagaagcacagatatatgtatatatatgagttaataaacatatacaattgaacaatgagagcacatggacataggaaggggaacatcacccacccgggactgttgtagggtggggggaggggggagggatagcattaggagatatacctaatgctaaatgacaagctaatgggtgcagcacaccaacatggcacatgtatacatatgtaacaaacctgcacgttgtgcacatgtaccctaaaacttaaagtataataataatttaaaaaaagaaaataaataaataaacatatacattttctaatctatttgctgagagggcctaggagaaatgatgccccagtagcaatgaaatacttagcatttagatcttggtttctaaatgccactcatcactaaaaggaacgaagcctctttagagaagtggttgattccaggactggggagggaaaatttaagaaaaacctggaatatctgtagttctagcaaataaaaatctgcttgaaaaattatgagccaatattaaaaaggtacaggtgcaagcctgaaggagctcttagcggtcaaagctagaacaatttgagtgacaaaataataacaatgagtataatgatgaattttaactacgtaacaaaataaatatacatgtgtccctactggaataaataattgaataaataagtaaattgtgggggaggacatctttttcttacagaacaattccaattaataaatatagaaggaatgaggaaaacagaaaatcattaggcaagtagcacagaaataattattgaaggcaatggatactaaaatcagtgagcaaaagtttgaggaaaagcagaaacttagcatagtctcaattatctctcctaagttatttcccaactataaagggaaaaacagtgactctaccataggaaagcatggcagacaccacattaccaagtattcaaagttaatgtaaccagtaataagacatatcagcaccctacatttactaatatggtgcactgggaagaatatgacatcactttcttgggactttttccaaaaatgtctaaactcaacctaatcacgagaaaatatcatacaaactgaaattgagagacattatgcaaaataactgaccagcagttatcaaaagtgtcaaggtcatgaaagacaaggaaagaatgaagacctgtcatagaatggaagacacaactaaatgtaagatgtgatactagagtgggtcctggaacagacacagacaatagagggaacattgatgaacttggactaatgtctatgttttagttaatagtatcatcccaattttaatgtccttactttgataattgtattatggttatgtaagctcttaacactagacactgaaatgaactgtagaaataaaatttcttttttgcaacttctccataaatctaagagtattttataatacaatgatattgtatgtctaggctgtatagattacatgccatcctcctatctgactacagataggagccaatactgaaaacataagtatgcccacaccttcttccttgggcattttgtttttgtttctctcttacctttcttccttcgaggaacttgagtgccgtgccaatgttagccacagcatggattcgcttcatccggcgtccttgttcacaaggctgtaaaaagtggggtaaaaaagggaatgagacaaaatctgcatattaaaatgttagttataagatctatttaaatggattaaaaatatacttgaagaatattcaaaagcaaccaacattgttcactttctataaaggttagcaaatacataaaggggtgttccccatggcactctgaagatatactaattcactcaataagtgcattcattctcagattatctgttaatgcatttgccttttagtcttctgtatgtctaagagcagaaattatttactgagacctctgttagacacgacacagtctcatcattggtctgtgcacagcccatttatttagcttattagttaattatttttaaaaatgtaaaacacacccagaacctgcaacctaaaacaaagtcaggacccacaactaagtatgaaagccatatcccaaaatatgaccaccattaatcccatcctcctatctgactacattgagggcacccgtcatactaactccagtctagtgtttgccattttatagagattcatttctttcacacgctttcttaaaaagaatgcttagtttttaattttatatgaagagcatcactgtattaatcatttgagacctacttttccacattatattgctaagattcatcatatcattgcctttcactgtatttcattcatttcaaaagctacataatgtgctatttctatactcttcttctgatatgaatgtgctatttccaggttattgatattttgatatgttgatgattattcttgtacttctcaccttttgtacaagcacagtttctcttggacatgtacctgagagtagaattgctgagtcgaagggaatgtgacttccatttgtaaagtaatatcaaactctcctaaaatggttgtactactttttattctgatcagcattgcaaaaataatcctgctaatctgtatcctctccaacatttgattttgacagataccttaaacatacttttttcaattgaatatatgtaaaatgtatatgtactctttttcattgcagtctccatttacatttccctgatcagcagcaatggggacttctcctcctctgttcattggtgatgtgagtttcttctgcaaaatgccttttcacatctgttgcccaggttttcctttgggttgtttgcacccatattgttttgaagatgtattttatatattcctgatttaatccttttacaacatgaattgtgaatatcttcaacaagtttgtaacttctgccagttgttttaaaggtttttaatttttaagatagtcttaattttaatatattaaatatagcaatcttttattgtcaatatttttgtgtcttattgaataattgttttcctatccctgtgtctaaaacatattcacccatgttttctaagagtttagagtgttactgtcagtaggtccttaattcatgtagatttaatttttgtataggccatgagataagaattcaattttacctttttctgctagaatgaacttaatttcctgttccattttttttaacttcaataacttttagggtacaattggtttttcgttacatgaaggaataatatagtggtgaagtctcagattgtagtgcacctgtcactcaacatttagtttttgatccctcacccctctcttaccctcatccttctgagtctccaaagtccattataccattctatatgccttcgtgtacccatagcttagctctcacttacaagtgagaatatatagtatttagttttcaatcctgaattacttcgcttagaataatggcctccagctccatccaaattgctgcaaaagacattatttcattctttttttatgactgagtagtattccatggttgtatatatatcacgttttctttatccactcactggtcagtggccacttaggttgggtccatatctttgcaattgtgaattgtgctgctataaatatccgtgtgaggtgtctttgaaataatgacttcttttcctttgggtagacacccagtagtgggattgctgtatcaaatggtagatctacttttagttctttaagaaatcataccgtttttccataaaggttgtattaatttacattcccaccagcagtgtataagcgttccctttacaacacttccatgccaacatctattgttttttgactttttaataatggcgattcttgcaggggtaaggtggtatctcattgtggttttaatttgcatttccctgatgactagttatgttgtacattttttcatgtgtattacttatttgtatcttgttttgagaaatatctattcatgtcatttgcccacgttttgatggtattgtttgtcttttttcttgctgatttgtttgagttccttgtagattctgaacattagtcctttgtcagatgcatagtttgcaaatattttctcccattctatgggttgtctgtttactctgatgataatttcttttgcttgcagaaactttttagtttaattaggtccatttatctatttctattttagttgcatttgctcttagggtcttagtaaaaaattatttgcctaggccaatgtctagagattttcttctagtttttttttctagaatttgtatggggtttcaggtcttagatttaagtatttgagccatcctgagttgatttttgtataaggcgagggataggggtccagtttcattcttttacatgtgactatccagttttcccagcaccatttattaaataggatgtcatttcttcaatctacatttttgaatgctttgtcaaagatcatttgattgtaagtatttggctttatttctgagttctctattctgttccattggtctatgtatctacttttataccagtatcatgctgtgttggtaactatagccttgtagtataattcaaagtcagataatgtgatgcctcaaattgttctttctgcttaggattgctttacctatttggggtcttttttgcttccacgtgaattttagaattgttttttctaattctgtgaaaaattatgttggtattttgataggaattgcattgaatctatagatttctttgggcagtatggtcattttcacaacattgattcttccaatctatgagtatgagatgtgtttccatttgtttgtgtcatctattatttctttcagcagtgttttgtagttctccttgcgagatctttcaactccttgattaaatatgttcctagatattttttgcagctattgtaaaaggaattgaattactgatactgatattattctcggcttggtggctgttgctatataaaagtgctactgacttgtgcacattgattttgtaacctgagactttattgaatttgtttatcaaatctaagaattttagaggagtctttagggttttctaggtatccaatcacatcatcagcaaacaatgatagtttgacttactcttttccaatttggatgccccttatttcatttccttgcctgattgttctggctaggacttccagtaatatgtttaaaagaagtggcaaaagtgagcatccttgtcttgttccagttctcaaggggaatgttttcaacttttccccattcagtatgatgttagctgtggatttgtcatatatggcttttattattttgaggtatgtcccttctatgactagtttgttgggctttttatcattaaaagatgctagattttatcaaatgctttttctacacttattgagatgcccatatagattttgtttttaattctgtttgtatgatgtatcacatttattgacttgcatatgtcaataaacacttagaatgacacataaacttcttgaatacctacatgaatattcacataaagattcctttaaccttcaagaaaatagcttaattcaggaggatatatctaaatggccagttatatcaggtaatcaagggagtatgtatttcaatctaatgactcccacaacctaatgcttatctagtatctttagctaatgcatatgcctatatacattccaaattgcctgttcatatatgtctagcttgattccttccaaagcagagcttgagacaagcacttgggtgcatgtagcttactagggaggtgatcccaggtggcaagaatgaggatgtgtggagagcgagatggggaaggaggaaaagctaacaaaggatgtgctattgagggttactgctattggcaactggaactcagtcccactgatgactctatgggaactctataagacatgtgtaaaatatgcctcagaatcacctgtctcagaattaccctgtaattttagggtggagcatttattcatagactcccatatccattggttgagggtcccttggtactactaactccccaacacttcaaagctgctctgtgcaacttgtgcctttaagaaaagccctgaggcagaaagccagacagatactacgagtgcttgaagaaagaagctgtcagagtatatgggaatgtctaccactgatgtagctgagatgagacatggggtgccagaagcatctgctacctgggaatccaattacttaaacgactgatgcaaaattattaccagtttatgtttttcaacaaacaactcttacaaaagctatttgagggctccctgtacaaaatgaatggaaattaattttgaagaggtaaaaatcctcttttaaaaactcagttatccaagtaataatgattgtgtcattattgccaagatacaagtgataaagaaaaaatggactttcaattttggactctgtgtctagtgtgttatccaacatcttgaaaattatttcctgaattcctttttccaaattatggtaaacattatttataaataatttatgtttacaaactacttaatgctctactactctgaaatgaaaaagagataagcaagaagagataatttattatttgacaatgtagaaaatgtactttctagctcactgttaatgttgtttttcactctgctggctccacagcacataaaaacaactctgaacaggctgttcttgctacaaatgatggatgatggatgatgtcaacaagaatatgaaaaatgccacactggtttcctgcttaattttcaataaacaactatataaatacacagatatggaccaacatttctttctaaatggaagacaaacacttaaagtgaggaagatggtaatttgcaactaatcttcttgtataccgtatagatacaatggttaatcatgttaagttactgatgaagttctttactcttaattgtaaggttgttattataaacataacattttaaatgcactaggggtttgcaggaacaagaagggaaatatattccttgcacctagaagtagaagtgccagcagtgtttccagtatactaccaaccacgacaaataactttcttttacctgggcagcacatcttagcactctcaactccatagtccccaaattccaaatggaaacaatttgacaagtatgatcacacaaaaaaattcttaccagtttctgcccagacaggacctccagaagggcaagcagtttaacaccatctttcatgtcttcaaaaagatcgtccaccaccattggaggtttccgctgtaaaagcaaagaggaataagtgcagaaaatatctcttccctctctgtttctctctttctctctctcacctttgttacttatggtggtgaaatttgtaggagaggcttctatatactttaattctttattttggattgagttgccaattgcctttcgataactgtgagaagaaaaacaatccagtggagataaaactcgatattcaaaaacctcagaagatttaatgcttgagccttaatgtatgtaccagcttctttctagaaagtgatttttgacaagggcaggatggtgtgggataagggaaggaaaagaggatactatcaacctaaaagataagagagagattatagcaggacgtaaaagcagagcaagagctgcatggaccaacctcagcttaactttgtgcaagacacattactggggcttaacaaggtgcagcccttctataggacattctcaccacagcaacctcattagctcagtgacctgctagaggagcactgtcagcagagctaaggttgcaggttcaatcttcctgtgggttagttagctgttatgttgtgttctacagcctggtgaatctagcgaaccttctttcagtgtggcattgaacccaaaagatcataagcacaaaagtacagaccgatcagtgcaaatctatcatcgctgctggaaaaataagccaaagaccacctttaattcatggagcatcttttatttttttatgaaggttattaaaatactcaatatatgggaattcatcaaacattgaattagggtctatcttggctcaggagaaagtaaagaagccattatgccaatgttgatggtcaatagaggggaggtgttcactgatttatcacagaatcagaatttgttttccatttagcatctgaattcaaactttatagctttctgattcttactgaatcttgttaaaggcctaatgctcaattcctgactttcaatgttctttctttctttaaaaaataatgtgttctatgtaagagatttaactccaaatgtttggttggaatgtaactttttttctctaccaactgatgtagagcatttatatttctcttacaactgcatgaattataatgtctgaatagtacaattctaagttaaaatgtatttttctctcattataaaatgaatagctgaatacattttgttctcatgctgtgaaatacatgttcaaaaataacagagttttcatttttgatcattctctttcaaattccaccattcacgctgcttcttacttacatagcaaaaatgtaatagtgactttatattctaagcatataaataaaattcatcagaataaaagaagccattacaaagaaaactatttggtgcaataagaatcaaaattattgttattagccatatacggtcattaaaaatgcagtctatttatcattcaaagtaaccacttgtacccaaattatttaaatcaagcaaaacaatgaggaacaagttcataaatgtttgatacattcagtgagcaaatgcaaataaaatttttcatgcattgttataaatatgcaaaaagtaaggaaagcagggaattctcataaaataataaagatttcaagaaattttgcacccaaaaatgataaaatgcacatcttcatctgtttcgattttaaaaatacacaggtgtctgccactttgaggaacacgtcctctcacctcacttctgcctctcttctttccctcctctgttgctactcatgctgcaggtgctttccttttccctccagctgttccctccacaaggctcctggaattggccttccgatcagcagcgacagctgaacagctcagcagcctactggcccctctgcatgggacattgccaataccattctctccctgatctgttcctacccaaaactctgtgaccagactgcctagttcacagccctttctctttctttctcctctcttcttcctaaccatggccattcaccactcaatcctgagtcctttgttctttacaaatttttttctgcttatacatgactcttaaatccaggtaagcgacctctcctaaactttgtcaaacatgtggcaggcacttcatatctattgctggcttgctggctgactgactgactgaatgaatgaatgaatgaatgtaaatattgtgtgaagccaataaagagactttattacaccagaataaaaaaaattagtaattactggacaagttttgccatccagtttgtataaggtattctttatatataccaaacaatcagttagggggacctttactatgatgactacctcacatttaatttttggaacaatattttaatagaaaatctttcagctaaaatatttctcctgtcacatgtacaaatatttataccaccaatatggtgactttgataagacttgggtcatagtgctgaaggtcaaaagggagagttagagatgcagataatttattggatcttgacttaatggaaaataaagatgtgacttgagctggcttgtgtccatgccagtatatgttagatatgttagtacatacgatgcttctattattacgtttttagtctttcttaaattcacttttagaagttaataaagttagtgtttctagtacagtagcaggcacttcagctgatcagtcagtactttttctattgataataaatatgaattacatttatgggtttgtgtattattcaggaaaaattaatgttaataccatcatttttatactaagcttcctgtctaacaaggtgactcaaagtataaaatcctgggctctaatccgagtcacttagtgtctctgagattcagattccttgcttttaaagagaggatggtgttcccataggtagtggctgtgaatattaaacaagatagcaggtaggagtccacagaatagcactcagcacacttagatgtttaacaatattttattcatttttcttctcttcctattttattatctttctccttttatccttatgaaacactcactaaatttgagtaatatctaagtcatagaaatacctactaaatattggaatttatatattgtatgtagtctatagaaggactattttgtcataattactttatgcatgaacattttttatttcatatataatacttaaatgtgagaacttcttaaattttcatttcatactgtatgtgagtggcctgagctgggcccatcatattctctgcttgggtccagaagatgtctgggattacattgtcccatggcagtgacctagggactagtgtcatcaggtcatgctgctgaggtcccaagagccattctgactgtccttctcacaactgggttagtcagtgtgttgggggctcccaagaacactttcaggcttgatgattcactaggactcagaactcagaagtgctgctgaactcatggttacagcttatgacagcaaaaagatacagattataatcagcaaagcaaaaagacacatgtagtgaagtccaggagaaactatgcacagtctttcagaggtgaatgacctctcccttcccagtggagtcacatgaggatgtacttatatttcctagcaatgacatgtgacaacccatgtgaagtgttcccaaccagggaagttcccccaggtcttagtgtccagggttttactggggggtctatgacatagacaagcaatatccatgtgactgacctcagctactcagctccagctctctcccacaccctcaaccccagcaaaaaaaaagttaacccaaatcacattattagcataaaaagatctatcaaggtggtacagtattgccaaggccccaggacaaacaaaaactgatgttcactataaatatagtgtggctcaaggtctcaggcatagaaaaccacactactggggcagaatattccaagggctcagattatctcccagaagccagccaaggtctattcttaaagacaggcccgtctttggaacacagcatctgagcaccgcaggcctgctgagttaagtctgtcttgcccagttggcttttccttctcatactttgagacaactagtagcctttcaatagctctttcttcttggttaaatcatctaaaattaattttatttacttgcaacaaaatgaggcacaactgacgtgtctaatttcttagtgtgtaaacactattctgagtgtaacaatttaaatatcagtgtctccccactcccactcacataagtgaccaaaagtaaatttgttctgtaaaacagaagtgcatatcttcagaagaacctaattgtatggtttttttttttttttttttactaaaacagtccccctttatgtgcagtttcaattacctagggtcaactgtagtctgaaaatgttaaacaaaaaattccagaaagaaacaattcataagttttaaattgcacactgttctgcatagtgtgatgaaattttttttttttttttgagacggagtcttgctctgtggcccagtctgtagtgcggtggcacaatctcggctcactgcaacctctgcctcccgggttcatgccattgtcctgcctcagcctcccaagtagctgggactacaggcgcccaccaccacacccagctaattttttttgtatttttagtagacacggggtttcaccgtgttagccaggatggtctcgatctcctgacctcatgatctgcccgcctcagcctcccaaagtgctgggattacaggcgtgagccaccacatcccgccgtgtgatgaaatcttaagctgtccctgcctgggacatgaatcatccctttgcccagggtattcatgctgtctactcaacctgacccacctgcttgtcacttcatagttgtctaggttatcagatcaactgcctcggtatcacagtgcctgtgttcaagtcatccttattttacttaataatgaccacaaagtgcaagtgtactgatgctgtcaatttggatatgccaacaagatgctgtaaagtgtttcctttacgtgaaaagatgaaagttctcaataagaaaatgaaaaaaaaaatttgagattgctaagatccatggtaagaataaatcttttatttgtgaaactgtgaaaaaggaaaattggctgtcacacctcaacaaaagttacggccagagtaaatgataagtgctgagttaagatggaaaaggtgttacattggtgggtagaggacatgaacagaaatgtgttctagtggatagtgatcaggttcagtactgtctgtggcttcaggcatctactggggactgagacatgtcccttttgaatgtagtttaactttttaatttttaaatgtgctaaaatacacataatataaaatgtgccatgttaatcttcttaagcatacagttcagtagtgttaaatatttccacattattgtgcaactgatctccaccattttcattttgtgaaattgaaactctgtacccattaaacaacaactagccattccctctgcccttcagcctctaccattctaccattctattttcttttgaatgattttgactactctggatacctcttataagtagaatcacacagtatctgtcattttgtgactggcttatttcacttattataacgtcctcaaggttcatccatgttgtagcaggtgccagaattccatcctttttaaaggctgaatcgtattccattgtatggatataccacatattttgcatccattcatccatcaatgggcatctgcattgtttccattttctggctattgtgattaatgctactatgagcgtgagtgtattaatatctcctgaagaccctgctttcaatttttgtagatatatacccagaagtggaattgctgaactacatgttaattctatttttatcttattttttgaaaaactgacatattgttttacatagtggctgctttgtggaagaatagaaacctactttgaaacattactagcatatcatcactgtatgaggtacaaatttctacaaatcttctacaatcttagaatccgtattgaccaatatcatgcagctataaagtagattttcagtattaataatttagtatttaacaaagaaaatgataaaatcacctgtctcacaccaggaccatctaggacctcatttgccatcatccataatcacttttagtcttctagtaaatggtttttacttttgagaaaagagctctcaaaacattttatcatcaaaaaaagctacaatattttactttaaactactaaacacatatcctatggcttaatatttgtgattgctaggtacctagtgataccaataaaactgaaccagaaaatgcttagaagaatagcgcatgccacagttaagtatttacttcagttgaggcacacacactattgagcacagtcagggttgctgaacaggatgaagagtcatgacctgagatagtcacaacattttcttctgcagagcatgtagggaggtctcaaggcaagggttgactctccatgtgcattctgtgcacccttgaaacctctgtgcacagaacgacccataacttgtagaaccagataaaccactacttctggtttatataagtttcaggtaggaattatttcacaagctaagagattgtatatgtagaaaaattcccatcccaggaccagtctggagttttgcatgctctgatgattatcttctgggtgggaacagcaagttaaacaacagtaatatagagaagtgggaaggaagagaggttaaccagcagatatggagcaagtgacctccccaaaggttggcaaagaaccctccacagtatatgtatcaaaatgccaaagtatccttggaccagatcaagtaaatcatgattataaccactgacagtagtcaaataaaattaatgtccaacaggttttgtcattttattcagcaaatctaattgaatgtttccaatatcttcagaaacaaagtgtagtaatttaaaaactgtatgtgtaatctgcttctctttcactgcctttgtaacagcactgttgtgatcattttccacttctgcttggcaaaggtgggaaggtccttcccattcttttttgtttcctgtgacagatagcataatcctttccacttcctcgattatttaattcaattccgaataaatattccaaaggcaataattgccctccagctcagctttaaatctgcttggaaaactcagctctcaacaattttcagatgtaataaagtttgttttactatatagtataaaagcattattgtaccaagttatttatttggtacaagttggggttacccttgactcctctcttttgctcacactcaatatctgattcatcaacaaatcttgttggcttcattttcaaaagtcttccagtatccaaccacctctcatcacctctactgctactatcttggtccaagtcaccagtaccttggccagatggcttcaataacctctaacttatctccctccttctgcccttgcttctcttcagtctacgttcagcagaagagcttcttgatcttctttactgtccatctcccccattaggatataagcttcataatgagatggttatttttttttctgttttggtcactgctacattttcagcacctagaatattctctagcttattaaacagcattttaaaatatttgttgaataaatgtatgataaataaaatatatttctggttgggcacggtggcttacagctgtaatcccagcattttgggaggctgaggttggtgaattatttgaggtcaggagttcaggaccagcctggccaacatggtaaaacctcgtctctacttaaaatacaaaaactagctgggcatggcggtgggctcctgtaatcccagctactcaggaggctaaggcaggaaaatcacttgaactcgggaggaggaggttgcagtgatccaagccatgccactgcactccagcctgggcaacagagcaagactctgtctcaaaaaaataaataaatgaatgaatgaatgaatgaatgaatgaatgaataaataaataaataaaataatatatttctaaagaaggaactttgacaaatattaatattagcaaaatgtttattagtctgcataaactttgtgagatctagatctttgttatccataaactaatatattctataaataaattaacaaatgctattcattttgaaatgggaattttcctttataacattttaattacatatttggaaataactaatttattagaatgtttagggttgacaaattaaattattttttccctggctttattaagatataattgacaaataaaaattgtatatatttgttatataagatgatatcttggtatgtgcatacattgtgaaatgattaaatcaagctaattaacatatccatcatctcacctacttattgtagcttgagaaaaacaactaaaaaattatttgggggggtgaattattgcatttaccttttcctctttgcctctttatcttcctgtctgagctcattaatagtctcaccaaaatgtgtacaaggaaacagatgggagtaaaattctattcggaacatgtttccatgttatctttcagcactgctggtggaaagacaactaaagaagatgaaagccaccactaaagtgatattttatgactataaagatgtcatttaaattcatgattagcatggatttgtttttagaaaaaacatggaaaatccaaaatgttccttttaaaagactgtatgcatctaacttggtattaaaacaaaatgtgctcttaatggaatctgttataggttgaattgtgcctactcaccagagatatgctgaaatcttaaccccccaaaatgctgcagaatgcagccttatttggaaatagagtctttagagaggtaatcaagttaaaatgaggtcattagcatgggtcctaatccaatatgactagtgccctcacacagtggtgaaatttggacacagacatgcacagaggcagagactgaaataatgcagctacccagagacttagaaggagcctggccttcgagtctccagaactctgagataacaaatttctcattttaagccacccagtatgtggtactttgttacggcaatcccagcaattaatagggaacctaaataatgttttataaattttttttctgcagtttttctgaaaagtgagaagatgctcatatcatgcctgagttcatcccaaacacagtatttaaaatgttcagtgccttttgttgatggctccataaattttaggctgacagaaggataaaggactgctcattctatattgaaaagaagctccatttatagaaacactaaaacatggctatttgagacctatttttcctcaaagggcttagtgacaagcaatctatttatctcacagtcaaatatcataagattgaatcaagggtgtttaaataaagatacaatattccattctatttgataaaatgagagaaaatatgaaactgcaagcatttgataatagaaaataatcaatataaatattaagattgcttatacatgcctaattttaaacatctaactttttacaaagggtttttaaagattgttccctttgggtggctgaagtactaaataactacaacagtctatgaattttatataaaatgtaggaattttttaagatatattttaaaatgtgaaagaactatttttaactgtcaaattttaaatatattcatcgtaacataacttctttgcctaaaatgcaaggcctatgctgttaggcctaagacatccatggtcattaggtgagaattccttcaaatttaagtccatgccacctctgtcttcatctctctgcttatcccaaagttagacacagccacacccactttcctattcccaatgctagtctcagagaaggggagatatctctgctctggaacaaacctacaccctccacctctgctcttgatttcttctctcattctgcctcctcgggcgccttgttccttcagaatcccattcattgccttctttttcagcctctccctctctacaagctcttgatcattcccttctatacagatgcaggctcatgaccaccctttattaaaacagcttttaccaaatccaatgttctgcgccaatatatatagtaatatatatatataactatatatatagtatactaatatatatatagtaatatatatatatttatatatatactatatatagtaatatatatatttatatatataactatatatagtaatatatatttatatatatatacaatatatatagtaatatatattaagtgtactaacatccttacctctcatttactcatcagctcgctagagtctagtttctactataacatggccactcccaatggcggccaatgacttccaaactgccaaatcgaatgggttcacctttaccaactaatttctccttctaaactgaatttcctagctttccccccaagcctcttgtattccctatatctgtgaataatctcaatcatttgctcaagtcagaaatctagaagtcattcttgattccttcccctccaagattccaattaattactcagttctatcaagtccactcctaaacatcttttcagtctatccatttttctccatttaagcttagaactctaagcttctggttcataatctacaaaataataaaaataatgcattttcttgtgtgagggttaaataaataagagataaagttgctaaggcactgtaattggcacgtggtaagaatttaggaacatgttttctcaataagtgctgataagctagatgtgagtcagaaacttgactttgaaaaaccatcactaaaaatcaatattgggctaatttaataaaatactccaccttctttcattaacagagctaacagaatagaaagatactggtttcttcttgaaaagtgagaaaattataggttcaatgtctaacaatagagccccatccctgaaagaaattatcaggtatatgaaataacaacaacccgccaattgttaatgttatatcaacaatttgtgatttgcaatgttttacataattggagaagcattaagacttcaatttgataataaacatcaaaaaagaacagatatttatacccacaagttttaatgatctaacatttgtgtagtaaaaatagaataaaaacacaaacacagaaaatccttaggtttttttcttacttataataagatttttgttttaagaaaagcatatttttacttataataattaacaaatgtaaaaaagaaaaaataataaaagcatgttttaaaaaacagattgcaatcttatttgcatactatctcttcttattgctatcataatatttataaagaaatgttacactagaataaaatgtcatcagtaaaagattttttatttaattaaaagtcaaaagtatattaatttgcaactgagcaaagcagtcaagcacaaaaataaaaattcctattaaaaagtgcccctagatatacaatcgtgtcatctgcaaacaggaacaatttgacttcctcttttcctaattgaataccctttatttctttctcctgcctgattgcctaagcatcttctgaacagctcccagtgctcccaagatagaagaactttaggagaaaaggatcaacttcctttcttctcaactaaacatcccagctcttaaacctgccactacctattattaaagctatatttggaaatggtaaatttaactcataaacggtttggttgtcagtttatctgaaaacattccaaagcacagagctatgtatacctggattaccatgcaaggaaacatcaaacatgaaaggggagacaagctcatcactgccattattccagggttgagttccaacctctagctattaaaaactttgaagggtgttttaatagtgcaaggaaatggggattcttagaagatcttagaatatattaaaatcataattgtgcatagctgttgactacctacttctagaaatttatcctaagaagaaaatatcatacaagtgttcaaacaacgtataccaggactttcactgtagtattttatataatatgaaacaactgaaaaccacctaaataaccctccacaggcaactggctaactcatcacagataaacatgacaaagtttatttagccattacaataattacatagttctatctattgtcatggattgacgtgttgggtgaaatagaggctccagaacaatatcctataaaaccacttatatgaaactgtgtgtagaaaagtgttgtccaatatcttaatgatgactgtatctggattatgtgatataagattacttttactttctttacactttctaaaagtttcattattaatattattttcaattacgtaacctctgtacactatgaaaaaataataactcttttcattttgaaaaaaaaaaacaaaaccttttccccaatcgatgacaattccatagtacaaatagctgccagatgggaccaacggaagctttaaaaaataagccccaaagtcatcaatcctatgtatccactgcctttttacagagcagattgtggggcaactactgggccaaattcccttctcatcaagtgctgtggggaagagagcataggaaagatgaccctggtttatcctatatctagacaggtcgctctaggcttctttcatggctggattgcaagcttctcggggcctgggaaagtgttttactaattttttcctgtcttcaaaggctagcgcagacacaaagtaagcagtgaatctgtagaatgggactaaaatcaactgtcatgctttgtttgcttctgcgctatcaaaatggctttggggaagcccctgatcaaaacctgcttgtagggttgggctttacatactacaggcaccactctcagcaaaagtgagaataaaaaatttgaagataaaattgttttatcatctaattcatttaaccaattattgacttgaagggagagtcaacataacttccactatataatcatatagactactcctttaaaaattatcagcaaatcctctaactgaattcagacacaattgtcccatcatctgaatttatttttacaaatatgatgtctcttggcttgcttattttttcatcagcagtacaagagattaattttattatactgtatcaagattaagatttattttatattagcatttatgttcaaagacattataatatatagacatatagtcacctaatatcagtgaatgacagagtggataatactagaatgattttagccttttcatgtcctattaccatggttacttttttaaatcaaagcaccagagatgagagcactgatactatcataatatctttagctaaaatcttttgcttagcatagatcacttatagcttctttgtgttccaaataggaacaaacacacacaaacaaaaatccagcacaaattctccttttgatatgacacacacattagtattagaaaaaataattggatgaaatagtttctcaagattcacagaattgacatgaagtaactgctcttgactctagctataagttcatttcttcccagaagcaatgttagcaaattccactcttaggcaacagctagaccaaccaataagattacagtatcattgattcgcaacagtgacaacagggacagaagcattttgttatactggacatttaatgatttactggctcaacctaagtaaacctgtaatgctgggtagtttcctttaccttggccagatgagagttgatccattttgtgaaagttcgtttttgtactatctcttgctcatctagaaggaaaaagaaatctggttaaataatgtaatatttcatgaagctgtataatgagaaaaagtcctatttacacaaatctggaaggaatcgtgaaatcgttttctcattcattttaccaattattgtcttgaagggaaaagtcaacaagagtcgatctacataatcatatagactattcctttaaaaattatctgcaaatgctttaaaatttgccatttgttagccctatgtttaccttcatccacttacttaaaattcactgatgacttatacttcaacaaagctgttaaaaatgaaaattcaccaagaccactaagtgctgaattttatgctaagtgcaaaggaatacagagggttgaatagggcaaggtccctgctataaaatatctagaggtggaaatggacaagcaagggctatgaatagtaaagggttacacagtaatgcaataagatagagccgtatacatgaagcaaaaaaggaacttcacccagatgagaatgtggtgactacacactggagtgacctccaaaaattcccaccacatggagtccccatttttgtgtcggcagaatgtgggtagaacctgtgatttgtgtctagccaataggatatgacaaaggtgatgagatgtcacacttgtgatcatgttactttatgatactccagcttagctgactggagtgagagattctcctgctggcctagaagaagcaaccagctaggctgtgaagttcctttgcagagggtcaatggcaaggaactagaggctcccttcaggagtgaagtgcaatctcagtgaacagccagtaagacaccaggcccttgtcaaacagtcacaaggaatgaattctgttaacattgtgacagagcccaaaagtggattcttccacagttgagcatccagataagaatgaaatccagctgatgccttagttatagccttgtaagaccctgaacagataatgcagctaagctttgcatggactcctgacatgcaaccatttggagataataaatgattgttgctttaaacttcaaggtttgcggtactttgctatgtaacaagaggaactaatatagaaaggaaaagaggtagggtttggataggctttaattagaggtataaagagataataatgatgttggtagtttgacaggaacagcgttgaatctgtagattgctttgggcagtatggatattttaacaatattgattcttctcatccataagcatgggatgcttttccatttgtttgtatcatctatgatttctttcagcagtgttttatggttcttctggtagagatagatctttcacctctttagttagatgtattccaaggtattttattgtgtgtgtgtgactattgtaaatggggttgcatccttgatttggctctcaggttacaagttgttggtgtatagaaatgccactgaattggccaggcgtggcggctcatgcctgtaatcccagcactttgggaggccgaggcaggcagattacgaggtcaggaggtcaagaccatcctggctaacacggtgaaaccctgcctctactaaaaatacaaaaaattagccgggtgtgctggcgggcctctgtagtcccagctactcaggaggctgaggcaggagaatggtgtgaacctgtgaggcagagcttgcagtgagccgagatcgtatcactgcactccagcctgggcgtcagagtgagactccatctcaaaaaaaaaaaaaaaaaagaaaagaaatgccacagaattttgtacattgattttgtatcctgggagggggtgtgggttgaaaaactacctattgggtaatatgctcactaaccgggtgacgagaccattcatacacaaaactcagcgacacacaatttactcatgtaacaaacctagacatgtaacccctgcacctaaaataaaagttgaaaaaaaaagagagaaaagccacacagaagtagtttaataccttcaaaagaagaattgaattttatccaccccaccagcatgtactgagtatcagctgttcacaaactagtaaacgctatgttgtgggggacatacacaagaaataatttcaatccctcgccctttgagggatgatacccaaatctctgtctttgtctctgaccttgtctgtgcttcagcccagaccatttgcttgtctactagaatgtaaagcccaggaggacagcaacttggttcccaatgcctgcaagtatgaccaataagaatgaatgagtaaagaaaataaatacaaaaccttttaatttggagaaattttgaatctatctataaaattgacagaatccatgacctctaatatattttaacatgctcattaattttcaagtgtatataaaaaacaaattggtataaaaataagtagcacttcctatataccaggcactgacatttagataaatcaatcacttgatattttaattatcatttatttatcattatatattacatgtaatattatataagtattaatccattaattcttgtcaagatctatgagcagcaactattataatgcccattttacatataaaactgtcaagacactgaactaccaaggtcatccagcagcacagccatgttgtagacttcagatatctagtagtatactatgccattatactgtcactcaagggtagcataaaaattaccacattcatctatcaaatattaatctcatgaaaattataaatttatagttcaaattttttgacctgagaatctttaggttgtataaataaagttaggtagcggcaaaatgatcttaaccaatcaaggtaggttggatggaatttggaactttataatgcataaaatccaattcaaaatctaaaatagacacagttagattatatgtaaattgtttacactcaacttgagattatacattcttttataaacatcacaaaataccactgtttaaaaatgttaatataaattggcataatatgttaatgttatactgtcataaaattaaatatataatctgatgatatattacttcttaatataaattgttatattttcactattataacctttaatgaaataaaaatagtattgtaacaatttcatctgatggtaaatctctgagtttatagttagacttcagctaaatggccttttttagaatcctcaaattatcttttttgtagcacagcatatatttaaatgttaaattctttacgtgtttccttttttactatggttgcaaaaacagattttactaggtcctacaattcactttttgtattatcaaacgtagtcagctgaattctaggtaaatatttttctgattttacttactattttcctgaaagaaaaaaattgtttaatttaattattcagcaaaccctcattttttatgtaaaacttgaaaaccttactcccaagatttggtagttaaatctgataccaacaacataaaatgttcaatttgtggaagtaacagaaacatgcaacgaatgtctatcaacttgtgttaaaagtttaatgaacaataacatttctttttaatgctgttgacagggaacaaaatgaaccttcacgactaggtctataaagttcttaagtacagtcatgcactgcataatgattttttggccaatgacgaacctcatagatgacagtagtgccataagattataaacacaactgaaaaattccagttgtctagtgatgtcctgccattgtagggcaacccattgctttttctatatttagacatgttcagatacacaaaatacttaccatgtgctacaattgcttacaatattcagtacagtcacatgctgtacaagtttgtagcctaggagtaataggctatatcatgtagcctagatgtgtaatagtctataccctctaggtttgcacaagtacaccctacagagttcccacaatgatgaattcacctagaagacaaatttctcagaatataactccatcattaagctacacatgactttatatgtcattatatttaagaaaacagtttaaatatatttaacaagtaacaactttattaacaatgtttctgtcctcagcttttctgcttaagaagagttatgagaattcagaccaattgcaaaggcatcgtaaaatggatgagatgacagcagcgtcagggtagaggagaggtgtggctggggaagccacactacaatttgggtgctgcacagctgtgataggctctgatttaagaccagtttttggtgtgggtgattattactgggtagaattggttcacattctccttctctcttataacctaaatcgtaaatggttcctaaaggccagaccgtgtaacattaaaagcaacaaccacagaggagttccaaatactctctgggtccttcatccttgaggctcacattgcttgtatttcaaaagcagttggtcctacaggcctcaggaattggagtcagctgaggctatataaacacctagctctgggtaatattataccgtagtatccctccgtagaaatgagttaaaaaaaaaaaagggttctggctcaggtattcaatttctgcatttctttgcccatttttagatattttctcagtgttttgccatttcagggcaagatcatgacatacaacaaatgcacaaatgaggcccaatttagcaactgtgattccatttgactattaggaaactatcataactgatgacagttcacatggttttcttcctgatgagttatactaatagtcacctgcgggtactgcacaattgtggtttactctaggtgacttaaacatgcacccggaagcacaaagatcataataaaaggtggcttgggttattgtgcagccattgcaatcaatcacaaataatatattgtctagaaacatgttaaatatacttttaattttaccttacataacaaatgtaccaactaatatgtgatgtaaaactgtgtcacagggtcctatgaccactgccttttaaatagatttactaaattacaaaaatgttaaaatacatgacaatatccacttaacagatggtatgtttaaaatttggacagtaaatgaaattagtatattttaatatattgaatacattcttccataataatttattactgagtgatatagcatctcatgtatcagtatgtacataataatgcataatgtattttcatcagaatcataaaatatcataaagagcaaaatagtaaatgtctagaagtatccatctgtaattaatatcacatttaatatatatattaccaggaagagtccgggtgctgtggctcatgcctgtaatcccagcactttgcaaagcccaggcaggaggatcacttgaggtcaagagtttgagactagcctggccaacatggtgaaaccctgtctctatgaataatataaaaattagccagacatggtggtgggcacctgtaatcccagctactcgggaggctaagaaaggagaatcacttgaacctgggaggcagaggttgcagtgagcagagatcacgccactgcacttcagcctgggtgacagagtaaaattgtatctcaaaaatacataaattaattaatactaagaagaaagaaatgctgtttacataattatatataggtaagcatgaaattgcaatctctggcaaaataaatacataaatagtaccatgcattgatacatttataggagcttgcaataggttatgataaactttttggggttttatttgcagattgttattatgcctaataggtttctttaatgataatgatagcttaaatacatgtcttaaggatttaaattatctaaaaatataaatgtaaatgttcatttaaaacaaatcacacatttaaaatcacattattcctggtagtatctaataaagatttttcatcattttcattgcaggcaaatacacctcaataaaatattggaatgaaattgaaaaaatagacaaatgcagattgaatttcttcccacaaccaaatgacgtgaatacaaaggggaaaacaacagcaaaggcatacagtgacaaggtaatgattattaattaccaaacacagtcaaatgacttgatttgggaacagaattatattatccggattgcatatctacaattactaaaattaccactaactttattatatatgggtagggaataaagtatattgaatagtccaacacaagaaaatggacaatttacaggtgcttataactactcaatgttaagattttaaaattgaatatataaatgaaagacatttacaggaccaggctgtggcagatttccaaatatgaccataaattcttcccattgtgatcagcgcatcctttgcaatgtgattttattgcctcttctcttaggaggtggtctcatttccccagaccttgagtctgggctggcattgagatctacattgatcaataatatgacagaagtgattttaagtgacatctgaggctgggccttaagaggacttgagattccactttggctatattggaattcaactctgctctgagacctctacacaaggaaactggtctaagatcctcgtgaataagaagtcacttggaggatagattctaaacctcaagaataagaaataaaagtacaaattggtgtgatgaaggtatattcctatttttggggattgggaggctttacttatttttaaaaactctattgaggtaaagagttaagctgtaacatacttcattgatttcctcacccttttcggctctgttttactatatcccctaatttgttggttgtgctaatatttgtagaaagaggtcttgtatttgctgcatcataatgacatttgtacttttttgactggtttaagtacaaatgaatgaaataaccatttttcctttagttgactttaccctgatttcacctagtgtttcaatgagtaaaaatacagctaaaagaaaagaaaagaaaagaaaaaaagtcacttggaggagaactgaggtacctcagatggcagccagcaacagctgcctgatacatgagtgagccgccctggacctgccagtccaactgataccccaccagcatgtagccatgtgaatgggcccaggcacagctggcagaaggaacacccaactcactcacagaaacatgagaaatcctaaactgttgttgctccacaccactaagatttggtggtggtttgttgcacaggaaaagctaaccaaaacagaaattgctaccaggagtgtggtgttgctctaacaaaaatctaagacatatggcattggtcttgcgaccaaataggggaaggagattggaaggacacaaagagcctattagcggaggctgattgggcagtgagggaaccgccattggaaattggagaaagagccgtacatattttgtacattatatattctgtcacctgcagtaacttgaactcatgattctggctagggagatttccttgcagaatgctgaaagtgtcagttggcttcttttagctgaacattataaggtgctggaagagacagaaatgagctgtttcatttgcagacacaaggcagaggaaacacagaggcctaggatatgatggactgaaaaataagatattttcttattcctagtctttccaaaaaaaagatttgcaaagtaagaaaacgcttcagggtaacagcaaatcaaaggtatgagtattgttgaaaactcagaaagagtttgacttgtttaaactccacatataaatgatatcacacagtacctttcattctgtatctcacttatttaatttagcataatgtccttcaggttcatccatgtcattgcaaatggtaggatttccttatttttttatggaggaataatattcaattgtatgtgtgtgtcatgttttctttatctgtcataatggatgtgttaattgactgtggtaatcatttcacaatttatatgtatatcaaatcatcacactgtacaacttaaatatatgtaagttgtattcatcaattatacctcaataaggctggggaaaaaagagaacatttggaaagatttaaggtagtgcccagttgaccttctcaactagacaaaccagcttctaagaatctttagggcactgcccacagcagcctcatatgtgtccaatgtttgtttcaaagctgagattttgggggcacagaatgcactacagacaagtttttaggaagccagctttcactgaagggacagcaccactccaaatgaacaggagactggaaccacaactttgtgtgtctaggaagaaggctaagaaaactatcagttgcaatcttgagccatctcttaccaagatagcaaggaacatgccttgcccctggacaaaacgaactggccacgtgtggctcactggatttcagaatggctggaccacaattgctccctctgttcaattctctcactccttggacagaagcatctattgaagtgaccccactcctgcctcatcactgcatgttgaagaagtggggagcaggtaacttctctttttagttaacgggtctatggattgagagaaatttcacctgaggaacctcatctctatctggacaagatgcaaacgatgcaacacaggacttagagcttgatgccaaaccaaaggctggaggagacttttgataccttgagaatggatgaatgtactttccatgcagaaagaaaacaaacagtagtgaccagaggacagattttaaattatggccacaaaatcctgtggtccaactatgcatccttcttttgtatggtgactttgtccttcccatccaggggtagaatcaatttcccttccccttgaatctgaactcgtatggtacttgctttaattaataatgcagcagaaattactttatgtcatctgattctaggccttaagaggtcgtgaagtttctgttttagctgtcttggatctccatcctaaaaccactgtgcaaagaaagcagtttatattagaagatgtttccatctgtggaagaattcagatgtctcatttgttacctagaactaaccaccaggcacgtgaatgaggtcaccttggatcttcaagctcagtcagccctgcagatgaactcagccacaggtgaacccaagtgaagtcaacaaactgaggcctaagacttcgagactgatgtgtctgatacctcctctctctcacatccatacatacttgatacaaattccttgtaggaagaaagcattttcctcaatatcgtattcctaaagatcagccccctgcctggtatattgtcttatatatgtgtccttatgaaaccatccatatttaactgaactaaccagcaaatccacatactgtgagaaagcatgaattctgattggcttaagccacagagttttggagtagtttgttacacagcaaaggctaactgaaataaaggcatttacatgtgtgggggggcggtgggagtggaggggtccttctcctcctccctcactctgttttccataatgaaaagattctaggcttatttctttgggcctgtctcctaggcctttcctgttttaatcagacaagtaatggattaaaagttgcaaagaacaagggcaaccaaagttactctgcatgagttctgacatggattgatgcgaagggacagacgagaagagagaaaattaatagctatctacagctgtgggcttgagggaaaagatgagttaagagaatttttagggagtcttgcctgtgttgagtcctctaatgactgcttcaatttttttttcaagtgaatgtcagtaaagacttacattgctcttaagactttcagaattggagttgcatttcttttgtatttaaaaccagtggctagattgaaagagcccaatttcattaaagttatatttgcaaaatgtagtatcatttcactttaaatctaaggcagatgggatgaaaggaatataattatctccgttcctaagttacagttgcttaacctcagcaatattgacatttaggcaagatgattctttgtcgtgggaggtggtcttgtgcattataggatgtctagcaatgtcattggcctttacacattagatactggcagtaccctacaccctagtgatatatctatttgaaaagtgacaaaatatagtaaatctaagacttttgctgaaaggttacatagaaattacacgatttttccaatatgaattaaagtatcttatgatgtctgaaattatgtcattcaaatctggaaagtttggtctcatgtggtgggaaggtataagtgggagagggtggatagatctgatagtgtgtttgatttatcttataattcttaacctctaaaaaatattttagaactatataaagcaaaatctattttttaaaaaacaaatattttaaaaatattacaatttaccaaattttaatgtatttgtcacaatggtggcagttatataaggacacatatattagaaaatgtgctaggcactgggttggcttctagggtgacaacaatgtggaaatgctttcatctcacgaagaatttgtcatctcgtatgtatgggggtgtgggagagaggaggggacagatgcatcagccttgaagccttggatgggcctcagttttgtaactttgtagtaaataatttggtagcaaaaaattgacctgaattgagaaaagactatttatagtctttcattattccacttaatgtgaaaattcatacttttctctgcagaaatatcaacgtctttgattgcaaggtgctgccacagactctgattgagagtgaaccataataaatagtatgtgcaccgtatcacgtttctaaaatccaaaagattctgagtttgaaaacaaagctggggtccttagactttcggataaagggttgtgtgaatcacacagaagtgcagggatggagatgtgcactcagagagtaataatcacaatagagagcacaaagcaatcaatacagtgggaggaaaaacagcacagcttattgtggcacttcaaaccttttagttctaaatcaagaccacatttgaacagtttcaagcagaacttttgtggattttttcctgacaccttttccttcctctatttgtggatataatgttgcaggagacaatgatcggatagtaaagtaatgaaaataccttttaccttgtatctgtacagcacttgaacttattcatgttttgtatacatttctcatttggattctcacaaataacctgccacgtacacagagaagaccattaactcggatgtgaacaaggaagctaaagaatagtgggggtgaggaaatacgccagaaatctagaaactggaatgaaggctgaagagttacagaataatgaacagtatttagtagtcagactcttaccctaatctaattttgaccagatcaatttgctgattatttgattcactaatttaatgaattccactgtgcccctcacatgtaccagccgttctgctgaccagctgtggatgcaatctgagaggatgggtttggtccctgagagtccatcagggaaacaggaatcaaaaagaattacatcacagtccaagttttgtaaatgcaaagaaaagttcagaacagtgacatgaaatatattagtatatttaaaaaatatcacttctacatgattaaagattattcttgtggaaaacatgaaagcctaccctcctactgtttgctacaatggaagctaaggagaaaatgctgccttcacatctaagagttttcctactgaattacatataaaggtgcatgttaatgaaaacatgaagacaactgatctcttggatgaaaggttatttccaatcagagagcacacacagaagccttgagaaggacttcaagctgaggctggacaaacttgccacatgtagccagctccctcctgtaaaatgtggcgtctcctgcttttgcaagaaagccaccaaaactatgaaatattttcctgttatgagctcttagcaataccagggcaccagaaagaaagggagtcttgaaaaatgtcctgaaatactaccttcatagaaccactttattttaacctgaaactgtattccaataccaagagtttcaacaattcaaaatacattgtttggtgtggaatggggaaaaggggggagaaaagctggtcacagtgttcgtatattttatgtccaatatttaatccagacttttaaaaaacccacagttctctcaaacaaacatgactgttctcagagagtgctttcaaagtttggtcgttgcttttcatcaaattactgctctttatcttaagtaggttcaggattttacaattttacattttcacattttgggattttgcatttcaaattactgctaatattatttcttagtctcaccctgtgatctaaatgttccttctctctctccctctctcatataaatacttatatttatatatttacatatttatattatatatttatatattattttgtcagtatccagcacggatacaataatttgacacaatttcacctatattttatactacctgtccccttgacaagacgtaaagagagctacaattttaacaacaaaactcataaatctcagatggagatgaaatgaaaaacagcaagcacctaaaagagtgaacctgagaaataaggtcaaatcacagagtttaaagagccagtgttagaaattgcaatctcaaattcaacccccaccatgtaattcaattagccacttggaagacctgcactcagtggttaatcctgcacagagcaccaggtggtgctgttgctttccgctgcttcagatctagcgtggcgttagtgaccctcctcataatagaagatctactggactccagaacctgtggccaccgcggcagctgcaggggtttccacatgagacagcagctggtggatgtcacaaataaatttcctgagtgtcaatccaacctcacatgctcaagtttattcgtatagtaatgaataattttaaaggttacttttaataataatagaaatctatcttctatttagaatgtatgtggcaggcatatgttgcatatatttactacacatattatctaattaaaactttgcaataaccgtatgagaaaatatcctccaccctcaccaattttacatgtaaagagactggagcaaacgaggttcatcaactcccttgaggtgacacaagacactaaacgtggagcatggatatctgtctgactcaaaagcccataccttcaatcacttcattctactctcacgtccaaattgcccattggggtttccagaataactttacatatcacaacctatctggagataggcaatgtagacgcaattcccaactcacagatgaggaaaccgtgtcagaaatgggtatctcagcaagcaagtgccaaagtcaaatgaaaccctccttactccctttcccccgtactatattaaaaacgatatggccagaatccagctggtcaatagagcacctccaagctaggccatgatgctcagttatcttcccgagctacaaactataaagagttctcctatccacggacatcttgaccgcctatctccagttcttcaaccttgtctatcctcattctcagcccatcttactactacttgagcctcctcaacagagcaggaaatgtttatgggaactggctcacctatgaatccacagaataattttcctttcacatgtctatatttgcatctgccttggtattattattatatcatgtgtcacaggtcaggataacagggaaacaaattctagaaggaattttgtcagcaggaggttttttagcatgtgctctcaagaactaaaaactttaagtgtggagaagcagaattaggacacagggagatgctggactcatgcaattatgcagctgaagctaggagagtctttcagagatgtccaaaatgaaggcaaggggctgggactttgcatccaggtattggccagttgctggatatggggtggccctgggaggaggtataacttgagaaaggcagatccccggggctgaggaccagtcctggggagaggctcagctgtgagtcttcagcaggcaacatttggagagctgggaatgagggcctcagagctgaggggcatggtctgcactgtgccccagtcatctgctgcaccagctacaatgttaactactaagctctaaaaatttaaacagtcccagtaacaatgagaatagcagcacggtcccaataataatgagatcagtagttctcattagttgtatgctatgttcgatacactgcattcaaagggggtcaagatttgctcctatttctatttgggactacagccaaacacttgaccaccaagagatgctgcctcctccatttatttcaaaatgaacaaagtgttcaaggcccacttttgcacttttctgaggactggatcaaaagtctgaggacttctggatcaaaagatcgatagtgcaaggacagggaaggggccatagctttcttgaggcagccaatcatggagttctccaaaccatcttagacatcttagttttttttatcagtttcttactaattcatatgcttcctcagtttaaccaaccaaacttggttgtatatttctaccctctgagcctgcctatctaaggtaccattttacttctctaaccagacaactttggcagccactatctagttctcccctctgacctccatatcatcatccaccctttgcataactatttctcctgaatatgataccatttttccagttcttaaacatcatcacccaagagcctacacaaataaaaaacatggattgccaagtagtggcatgtaggcagaatctgggccccaaatgtattttccttcatcctgcaaccttccaagaaaacattttaatttaaatgtttgtaggtaggacttaagttctaatttttacacagacccatcactttcttttgtctttaaccagttacttctcaaatcaccagaaggtaatgaggtttaagacatcttaaaagaggaagacttatatttcaaatactcataaatgggaagtgagattttgaaaaagcaacatgatgagaaatcttaggaagagcaaagaagtaaaatagagactcttgattttaaaataaactcatattttttgttacaattattatatctttgtcatagatatgttgtgtctttggggaaattggaaaagatattctgtttacattctcaatccgttcccccagtataagcatatatcacataacatttcagccaatgatggaccacatatacaactgtggtcccatgaaattataatactgtatttttactgtactttttatgtttagatatgtttagacacacaaatatttaacattgtagtacaattgcctacagtgttcagtacagtaaaatgctattcaggttgatagcctaggagtaaaaggctattaacacatagccaaggtgtgtagtaggctatgccatctaggcttgtgtaagtaccctctatgatgtacgcacaatgacaaaactgcctaataatacatttctcagaatgtatcttcattgttaagcaatacctgattgcattttaaattagtatatgtttaagcaagtatattatttcactgaaacccagaacaattggaacccaagaaaagttacttgcaatgatgtaaagacatgaatgaattcatgtaatttgataaataacaatataacatgttggtatttttacatataaacaaacatcataactaaatttcaatgagttataagaatgcatgatatattttatataaaactttagaaaatatgagaatctacatccagagtaagcttgttatcagtaaattccatgtagaaaaaccagaataaaacttactactgtatctacatttgtttcctaataaggaaaatggttcagctacctatgtcctgaaggtagtcactgaagagaaactgctgtgatgccagaggcaaacttgagtgcatctgattatcatcttatatgtaaacatagtgaaaaagaggtaaaattctgaggcaccctcacattttaaaagagatctgaaaacaaagtgatatcagcaagatggcataatagcagtttccagtgctcatttcctcacagagacatcaatttgaacaacccattcacatgcaacaaaaatatctgcctgagagctaaggaatatagtgcctgagtagagcacagaaataaacacatacattgaagagggtatgaagaacagttttatattacccacccatatcacccccttcccaagcctgtactgcataccatggagagataacttccatatgagggagaatagtgaagtgagcacttgacttcaaagtagactccagcacttgccccagtgaactctagtgtcaagttggccccttcagaccgaggatttgggcctgcccatgcagatctgtgtttcaggactgccctcacagacccaagtgccagaccaactccagtacaggatgacccccatgaactcagaccaaaagcccaccccactgcctgactgttttctgtggactcaggttttaggccatcctccacagacccagtctccaggcccaccacaatggaccatagtcccagctttactcccatggtccaaaatatcaactcagcccctataagctaagatgatgagaggaccatctgtcccctgacgaaaacatcaggccagtcctcccaaggatttcagcagcatgcctatccatgaacccttccagctgaccttttcagaatccttggtcaggctgactgatgaagggctttccctgctaaggccagtctgaagactggcaaatgtgcctatgtcttcaaatgcataggcaccagctcaaggccacaacaaaccaaatatcagagaaatatgacactaccaaaggggcaagtaaaatactagtaactgactttaaagaaatggatatctatgaactgcttgagaaataatttaacataatcttctaacaaagaagctaagtgagctaaaggagaacacagaaaggcagctaacccaaatcaggaaacaacacctgaaaaaaatcagaagttcaacagagagacagaaaccatacaaaagaacaaaacaaaaattctggagctgacgaacacaataactgaactgaaaaaaattgcatagacagcttcgacagtaggttcaatcaaatagaagaaagaatcagaaagcttgaagacaggcttgacattattcagtcagaggatcaagaatggaaaaaaaggatgaaaaggggagaagaaagcctatggaacatatgaaacaccatgaagctaatcaatatacatattatgtgagtttcagaggaagcagagatggagaaagaagaagaaagcttgtttaaaaaaaataatgttagaaaacttcccaaatctagactgggaaataaacattaatatccatgaataccaagagccctaaaaagattaaacataaagagatcttcaccaagatacattataatcaaattttcaaaagtcaaagacaaaaaattttgaaagcaactagagaaaagtgatttgttatgtataagggaaactccgtaagattacaagcagttttctcagtagagacttgcaggccaggagaaagtgggataatataatcaaagtgctggtgggggaaaaatactgtcaaccaataatactatatccagaaaagctgtctttaagaaatgaaggagtgataaagaccttcctagataaacaaaaactgtggatgttagtccctactagaactaccttacaaaaaattaatgttagagttctttgagttaaaataaaagaaagctaattaacaaaatgaaaatatatgaaagtaaaatctcattgtaaaggtaacatatagtcaaattcacaatatcctaatactgtaatggtgccatacaagtcactttgatataaaagttaaaagacaaaagtattaaagacaactaaagctacaacaatttgttaatgggtacacaatataaaaagatgtaaattgtgacattaataatataaaacatggggagaggagaagttaaagtgtagtttttgtttgcagtcaaagttaaattgttaccagcttaaagcagactattataactataagaggtttcatgtaagcctcatgttaccacaaagaaaaaatctgtaagtagatacataaagataaaggaattaaaacataccaccacaaaaaaaatcatcagatcacaagaggatggcaagagaggaagaacggaataaagtaactccaaaatagaaaacaacagtttgtcagtactgggtccttgcctaccaataattatcttaaaagtaaatagactaaattctttaatcaaaagacaaagagtggccaaatggattaaaaagtataagatcaaactatatgctgcctacaagagattcactttagctttaaggaagcacatagtctgaaagtaaagttatggattaagaaattccatgtaaatggtaaccaaaggagaacaaggatggctatccttatatcgcacaatgtagattttaagtcaaacactgtcaaaagagacaaagaagatcattatataatgacaaaaggatcaattcatcaagagcacataataatgtaagtatatatttacccaacatcggagcacctaaatatataaaatgaatgctaacagaatcgaaggaaataaacagcaatatgattaatagtagcagatttcagtacttcacgtttgacaatggatagatcatcctgacagaaactcaacaaggaaacaatacatttgaagaacactataaacctaaacaatgtaacagatgtatatagaatattccatccagcaacagcagaatacacattattttcaagtgcacacagacaattctccaggatagataatatattaatatattagaccacaaaacaagtcttaacatatttaatttttatttatttatttatttatttatttatttatttatttatttatttttagagagagggtcgcatctgttgcctgggctagagtgcagtggcactcactgttgcctgggctagagtgcagtggcactcactgttgcctgggctagagtgcagtggcactcactgttgcttgggctagtgtgcagtggcactcactgtagcctagaactcctgggctcaagcaatcctcccacctcagcctcctgagtagctgctgggattacagctgagtgccacaatgcccagctaatgttttaaaatttttttgtagagacagggtctcactgtgttgcccaggctggtctagaactccttacctcaagcaatcctcccacctcagcctcctaaaatgctgtgattacaggcatgagctattgctgtctggcctcttatcatatttaagaaagttgaaatcatgtcttctcttttctgaccacaaaaaaacataaaacaagagatcagtaatatgaagaaaatttgaaaattctcaaatatgtggaaattaaacaattcattgaacaatcaatgggccaaaaaataaaagggaaaccaaaaaatatcttgagatgaatgaaaatggaaatactacctacaaaaacttaggagatgcaacaaaataagttctaagaggatggtttatagtaataaatgcctacatttttaaaaaaagaaagattttaagcaacctaattttatacctcaaggagctagcaaaaagagaaagactaagcccaaacttaggagaaggaaggaaataacaaagatcagggcagaaataaatggaatcaagactagaaaacaagagaaaacaatcaatgaaactaagagttggtttttgaaaagataaacacaattacaaacttttagctagactaaagaaaagagaggagattcaaataaataaaataagagatattacaactgatactacagaaatataagggatcataagagaatatatgaacaattgtatatcaacaaattggataatctagaagaaatggataaattccagacacgtacaatctaccaaaactgaatcaagaagaaatagaaggctgggcatggtggctcacacccgaaatcccagcactgtgggaggccgaggtgggcagatcacttgaggtcaggagttcaagaccagcctgaacaacatggtgaaaccccatctctatcaaaaatacaaaaaataaataaataaattagctgggtgtggtggcatgcacctatagtcccagctactcgggaggctgaggtgggagaatcgcttaaacctgggaggcagaagttgcagtgagctgagatggtgccattgcactcccgcctgtgtgacagagcgagactccatctcaaaaagaaaaataaaagaagaagaagaaatagaaaatctgagcaggccaataatgaggaaggagattgaagtagtaagaaaaaatctttcaacaaagaaaatcccaggacctgatggttttatgtgtgaattccatcaaacatttaaagaaaaactaataccaatctttcccaaactgtttaaaaaattaatgagaatgaaccacttccacactcattttataaggccagcattactctcatactaaagccagataagaatacaagaaaagaaaattacaagccaatatccctgataaacatagacatgaaaattctcaatgaaacactagcaaaccaaattcaacatgaccatggtcgatgggatttatacctgagattcaagaatggttcactatatgcaaattaatcaatgtgatataccataataatagaatgaaagataaaagtcgtatgatcatctcaatagatgcatgaaaagcatctgacaaaactcaacataattttatgattaaaaactcaaaaaattaggtacaggaggaatgtatctcaacacaataaagaccacataagaaaagcctacaactaatagtatagtgaatggtaaaatgttgaacatttttcctccaagatcagtgaaaagacaaggctgcccactctcacagagtgctatgttctattcaacataacactgaaattcctacccaaatcaattaagcaagcaaaagcaataaaaggcatcaaaatcagaaaggaatacatagacttttgtttgcagatgacattatctcaaatagagtaaaccctagactccaccaaaaaaatggttataactgataaatttagttaagttataaggtacaaaattaacaaacaaaattcagttgcatgtctatacataaacaatgaactatccaaaaagacatttttttcaaaaaataaattttaaaaatattctattcacaatagcataaaaaagaataaaatacttaggagtaaatttaaccaaggagataaaagatctgtataatgaaacaataaagcattgatgcaaaaaactgacaaggcaaatacatggaaagatatttccttttatggatcacaagaatcaatattgtcaaaatgttcatattaccttaaatgatctacagattcaatgtaactcctatcaaaattccaacggcatttttaatagaaatagaaaaaaaagtcctaaaaattgtatggaaccatcaaagaccatgaagcaattttaaggaaaaagaacaaagctggaggcatatttcctgattttaaattatattatatagctatagtgatcaaaactgcatggtactggcataaaaaaacaatacatggattggaacagaaagcacagaaataaacccatatataatattcagtcaattaatctttgaaaaaggcatcaagaatacacaatggagaaagactgtcccttcaggaaatggtgttaggaaaactggctatccacatgcaaataagtgaaactggatccttattttacaacatacacacaaatcaactcaagacagattaaagatttaaacgtaagtcctgaaatcataaatgtactagaagaaaacatgggcaaaatagcttcttgatattggactagacaatgattttctggatatgaccttataagcacagccaacaaagcaaaaagaggcaaatagaattgcaccaaactaaaaagcttctgcacagcaaagggaacatcaacagagggaagagacaacctagggagtggagaaaatatttgcaaaccacacaattgataagggattaatatgcaaaatatgttagaaactcaaaaactaaatagcagaaaaacaaacaaagaaaacgggcaaaggacctgactagacatttctcaaaagaatacatacgaatggccaattacaagaaaaaatgctcgacatcacaaaacatcagggaaagcaagttcaaacaaccatgagacatcacctcatgcattaggatgtatattatcaaaatagcaaaagataacaagtgttggtgaggatgtggagaaaagggaacccttggacattgttggtgagaatgtaaattattacagacattatggaaaacagtatgaagatttctcaaaaaaattaaaaatagaagtaccatatgatccaatagtcccactactgagtatatatccaaaggaaatgaaatcagtatatcactgagacatctgcaccaccatatgccctgcacactattcacaacagctaagatgtggaatcaacctgtctattgacagacaaatggataagagggatagcattaggagaaatacctaatgtagatgatgggttgatgggtgcagcaaaccaccatggcacatgtatacctatgtaacaaacctgcacgttctgcacttgtatcccaggacttaaagtatatatttttttaaaaaactctaaatatcaatcatctaaattttcactattcaggctttcactataaatgctggttttaggttttccaaaatgatgaatgtaaatcagtattattcatttcacttccactagttttaggttcagatacaataggaagaaaagattttaaacttttagagttcttttaaagtctactccacacattcatcttttggtacgaagtatttcaactcaaattataatagaggaaaaagagtacacacacacacacacacacacagaaagagaaagagacggagaaacacacatagagacaacaataacaaaatagtaccttttatcatacccggagtcttgtagattgtttttatcatatctcacctattttactgattttggtaaattatcctaattcagtcgtatctaaaccaaacacagctttcaccaagggaacttccaactctcctagcagcattctcctgatattatcactatagcaacatctctataaaagcatactattcttccctcattcttcatccttaccccctgcttactagccaaatgcaccgctccccagtgccagcgtgtctacaaagacagtgctcatatcgatttataaaaagtgcttcagatgcacttttggtgaaaaaaaagagacatttttcattcgatatttagaaaattaggcattttatcttattaaaatcctagtgttgattgtggtaattgtttcacaatgagaaatatatcaactcatcacattgcacaccttgaaaagatatattgacatgatttttatgtcatctcaataaagctggaaaaaattttaaaaatcttaataacttctaagggatttttgttggaaaaaaatcgtccaacttacaaaaacttccagaattgttacttttgaaatttaattctagaatttgggagaagaaattaaatggacattttttagatcactattacataggcatttaatttcttgtatttttacacaagatataatcttgtttatttctgatttgttctttgaactttctggaatttttcccaaatatctaatattgcaaaacactcattacaaattataattgccatactagaaatacacatagcaagttgccaagagaatcacaccatttttttgaaacttgcaaacaatattggagaggtttgacattacttaagcacataaaatatcagttaaagaaagagccttacaaaagacaaacaaatataggtgtaagaatgtacaaagaatattttttaaattccattttatactgcgtaagacaatcaaagactagatttttaagcaagaaatgtttacagatgtgtgagactctccaggtctagaatcaaataatttcttggcctgggatttcaaggaaaaacacgaatcagttgtagcctactcatgcctattaaaacaccaccacaaacaaaatcactggtgaaaatgttttcatttttctgactcatttagagtaagaaatgtttgttttttgtttgttgtggtttggttttggtttgagacagggtctcactctgtcacccagacaggagcgcagtggcatgctctcggctcactatagcctcaacctcctgggctccagcaatcttcctgcctcagcctcccaagtagctgggactacaggggcatgccaccacacctggctaatttttgtattttttgtagagacggggttttgccatgttgcctaggctggtcttgagctcctgaactcaagtgatctgcccaccttggcctccaaaaatgctaggattacaggcgtgagccaccgtgcctggacaggaacgtttattataacatcaaatttgttaacccccaaaagtttgcttataaaaaatgttaactattctcatgatttctagggaaaaaaaaatcaaactcactcttcagtagaggccaaaagaaatatgaatttcctcaacagactttggggtctaggagtgcaacagatccgactcgggatcccagcatcatcatttactgcgagaatttcaaaaggtgacttagccactttatagcttcatttagccatatgtaaactagagacaaaaataataatgaaaacctcctagaatcactgtaaatattaagttagatattttatgtaaatgctgtgtccaacacttatcacatagtattcattcatcaataaatgttagttacttgttatacttgtttttactcttattgatttaaacatgatagcagcaattaacttctcttaagggaatagaacagaccattgctttcttttattattagaatatgtatttaataaagacagggaagcgaagaagtttctagaagccaggagaaacctgatcattaatttatgtggttccttttgcctccactagcttcaacactaagaaagagggcctcttgtggaatttagacattcaaaggtatatttactgagcaaatccaaatcattggtttcaatttatcttgacatgttcaggccaattaagttagttaattactgggaataaagtaatcctgaatccttaaaagctgggcccacaacctagtattcattcctaagggctagcagatttgtcctccagtatggcatatgcagcaatttaaagtcagggaaaagtatggacttattaatactctttggcatttactggcactgctatttaccctctattacgtgctaagtgtctgacgacccaatacccatatattcaacattaaatcttcaaccttataattcttgaaattctcatttggtattcactcaagacccagaaaagggtcaaaggttgctaaactttacttcgctttaaaatcttcccttattcagacaagttccctgctgaagtttaaaaaaaaaaaaaaggaggctctaaggaagggcatatttctaaaaaactgaaaaaataagagggagatggttttcagttgttttacaaataggatttcttgtccttttcaatttctcacttaagccttatttccatttggaaatccagctactcagtgccaactaagggggaggaactgtggggtttaaaagttagaataaacatcgtttgtagccttaaatgaggaccagtcttcttaaatgactcaagaaacatttactgcacacaaattatgtgcaaagcactgactacatacatgggtgatgggagcagagggcacaggggcaaggagaaaaataagatacaaaacctaaacctaatgtccttgtaaacttagttcctttacatccttgaaaaattatttttttcttccacagcactacagctgtgtatagggaaaaacaggggaagaagaaccaagcaaatgtagcagcttctagctccttacccctccagtgttgaacctggggtgtgtgtgaaaaaccaaggttaagcatcacagcccactgagataagagtgaaggaacaagggatgacgcaaggtaacacagagatgctggcaggtttgagaaaaacatgttctcgcttctcaagctgaagcgagcaactagcatgacctttctttgtattttcgttttgcagtgtcaagggcaatgttgtttcttttcaggaagaaacaataccagctttgagaaaaaaaatccacattaaaaaaaaatagcagctattaagaagtgtgagaggaaggaggtgcagaggggacacaggaagatccaagagcagcaaaatataggttcagaggcaatttgagtccaatccaccacctttcaaattaaattaaaagcatggttaaaagagcatttttggcacaaaatcttaaattcacggtgctgtaggataaggcttagtgggattatcaacagagtgtggatgccaaatggacatcaggcaggaagagaaaccacagatgcattttcagcaaggtgtctttataggattactccacctagagcttggcctgactcaaatattaatttcacaaacaaccgcagttgtaagagtgacttccattatttaagggcctaatctcgggtagaataacaatccacaaacactttttttgtggcactgccaagcatcttttgtttttcaacatatgattttaaacattaacttgttattgtatatatttaagttgtattacatgatgttttgatacacatagtgaaataattactacggccaagaaaactaacatattcatctcttcacatactgtgtgtgtgtgtgtgtgtgtgtgtgtgtgtgtgtgtgtatgcgtgtgtggcaactgtataccctttgtcccccatctccctaaactgctccatccctctgcacctgttaactgctgtttcactctctgtttctatgcatttgcctttttttagatttactgtttaagtgtcatgcagtatttttcacttagcgcaagtcttctaggttcatctatgttgtcaaaagtcgcaggacctccttctttttaaaagctgaataatattccattatatatatgccacaatttcttcatccattcatttgtagatggatgaatgctaagcataaccattttaatcattctgttaataactcagccaatgaaaaagatttttttcccattataatataaaactgtacgttattttgttttcctaacctacacagtgcttacatgtttctttaatagtaaagatcgtaattagcctatagtgaagtatatataacagataatttggatgcttctattgatttttttgtctccattattaccactgagtccttctaccatctgctgaagcaaaggcaacagagaagaataaaagaagaacagagtattttttcaactgccatgatgtctccagcctgaaactctccttctattccaatgctaactagttattatagcagtaactttgcacttacagatttttgtgcaaaatccaagaaaaaaaagtaatctttattgtcaaaaaatagcttcctgggtgctttctggagaaaaggagggcggtctgacttcctcatgtagaaaatctcagatatgaaaaggaaaagtaacaagggaagggaacacattgcttgtcctatcaaatattaaaaataaaatgtaaaaggtgcattaattaaagcaatgtggtaacagagaaagaacacaccatagaatgcaatgaaatacacagtccagaaagagacttgtgtctatctagacaaaatgagaaagatcatttgatgaatagtttagggaaaactagagggcaaatgaaaatagaaaaaaaaatcattgagaacctctctttacaccaaaataaataccaaatggtttagggaattaaaataaactataacaactacctgaaaatatagtaaatatgcttaataatgaagacagacattttaggcctaaaaataactaaagaggaataggtttcattgcataaaaatcaaaaatacatatccaacatattataaacataaaggcaaagagtatagtgggaaaatatgtgctaaaaatatgagttaaatttttattttattttattctttttttttttttttttttttttttgagatagcatctctcgctcttttgctcaagctggctgaagtacagtggcgagatctcggctcactgcaacctctacctcctgggtccaagtaattcttgtgcctcagcctcccaagtagctgggactacaaatgcgtaccaccacactcggctaatttttgtatttttagtagagatggggtttcaccatcttggctagagtggtcttgcactcctgacctcagttgatccacctgctttgtgctcccgaagtgctgggattacaggcatgagccactgcacctggcctatttatttacatttagagacagggtctctctatgtacccaaaatagagtgcagtggctattcatgggtgcaatcagcacactgcagcctccaactcctcgtctcagggatcctcctgtctcagactcctgagtagctagaactacaggctcttgccactgcacctggcttagaattttaaataaaatcaatgagaaaaattttcagtcccattacatttgtaagcaaagatatggaccagcaattcacaaaatggtctttaaaacatatgaaataaagttttacattattcaatttaaaaaacaatgagataagcataatatccaggggtaacttttaaacaaaaagaaagagattttgagctgtaataagttgccatttttgaaagccagtatttttaactcttataatgaagattaagtaacattaatgaattagttctttattgctcctagtctcagtattatcatacatcagtggtccttaaagtgcccagagcagcagcatcagcaccacctgggaacttgttagaaatgtaaattcctggctccaatcctgacctacagaagcagatcagcaatcggctttaacaagatacccaggtgattcttatgcacaatcaaattttgggatcactgtatggatcataagctgtagaaaattttgtggtgcagtggttcccagcatgcatccaatttcctgggtttagtttaatcatcaccttatgggcaagttatctagattctcctttcagtttcctcatctgtgaaatggaggtaatgatggcacttgcctcataaggttgttggtaggataacagaagtttatgtttgaaaagcatatgtatcagtgcttatatagcttagcccattgttaaatttagatttttttaagtaagtttaataaagaagagaaaagaccatattttaaagatttaaaagtaaagataatcaataattacactgtgagaaatgacaactagatttgcatatctgtagtagaatagaaaaaatgggtcataagcagctttagggatgatgagaagaaatggaggaagaaaaaagaatatacacaagctgcatccaaaatactctcaaatactctgccagtggagagccacacgtataattaattcagagatcttcttggagatggccctagaagtgtgaattcttgcactctgcctaaaacaatttgggtatataaaccacctctctttgatggtaaagatatgtttgtttgatttttgatgctagtaaaatagctgtagaaacaagtcttgaggccatactttcataaaataaatacacctttattaaattacaggtgatctgaatacgatcttagcctgtcattaagatgtgttcttagttatttcagtctactgaatagactgacctgcaatttagtttacaatttagtttctgaaataatttaaaaacaaaaagcataagtctagcaattatttcgtgttgtctagaccctgtgtgacaactctgctgaattcttcaattatttccatgttaataataactaaatagatcattatgaaatcacagcaaaataaaaaacacaatcttccattttctgttgctcctatgttctttctcagcaccaagctatataaaagttaaaacagtttatttcctctatattatgtaggtatttgattgtcccgaacacatcaaaatattacgctttcagaaaaatcttttgaatctctgcctataaaaccattactatatcatatataaaactcatactcttccttctctgtgtataatatttagattctctcctgtgaacaggatagccagggaattagcataccttttgggtcaggtagatggggtagtcagtgagatctccgaaaaacaaaaaggttgcttgttaaaggccaacgtggtcaacttgacccttttggggaggtgcagccttgccagcactagaggctggacttgctgaggccacgttggatctccagtctcagcactgggttattttagtccttcatcccaacaaacttcgggatgggtggtgtgctgcacctattcccaccaggaagcgggtcttgcagattactaacagctgttcccttaatcagaggcaatcaaaacaatggtatccccttccttctacaaattaataaagggagctatctaggaaggttcagtccttactatcatggtaagaagtctttcttttgtagtgtacctcactaaagagaaagacaaacaagcaaacaaaaaaactcctactcacagcaataagtaaggtaagcatctatctaggagctctctcctaaaggcagccagatgcggaggaattcacgagactgccctgcccagtctcagaaagggatgcacaaagggggattcatcccattgctcagaaagcaagaagggaagggactttgctcagaaatcaagctgcttatttaatttgatgtttactctggtcttttttgacctacacagtaatacagagatatttttcaattgacaactttctatctcagttacttagtttcaataaatttaacctgtaaacattaccttacaatgtgttccattctgaggtttcttttaacccaatggaatagaaatgacccctacttggtttgtcttctgagattgcttaagaacaggaagcaaagtactgattactaggcttgcttttaaaataacagccttggcaatgatctctagctgagaactggcacttgtgttgactctaggtcttcagaaaaggaaaatcaagggaagaaagaaaaattcaatgtgcagaaacaaacaaacaaaaaatgccagcaatttctgaaggaatggagaatacatgtatatgaatcctgtagcaccacgaaatttagagctacacacctacaatccttcagaggcatttcatgacagctgcatgatgaagggggaggatttatatttaatttctatatgtgtatactttttaccctaaaaaaaaggaaggaagaaagcatgcaaattaacttcttgtcactaataaaatggtgtgatttaacccaaaatccgtgactgtaaagtacccacaaagagaaagaaaatgggtctcaggaaacaaaattgttttattatggctgtatctgtattgggtcaattactgtgacgaaagaggcattttccctggcagagaaaagattaacattttagtgtattttcttaaataatttaaaaaggaaagagtaacatgtaactaaatttagtttttaatcattttctacttacttgctatatgcaactaacttgttattttcaatgcattttttaaatttttcaatgctagtttgtgcatcatcacagtttttaaaaatttccttgccaggaaattatcatatttgtaattacaataacaaaactctagtcacttcctgaattaaagaaggggttggggtgggggcagctttatcaccgcaatcttggactgaccttttgcctgaagcatttgaaaaggcaagtagaaatcaaatatatttttgcataatgcctacatctttaatgacacttctgaggtgtctgagtgatatttctattgtcattgcataatataatacttagcattttactgtaatgaagtgtaacaattgaggtaatgttactaccatcttacgtaaattcaaacttttacaaaccaaagtatgttctatttttgtccattttgccaattcagttcttctcactattcttaaaggagggtccattaattacatgtatccaaaatgcacaacaatctaattagctgttagaatgactcacttcagtcctcaatgtcttgctttttgtaaaagtgctcatttcctatgacttatgggagaaattgtttggattggaagagcttcaaagccaataaacagaataaggggactcccagaataatagatttctagaataagagcactttttatggattaggaaacagctccagagtctatgacccgcccaacgtcacaaaaccagaatgtcagtaatactactcatcgttgccagatactcaaaagctcctctgcagttggaaagattcgttccagaaaaagtctttcctgaagggcaactcactttcgctagggatgaagagtaacttaaaaaggagagagagcggaggtaaggggaatgaattggtgtaatgccaaaagctgtggaataaaagttattccatggtatttgttcatgggtgttgtgtgtgaatgatgtgtgttgatgttttctgggtcatttagtttatgagggaaggcaggaaaagccaacagagcatacaaaaacaaatcagccacaaattctgaaagagggagttgcctttggtctaataaacattttaggaatgtaaacaccttctgggaaggattccttctgggaatgtctatttgacattcacacctcattgtcaactgctcgaattagataacaccttgttgaatatcctcaggcaatgaaaaattaaaggtaaagaaagagaaaggaatacttttctaagggcgaggcacttagaggtggagactcccctctgggcattacctacttgaggtctctatagaggaggctgatttttttttaaattttattattattatactttaagttttagggtacatgtgcacaacgtgcaggtttgttacatatgtatacatgtgccatgttggtgtgctgcacccattaactcgtcatttagcattaggtatatctcctaatgctatccccccccctccccccaccccacaacaggccctggtgtgttatggtccccttcctgtgtccatgtgttctcattgttcaattcccacctatgagtgagaacatgcggtgtttggttttttgtccttgcggtagtttgctgagaatgatggtttccaaggctgacatttttaactgaaactgaagagaagtgatgaaaaagcaggttggattccattgctcacaactcttctttcctcagatgaccccaacttaccattctctaattttgaaaacaggaaaaaatgttcaagaagatttagaacctatcttcaagaaatgtcaagaatgtaatattgggactctcataaatcataacttttctgcctacattttctgaagatttccctataaaagtctgttaccttgacactctaattcatatgctcaagaattaggttaattattttttaaaactttgaagaaaatgatcaaactaacagtaacaatagcatctacccatcctaaaagagtatgcatcatatacagcaaacttctatgactaagaaacaaaacaggttcattgttagatacagcataatagcatcaaagctctgcttcacctgttggaagcacagaacatattttaactttacgggctgtgggagctgggggaagcaaaaacattagagatgttcaaccaagctctgagtcatctctttatgagttacagattcttaaaaacaaattaaatgaagtccccagctgtaactatgatttgagcctcataacggggtgagaatggagaaaatgggccaaatctacagttatggaatatataatgggatatacacatatatatgtatatatatacacacatatatatatacacataaatatatacatatatatatatatatatggcagatataacaagataggccttagaagttaatttggtggcaaaaggagtaggtttagagaggaaatatatataatatatatttgttgttttcgtagatgagatctggagagttgcctcagaaacgtgtctgcacctctgcaaaggcatccccaagctcaaccctgtgtaattacctcctctttgctcttgttcttgcctttcctttctgcacctgacagttaattgctgtaattgaacaacaaggactgggatgcccttcctcctcttgctctcacttctttcatgactctcttcagtctttgttggttgattaagcttaagcagtctggtaatcaatccaaatcttatctcattaattggactaaatgaagctttgagggaaggaaaggagatgagcataataggtgctaagtaaataccgtagttgtttctcaaccatggaaaaccccacttgaaggatatacactttatatgtttgcatgaaagtattaaggtatttgaagtaactaaggtaatcaaagtaattttccccaatgtataatctaacttctgtttttttcaggcacactaacactttcagatccttgggacaggcaccattcagtcaaatccttatagagcaggactcttgaaacgtcagttcactcttagctgtttttggtttgttttttgttttgtttgtttgtttttaattttgtttgcttttcatttctgtggctttaggttctttaagccaccatggaagtacttattttaagagaataaccattggaattatgctttcttaagaaaaataaatgtgaatgaatgtaccaaacatgaaatgtaagaactcttccatctaagctataatcccatccctgaatgacacatgatggtggtgggtacagttgatgaggttttctctaactccggtggtataggatggtggtcttcaatctgggaatgtaataaatgccctaaaggactatttcaaggagcaacacctgataaagtttttcctaatgtcatactgcattgagcagaacaattctgaatgaagcttttatttagtggtctgggctgaattacatgcctctagatttgtatctgtcaaaatgtgtttcatggacgaatgacatcagaatgcaatgctcactagagatggagcttcctgggttctgcattagatgccccaagactctctgagacaaggcttagaggtctgcattggaacacactcctcatgtcattcttatccgaactagaattcaaaaaccacagctttagaatcttaaaatagttgttcaacaatttatttatgcaaactgctgaaaacatgaaaaagagaagttatattgcatttcactacagttcagtaatccaataggctgttgttccattttaagattgtggagtcaacataaataaacatgatctttgcagtcagaacagcctagatttgccacaacttactagctatgcaaccttgaacaagtttctcagcctatcagaacatcagtttcatcatcactgtaatgaggaaactattaacagctacctcacagggttgcttgaaagctaaatgaacaatgtatatgcaaaacacatagcacagtgcctggaatgtaataggcatttaatgcatgctacattattactttctatcttagcaacttgaggtgactgtaatctcttttaaaatattcagtgtaaacaaactttctcttataattcttgcagcattattagtaatgttctgggaaacggctattgcataatctgccaaataagaacaaagtggacctcggctaatcagcaaacgtgcctgtgcatgtctttctggtagcaattcagtcagctattaaattgttcctgctgtgttttttcaaaaaaataagtaccaacccatctttctttgctaatgttaactctaatctgcgttagctgcttgcttttgcagttattggtatgcattcacattctgtatctataggatataaataaaatcaatagaacttgctttgcgtgagccagtgttcaaggtccaactacagattgggaataaggaattactaggcatttacagcagaaatactagcacatagcacagtcttggtttttgagtcctactatgcagtttacaacactcccatgtatttagacagtgttaggtttttcttccaatcactcagtttccaagagtacattatactcaaatttcttgatgacaaatcctatgcaatttggtgtgttttcctttctaaacctactccttttgccaccagattaacttctaaggcctaccttgttagatctgtcagaggtaagtaactaaataattaactactaggggatgcaggctaccccaaaaagacacaggtattttccaagtgacacaggggcacacagaacaaaggctttcaaaaccttgtcatattttcagtcacagcaggtataaggacagatagccagattcttgaccttcctattcaaattagctacaggaagtggggaaattattttacactcctctaaatctggctgtcaagaattagtggaaaaatccaactttgaatttgtgcttccctgagtgtaatcacatttagtccgattagattaaagaagagtagatcaccctcaaagcaaacaggaaatggagacacaatttgacttcatgattgagcactaacaaaagatatatggaaaatagattggggtctaaagcaaatagcatttttagtaatttaaaaataacttgagagacacatacacatataaaatgccagcttttattgtcagacaatcaaaattgttcatatgttaagaaggcatttttttgtcatttctttaaattaatttgagcttcagataggaaggctacaatcactgcagctaataaagtgtttttgttcttgacaaagaataaaacttgctgttgcaagtggctcaacgatagaaagaatcttattagaagtataattaatgcagggctttaaagaagtcacattgctaacctagggtgcatggttttaggcagaaatgtgaacacaattgccactttgcaagaactcaccaagatccatgaaaacaattgagtctaagaaatgacatcgttactgcattttaaatcataaaaatattcttgcctgggcgcggtggctcgcacctgtaatcccagcacttggggaggccgaggcgggtggatcacaaggtcaggagattgagaccattctggctaacacagtgaaaccccgtctctactaaaaacacaaaataattagccgggcatggtggcgggcgcctgtagtcgcagctactcgggaggctgaggcaggagaatggcgtgaccccgggaggcggagcttgcagtgagccgagatggtgccactgcactccagcctgggggacagagcgagactccatctcaacgacaacaaaagaaaaaaaaattctctaactatgaaaatgcttctaaactctggtgattttccagacgggagttggagtgaaggtctacattcacttagactgtatcacaactccccattattacaagcttgagttttctgttttgtttttttttttaatttagatttgtaagcaatatgccaataaaataatttacttatttactatactataccttgcctacttgcaaaatgcttatagtatccaacaggccttacttagaaagtaacaaccagaagcaaatgtttcttggaataacaaactccacatcttctctacatcctgcatttttccctgtatattctgtgatttgatgcggtgtttttgtgagtgtgggagtatatgtgtaaagtgtcattatttctactaaatatataaatctagatagcaaaaatggttttttttgctacaataggcagtgaaacaattgcaaactatttttcttttgttaaattcatgaaatctgaaactttatatttttttcacttttcaaaaagtttttaaattatgaaatatttacagattcacaggaagttacatggaaatacacaggaagatcccatgtacaccttcacccggtctgccccaatgttaacatctttcattaccacaatataatatgaaaacttcatatccttggcctggcgtggtagctcatgcctgtaatcccagcacttcgggaagctgaggtgggcaggtcacttgaggtcagaaattcaagaccagcctggccaacatggtgaaatcccgtttccacaaaaaatacaaaaattagccaggtgtggtggcatgtgcctctaatcccagctacttggaggctgaggcaggagaatcacttgaacatgggaggcagaggttgcagtgagcagagattgtgccactgcactatggcctgggcagcagagtgagactccatctcaaaaaacaaaataaaaaaacaaaaataaaaacaaaacccttcatattctttaattccagtatctaactttgatttcaagattccctttgaaatttttaaggcttattaaccctatgaagtctataaccctgttttcctgttaactttcataattaagaatttgacctctaattactatgcatacatctattttatgaatttatctaataacattttatatgactgtcacttctctgtttatttcattaactttttattttttttaacagtaagagccatcttttgtttccaggttatttatttaaaaatccatcaagtctttggaaacagatgttaagttaatattctaatttatttcagaagagatttgacttcatatggctataaccaagaaatgcaaatctatagtaaagataatgatattttacttgctacttctcacaaaataggctccattggtttaaatttagtaactaagagtatttctttttttaagtcatattgtagaagattgcattttccaaagatgacaacaataatatttctggtcttacatgctcttccagaacctagttactaccccatttagaggtagaaatttttttccttccccttgaatttgggtgagctattgggactgctgtgacaagtaggatatgtaagaagtgaggctgtgtgacttctgagactaagtcttaaaggcaaaaagttctgtctggctctttctcttgagtcacctgcctttggatctcagctaccatgttgtgaggatacccaggccacaggcagaggccatgtggcagatgttccagctaaagtctcagccacaggcctgaatcaactgccagatgtattaagagagctttcagaagattccagccaccagcattttcttttcctttcttattgtgtcacttttttttctttccaacttttattttaggttcagggggtgcatgtacaggtttgttacatgggtaaattgcatgtgttgggggtttactatacagattattttgtcacccaggtaatgagcgtagtactcaataggtagtttttcaatcctcaccctcttcctatcctctaccctcaagtagaccctggtatctatgttattctcttctttgtgtccatatgcactcgatgtttagctcccacttacaggtaacaacatgtggtacttggttttcttttcctgtgttaattcgcttagggtaatggcctccagctccatccatgttgctgtaaataacatgatttcattcttgttatggctgtgtattattccatggtgtgtatgtaccacattttctttgcccagtccatcatcgatgggccgattccatgtctttgcgattgtgaagagtgctgcaatgaacatctgcatgaatgtgtctttatggtagaacaatttatattcatttgggtatatacccagtaatgggattgctgtgtcaaatggtaattctgctttaagttgttggagaaatctccaaactgctttccacagtggctgaactgatttacattcccaccagcaatgtataggtgttccctttttctccacaaccttaccagcatctgtcatttcttgactttttagtaatagctattataactggtgtgagatggcatctcatcatggttttgatttgcatttttctgatgatgagtgatgtcgaacattttttcatatacttgtccacatgcgtgtcttcttatagaaacgtctgttcatgtcctttgcccatttttcaatggggttgtttagtttttgcttgttgatttgtttaagttccttatgaattctggatattagatctttgtcagatgcatggtttgcaaatattttctcccattctgtaggttgtctgtttactcagttgacagtgtcttttgctatgcagaagctttttagtttaattaggccctgcttgtcaatgtttgtttttgttgcaattgcgtttggagtcttcatcatgaaattttgccagggcctatgtctagaatagtatttcttaggttttcttctacagttttatagttttagattttacctttacatctttggtccaccttgagttgatttttgtatatggtgaaaggaaggggtctagtgtcactcttctgcatattagccatcagtatttaagtcttctagctgaggacccaggcattgtggagcagagataagccattcctactgagccctatccaaaattcccgatcctcaaaatgtgtgagaataaaagtgattgttttttgctactgagttttctaatttgttacagagccacaaatgaccagaacacatgtacacttagatgtaaacatttgcaggaagagtatttggcattcattgggctacatctgttaatacctgtaatgttgctcttctcttggcttcttatacaatgtgttccattcttcattgatcagttagtctctactttgtaaacttcagcaaaacctacctagttaaaatgaacaatacatcttccagagaggcctcaggaactactgatgtgtgcaaagacctgcttccctgagaatgccctcaacatagcactgacagctctctgaattcccggtgaagtgcagcaggctaaaccatgtatgggcctgaatcaactaggacttttatttgcacaggtaagaggggatgccctagtgggccagggactggaatgttgtgagagggcttctccatcagccacaaccttcagcctgtacctcaaatcaaatgacctcccagttacccagagagagaccagaagtctcaccagtaagtacacaggagtctctgagggtgcaaagaataatgtcattccagaaatatttactaagtagccactgcatcctaaaaggatgatgtagggacttcagagtaggaaaataaccatgtaaacatgcagttaccatgtggtgagtactatagcagacataagcacaccaacttcccactgctcatggcccctctcgctacaccaacgtctcatccgtcacctttgctttcattccttgtcctgtcctcagacctccctttccagttttagtgcaaacacctcatcactttcccttgatgtttcttaaagggaacctagttgtccaccagcccaagaatgccttgggggttttgttaatattgcagacccctggctcgctccagactcactgagtcaaaatcaccagtggtgggatccagggtttgaatttttgtaaatgtcccctgctgattcttatgcatctattcttgtcttccccactctagtctctgctatccgattcactcttcttgtgaacactagattaatttttcagagcttgactctgataatatcactcccttgccaccttaaaatgggttaccagtgcctagcaggctttttgctctatatcccagtactcaaaactttttccaatctggcctcaacctacttcctagtcatgtcaccaataacccacatagagctagttgtatgacatacagcttgcttctgccaaatcgtatccccctccaccccctacttcccaaacatagccaggacttcccaccagctgcctgcctgaagggaagtttttcaagttagcctgacactctgaataccttcagctcttctgtggcagctggtaaaaattctccttagtacctagttcaaaggtaagatctcccataatatcatcatatctggaagttctctttcccttctctgtagcaccttgtcttaaacattctcatagtatctctcacatctctccttgtaataacaatatcattacttacctagtcccactcaccccctaaaagtattcaaatatgtgtatatatacatgtgtgtgcatgagtgtgtacacacactgagttaaattttaagtcaaatttatatatatacacacacacatatattacatattacatatacatgttgccagcttaaaatgggttaccagtgctcaaaactttttacatatatataaataaatatatatataactttattttattttagatccatggggtacatgtgcatgtttgtcacaagagaatataaggtactggtggagactgggcttctagtgtacccattacccaaacagtgaaaactatctgataagttatttttcaatcatcagcctccttccatccttcccttttttggagttttcagtgtctattacttccatctttttttaaaattacttcatctttgttaaagagtatactggccacttacatatattgtggccttttcaaaatttgctgaaatctgtaattctacaatataaatttatttcataatttctaaatactttgtagaaggttgcaatcatatttaaaatttttcatcagagtattctatttagtaattgttttgctatgaatacagacaaaatcatgaagtgctattaaaatcaagtggtcactttgttggagtggagagattctgaagtgttataaatcttatacattttataattattttattgacaaagaccaataaataagctgctactgagtaatataaaagttactttgcaccaaagggaatacattaaatatatattttgagttacctttgctcagatcctaaatcagtgaccctcattaaggaaccactgtgtgttgggacttctagtgtgccccggcttcatgcgtcacatcctaaaatgaaggtcactcagggtggaggggcctttaggatcatcacaactttccctttctcacaccctcaacccatatctgcctccctgggaggacaggctttgcagtgacatctctatcattactagttgggcatcattacctcactgtactgagccccattcccttattatgaggataaaaatagtgtcaccagctttctaaggttactgtgaggattgtgcagaaaaataggaaatctataaatgttgcctgttttattacaacaattccaatgtgtgggacctttatcagaaaacttagagaaacagaagacgccttacttccagagactggtaaaataggctgtgtctgtttttacaggttccagaatttctcctacctcaaatccccctatcagcctccaatcccctgaaagctggcagtgactcagatgagcctgtcagtctggaatcaatggttcatttctgctgtaaaagggacattggaagagagcactatgcctcactggtcatttgactgaatttatcagctcttttcctgagagcaaaagtgggagaattagactcgggtgggcctgcggcagagagtaaaaaagcagggatggactggaggtgaggagtcctaacaaatatgtttatcctactcaacattacctaaaaactagatatagccacacaaggaaggagaaaaacatctcttctgtgtgcatctttgcgatggatttagaggcaatgtataggaaggcattattgcctgggggttatgaacagaagctctggtaccagactgcctgctttcaaatcctggcactggcactccctagctctgtgatctttggcagattatgacacttgtgcctcgatacccttatctgctaaatcggggagcacaataattaaagttttccttagggttctggtgagatttaaataagatgacacatgtcatatacacttgcagtagtgcctggccacaaagtttcaataaatatggagagagagagagagagacagagagaaagaaagagatcacaaaatcggatcatactatactttaactttttatacttaatttagtgtgatttataatttataatctaagtagagataacccaaaatacatatttaatgtattccccttggtgcaaaataacatctgcttctctgtatccctacttattttatttatttattttgttttttgagacagggccttgctctgtcacccaggctggactgcaatggcgctgtcagacctcactgggaccacagtagctgggaccacaggtgtgtaccaccatgcccaactaatttttttgatttttagtagagacgaggtctcgctacattgcccaggctgctctacacttctgggctcaagtgatcctccctcctcaccctctcaaaatgctggggttacaggcatgagccactgcacccggccttatacttttcatatcttatttaatatagcaagttaacgtaatatttatatgtaaccctacactcttgtgaagaaaatatgcagaaaatatttctggaataaaaatgtatacatgcttctgcatcttcacgttacattacatttaaatcttcatcatattttaatagctgcataatgttgcatggtatgaatgcatttttctattcataaagagttccttatagggaaacataagatgtttttagctgatatggcttggctatgtctccatccaaatcttatcttgaattgtagttcccgtaatccctacgtgtcatgagagggacccggtgggaggtaatttaatcataggggtggttatcctcatgctattctgctaatagtgagtgagttctcatgagagttgagggttttatgaggggcttttcccctattgctcggcagttctttccttgctgccgccatgtgaagaagaacgtgtttgcttctctttctgccatgactgttaagtttcctgaggcctccccaaccatgctgaactgtgagtcaattaaacttctttcctttataaattacccagtctcaggtatgtctttattagcagcatgagaacagactaatatactagcattatcaaaaatgttgcaattaacaactttgtggtctagttttgcatgcaaatgcaaatagatccgtgggataaaatcatagaaacaaaattactgactcaatgtttatgcacgtctctaattggaggaatattgcctaagtgcagatgttttcgtcttttgcctattttctactgactggttttcctttttgtaatgatttataaagacctttgtctattacaaaattatataacttctgtcatatttgtgacacatttttctccaactttctcatttgctttttatttatacattttgttgtgcagatatttttaggcactgaaatgtacaaatcagtttctttttggttctgggtttctgacaagctaagaaaggatttccccattactagattataaaagaaaaagaaaaacaccgccatgatttttaaaatagttctatggtttcatcttttaaaatttaggttaagccatatggaatcgtaaaaataagtgattttagcctacaaaatgtcagttgcagacaaatgtatttaaacctttggtctgcttgaaatcgcatgtgtttgtgtttgtgtgtatgtgtgcatgtgtttggggtgtctgtgtgtgctgtgtgaaatacaaagacatgaggtaataagtcagctcctttcctctgcttccctatccaagagtctccaaatgatgacatgaatattctcatctcttacatatgtgggcctattttgaactacatattccaccctgagtatatatatgtctaaattactatggttggcaagtatattccaatatctaatagaattaggtttccctcataactcttcttttgtagacttttttctatataccatataatgtttatttttctgaattaatataattatttctaacaattcaaattttttaaaagtcttgctcaagagtgcaattttagcttaatttgttatctgacatctttattgtgagttttcttgtccaggaacaagttatgtctttcaatttagtccaagtcctcttctatatattcctcaaaagactgtgtcagatttttcctcatataatttctccgcatttgatatcttccaccttcttaaattctcttgctgttttttaacagcttttcagttaattcctttatgtcttccagtcatacattgataatatatgtaactaatgataggtttgccataccacttctaattatttttgttatttatttgtacccaattatattggctggtatgtgactactgactttggtgggaatgttcttaaaacttagcactgatgctggctatatacaaacatactctcatacacacacacacacacacacacacacaccactatgaagattttatacaaatcagaattaagtgcaaatttcatagaacttattttgcatttggatgggtacagagtttcttctttgggttattactaagataaattatattaatataattcataatattgaattatccctacattcctagaagactcccccatttggtaacacattactgtattaacaaactgctaagtctattctaggtcacagaaaataattgcagctctatgttgtcttcttcagccctgattctctgatgttcttcagaaagaaaatcggtctgtattagaacattctccacatctacaatggcttcccatgggccaagtcatatctttgtaaagggttattttgggaccatttcgcttatctttagagaagtccatatcctaactgagcttcagagtggtatgtatcagtctttgatgtctttcacttgatctgatccaattatcactattatttgacagatagagatactcctatcctaaagatttgggtaggagtatgattattttcaagtttaccaatgttgaattttttccacaatttttgcattcctttttgttgcttttgataagtctcagggaaaaataaaaacatccttccttatcatcttttaccagaactcctacaccattattccaagggctagctgctgctcctttgaatggctgtacttaaattatctaaccaatatcccatttttagatatttaggttatgccaaattttcactgtgatacatatcactgaaaagaaagaacattttaaaagaccaatattggagaaaatcaaattcacacaaaatagtgactagtagaaaagcaaaggatgcctgtagaataatgaaaaaactaatgaaaaagagctgcttttgtggggtgagttgctcaggcagaaaggaacagaaagggaactaaatctctttagcaacttcctcttatttaatctcttctctttccccttcccacatcctctcttgtagagggtctgctgtggcaatattgctgtgtgagattaggacacctctctctgatgtgtaaggtgcaagctagattgtggtggcaggcagcattatgtgtttccattctcttgagttctcacttattggaaaatccaggatagccattagtaatcacagaaatggttttaaaaccattgtccggaagaaattccttttctgccacatggaactcaactactataaattatgattttgggaatactacattgatttaagtaagagggacagtcaccttgaatcaaagaaccaactcttacattgggcttgtaaatgtttttctgtttaagaataataatagcaggatttaactggacacttatcttagacatagatgccgtaaaatttcaagactgcttcacctttatcacttgtctgtctgaagaacctagagatttacacagtctagctgacattcaagttctttaacttctcacccccagctgcttcatcagatacagatgtctcaaatcagacttaggactaaggtgggcagcagtgaataaaacataaatgtcaacaacaaaacccacaagaaaatttaaaataactttcttgttgagggtctgtactgggcattaaggataaagaagtatcttatataatctgtgccttgaagaagcttacaccgtgctgggctaaatagagatgacaattttcaagattgaaatgatcagtgatacaatgtcacacagaaaggcaagaactattctattaaaagttctttggtctggattttttctgtgtgtgcttttactccctgagtagatggacagccaatgagagtcctgatcagtagctaactaggttctaggacaagcaatgtcaagaatagacttgcagaagaaaaaagaatcctctcagcaggtcaagctgcccctacattatggataggaagggttggggaggagggatgtgtgggatgtcagacttgccagaggagctcttttgaaactcactgtccaggcttcctcgctttgcagttctggtgaacattagaagggagaaggaaaggcaggcacattttgaagtcttctaggtaattaactttctttcctcttcaccctgcatccaaaagaggctggtagggacaccctgcaaaggcccatccaggtgggtccctgggagggcacccagcactaagggcaccttttgaaaaataagccaggcttaaccctctacagccacataacaagcaagaaatcaggaaagccaagagttttaaatgcttgtattctttttctcttttttttttcaacagagacttgttctgttgtctaggctggagttcagaggcatgatcttggctcactgcaacctctacctccctggttcaagcaaccccaccacgcccggatcatttttgtgtttttagtagagacgggattttaccacattggccaggctggtctcaaactcctgacctcaggtaatccactcattttgggctcccaaagtgctgggattacaggagtgagccaccatgcctggccaaatgctgtattctaatccttccttttagtggcgataatgggtatttgttagccatttcatgggattatgtaatcatgaaatatactattattagttttgattatctgagaaaggctactagtaatctcagaaaaccattttctaccatgaaatttaatataaatattctttattttaaagtcttattttttatggtggctttaagtaaaaacctgttagtgtgaaaactcttcatcttctcatcagaaaatcaatcataaaaatgagttttggtaataaatggatctaaaccggtagaagtgcaggtcagaagttacaatgttaaaggtacaaaaatagaaccatatgggaacttttttctaaaaagtctgcagtcaacatttcatccatcaattcatatcaccattaatatttggaagctttgagtcaagcaagaatcacatgtgcatgtgaccagccctaagggactcccctttagagaggcagcaaaggcccggcataaccatctagcatggctctcttaattaatatgaattgcagttacccacttgaaacattaatgcaaaatgaaactactactttagcaaaccttagctggatccattttttcaatacacattctttcatattccaccagtttgctgtttgaacctactgtctcaatatataaaagcatacttcactcagcagaggaaccagaaccaatttgtccctaaacatttctttttttttttttttttttaaagacagggtctcattctatcacccaggctagggcacctagtggtgccaccatagctcactgtaacctcgaaccctaggctcaagcaaccctcttgcctcagtctcaggagtagctgggactacaggtgcatgccaccacacctgactaattattattattattattattattattttgtagagatgggatctcactctgttaccaggcctcaagacatcctcccaccttggccttccaaaagtgctgggattacaggtgtgagctactgtgcccagctaaaaaaaattatgtcttattactataactttgtaaactgtgttcatctgaatgaaatagtcacctgaggcataacaaaatataatcttagattataacaacacatttaaattaagacatgtatgagagaaaatccatttttttttctggaatattccacataggtcatagcatactacctaattttttatgttaaatgttttattttaccatgtcaaaaagacaaaaactattattattatattattcttataattacaaatgtaatttatatttaccaaaaaactacaagcttcccatagtttctacaattattactttaaaaaaaagtcctgtatggtttcttgttgccaagtgcaaaataatagtcttatctttgtgggtgtggttctggctttcctaacttgtctgtcactgatcactaataaacatcctttgtcccatctaaactgagttataggatgtgtcccaatttaccttaaggtttcccacctccactccattgcttatgctagttctctgcctgccaatggacaatctaattcacttttcctttgaaactcgtctcacatactaattcattaaaaatatcaagttctggctttgttctttttgcttaagattgctttgactatttgggctcttttttggttccacagaaattttagaatagtttttttctaattctgtgaaaaatgtcattggtagtctgacaagaatagcattgaatctctcaattgctttgggcagtatggccatttttacgatgttgattctttcaatctatgagtatgaaatgtttttccatttatttatgttgtctctgatttctttcagcagtgtcttgtaattctccttttagagatctttaacctctttgggtaggtgcattcctgggtatttcattttctttgtggctattgtgagtgggattgtgttgtttatttcactctcagcccagatgttgttggtgtacagaaatgctactgaagaacaaagccggagttatcacactacccatctttaaactatactatacagccacagtaaccaaaacagcatgttattggtacaaaaacagacacatagactgatggaacagaatagaaaatttagaaataaagccacacacctacaaccatctgatcttcaacaaggctaacaaaaacaagcaatgggaaaaggacttcctattcaataaatggtgctgggataactggctagccctaggctgaagattgaaacaggacccctacctttcaccatatacaaaaattaactcaaaatatattaaagatttaaatgtaagacctcaaaatgtaaaaatcctggaagacaacctaggaaatattcttctcaacattggtgctggaaaagaatttttggctcagttcccaaaagcaattgcaacaaaaccaaaaattgacaggtgggaactaatcaaactaaagagtttctgcacagcaaaagaatctatcaacagagcaaacaggcatcctacagaataagagcagacattcacaaactgtgcatctgagaaatgcctaatatccagaatctatagggaacttaaatcaacagcaaaaaaataaaataaaataaacaaaaaaccccattaaaaaatgggcaaaaatcatgaacagacacttctctaaagaagatgcacatgtagccaacaagtatataagaaatgctcaacatcattaatcatcagaaaaatgcaaatcaaaagcataatgagataccatctcacactagtcagaatggatcttattaaaaactcaaaaacaacagatgcttgccaggctccagagaaaagggaatgcttatacactgctggtaggaatgtaaattagtccagccactttggaaagcagtttggagatttctcaaagaacttaaaacaaatctaccattcgacccagaaatcttattactgggtgtatgctgggtatatactgggtattttttgcatatactgggtatatgcaaaaaataaataaatatatcactctaccaaaaagacacatgcactcataggttccttgctgtaccattcacaataacagagacatggaatcaattctggtgtccatcagtggtagactggatggagaaaatgtagtacatatacaccatggaattctatgcagccataaaaacaatgaaatcatgtcctttgcagcaacatggatggagctggaggccataatccctaagcaaattaacacaggaatagaaaaccaaatactgcatgttttcacttataagtgggaactaagcattgaaaacacatggacataaatttgggaacaatagacactatagactactagaaggtggagggaggaagtgagttaaaaaactgtccatggggtactatgttcactgccagggtgatgggatctgtactccaaacctcagcatcacacaatattgccatgtaacaaatctgcacaggtaccctctgtatctaaaataaaagtataaaagaaaatcaaagtccttcacttgataatatcctctccaccttcactcacagatgagagggcagagaatttattagtgcctctcttccggattatccatcatatcacaccttatataatcatctgtgtatttattaagtgaactggcatgtcttcatgggcccagtgtgagtgagtgtgggtgtgggtgtgagtgtgccctgcaatgcaacagcagcctggctggggcagttcccacctgagctcctggggtgggctctgaccacccgcaaccctgaactagaatatgtaggtatttatctttcttaaatgtatgtacaactcatttatttcaatgtttaatatgagaagtattttggtctttatttagaagtttggtgaaacttttgcaaccagaaatatgccacaggagcttgactcctgtttatatcaattaacttgtggtcaaatgggtttccttataagtcatctcacttgaagttacagtttgcagtttccaagaatctattgatagcattcaatgaggacttgtaccataaagaaaattatactacaatgaaatgtgttatgaaatgacatagcttgggctgggcacggtggcttatgcctgtaatcccagcactttgggaggctgaggtgggcggatcacgaggtcagtagattgagaccatcctggctaacatggtgaaaccccatctcaactaaaactacaaaaaaattagggtgtggtgacgggtgcctgtagtcccagctattcggaaggctgaggcaggagaatggcgtgaatccgggaggcagagcttatagtgagctgagattgtgccactgcactccagcctgggtgacagagtgagactcctttaaaaaaaaaaatgacatagcttgaagacatagaggacggaaaacattcaaggactctatagttgtgatctcagtgcattgagaaatgccaggttgagtctaagagagacttgaggtcagacagactgtgatttttaatgttgatggtgccatttgtaaaccatgtggccttgaccaatttactatatttagagtttggggcctttattttctcatttattaaacagagatagaaatgcctacttacagggttgtgaaaatcgtatgagatcattaagtagagcacctagatatgttcgcagcatgttagtaacatgggcctccacaaacaagagctctttaatcactaaggtctggaaaaaaccatagtgagcagaacccacccaccttctcattaacttctttttaccaatgttttagatgaggacaagattcttcccccaccccctgcctccgccccatcccattctgctcaattttcattttctttgtttctggaaaggcttcagtagctggagggaggagtcattgtcaggtgcacaaagtcaagggaagaggtgaagtcccataaagtctactggtcttgccattctgtgtgggacagggatcactgtaaggaatagtcataagactgattttttagtttgaaaccaaatcatacaaagaatggacaggggacataagagtgttgacctgtaagagaggaacgctgaggagaccagcatcacctcatgtgcaggaacagccagacaaggtcccctgaggcccaatgggataaaactaggacacatgaatgaagttacaaagagacatatttctgttcagtatacataaagaactgggttttggatgtttgctctatccaaagatggacagggaagtggttctaaaaggtcagattatattacctttaggaggtattctaaacttaatatccaatgaatctatgaaatcttcaagaaattttattttgatgctacacaagacccagcttataggaaacagggtgaattattttaaattacagaattgtgtcccatatttatcgtaaactatctaaaaacaattcattaaaataaatacgtcccttgatgtcacatctccctccagctaccatcagtttcccaactctcttgtacaaaaaactcttccaaggaatttctactgagtcagtctccacctcctcaactctcagtctctcctgagcctaagccaatcagactttcatcctcatgattttaaagaaaacattcttatcaattcccagtctctcctgagcctaggccaatcagactttcatctccactattttaatgaaaacattcttatcaatgccacaccttcaccgtaccacattccaagcttcattttcagttctcatatgacatgacctttcagcacattaccattgctagtttacaccctcattcttaaaactccaatagcctggatgcccagccatcctcttctcctgtttttggcttgttatttaccatactgctgctccttttcaggttcctttgcggtctcctgtcttttgttctgaactaaaaatactggggaggaccaagtgaacaatgatcacttctacattcttccttcagtaaatctcatctggataaatgtcatctttatgctcccaaatcataaacacatatcctcacccttgaactctcttctgagccccagcctgttcaataaaactgatttctcaacatctccactggatgtgaacttttcaaggcacaactgcttgatttcacacatcatcatccaagctccagatacactggttcaatttattgcaagaacctttatgtttgttatttactcagcctggaatgccttccccgctttcaaggctctgtccttctcatgcaggtctcagatgcaacatcaactcgttagcatgcttttgctgacacccctatctcaagtaggattgtagaagtttattaaatagtaggtgaatgaataaatgagcaatctggtttttttaatcgtaatacttaaaaatgttgccactagctattccaaactgccttgccagaaactatatattctttcccgaatttggaaacactgaaacagaaatctgttaacagagctgttgtgggaaaatgcaattggctctacatctgcccctagtgggaactctggaaactttacagcagcagccaatctagagtttaggctctgacaaagcagtaaacttcaaggtcacacagctgcctcacctgtacgatgcggctgttgggtctatgttctctaaggtctagtcccactctgaaattctatgctattatgtttcaaatattctatatcctgaatagctaaatggggaccttgtccttacatctgcttgtacatagaatgagaagagagatggagctagctgccctgatcaggccatcacagtggagaactgagggctcgaaccaaggggttgattctacatatttctttctgattccttgcacttctatcccaaaagagtgtgcctggcaaaaagggcaatctaaaaaaaaaaaaaaaaaaaaaaaaaaaaagcctcttgtgatctgtgtccctgggtggaacttagagaagaacaattgtcagtatttactttaaggccaattttacattatgaggtattttttgaccattttcttgttttaaaaagttatgattacagttttttgtttgtttgtttttttttttttttgagatgacgtctcactgtgttgcccaggcgatctcagctcactgaaaccttcacctcccagaggagttcaagagatgctcatgcctgagcatcctgagtagctgggattacaggggtgtgccaccatgcccagctaatttttgtagttttagtagagacagggtttcaccatgttggccatgctggtcttgaactcttgacctcgagtgatccgcccgccttggcctcccaaagtgctgggattacaggagtgagccagtgtgcccggccaagttatcattatagttttaacttttttattattattcttatttcttgaagctttccactatgcatggtgactgggagtgttcactgctaactttcaaggtaagtattgtacgtaagcagaatgaaaggaaaaggtatgggaagcatgatatgtaaaggatttatatcttgttaacgatggtattcacaaaacaacatgtttaaaaattaattgaaaagagatctttcttcttatcatcttcccttcctgttgaatttgacagtcaaatacatttggcattacagactttcgaacttaccagagcagttggtttatttcacaaaggactggtcctctctaaaggcacagacaaaggcacaagcaaaaactgctcatcctctgtgccaggaacatgagggcctccatatgtctggggaaaatgtgggcactaaattggtagacaaaataaaattcaataagatcactcttaccctcttctccaatcataggtatttctctaatagcataaaaaatttttgttaaattgatatgaagtggtagatttcatttacacacacttgctctgggaggctctagatattttagtaaaccaacagacatttgatttttgagcaacatgttttcccattgagcatatggagagaaatttatttttaaacattaaatagacgtgcatcttacagtaactaaaactacctaaagcactttcctgtttgcctcaaactttcttttttcttagatacagtgtctcactctagtttccgaggctggagggcagtgacatgatcagggctcactgcagcctcgaccttgtgggttcaagtgatccttctaccacctcagcctcctgagtagctgggactacagatgtgcaccaccatgtctgattaatttttttatttttattttttgtggaaatggcatctcactatgttccccaggctggtcttgaactcttggcctcaagtgatcctcatgccttggcctcctatagtttggcaagtacaagataaacggctgttgaattggatttaattcagcagccagatatctgctgtgttcagaatgagtgagcacaaactccagagaccatgtgactattatacaattatagactgcatgtccactgaagaaacagctacttgtaatgaattctttcttttgttgtagctattatgaatatatttataaggaaaaatccctaaaatacatgcttaaatatgtagtatatattatagtcaagcgatgtttttcttctctagaaaatctccctttttctttcgctatagcaactatggtagtgagtattatttactttttatatcatgatgatttttataaatacatacatattttcatttttctaagactaggaattgatccacgagctccatctaatttagtatcagtatcactgcattgatgaagtggtaacgaaggcaccatcccttattacatttaaacgaggtaagaaaaaggaaatatttcctgggccttagggagaaaaaagctcaggctcagatatacagattcagaaactgatatggtttggctgtgtccccacccaaatctaatcttgaattatagctcccgtgattcccatgtgttgtaggagggacccggtgggaggtaattgaatcatggggtcgggcctttcctgcgctattctcatgatagtgaacaagtctcacgagatctgatggttttataaaggggagtttccctgcacaagctctcttatcttgcctgctgccatgtgagacgtgtcttccaccttccaccattattgtgaggcctccccagccacgtggaactgtgagcccgttaaacctctttcttttgtaaattgccctgtctagggtatgtctttatcagcagtgtgaaaactgactaatacagaaactgaatatacacattaaaatattaaaacaattcttctttaagtaatttaattaagtcacatttgccagtttttcataaactcaatggtctcttagcaatacttcccataatgaatcagcttcaagagtttcaaaatagcatcatgggaatgtggtgtcctcttcatttgcaaagttaaaagaaagtctgccatttgtagagtgcaagaagggacaatgtggcaattagtcatcacagttgatgaatctgaagaattcaaaattcttgaatctgggtaagtctggtctttgtatgcagaaacagaagcaggtaacatataaatatacattcaatatgtgatctatctgacagataatacaatagccaagaagagtattttatgatataattaacagtgttatttttcatctagctgtgcttccatgttaatccagatgttttgctgctgttcatctttgtcacagagagaagcctaataataacaaattcaagtgatgttattatctttcttaatagatcagaggcctcttctgagtcttatactgtaatcaaatagagaacaaacatctggatttaattttcacccttctcgtgagataataaacagcacagtccaaggaaatttactgtttctttaataatttcaatactacaaattcacaggagagaaaaattatcgttctgaatgtattaaaaacactaaatccagccccttgagtcctcaaatgatcaccaattttaaaatggacaagccactggctaataatgactacacaagcctgccaaggaaaacatcactgcaggctgctctagtaagtgcttggaatacagaggaagaatgctctttgtgcagtactatttggatctacttatctgatggcattaggttatcacacacccacagggctttccagaattcctcccacttcccgcccttgacatgctgagcagtcctacattggtgacactatcagatcaaagaactaaaaatgtctttggttcccaaaggaataacgacaaaagaacaataaatgcttggaattagtgctgtggacactctgtctacaagagccagatacatcagggttttttgcctaatttttagataaacatggataaattgtgaaaagttgaaagaggcttggtcaattcctttggtaagaatcccaaactactgactataaaactgctcattatgtaactaaaattctgctgcctttctatagtaagaattaaaatccattggccagattcatttgagtcaagtgtattcaagggtattattttctttacattgctatgtcttctattgtttacttatcctacaaaagcaatggcattatgaaatcatatacgtatcctatagcatagaaagtcagacacaaacactctaacaaggtgctacaagtcaatagatgaagatgaactacatgaaatgatatctggtaggtgaaatgtagaagatgaggtaactggagacacaagaactacctggaaggtaaaaggtacgacttgggttgaaccaaaaaataatgtgagacctgaagagattcagtaaattctataaaatgtctcccctttagtgccaacaagagccagcaaagtccagtaatactcatcaggactgacgactccattaaatgcagtagcagttgacaagccctatgacttcacatatagtatgtaacaaaggcgaacagtttaacaggaggatagctctgatacggcacaaacctcagaagaggtgacgaaacaaaacaacagatggcgagaggctaaggaacagttgccatgacccaggtgagaaggaactgagagtccaaacagatctcacctatgcatggctttcttttagacactggggtataaaatgtataatccaaacaatactttttactcaaatggctggtaaagggtgataattttttttaaaaagctcacaattttaaaattgttcctatttttttaaaaagcaaacagaaacctttctttttggcatcttctcctttgtcttacatagaaacttaagtgcagaattttaaggctgattacggatgagtagaagctatggtaacttttttcccttggggttgaagtatctgtttgctggcaaataatgcaaaaaagaaacaaatggatctgctgaaaatctacttctgtatttctctcttaactaatgacaatcatttagctccaattttcatgttcatgtttccctttcttcttggctttgcttcaggtctaaattttccttgatgttcagagaaacgaagagatgggaaagaattggggtcactggaggaaagttttcctctagatggctctttattttataaagaataaaagagatacagtcagaaaatttttcagtaattcagaatatgaatgtatgcactgtgaaattaaaaactcttacttaaatgaaactacggtaaaaatgatattttagtaaagaactaaatgtccagtgaaggtctgaacaaacagtttcatcttttctagatgggaaacatgctgtgattcttcccacgtatttacaatgtcttaaagttgcaagcttaaaatcagacaatctgggaagatcactttccaaatctaacaaaacagcaaaagaaacttctccctctgagaagtgaggaagctttgctcattcaaatggatatgggatatatgctaaatggtttacaccaagctagggagcagccattcaaatcaaaagcagaaacattggtagagttcaacagtgagtcaagtcaaatgcctaaaaataggaagcaaagcatttgataattactgggagacaagatttatatatgatgtgatcattgtcaaggccatgatcaatagtagacctggctaggcatagggttaatttaattgaagaaattgaggttcacctaatccatgggttaataaatatattttaggcaaaccaaagaagaaggaacaataggctgaggttgacatttaattggcaatgccatcgagatatctggtagggcaaaaaaggcaaatacaagacagcccagtgtcgcctacacaaggtgaggaaacttcgcagcaggattagaatgtggatgcctaacttttccaatatacaaagaacccaggcaggctgctatcctgctgaacaggtatgggtaaaaatgaagttcaggccataggcaggaggagcccttaaacacccacagaaaacacgacaaaccatcattgaaacgcttgcagaatcactagacttagcaatagttctgggaatctaaccggagttgcagtttgaatggaagttaagtgtcattgagaggactggttcctaagatgagatcccagcagtagatgaaatgagaacatctaaacaggagtgaggagaatgtccactcattactgattccatatactcagaagtaggctgtgtgtaaaaagtgacacctgcctttgaaattcatccccggggttcacctggccattctcatcttgcctacccacatgctgcttgtcctggatggtcttgcccctgggtctccactcattttgatccagtgcctgtgctcctttgatgccaaagtcaggagcttggagataagttacctaatgcatcttctgtactctcctctctgcctccatcccaatttcctcaaccctcagcttgagaaagacttggatattgatatgggttaagttgtgccacctccacccactgccaccaccaaattcatctgttgaagttctaacctccaggacttcagaatgtgaccttatttagagataaaagtctttcaagttcaagtaagctcattagggtgggccctaatctacgataactagtgtcctcagaaagaggggaaatttggacacagaaatacccataggaagaaaatatgaagaagagataggaagaagacagccatctacaaaccagggagagaggcttggaacagatccttccctcccaaccctcagaaggagtcaccctactgaaatcttgattttggacttctagcttctagaaccaagagacaatgcatttccattgttcaagccacccagttatggtactttaatatgaccatcctagcaaggtaacacaggtacatctgcacaaagtgaagaatgaaggtgatgttaattagtactttccacaggcccatgttactcaattcttcatttaaacaaaatgcctctgattatatgtgtttttgttattttcaatcctttctggaacaagtagggtataaatacagatttcttgtgatctgaaactagacccacagttgcttcctctttttattcatacctgttgagttttaagtagctactattcatagaaagaaggaaaaaagaaagaaaaaagggagagggagaggaaaaggagggagagacataacaaaaattgatgaaggtgtgtgtgtgcctttctgaggcagcaggaaagagaagttctcctgtaagagctggcttaaatggagaggtgccccttttgtggcatttcaaggaaagacaaacaagccatacccataaaatgaagaaaagaacaggaggagcatatatgagccagaccagggtggagaagcagcaccaggggtcaaccagggcagaggatctgtgaatttcagactcagatcactagcctgcaggtgaaataatcattgccaggaacatgagacaggactttagcttcttggggcccatttctttgaagatttctcccaacttctcactctcactcacagcacaagttgatgaggctgagcactgaggcagttgctgggtgattcaagcaacaggaaaattaactccagtatgcctatatattacatcagagttgagggagacttttttggcctccctccctgatttccacgccatattctgcaacataatgactaaatttggctttaacatatcacaggtggttattttgcaaaaatgagtttacacgattttaaacgaaaatgctatggactgttctgtccttagccccaggatgataagtctgatcaaaggaaatgaagccacatctcctgacataagtttcctttcagaacttcccatgcaagttgggggatgtggatgtgacaggagttattctgtttctgggttaggtagttctgggttaggtagtttggctgcatttgaagaaaatggttggagactttatttgaaaatattccatagtaatggaaaagttatgcaaattcatctccctattctatatctagaatacatatgtatatatgttctagaatatatagatatgtatatctatacatacatatatatgtggattatttaagcccaggaattcaagggttatataaactcatctctctatttattttatatacatatatagagagtatatatatatatagatatactatctatctatacatatatgtatatatagatagatatactatctatctatacatgcatgtatagatagatatactatctatatatacatatatgtatatgtatatagatatactttctatatagatataaatatgtatatctctatatctgtatctatatctgtatatatacatatgtatatctatatctagaacatatatatgtatgtatgttcatatatgtatgttcatatatgtatatatgttctagatataaaagagtgatgagtttgcataaattttccattactatggaatattttcagataaagtctccaaccctttatatgtgtgtgtgtgtgtgtgtatgtgtgtgtgtgtgtatgtagtggtattgggaagggattatcactttattctttatactgttctatgttggttgaattttaaggaacttgcattactatataatctgaggaaattaagctttatttatttatttctttttgagacagggtctcactctgtcacccaggctggagtgcagtagtgtgatcacagctcaccgcagccttgacctcctgggctcaggtgatcctcccatctcagcctcccaagtagctgggattacagggtgtgcaccacctcatctggctaatttttctattttttgtagcgataaggttttgccatgttgcccaggctggtcttgaatttctagactcaaacaatccacccactctggcctcccgaagtgctagaattacaggcatgagccactgtgcccatcccagctattttaattttggaaaaaagttatagaaatctatctaataatttttgggggcagggcacggtggctcatgcctatagtcctagtactttgggaagtcaaggcaggcggatcacttgagcctagaagtttgagaccagcctgggaaacatagtgaggcccccttcccactgtccctacaaaaaataaaaaataaaaaatagctgggtgtggtggtgtgtgcctgtagtcccagctactcgggaggctgaagtaggaggacagcttgagcccaggaggtaaagtctgcagtgactagagatcatgccactgcactcaaacagtgagaccctatctcacaaagaaagaaagaaagaaagaaagaaagaaagaaagaaagaaagaaagaaagaaagaaagaaagagagagagagagagagagagagagagagggagggagggagggagggagggagggagggagggaggaaagaaggaaggaaggaaggaaggaaggaaggaaggaaggaaggaaggaaggaaggagaaaggaaaaaattctattaatggttaatgccattaatagaattctaaaaaataacaactatattttataaagaatatctctgcttaaaatacagaaaccttactagttttccacttgaacttatttctcatctaaagaagcaatgatgaaatcttgtatcttccaggcatcacattttctacgttaaattattaaatagctaactaggaatgaagaaataaaaaatggaatcatgtttcccctcttaaatcagaaacaaaagctacttggtacttcaaaatactgattgtccttgagatgtaaagggagtgtctaatgttccacatcaataatctgacccacatcagaagctattttggataacaggaaatagttatctttatcaaacatataaaagttcacattaatatgtggctgattgtaaagcgaccctgccaagaagaaatgcattagagcatttcagtctggtgacctgtacttgaggctgagtcaacacttccatgatacaacttcatctttgaggcttcaataactgagccaattaaaaccaattccaggttaaaactccacacatagctttctgggcagaaaggctctttttatagaaacaattttacttttctaaatgcacatctttaaaggtatttttatagctgtgattaaggcttggtgtttttgctaatttaaaaaggtattttttttctttttcttggatgtgtatgtgttcattagagtattgcttggttttaaataaaataggcggagtatgttattcaagtagttcataccttcccaaagccaaagttaaaatattaagttcaggaaagtaataattaacaactattcttcctaaatgtcttggacatgaaaccagagccaatttcccctaggataatgtagagtatgttaacattacaaatctgtggtttaaataccctccatgttcacagtctgtggcttggcagtgcttggagagaaaaagccacagtttgttgtctgtaacccagtggccatctgtagtgtggcaagaaggggatctcattggcatttctgtcataatgtggcctagttcctaaaacctggcatgaggattaaagtgatgaagggccagggtccaagccggagatgaagcatagcagtacacagggagactctgggggctacccggcattagcccaggaaggacctaaaccagcttccaaagagtccactgccccctgtccagagcaactcactgcaaaattcttcaagggcaaaattgtggttacaacttgatcgtaactttacagttcctgaaggcccaggacatagctgtcagttgcagagttagaatcttacctttaacagtatctggaccacaggagatgctcaatttatatgtgtcataggaataaagtgtctactaaattgccactctgcattttaccaatagaagagcacacaaatgcaaagaagtgaatcaatcatatggcaaagttttcaaaagagagtgtcctggtttttctgagtttttttgtttgtttgtttgttttttgagacggagcctggctctgtcgcccaggctggaatgcagtggcacgatctcggctcactgcaagctccgcctcccgggttcacgccattctcctgcctcagcctcccaagtggctgggactacaggcgcccgccaccacgcccggctaaattttttttttatatatttttagtagagatggggtttcaccatgttagccaggatggtcttgatctcctgaccttgtgatccacctgccttggcctcccaaagtactgggattacaggcgtgagccaccgcgcccggcaaaaggaaaggcatgcctcggttctcttttttttttttttttttttttttgagacggcgtcttgctctgtcaccgaggctggagtgcagtggtgcaatctcgtctcactgcaagctccacctcccgggttcacgccattctcctgcctcagcccccccagtaggtgggactacaggcaccagccaccacgcctggctaattttttgtatttttagtagagacagggtttcaccatgttagccaggatggtttccatctcctgagcttttgatccacctgcctcagcctcccaaagtgctgggattacaggcgtgagccaccacacctggccgaatgtccttatttttttaaccaatagcctgatagttaaaatttactagttcatgtgactacagtgagtaaggaagtcctatagaaaagtgtttgcaagagcccttctgaagcaacagaaaaaaactgatgtcaagatttttttttttcatgtttgttggccaacatcacggatcattagagaaatgcaaatcaaaaacacaatgagatatcatctcatgccagtcagaatgctgattgttaaaaagtcaagaaacaacagatgctggcaaggctgtggagaaataggaacgcttttacactgttggtgggagtgtaaattagttcaccatgtggaagacagtgtggtgattcctcaaggaatcagaaataccatttgacccaacaatcccattactgggtatatacccaaaggatcctaaatcattctattatcaagatacatgcacacatatatttattgcagcactatttacaatagcaaagacataaaaccaacccagatgcccatcagtgatagactggataaagaaaatgtggtacatatacaccatggaatgctatacagccataaaaagaaatgagatcatgtcctttgcagggatatgaatgaagctggaagccatcatcctcagcaaactaacacaggaacagaaaaccaaacactgcctgttgtcactcataagtgggagctgaacaatgaaaacacacggacacagggagaggaacaacacacactggggcctgttgaggggtgaggggcaaggggagggaacctagatgatgggttaataggtacagaagaccaccatggcacatgtatccctacgtaaaaacctgcacattcggcacatgtatactggaacttaaaataaataaataaaaataaataaataataaaaaacattaaagtgatgaactaaagtgtgtgcgctctcttgcttgcttgctctctctcttcaaaggcacataatggacaaggtgaattcactaatatccattcagtaaatatttagtgactattcacctcattttgcaaagttgaaaaagatactggctatggcctcaatagctctaactatttataataagtgctctaattacaggtaaatgtagtgttcataattttatataaattaagcacacacaaaatattagttatgcttttcaactcagaagagagctaaaaaggccatgtttcttaatgaagtatatattttttatcacaagggaaaatgcttacaatttcataactctggagagggtcagacactctagaatccagtcctattttgccttaactaaatgcttgactttgtacccgtcaatctttaggaacctcagttacttgtctttaaaaattggagttagggcagggcacagtggctcacgcctataatgccagcactttgggaagccaaggcaggcagatcatgaggtcaggagatggagaccatcctggccaccacggtcaaacctcatctctactaaaaatacaaaaattagctgggtgtgatggcacacacctgtagtcccagtttctgagaagctgaggcaggagaatcacttgaacccagaaggcagaggttgcagtgagccaagatcgcgccactgcactccagcgtggtgacagagcgagactctgtggcaaaaaataaaaaaataaaaaaaaatcagagttagacaagctgattttgaaagatttttccagacccattccaagatggccaaataggaagagctccagtctgcagctcccagagtgatcgacacagaagacgggtgatttctgcatttccaactgaggtacctggttcctctcattgggactggttggacagcaggtgcagcccacggagggtgagctgacgaagcagggtggggcaccgcctcacctcggaagtgcaaggggttgggggatttccctttcttagccaagggaagccgtgatagactgtacctggaaaaacaggacactctcgcccaaatactgcacttttcccaaggtcttagcaaccagaagacaaggagattctctcctgaggctggctcagcaggtcccacactcacagagccttgctcactgctagtgcaccagtctgagattgaactgtgaggcagcagcctggctggaggaggagtgttcgccattgctgaggcttgactaggtaaacaaagtgactgggaagttcaaactgggtagagcccacacaggtcagcaagacctactgcctctgtagactccacctctgtgggcagggcatagctgaataaaaggcagcagacagcttctgcagacttaaatgtccctgtctaacagcactgaagacagcggtggttctcccagcacggcgtttgagctctgagaaaggacagactgtctcctcaagtgggtccctgacccccatgtagcctaactgggatacacctcccagtaggggccaacagacacctcatataggcaggtctatatggggatgaagtttccaggggaacgatcaggcagcagtatttgctcttctgcaatatttgctgttctccagcctctgctggtaaaacccaagcaaacagggtctggagtggacctccagcaaactccaacagacctgtagctgagggacctgactgttggaaggaaaactaacaaacagaaaggaacagcaccagcattaacaaaaaggacatctacagcaaaatcccatctgtaggtcaccaacatcaaagacaaaggtagataaaaccacaaagatggggagaaaccagagcagaaaacctgaaaattctaaacaccagagtgcctcttctcctccaaaggatcacagctcctcgccagcaatggaacaaagctggacagagaatgactttggcaagttaacagagtaggcttcagaaggttggtaataacaaacttctccaagctaaaggagcatgttcaaacccatcgcaaggaagctaaaaaccttgaaaaaagattagatgaatggctaactagaataaacagtgtagagatgaccttaaatgacctgaaggagctgaaaaccatggcatgagaacttcgagatgcatacacaagcttcaatagccgattcgatcaagtggaagaaagagtatcagtaattgaagatcaaattaatgaaattaagtgagaagacaaggctagagaaaaaaaagtaaaaagaaatgagcaaagcctacaaaaataggggactatgtgataagaccaaacctacgtttgattggtgtacctgaaagtgatggggagaatggaaccaagttggaaaacactcttcaggatattatccaggagaacttacccaacctagcaaggcaggccaacattcaaatacaggaagttcatagaacaccacaaagatactcctcgagaagagcaaccccaagatacataattgtcagattcagcaaggttgaaatgaaggaaaaatggtaagggcagccagagagataggtcgggttacccataaagggaagcccatcagactaacagtggatctctcagcagaaaccctaccagccagaagagagtgggggccaatattcaacattcttaaagaaaagaattttcaacccagaatttcatatccagccaaactaatcttcataagttaaggagaaataaaatccttcacagacaagcaaatgctgagagatttttgtcaccatcaggcctgccttacaagagctcatgaaggaagcactaaacatggaaagaaacaatcgctaccagccactgtaaaaacatgccaaattgtaaagaccattgatgctatgaagaaactgcatcagttagcaggcaaaataaccagctaacatcataatgacatgatcaaattcacacataacaatattaaccttaaatgtaaatgggctaaatgcctcaattaaaagatacagactcacaaattgtataaagagtcaagacccatcagtgtgctgtattcaggagacccatctcacgtgcagagacacacataggctcaaaataaagggatggaggaagatctaccaagcaaatggaaagcaaaaaaaaagcaggagttgcaatcctagttcctgataaaacagactttaaaccaacaaagatcaaaggagacaaagaaggtcattacataatggtaaagggatcaattcaacaagaagagctaactatcctaaatatatatgcacccaatacaggagcacccagattcataaagcaagtccttagagacctacaaagagacttagactcccacagaataataatgggagactttaacaccccactgtcaacattagacagatcaatgagacagaaggttaacaaggatatccaggaattgaactcagctctgcaccaaggagacctaatagacatctacagaactctccaccccaaatcaacagaatatacattcttctcagcactacatagcacttattctaaaattgaccacataattggaagtaaagcactcctcagcaaatgtaaaagaagagaaatcacaacaaactgtctctcagaccacagtgcaatcaaattagaactcaggattaagaaactcactcaaaacctcacaactacgtggaaactgaacaacctgctcctgaatgactgctgggtaaataacaaaatgaaggcagaaataaagatgttctttgaaatcaatgagaacaaagacacagcataccagaatctctgggacacatttaaagcagtgtgtagagggaaatttttagcactaaatgcccacagagaaagcaggaaagatctaaaatggacaccctaacatcacaattaaaagaactagagaaacaagagcaaataaattcaaaagcaagcagaaggcaagaaataactaagatcagagcagaactggaagagatagggaaacaaaaagcccttcaaaaaatcaatgaatctaacagctggttttttgaaaggatcaacaaaattgatagactgctagcaagactaataaataagaaaagagataagaatcaaacagatgcaataaaaaatgataaaggggatatcaccacagatcccacagaaatacaaactataatcagagaatactataaacacctctatgcaaataaactagaaaatctagaagaaatggataaattcctggacacatacatcctcccaagactaaatcaggaagaagctgaatccctgaatagaccaataacaggctctgaaattgaggcaataattaatggcctaccaaccaaaaaaagtccaggaccagaaatggattcgcagctgaattctaccagaagtacaaagaggagctggtaccattccttttgaaactattccagtcaatagaaaaagagtgaatcccccctaactcattttatgagtctgggatcatcctgataccaaagcctggcagagacacacagaaaaaagaattttagaccaatatccatgatgaaaatcgatgtgaaaatcctcagtaaaatactggcaaaccgaatccagcatcccatcaaaaagcttatccaccatgatcaagctggcttcacccctgggatgcaaggctgattgaacatatgcaaatcagtaaacgtaatccattatgtaaacagaaccaatgacaaaaaccacatgattatctcaatagatgcagaaaaggcctttgacaaaattcaacagtgcttcatgctaaaaaatctcaataaactaggtattgagggaacatatctcaaaataataagagctatttatgacaagcccacagccaatatcatactgaatgggcaaaaactggaagcattccctttgaaaaccggcacaagacaaggatgccctctctcaccactcctattcaacatagtgttggaagttctggccagggcactcactgaagagaaagaaacaaaggatattcaattaggaaaagaggaagtcaaattgtccctgtttgcagatgacatgattgtatatttagaaaaccccatcatctcagccccaaatctccttaagctgataagcaacttcagcagagtctcaggattacaaaatcaatgtgcaaaagtcacaagcattcctataaaccaacaacagacaaacagagagccaaatcataagtgaactcccattcccaattgctacaaagagaataaaatacctaggaatccaacttacaagggatgtgaaggacgtcttcaaggagaactacaaaccactgctcaacaatataaaagaggacacaaacaaatggaagaacattccatgctcatggataggtagaatcaatattgtgaaaatggccatactgcccaaggtaattaatagattcaatgctaccaatgactttctccacagaattgaaaaaaactactttaaagtttatatggaaccaaaatagagcccacattgccaagaaaatcctaagcaaaaagaacaaagctggaggcatcatgctacctgacttcaaactatactacaaggccacagtaaccaaagcagcatagtactggtaccaaaacagatatatagagcaatggaacagaacagagccctcagaaataacaccacacatctacaaccatctgatctttgacaaacctgacagaaacaagaaatggggaaaggatttcctatttaacaaatggtgctgggaaaactggctagccatagatagaaagctgaaactggatcccctccttacaccttatacaaaaattaattcaagatggattatagacttaaatgttagacttaaaaccacagaaaccctagaagaaagcctaggcaataccattcaggacataggcatgggcaaggacttcatgactaaaacaccaaaagcaatggcaacaaaagccaaaatagacaaatgggatctaattaaactaaagagcttctgcacggcaaaagaaactaccatcagagtgaacaggcaacctacagaatgggagaaaatttttgcaatctacccatctgacaaagggctaatatccagaatctacaaagaactcaaatttacaagaaaaaaacaaacaaccccatcaaaaagtgggcaaaggatataaacagacacttttcaaaagaagacatttatgcagccaacagacacatgaaaaaatgctcatcatcacttgtcatcagaaaaatgcaaataaaaaccacaaggagataccatctcacaccagtaagaatggcgattattaaaaagtcagaaaacaacagatgctggggaggatatggagaaataggaatgcttttacactgttggtgggagtgtaaattaattcaaccattgtggaagacaatgtggcgattcctcaaggatctagaactagaaataccatttgacccagcaattccattactgggtatatacccaaaggattataaatcatgctactataaggacacatgcacacgtatgtttattgcagcactattcacaatagcaaagacttggaacaaacccagatgtccatcaatgatagaccgaattaagaaaatgtggcacatatacaccatgaaatactatgtagtcataaaaaagatgagttcatgtcctttgcaggggcatggatgaagctggaaaccatcattctcagcaaactatcacaaagacagaaaaccaaataccaaatgttctcactcataggtgggaactgaacaatgagaacacttggagacgggggcaggggagaacatcacataccggggcctgtctgtgggggctggaggagggatagcattaggagaaatacctaatgtaaatgacaagttgatgggtgcagcaaactaacatggcacatgtatacctacgtataaacctgcacatgtaccctttattaaagtataataaaaaaagaaagatttttttccatcaaaattatgaaattgtataactctttcaggatcacaacatttcaaccattaagtgtcacctaggaagctattttaaaatgcatatctattcctgctagtgaagtttgctttttaaaaaatgcagatcattgtataggtaatgttaacttgtcaaagtaggatgtttaatattattagccgtcttccaaatatttataaatatttaatggagttttgtacaactattgttatcatcatattaaatgcataaagatgactccaagactcaatgttgtcttgaaactatttttttttaaagcacaaagtaacaggagaacaaaatatacaaaactttcaaatatatcagaaataacattccttctttgattattattatggtgctaagaattattgttttgaaaaggagccattttatcacacagttgagacatatttcataagaaacaaaaacataaaatcaaataaaagttgttagagtattatttgtacacatgcatttccagtctgattaaaacatcttttacattaatttgttattaaatttattaattatgcataggtgtttacctacaataattatatagtcaaagaagtgtcataccattagaacacaaaatgatctcagaatatctgactcttactcaagagtttggcaattctttctcaacaaagtgttttcacaccttttgacttttacagacacaagagcaaagcactctttaggaattttttacatcttcactgaataagacaaagtccagagacagaaattttcaccggtgtttttgtatgccatgtatcacatttcctactaattgttggaacagagaaattaaagacatataattagcatgaatgtatccagaaataagcaaagtaattactagtttctcatcatgattattcagtatgacttaaatgtttttggtgggaaacttgatattgaaataattaatattcaaaatgatctttccttgtaaagaaatgtaaaggcaagcttcacttcattaaataaccatgaaatcatctttataataagttattttgaacccggaaagataaagttgtaagtgatgggtgggctcccaggtcctctgtataagtaagccgtagacaggttgcctgacagtgctcaggagctagtgttgggccgggcacggtcactcacacctgtaatcccaacactttgggaggttgggcaggagcatcgcttgattccaggagttcaaggccaccctacacagcatagtgagacctcgtctctacaaaaattttttaaaaaattagccaggcatggtggcatatgcctgtcatcccagctacttgggaggctgaggtgggaggattgcttgagcccaggaggttgaggctgcagtgagctgtgattgcaccactgcactccagcctggatgacagagtgaggctctgtctcaaaacaaaacaacaacaacaacaaagctagtgttgattctggtcaagggagcattgagatgaggatgagagagtctcccttttataagattgattccagatacaatttgaaacagctaatggctctctttgatgttttacttccattcttcttatacttttctacctcttaattcctcttctgcaatgaccctaaagtcttcagggtcccaagtcctccaaattctgacctcctcccaggactagcttcatggtgtgtgacctgagtggttgcacagggtcctgcactctgatgggccctgcacacagttttatgccctgttgtgtattaattactcctaataactgtttattttgtgctggatcctgaaaataaggtagccaggcttgccgcctatccataatgatcatgtggtcattaacagctatgcaaaagaacaatcttgaaagaatatgcatgaatatatgaatactaagttacccctcaattctctcggagactgaagtccctcaaatatctacttaggaactcggtttgccacttaaccactctagaactctgttatttcatctgcaaaataagaacagcaaattatgaactataagttccttcccatctaaacaaccacaccagcctatagggacttgtgctttttaaagggaaggtgtttttgcagagtaaaagatgacatgaaaataatttagaccatccagtagagtgctaccctggttaatttccttaattatatgtgtttgtttttgtagaagttttagtttttcaactattcattaaataaatacttacccatagtatctaccactcagtttttaaatttctccaattattatgtcactctcatagaccacagctccatgaggaaacaaagtctgtaagttacgtttacatttgctttcagaagacttgagcacagtagattcccaacaaatatttgttaaatgcatgaatgtatgattgaataaactaagtgcctactaaatgtcagctgaaaaaaatatgagtacctacttgtgcttagtactggatatccgaagttgaataagacaagatgcctactttcaaggttctaatacactaatggggacagagcttcttgcataaacccttacagactaatgcaaccaacaccttaatagaaacatgttcaaagtagagtacaaacgaggaatcctctcactctggctggtggtattaggaaaggcttcacagaggaggcaggatttgagctgagtcttgaaacttgagaaaggcaaaaggtaaaaagaacatgtaaggcagggaaatgagactgagattggcttgaaggaatctagaaattgttcgggggattgcaacaccatagtttatagaggctgagtagaaatgaaaaaaggaaggttaatcgaagtcaggcaatggacacccttccaaccataatgagtttatctggaaggttatagtgagtccttgcaagcttctaagcagggaagaagacaatggatgtcactgctgttgtgttttgaaagatctttcttattacaatattgggatgtggtctagttgaattcctacgtttctggatgtattgtaagaattccacttttttctgttgaatagtagagcaaggaatgctcatatcagccaaaattggataaaatgaaaataatctgtgagaagccccagaaaagtaaaggagctgaaaaagcaggccatgaatacggaatcagtgtaattcttggcaagatgaacgcagtggctcataacttataacaacaacaacatataacaaatacaacatcaacaaataacaacgacaacaacaaagaacaccaagataggtcctgagaatctcaaaattcttcccaagtcagtaaacaagtcaacagtagaataaagaagagcagatgaaaggaactcaaagtgccagtgacacatgtgaggagaaaggaagcaaatgaatggaaggcaattgcataattctaggtaaataacttttttaatgtgggtggagaccactgtttactaaatatgaaagattaatatcagcagaggaaggaattgtttgtttttaatccaagaggtcattgtgaacaataaaaaacaaaaaagaacataagttaccacagaaaccatttgttgaatacttaacaaatttcacgatatcaaaataattcaaaattgtacatggataatttgaaactgaatctgtctggggcagtcaccaacttctttgagatgtttccatgtatttatttgagaagaaacaaatagaaaattatcattgtctatcctcagcattatgggaaggctgcatatattcttatacagtaaattctcaactatttaaaataaattactacttatgattaactgaatacttatgattaacactgaatacttatgattaacaattgcttaattaaactacagactgtcatacaaagatcagaaactaggtatttaggtgtgagaatcacacacacacacacacacacacacaaagtgtaatatcctcattagccccaatctgaaagaatataaaagagaataataataacctgggatgtgaattgtttttctaagtttcttaagatatatgagggatttgtcacatgaaactgaaagtctggttcccccctttataagtacatattaccttaaattatacattcatggaactctaaacttcatgggctctggcgtggtcttcactcctcttacagagaccacgccaaggcctcagctctgatccaacataaacagggtcacacagccaccagcacagtggctaacagagtttttccagatgcagatgcaatttccccaattcaattgccttacttttggggagggttccatccaggttttcatggagaggaaatcccagagtttacaatgttccagacaatccagcacctgtagtgccatactttctcttttcttttcataaatttgagccctggcagagctaattaaacaatgatgaaagcaaggaaaatagacatttctgactccataaagaacttccccaaaacacaagcaggaataatactagtttagttacatagcaaagatctagagaaataatgtcaaggggtgaaagtggagacgtctaaggggagggttgcccaaggaaagaaggcactgagaggcggggcagtgacacacaagtgtccaagatggtaccgacaggagaatttctcaagggtcattgtcagctcatagcacggtccccaactcaacaagagagggaggctgattgagggagggcctgaaagaagagacgtcttactctgaggacttatgtctaaatgggctctacataaggtatagaattatatttaacgtgttcttaaagaattgctcctaaccagtgaatttctgagcatcttgaacctccttgtgggcaatgcacaaagccattctttatttttccagaaatgattttaaatgataggcaggcacacgcgcaccggctcagacctgatatttatatataaaatgcacatactctttttatatattatgaacatgtagaaacatgtacatgtaaagaaaattaacaacattaacacagttgatcactccctccttgaactcattctttgtttggctttcagaccttccttttgtcttttttcttcctaccacacaggctgcagcttcttagtctcatatgtgggactctcctcattccccacttccctcagtgttgagtgcccatttcacaaacctcttttcttcttatctgtccgggctccctgggtggtgccaaccaatctcacagctttaaacactatctctgtgctgacaacgtccaaatgttttctcctgctgtgtctcctccattgatctctacagttacatacatatactcaactcctttcctggaaatctaccaggtatctaaaatgtaacatatccaaaataaggtctcagttttcctcctcaatgctgttccacacaacagtttttctttatttcaaaactaaaagtgagaggaccaagtttaatttttttctcttatacaccaaaccgaattcatcaacacattgttttagtcttaccttcaaaatatatctagaatattaccacctctctccccatccaccgttcaacccatcatctgtctcttgacttgtcaaaaataacctctattccggcctcccagcttcccccattgaaaataaatataatattaactatttatattatatgcacttaacaaatacttatgaagtgtccatattatgaaatgcactatgctagacaatatgtagggcactgatgtgagtttgacccaattcctgtcctcaaagtttttatattctgggtgaataggttagatacatacacacaacccaatacaaagcaacagaagataattgtcatattgtgctataaagagctagaggggtttagaggaaggagaggaaatttctgattgtattggcaataaagcctttgctgaggaggttgcattgaaggtgggccttgaagataagtcaggttttaggaacagtgacttgagctcattccagaaggtgccccagaaggagatgaaagagtcaggacatcttccgagcatggaaagtagtaacatttggctgacataggtggatatatagaggagctagaggaaaaagctgttacagttaaaatggacttagaatatggaatcccagccaaagaagttgggactttaacagggaggtcaaagaagtaattttgctatatgtgtttaatgttacatcataagagtaacaaaagtaaggtaatatgtttaaaaaaattcatgtggaggtaacaagatatagagggatactttatgttttatttgtagaccttagacactcttacttttagaggcctgccacacactatatcaaaggtgcaataaagtgaatttacattacatgccatataaaatatactgacacatatataatttttgaattgatttgatttacatttgactgcttgccataatttagtatttgtaaacctttgcttttttttttttatttaactgttttctttttctatttgagagcgaatattttataggtcactgaagaccctgaaggcctgaagcactttctccatgaagcgcgatggatgaaataggttggcaaacagagaggcttagaggaccaagcactacacaaatgtaaacactttcataaatttattaataaaagtgatgtgaacaagtaatataccatttaaaaggaaaatgtgctcaaaacattgtatctacaaaaacaacaaacacatcactcattcaggcaagatgtgtatctttaaactgattttatagtaaaaaaccactcgattaaaacaaaaattcagatacacattcttcaaaaagagggcaggtaaagtaggacccaatgtaattgatttaattggttaattgccttgatcaattttatcttcaattcattaagttaggcataataatttattcatttatttatcaaaaatgtatttaactataatgttccaaaatataaagaaatgatcactgttttgtatcatacttaaatttgagataattttacacaatatttatgtgggaaaagagagattaaacccaaagggatttcagcctaaatacaataaatgagtttttgacactgttttgtgttttaataagaagagtcattaagttagagtaataaagtataaagttttttaaacttttattttaagtttaggggtacatgtgcaggtatgttacataggtaaatttgtgtcatggaggcttgttgtatggattatttcatcatccagatatcaagcatagtacttattagttatttttctgatcctctccctcctcccagcctccaccctccaatgggccacagtgtctgttgttcccctctatgtgtccatgtattctcatcatgtagctcccacttataatgagaacatacagtatttggttttctgttcctgtatcagtttgctaaggataatgacctctagctccatccatgtccctgcaaaaaacatgatctttttctttttatggctgcatagtattccatggcatatatgtaccacatttttttgtgcagtttaccattaatgggcatttagattgatgcaatgtctttactattgtgagtagtgctgcgatgaacatatgagtgcatgtttctttataatagaatgatttatattcctttgggtatatacccagtaatgggattgctgggttgaatggtatttttgtctttaggtctttggggaatcaccgcactatcttccacaaaggttgaactaatttacactcccaccaacagcatgtaagcattcctttttctccacaagctcgccaatatcagttactttttttactttctagtaagagccattctgactgttgtgagatggttttggcttttattggcatgtctctaatcatcagtgatgctgagctttttttcatatgaaagccaaggcgtcctaagcaaaagaacaaagctggaggcatcatgctacccaacttcaaaccatactgcagggctacagtaaccaaaacagcataatactggtacaaaaacagacacataaatcaatggaacagaacagagaacccagaaataagaccacatagcaacaaacatctgatctttgacaaacctgacaaaaacaagcaatggggaaaggctttactattcaataaatggtgctggaataactggctagccacatgcagaagactgaaactggacctcttccttaccccatatacaaaaattaactcaagatatatacaaaaattaactcaagatatattaaagactaaaatgtaaaacacaaaactataaaaaccacagaagacaacctgggcaataccattcatgacacaggcacagacaaagattacatgatgaagatgccaaaagcaactgcaacaaaaacaaaaattgacaaatgggatataattaaactaaagagcttctacacagcaaaagaaactcatcacagtgaacacacaacctacagaatgggagaaaatttttgcaaactatgcaactgacaaaggtctaatatccagcatctataaggaacttaaatttacaagaaaaatcacaatgccattaaaaagtgggcaaaaaacatgaacagacactttgcaaaagaagaagatatacatgcggccaacaataattagtataaaaattaatcaaggcattataaaaacatttcaatcttcacaggatgccaagctttttcttttccaagctatgatcatagccaatgatgctaaattaaaagaaagttacattttcatcaattatttattattatttcatttgacttttcagtatacttctgttagtctgaagttttcttttgtgtaatgaacttataagaaatattatacttaaaacaaaaaaggtttaaggtttttattactcataaaaaattttcaagaggagattgtgattactttatactgaacacttagcaaatttcatagctatatctccaagggtaaatgcttatccttttttgtttgtttgtttctctttcaatctattcacaaggtttaataatcaaaatttgtccttgcagtgaataatcctactctcctattaatttttttgtatatacaacacctaagcatgcacattttaatgttttctggcatttaccactttttctgtaagattgcgttgatgtcaccccatcctacaataaccaacactgatatgttcattttagaaacataaagtttaatacagtatgttcacatttaaaatgtagttaataaaagtcagtcaacaagttctttttaagtaactataaaaaattacaaaaaagccttaaaatgttgtcactatctaaaagaagtttataatccaaagagttcagccatttattttcttagttgtgactaagtgactccgtaagccacctgttaaatggatcccctttagttggtcttgaatagcagaaaatgtatgtactaattatgtgcatttaaagttttaatacccctttattatactattgtcctgtatttgcttttacggttatatttaaattgagtaaagttccagaaacattcattattcttaaaagcaaatgaaactctgcattgcagtctgactgctcattcataattcagtatcccagcctaaaacattatgctcaaacaagcacaaatattggcaaaggtgaaatattgaatggctactgttgcagctaaattatgtagcaatctctgtgtgtgctttaatttcctagccctagaaataaaaattaaaagcaggaaaaatagtcagcaattatgggtgtaagctaaataagcaagggagtagtgccaagttgcaattattcaaagctgcatgctctttattagttatgcacaggtctgaaatgacaatgaaacccaaaaatggggaaaaaaaacctcaaacacattagttactcattatacatatctagacaaagaaaaaggattctaggagaatgttcttatgaatttgaactttgaaaattagcaactctggttctgtttacgttaatggaaatttacttttcctcaaatttgtcttaattatctgggcaataataccagccctccatttattaggatcttgggcacttgtttggaggttccagcaggtaagcagggttactaaatacccttgacagaggacagatctcctctttctgtggagattggcccctctttggacttaaagcattagtaaatatgcacagtgacaactgagagcaagagacctgcacgtcaccaactgaatcagcagaattaatccagctgatcaatttgtgaagtcacactcgccagatcactttcacttcctgccatttcacccagtttcctttgatgcaggctagatgtgttgcattttgtagcagtacagactttacattttgtagccaacataacctatagacatgaagtaattgataccaaaggctagtgataagtatctagtgctcaggagttttgtcttctgaattttcaggcttactcttctaactttgtcaggtacccttatgccaccttataactctctcttttatagaaataaaagctaattaatgcaataagtatagttactttattgtgtaataaaattactagttttatacagcacagagtgtacaaaactattaacattcctccaaaaatccggatagttagaaaaatttgcaggaaaaaattgaacaaattatcaggctgtgccttctcatccagttttcttccatgactatttgaatggctcaccatatcacagcatttataatttttaaatctcctttagtaaattatctcattgagcttcacaacagttctgagaggggctaagcagatgggagcaatccacattttgcaaatggggcacctagacacgtagatgttaaatagggcatccactgtcacaggcctatttgtgtgatagggtgagaggctctagctctttcctccatgccacagatttctcaagcaaaactaaatctactaaaaaacataataaaacacaacattaaatcatccatactcttcactttcctctcacccctaacccaattatcttaataaaaaggacttccactcaaactaatatcagaatgaagagtagagtgtttgtaggaacacagtctgattctgattgagtttattcaaatttgctgtttgcaactttcacttatggtcaagatgtatgtcatccagagaatgttcacatctaatatattcaaaggaaaatctgctttactaccttattatcttccccacacttttgtaagggactcaccgacttcctttccatcatttcatagatgatgtcattgaggcacaaaatggttcaacaatttaccctcagacaaacagccaagacaaacatagacagtggaatggaactcaaattcagcattgcatctacccaggtgaagatgtacaacttaaatctgagatccttggtgctggtcagacccaagcagagaaattttcagcccatggaaaaggtctagacccatctatatattcagcaaggatattttatctaacaaggctctttctggcatgacatgtgggattggtcaacaagaaataggaaacatgtaccactcacactgaagcatcacaaaccagtccaggcagataaacacgagtggggggtcacttgaacacagaagctctcaatcaagttggtgatctctggacagacgtggagaaactcctagttccaccaatatcctgattttctatagctgtgagcatgttctgggtcatgaataccccgatttaagagcttggtatgtatttgaaggtcaagaatgcttaactggaaattactgctatgcacagcaaatgcattataagcaaagaaagtgggtctgtgacaaattaatatcattgatactgtgcaaacccacaatgatcatttgttggagatactagaaaacctaaaagtcaagctataacattatgtttaagctttcttagcaaagactagcacaaaactcttctaaattggggtatttttataccttgaaaccatgcatttgaaggctgggcttatgacattgaatatatcgttaggattctaacaatgaagcagtgaatatatcattgggattatgacaaagaagcaatatctttagataactacaggtgataattatatttgtttcaaggaatattgaaacataaatgtaaagaaaattgacaattagaatctgttcacctatgagtttctatagtatttccctgttagttttcttctagaaagcagagaagagcagccgggcacggtggctcatgcctgtaatcccaggactttgggaggccaaggcaggcagatcacctgaggtcaggagtttgaggccagccgggtcaacatggtgaaaccatatctctactaaaaaaaaaaaaaaaaaattagccgggcatggtggcacatgcctgtaatcccagctacttgtgaggctgagggaggagaatcgcttgaacagggagatggaggttggagtgagccgagatagtgctactgccctccagcctggaagacagagcaagattccatcttaaaaaaaatcaaaagcagagaagagaaccactgttgtttgttgttggagaagagcatcactgagggatgcaggactagtctgtaccctgccacgaacaattcatcttatcacatcgtttcatctctttgggcctcttttgcctcatttttcttaaaaaaattctaaatatctaagggtcttctagttgggaaatgccactggttcacctatttgacaatagcatatagctatatgtccacaacttgtccataatctatcaaaacaactgaggatgtattgtcactggtattattgaacaacagcagcagtacatttgacaataactcttaattcccaactggacaatgaataaccatgtaagacatgctaatgcagacacaaaattacaaaaaaaaaaaaaaaagctgtatttttatcttttccttctatgtaatgaatacagcatctgaagacagcatggccctgtttgaaaacactggaataaagacatccatcccattctgggctataattccatgaaattgagtaaaaccccaaacaaatttaactgattgtgggttaagatggtatttgaatttttttaaaacctgaaatttcttccccctaccttgcagcctctgcatcacattggcgatatcccgaggacaccgggaggcccctctggaggttgccatggtccctccggaagcacgaagccaacaccaagagactcttcactggaggcagcacagggctacaccactctagaaaacatgcttggacttttctagatctattctgtcataaatgaattccaggcctttgcagcactcaacaaggaggcagctctcccaaagactgaactgcttctttttcttcttccgttttaagactgtcctcttacatgaactcaagaacctgaaaaacaaaaaagaaaaggtacaacataaaaaaaaaatctacgaaggtcaccacagtgctaaaaggagaaatatttctatttaatttgaatgcctggtccattatcaagtgaaacaacttagtgaaaagcacttataaactacaaagtactatgcaaatgttaggaattcccatgatatttaataaaataaatacataaatgagacatataaaataaaattgggttgctaaaagaagaaatgttcactttcattccatgttttctttttaaactatcaactttttccattgatctatgaaagtggtttcccttatactaaaaacactcaattctagttttcaatatgcacgggttctctagtctgctaatttagcctgctttgcacatgttttgctctgttgcgttgtactctttccaggaatgggaccaaatccttgtttctcataccaatttgatgaattaaagcagtataaatgtaaaaaccatttaattctaaaaatttgagtttcaagtactccaattttagaagccaaatgggtatgatttagtttttttcctccctatgtataaagactcaagagttttaaggctagggtggggtgggtgaagcagagtggacattttccttctaaattctctgcattggttaagtttttgtttttgtttttgttttgggacagtctcactctgtcatccaggctggggtacagtggcgtgatctcagcaagctccacttcccgggttcaagcaattctcatgcctcagcctcctaagtagctgggattacaggcgtataccaccacgcctggctaatttttgtgttttttagtagagacggggtttcaccatgttagccagactcgtctcaaactcctgacctcaagtgatctgcccacctcggcctcccaaactgttgggattacaggtgtgagccaccgtgcctggctggttaagtttcattgccgggggggggggggggagggggaggggaggagggggtgcagtgggctttgggaagaggtaggagagtagtcgttgaaatcttgatattgcaaaatgtactttaaataagaatttcctaaccctaggtttagctgaagagaaggtattgccataaacgaaataattagacagaaagaagagggggtgaataatgcaccaagagaaagaaacggcctccgaagaggcccacagggaggtgatacttgattacagttcccattgcatttctaggttatgatgatgaaggttaaaaaaggaatgggggaagagaggaagaaggggagaatggcaaaagcaaaactcctaaagaaagctcatacatgtgagatggtgcaccttcctgaaggaaaaaagaaaatgagaggagcctgtgagtgctgtaaaaattatattataacttggattatagtccataaaaggactttgctcatgaaggattggttaaataatagagtgcaattatgaattacaatttattttaaaatggcattactaatactattatatattggtatctggtcagaatgtatgaatgcaaagctagtaacatgctttttagcctattatctaaaaaaaaaaaaaagatgcaaacctttgcacattgctgctgccccatgtgcaatgcatcagaaggatgtactggagcaagaaagcattactaacttagcaagacatgggacagcgatgcagtgaatggaagtcattggtaggaagatagaggcaaacttctcttggctacttgaaaggagtatatactagaagtaggacccaatacttggtgtcttataggctagagaggtacttctcagtgggtgactctccaagggattcttcatggagaaataattacttgtggttgggctgtcacatacatacctatagccctgctggaattgtgtgcccattagcagcctgtatatcctggggaaaaatattccacctgcccacatacaaaagctatcttaatttgggagaataatagatagtgaaaagtgcctgaaggaccttataaatggatcccctaagctattaggaagttaggttttcaaatgcaaaaatataactttctgaaatcaatcaatcaaccaatctacctattatctatatcatttatctgcatgtatgttaaagacattcacttcatttcagataccccactccaagctgggctcagcactggagctcacagatgattaacacacagtccccaccttcaatcaagaattatggaattaaaagggatttcagttaaatcattgcaacagaaatcactctgcctctatcctcttctaattcacattcacatagcttggtagattaatctgaaatactgtgcatgccctctctctctctcgttacattaaactcagaatttccctgcatgtgcccagtattcatccagtcttactttcacagcataactaacacattcagagtgccagagctcaatgctgggattactaaggtggatatgacacagagactatttttgaagagcttaggacacagtgggagataaaacatagaaaagataatacaaaaataccagggctaagtgcaaatacaaagatgtgaagatacagaggatggtggctaagccagtgtgggtgttctggaaaggtgtccttcttggcaaggagcagacacttgagctgagtcttggtaaatgggttagtcactcaggtgaaacatacgaaagacacatcctgggcagggtgaagagcttgagcaaaggcctcagcatgagaaacagcatgactgggacatggaactatcaccagtcagacactgagaaactctacaaggtgacattgtggaaaagagggcggagagtgaggtggtgtccagatggcgcagggccctgagtgctatgctcagaagtttggttctggttctctagcaggcaacaggaagccactgagagatcttaagctggaagtgagaaggtatgattgggattattctagctatgattttaaaggatgtatttgagaaggacaaaactggaagatccagaaagatcagttaggaaagtatctcaggaatccaggtagaagatgaccaaagacggaaatcagacagaggtagcagagtgagtggagaatcaaatataacacagctttagggaacaaaatttgtaagacttggtgattggtcacccaggggtggaggtgggtataggtagaaggaggtggggtttccagagtgtatatctgaggagtctcagatgactctcaggatttggggtgccattaattgagctcagcagaagaggggccttataggttttacatccaaacactctccccttcatgcttcatatctttggaacaactcaggagcaatttcttcattaccccttcacatcacccctctgaagaacactttcagctgaacaaatggaaatacctagcccaggatccacataccacttgaagcttttcctaaacacaccaaccaacactcaccattattttccactgaggcctctaacatcaacgatccatactatcctaggtacaatttggcttctatctttcactactgctagtcttacctcactctaaagaaacagtgaacatttcactggtatagaggctataacattgcaaaatctcattcattgacaccaagtatatccctgaccacatcctaggcccccgatatatattttttgtttcattgaatcaagttcataatactttacatttatgagaaaatccccagaaaacctcttcctcttcaatgcaaaaaaaagtggatgcaatatccttcctttttcagacattaaacattttgctttcatcattcacatgtacacatatttcctattttgtgaaatcatgattttcttgctttttactgatactttatctaattacatgatttaataagaaatttaaatgatgttaataaaaagaaggtaataaaaggagactgggaattaggaaatatcagttctaggctaaactttatcccagctagttgggtgattttgagctggttctatgcatgaaggtcctcaacaactacctattggaggagagtgtggtaccaggaaatgcacagactttgatctaagaaagacctggagctgaatcttaattctatctcttactgtgcacgcaggcttaagaaaaatgagcttttctgagcccttctttcatcatctgtaaaatgaggtatacttatgccaaattaggtttaattttatcctgcttaaattaatttttttaaaagataaatatgtcatgtttccagcagattgattggcatgtagcagagtttcagcaaatactagtttccattttccttcccctgttcccagtttctccagctgcaatatgagagacggccctaaaatgcagaggtactcccaagtgtgctcttctgttccaaaaccaatagcagcacaaggcagagctaaaacaacgactggtgcaaggtcatgagatcctccaacagactgtttacctagcagtgttctggctatggacatgacagaaccagaacaccagaggcagatccagaacatcaataaactcactattcccaagattattaaaacagtttttaataggtgcaggatactgcgggagcacgaaggagagggaatgaagagtgaagctaggcattgggatggaattggagaatttgatggacattcatgggctgtataccaataaatagtccctgcaccatctccaaatttttccaggggaaggaactaagattatgatgcagctaaatacattcagaaaggtaagattcctgtatttattatttcacaataaatatgtattgagtagctatttgtaagggaccatggtactgagtaaacagcagtcaacaagagagacaagcccctcttacagcttatgtgccggtagaggaagatgatataaacaatgttacaacaaaggagggcaagtattgtaatggaaaagtccaggctactatggaagcaaacaaaacacccacccaatcaataaccatctgctgcattttttttttgttcaggacacagagagaatttggactatctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaacatcactccctgtgaaaaaacacagttgtgaaatagcacaactcaattttttctgtctcttggcagaatggacattggctcttaaagcagtttcttgtttgtgtgactaaaaaggaatacactaagaaaagcactgaagaaatactactgagccacaagaatatatataagcaatgcaactgaatttctaggtattaggaaactactgcagaaaatttcaaaccctgcaatgaccagagacaacgtggctcatttctaaccaaaaagaaaatgaactgagaacataaacacataaacagattcacaacagcaggaagtacagatattaattaaatgtctaaacatgtataagaatagcactaatattgaaacccactattgaataaaatttttagtcatgaataaatttcagtttcccttctattcaagtcttttgctgaagagagttcacatactgtttaattttaaatttaattatttttttctctattcacccattaataatggtactaattaatgaatactaagatggctaaaagagaagaacagggatatctttgaattaatgtaagtatattactaataaatgtgtgcaggttatcagggaacaatgctgtttcttattcactagtatgaattatacagagtaacaataagaaatgatcttttccatagaagaacatgaacaagtaagcaaaagacaaagtgtatagcagaaatcagcatgaaagatgttcagtgtcataattaaattttgtttattgtaagcctaaagtataaattacaaccaaagacatctgcaaccttctttttttcccttgctacagtatattgcacaccttgccaaacattagttctcgttagattagaccacaaagaagtacacatttaagaggagacacacagaggacctcgcagaggcgtttgggccctgcatgcctgtcacattcagaccacagggtgtggctgcagtagctagagctggagttgtgaaaatgccaccaaccttgcccagttatgggcttcctacatcctgtgacagtcacacctcctttcatttccaagatgctgtgtgtgcagcatagttatcagaaagtaggcccagtgcagcaccaaacaattcttgaacatttttaaatggcaaactagctttttccaatctcctctccctggcaggaaggactcaagtaaaaaagagttcttaaatgaggtcaatgaggacagaagaaaaccagtttgtgaaaatcattagttcagaaagatgaaagtgagactataaaataagagctaggcaaatatttccaaagcctagcaaatattgttatctgggtcagtctgaagctgtttcttaatcttcagcatgaaacatattaagttagtatagatctctcacattttgttctaaatctgccacaaagtaatgaacagaaaagaaaaaatagatatgtattttgtcacactgttccggtgatatcaggaactttttagccatactacaaatcttttttcaccatggggaataaaaagcctctcaaagaacaatcgtcatgactcgtgattaaattcgcattttatgaagatgtaggtcatattaatgacctttgcctcattgaaaattattatactttctcttgcataggtctggcttctgtatacgaatgttgtctttaggaaagtcattctcagatgaagacaaaaaatggatgggcattaaagaagagaaaaataattcatttttaactttcttaacattcacaggaacatttcagatacaagttttccaccccaaaacgaaaagctcagaaatgaacattgtgggatgctaaggcttcattgctgatatttccctctgggctggacctgactctatttacggaagggggcagaacttccagcatccaaagtctgggatcccagtcagcacacccagcctgccttcccaaggggcttcttcctgtgcggctgatggctgcttcgttttgcacggatgcctgcccgttgggatgcacctggccgcctgtgcaccaccatttcccagaactcctccgccagcaatgcaagatctctctatgtgaaacgtatctttataaagaggagacgaaagttctcttgccctctagtgcaggctctgccgggaagcaactgcaccatgacagcgccgctggagtctgacgcgccagggcctccgcgcagccttcaagccatttccctcccccagcccttcctaaaatagtcagggggtggaggaagggaggctcctagaatctgttcaacgccctacctctcccatctgatagtagcaacagtaccgaccatcacaataagaggctggctgccttttgcttctgcaccattggagcccaggagatgtgccacaagcggaaatgacaactcagagagggggatattaatagggacatctacgtacgagatgcaaagaggctccccaacctcctagtctccttatctatgagtatcgcacacgtacacacatcactgccaccaccccctcccatcaagcacgcagagccccagcgtgcaggcacaaacttgctgacaatttgtctgcaatgtgttcgtcttgcacctctctctcctctccctgtctctgtctctccctgtctcccagtctctgtctttccttttaccttctctctcggcctcgttcagtttcccagcagcaaggcgaagcgagcgaacgcttcctcccggctctctgcgcccaggctcggcgggaccccggggatgcgcggctgtccgcccgccctgtcgccgggatcgggcgcggtctgcaggactgcgggagcccagccgccctggtgacagaggacaacaatctcagcccgctgcggccggcggccg
